United States Patent 11,882,838 (BACTERIAL INOCULANTS) - sequence listing, part 4

SEQ ID NO: 473 - DNA, 2376 bp, Unknown
  Kingdom: Bacteria, Phylum: Actinobacteria, Class: Actinobacteria, Order: Streptomycetales, Family: Streptomycetaceae, Genus: Streptomyces
gtcgtacggcggccagccgcagccgggtgcgtccttcggcggccagccgcagccgggccaggcgactgcggccgcggcctccggcggtcagccgacgcccgccttctcgccgttctggttcgccgttccggcgccgcgtccgctgttcggggaggacggttcgcctgcgccgatcgccgaactggcgcccggcacctggtacttggcggtggaccagcgcggccagggcctgctgacggagatgcaggacggccgccgcggtgtcctgcaggacgcgtcgaacatccagcgcggctgacagcggacggcccctgcggccctacggctccgacggcccctcgtcctcacgggcggggggccgtcgccgtactcgggaaaccgaggtccggaggccggggccgagggccgtcaggagctggacttggcgccgctcttcagctcggcgggcgtgggcaccttgtccttgaccggggcgcccgcgctcttgcccgcgtccttcaccttgttgacggtgtcgttgaagctgttcgccgccgaaccgtcgcccttgcggagcttggtcggcaggtccttgaggccggcgatggccgagctgaccggggcgagcgccttcgacagcgtcgggtcacccttggcgttgcgctcggcggccttgagccggttgtacgcgaacgcgccggcgagggcggccttggcgagggacgccttgcggtgcttcgcgcccttcttgaacttgccttccttgtatggtttcacgatccacttgtaggtcgcgccggcggcgagccccgcgttcgccacgaagcgggtcttggcgaacttctgccgttcggcggaggtgctcgggctgggtgtggccgcggcgaccgcgaccgtggggctggtctgccgcccgtcaccctggctcgtggcccacgcggtggtggagccggcgagcagggcgcagcacagggtgagcgccacagcgaggcgccgtatcggtacgggcacggtgtcctcccgaaaggtgttgctccgggtactccagaggtccgtgtgaaccaggccgtagcgaccgaaacaggacaccttccgtgcggagtgcctgactttccgtaggcgtccgggtttcaatcagcgtcgcggggccagacgcacaggcatgtcccctcgatatcgcacgggttccggctccgccgggacggccatcgcggtggtcgccgacatcatggccgtcatcctcggactgtggatcctgatgtacctgctggacgcgaaccgggccaacgacctggtgcggttcatccatcacgcggccgactggctcgccggctggtcgcgtgacctgttcaccttcgacgaggcctgggcgcgggtggtggcgggctacggcctggccgcggtcgtgtacctcttcgtcggccacgccatcgccaaccgcctgcaccggggctgaccgccgcgccggggccgaccgggcccctgcctcagtcgcagcagtccggttccaggcctctgggcaggccgtcctgggcgaagaccgtgcaggtcgcctcgtggccgccgagcgcggcgaccgcgaggagcagcgaaccggcggtccacgtggtcagttcgcgcggccatatggcgtcgtcctcgaagacgtagcccgtccagtacaggccgctctccgcgtcgcgcaggtgctggacggacttgaggacgtcgagcgcgcggtcggactcgcccgccgcccacagggtgagggcgagttcggccgactcgccgccggtcacccaggggttgggcaccacgcagcgcacgccgaggccgggcaccacgaagcggtcccagccggcctcgatgcgcgccttggcctccgcgccggtcaccgcgccgccgagcaccgggtagtaccagtccatcgagtagcggtccttgtccaggaaccgctccgggtgcctgcggatcgcgtgcctgagcgcgccggccgccaactcccagtcgggctgcggctcttcgcgctgctcggcgatggccagggcgcagcacagcgcgtggtggacggaggaggagccggtcagcagggcgtccgcggtcgccgtcccgtcgtcctcgtgcttccagccgatctgtccgccgggctgctgcaggcgcagcacgaactcgacggcggcgtagacgaccggccacatgcggtccaggaaggtgtcgtcgccggtggagaggtagtggtgccagacgccgacggcgacgtaggcgacgaagttggtctcccggccgcggtcggtgacgtcgtcgtgggcgccgtcggcgtaggcggcgtaccaggagccgtcgcccaactggtgccgggccagccactcgtaggcgcgtgcggcggcctcgtgttcgcccgccgcgtccagcgccatc

SEQ ID NO: 474 - DNA, 4106 bp, Unknown
  Kingdom: Bacteria, Phylum: Actinobacteria, Class: Actinobacteria, Order: Streptomycetales, Family: Streptomycetaceae, Genus: Streptomyces
accctggaggacatcgtcgaggaactcgtcggcgaggtccgcgacgagcacgacgccaaggacgtgcccgaactcgcccccgccccgcccgaggacggcaggcccgcctgggacgccgacggcggctgccgggtcgacctgctcaggcgcatcggcctcgacgcgcccgaaggcccgtacgagaccgtcgccgggctcgtcgccgacctgctgggccgtatcccggcccccggcgacaaggccgaactgccgggctggcggctgtccgtgcgccaggtcggccactaccgcgccgaacgggtccgcctggtgcgcacggccaccgcgacccaacccgccgaggccctgacggaggccgcccgatgagcgtgctccaactggtcctcgccgcgctgctcgtgctcgtcaacggcttcttcgtcggtgccgagttcgcgctcgtctccgtccgccgcagccagatcgaaccgctcggcaccgcccgcgcccgccaggtcctgcacggcctccagcggctgccgcagatgatggccgccgcccagttcggcatcaccgtctgctcgctgaccctgggcgccgtcgccgaaccgacggtggcgcggctgctggaaccggtcttcgcctggatgcacctgcccgacggcatggtgcacccgccgggctacgtcatcgcgctggcggccgtggtcttcttccacctcgtcatcggcgagatggtgccgaagaacctcgcgatggccgccccggagaaggccgcgctgtggctcggcccgggcctggtcgccttcgcccgcgtctgcaaacccgtcaccgtcgcgctcggcgcctgcgcccagggcatcctgcggctcttccgcgtcgaacccaaggacgaggtggaggccgtcttcaccagcgagcagctcaaccggctcgtcgaggactccgggcaggccggactcctcggccccgaggagcaggagcgcctggaggacgcgctggaactgggctcgcggcccgtcctcgacgtgctgctgtgccgcgacgcgctggtcaccgtccgcccgtcggtgacgcccggcgagatcgtcgcgctcaccgcccgcaccggctactcccgcttcccggtcgccgcggagaacggcgcgttcatgggctatctgcacgtcaaggacgtcctcgacctggaggactccgaccgtgccgtgccgcagcggatatggcgccgtatggccacactccgctccgagctgccgctcgacgacgccctgaccgtcatgcgccgcgccgccacccatctggcccaggtcgcggacgcctccggcaagatcctcggcgtcgtggccctggaggacgtactggaactcctcgtcggcgaggtccgcgaccccgcgcatcgggtgaccccggagatccggctcacggaaccccgcgtcagcggagaaccggaacaggccctggccacctgagcccgtccctcccaccgcagcccacggccgcccggccgtgggctcgcgtgtgcgccgggccggagggcggcgggcccggggcccgtcacagagccgacgggtcctgggggccccggcccgacagcacctccccgtacgcctgcatcaggtcgggcaggcgcagggtcgccaggtcgtcgcgggtcagcgtgccggggtacgtggacaggcggagatcccggtacgcgcagctcttctcgtacagcgtgcgcaggaaccggccgttgccgagttcgtcgatccactcctggtcgacgacgtgcccggcgatcgagcgcagctcgtccagggcctcctcgtcccactggtcgccgttctccgcggcgaggaccttgccgatctcggtgagttcctgggggcggtacgacgggaagtccacgcgggtggtgaaacgggacgacagcccgggattggcggccaggaggcggtccatgccctcgggatagccggccaggatcaccaccaggtggtcccggttgtcctcggcccgcttcagcagcacctggagggcttcgtcgccgtaggcgtcgcccttgccgtatcccgagttggacagggagtacgcctcgtccacgaagaggaccccgccgatcgcggagtcgatcagttcgttcgccttgaccgcggtctgccccaggtactcgccgaccaggtccgcgcgctgcgcctccaccaggtggtcgccgccgagcagcccgagcgcgtagaagacccggccgaggatccgggcgaccgtggtcttgccggtgcccgagggcccggagaagacgaagtggcgtttcggcggctgcacgggcagcccctgaccggtgcgcaaccgtgccatgttcaactgtgccgacaacgccttgacctggcgcttcaccggttccagccccaccatgcgctccagttcggcgagcgcctgttcgagtaacgcggggtccgtcggcccgctgggcaggggtccggcggcgaccgaggcacgctgacgcaccgccggatcggcgggggaggggaagggaccggaggggggcggttccgggtcgtcgagtctgaggtcccggccctccgtgccgaagagcgggtccagggcgtccgggccgtccacgctgtcctggccggctccgccgagcgtgatcgccgcgaaatcggcggcctcgtcgtcgtagccgtcgccctcggcgatcgccgcgagccgcgccgaggtgtccatgaaggccgggtcgacccggtgcaccgcccggtacagcgggagggcggcggcgctgcggccggtgccctcgtgcgccctggccagccagtaccgcagttccttgcgctgcggctgctcgctgcggcaccgcatgagcgccgcggacagcagcggctcggcctgcccgtacatctccagccggacccgggccatgccgccgaacagcccggcctcgatgccgagcatcggatcgtcgacgagcgggtcggtgtgccgtacgagctgctcccagtccttgatcaggtaggcgcggcaggcgtgcaggaaccggacctggctgtcggtgtccaccggcggcagtccggccagggcccggtccagttcgggcacgtggcgtccgtccagccagtgcgaggcgtgcgcgagcagcagatcgcgcgggctctccagcacgggctgcacccaccagcccagccagtaccaggagttgagggtgcggcggtgccgggaccgctgctcgccgaagcggtcccggtgccggaacatcctgagcagcgcggtcgtcgtgtcgacgcgcagcgcgtgcagcccgagccagccgtccgccatcccgggatccatctccaccgcggcccggaactcctcctcggcctgcggataggcgcccatcgtgtaggcgtccacgccgcgcagccaggcgaggtcggccggggcgtcggggccctgcgtgccgaagtccatcacgtcccccacgaaccgtgcccccgtaggttcgccgccggaccgccgcccggtggctgccttggtcgaacggctgtgccgcggaccggagttgcaggtgcgcgaagcagtcgttcgaaggtcgcaccgagggcatcgtacctgcggggtcgccgcccgccgaagggtgcggcacagggtgttcggcggggccgaagcggaagtggtaccccctgttcgatgaccgagagtgaccgaatgaagccgcgcggcgtccggatagcggtacaagggcagaacgaagcccccggtcacgggggaacaaccgggggcttcgtgtttgcgggcggtccgcgatgaccgcacattgagaacgtaagacctgtacgggccccgggtcaagcgaagttgggacactcggccaagttcgtccacagcggccttcacaagttcagcacattgccgatggcccctcaccctccgtagtgacttggtccggtccaaccgttccagcgggccccggcagcacctcgtacccctccgtcgactgccgcaccaggaggtccgcgaagggccgggaggggtcctcggcgaagtgcaggcgctccgcctgggtccagcccgtccagaactcccgctgctccgccccgtcccgcgcccgcccgcgcgcccaggactcctcgcgcggcagctccatccacagcagccgggccaggtgggggcgc

SEQ ID NO: 475 - DNA, 1867 bp, Unknown
  Kingdom: Bacteria, Phylum: Actinobacteria, Class: Actinobacteria, Order: Streptomycetales, Family: Streptomycetaceae, Genus: Streptomyces
caccggtgagggcctgcaccgcttcgtcgacccggtcgacgaccaggcgtatctgtacacgcagttcgaggtgccggacgcccgccgggtcttcgcctccttcgagcagccggacctgaaggccaccttccagttcaccgtgaaggcgcccgagggctggaccgtggtgtccaactcgcccacgcccgagccccaggacaacgtctgggtgttcgagccgacgccgcgcatctcgacgtacatcaccgcgctgatcgccggcccgtaccactccgtgcacagcgtgtacgagaaggacgggcagtccgtgccgctcggcatctactgccggccctcgctcgccgagttcctcgacgcggacgcgatcttcgacgtcacccgtcagggcttcgactggttccaggagaagttcgactacgcctacccgttcgccaagtacgaccagctgttcgtgcccgagttcaacgcgggcgcgatggagaacgcgggcgcggtgaccatccgcgaccagtacgtcttccggtccaaggtgaccgacgcggcgtacgaggtgcgtgcggagacgatcctgcacgagctggcccacatgtggttcggcgacctggtcaccatggagtggtggaacgacctgtggctgaacgagtcgttcgccacctacacctccatcgcctgccaggcgcacgcccccggctcgcgctggccgcactcgtggacgacgttcgcgaactccatgaagacgtgggcctaccggcaggaccagctgccctccacccacccgatcatggccgagatcaacgacctggacgacgtcctcgtcaacttcgacggcatcacctacgccaagggcgccagcgtcctcaagcagctggtcgcctacgtcggcatggacgagttcttccggggcgtgcaggcgtacttcaagcggcacgcgtacggcaacacgcgcctgtccgacctgctcggcgccctggaggagacctccggccgcgacctgaagacctggtcgaggaagtggctggagacggccggcatcaacatcctgcggcccgagatcgagacggacgcggacggtgtcatcacctccttcgccgtccggcaggaggcaccggcgctcccggccggcgccaagggcgagccggtgctgcgcccgcaccgcatcgcgatcggcctgtacgacctcgacgaggcgagcggcaagctggtgcgcgccgaggacggccggatcgagctggacgtggacggcgagctgaccgccgtaccgcagctggacggccggcgccgtcccgcggtcatcctgctcaacgacgacgacctgtcctacgccaaggtccgcctcgacgagcagtcgctggcgttcgtcaccgagcacctcggcgacttcgcgtcctcgttgccgcgcgccctgtgctgggcgtcggcctgggacatgacccgcgacggcgaactggccacccgcgactacctgtccctggtgctgtccgggatcggcaaggagtccgacatcggcgtggtgcagtcgctgcaccgccaggtgaagctggccgtcgacctgtacgccgacccggccgcccgcgacgctctgctcacccggtggaccgacgccacgctggcgcatctgcgcgccgccgaggcgggcagcgaccaccagctcgcgtgggcgcgcgccttcgcggcgaccgcccgtacgccggagcagctcgacctgctgaacgccctgctggagggcacgcagacggtcgagggcctggccgtcgacacggagctgcgctgggcgttcgtgcagcgcctggcggcggtcttgtcccgctcgtactcgccggcgatctccgcctcgtcgaaccggcccaccgccgccaggcgctgcacg

SEQ ID NO: 476 - DNA, 11502 bp, Unknown
  Kingdom: Bacteria, Phylum: Actinobacteria, Class: Actinobacteria, Order: Streptomycetales, Family: Streptomycetaceae, Genus: Streptomyces
cgccgcgaccagttgtcggtgccgtccgcgcgggtgtgccgggtgccgtgcacgggctggagactcgccacgacgccgagctgcgcgaaccggcccagcaggtcgtcggggatggactcgacgtgctcgacgcggtgcggggcacgcgccaccggaccggcctcctcgatgacgtcgagggcgaaccgtacggcccggtcgccgatggcgtgcgtcgcggtcgggatgccccgctcggtgaagaagtgcacggcggcgcggtacgcctcgacgtcgcgccacagcggctcgcggttctcgccgtggctgtccgggcgttcgaaccaggcggtgccgttgtccgccgtcccgtccagcatgaacttcgcgccctcgacgtgccagcgccgtccccgcagcccctgcaggtcggcgacgcgctgccactcctgcggtgacgagtcggcgggcaccagcggggagcagcggatgcgcagcggcagctccccgtgttcctcgatgtgccggtacacgtcctcggacgggtcggagaagtccagcgcgtgcagaccggtgaggccgccgcgcgcgaggaggcggagctggtcgagcacgtatccggcggcggtccgaagcggtacgtccggatagtggtcgaacaccaggtccatcgcctggagttcgaccacgtacccggtcgggcggccgtccgcgccgacctcgaccgacgaggcgtcggtgaacgtctcgcggccggtcagcccggcgatccggacggcgcggggactgacgacgagcgcgtgcgcgtcgcgggtcatcagcgagatcggcgtctcggggaagcgttcctcgaacaccaggccggtcggatcaccgtcgaacacgttcacgtcgaggtcgtagccggtgatccactcgtcggccgcccggccccgcgcggcctcggcgaggcgggtgagcacctcgtcgagggtggccgcgccggagaggtccacgccgctgccgatcgagatcgacccccacaccgggtgggcgtggacgtccaccaggccgggcaggatcgtggcgcccgggaactcgtggacgacggtgccggggccgcgcagggccgcgagggcggtcgcgtcgcccacggcgacgacacgcccgccggtgatcgcgaccccggccgcgagcgcggacgcgcccgggttgcgatcagcggggcccgtgtcggccggtacggggcgaccggcggcgggcgacggccgaccggtggtggccggcccggagcgaccggcggcgggcgccgggtgaccggcggtggcctcggccgtcgcgccggccaaatccttgggaaggccctccggaaggtcgtcgggaaggtcctccgtcaggtccgccacgacctgccgggcgagaaggatgacatcgcagtgcacagggattcctcaagaaggtcgagctcaggcgccggtcaggcgcggggaatgctccggagggcgcgggccgtgccccagtagacggcggcagcggcgatcatgccggacgggatcgacaggtccacgttcgccagggccccggcgaggggaccggtccagaaggtggtgttcacccacagcgtggacacgacgccgccgacgacgatcgcgaggacgccggcccagtggacaccgcgccggtaccagaacgggccgccgcgctcctgttcgagcagatgggcgccgttgtagcggttgcgccgcatgacgaggtcggtgacggccaccgccatcgccggaccggtcaccacgaccacgagctggagcatggtgttgacgctggtcaggaagtcgaagacgaggatcgcgtacagcgtcatggcggtgccgaggacgccgatgatcagcaccgcggggatccgggcgaggcggacgccgaccgactggatggacaggctcgcgctgtaggcggtcatgccgttgttcgtcatggtgttgacgacgaccgcgatgacgaagacggggatgaaccagcccggcaggatgctctccagcgcgccctcggggtcgctcatgtcgaggctggtcgcggcgagcgcgccgacgctcgtgaacacgacgctcggcaggtacgcgccgaaggcggtccacccggcgatggcgaccgggctgctctcccggggcaggtagcgggcgaggtcggggctgttgctgtacgacagcggcgtggaggcgatgatcgtgaaaccggcgcccagcgtggccgcgagcgccgtgccccggagcggggcggccggggcgtacgaccagtccgcgtgcgcgagcacgtaccccgtgacgacgacgaagaccacggtcagcaggacgctgagcgcggtgtagaggcggacgatcgtcgcgtatccgaagatcgcgatgagcagggtgccgccggcgatgaggcagatgacggccgcgtcgacggacgagctgtgcggcaggccgaaccggcccgccaggccgatgcccgcgacggaggcggccgaccagttcagggccaggtaggcggcggcgatgagccatccggtcagcacgagcacgactttgttgcccagcacgccgtacatggcacgcgagatgaccgacccgctcgtaccggctgccggaccgctcgccgcgacgatcccggtacagatccacagcaggttcccggcgaggatcacgccgatggcctgcgggagcgtgagccccatgaggatcagggtggcgccgacgacgaagctcagatagctgacgttcggggccgcccagaccgcgaacaactggcgtggccgtccgccgcgctcgtccgcgggcacctggtcgatgccccgggtctccatgtgcccggcgcgctcggagccctgtccctccagggggccgggggcggagggggggttcgttgtcgtcatcggggcctctcgggtccgcggaccgcgtcacttattgggcgcgtggccaactaggtattggtcgcacatccaataacgtgtccctcatgacgtcaagacctcggacgacaaggacccggaagcagcccggcgagcggcgcgcggagatcgtgcggacggccgcgcggatcgcgctggaggaggcgctcgaacgcgtcaccctgcggcgcgtcgccgaagagctgggcgtccgccccggactcatcggccactacttcccggccgcggaccacctcgtgagcgaggccttctcgtgtgccgcgaccgaggaacgcgcatcgctcctgccggccggcgaagaggtgctgccgcccgtcgaacggctggcccgcttcctcgtgcgcctcaccgacggcgagtaccgcgacctcagccgcctgtggctcaacgcccgccacctcagccggttcggtgccgaactgcgcgcggccgtggccgcacaggagtccctgacgcgcgccgccctcaccggcctcatcgaggacggcgcccgcaccggggacttcagggtcgacgacccgctcggcgcggcgctgtacatcctcgtcacggtggacggcctcggtgcgtacgccaacgacgacacgcaggtggagcatccggcgctcgacgacatggtgatcaccacggccgaacgcctgctgggcctcgcgcacggcacgctgcgggcgcgcgccaggcctctggggaccaggccggaatgaaggggcgttgcatggtcatgcgtaaccgtgcataatcttcctatgtccaaggttctcacctcccttccggccggcgaacgtgtcggcatcgccttctcgggcggtctcgacacctccgtcgcggtcgcgtggatgcgcgacaagggcgccatcccgtgcacgtacaccgccgacatcggccagtacgacgagcccgacatcgcctcggtgcccggccgcgcgaagacctacggcgccgagatcgcgcgcctggtcgactgccgtgccgcgctggtcgaggagggcctggccgcgctcacctgcggggcgttccacatccgctccggcgggcgctcctacttcaacaccacgccgctgggccgcgccgtcaccggcacgctcctggtccgcgcgatgctggaggacgacgtccagatctggggcgacggctccaccttcaagggcaacgacatcgagcggttctaccgctacggactgctcgccaacccgcagctgcggatctacaagccctggctggacgcggacttcgtgaccgagctgggcggccgcaaggagatgtcggagtggctcctcgcccacgacctcccctaccgcgacagcacggagaaggcgtactccaccgacgccaacatctggggcgccacccacgaggccaagacgctggagcacctggacaccggcgtggagaccgtcgagccgatcatgggcgtacggttctgggaccccgaggtcgagatcgccgccgaggacgtcacgatcggtttcgaccagggccgcccggtgacgatcaacggcaaggagttcgccaccgcggtggacctcgtgatggaggccaacgccatcggcggccggcacggcatgggcatgtcggaccagatcgagaaccggatcatcgaggccaagagccgcggcatctacgaggcccccggcatggccctgctgcacgccgcctacgagcgtctggtcaacgccatccacaacgaggacaccctcgcccagtaccacatcgagggccggcgccttggccggctgatgtacgagggccgctggctcgacccgcaggccctgatggtccgcgagtcgctgcagcgctgggtcggcgcggccgtcaccggcgaggtgaccctgcggctgcggcgcggcgaggactactcgatcctcgacacgaccggccccgcgttcagctaccacccggacaagctctccatggagcgcaccgaggactcggccttcggcccggtcgaccggatcggccagctcaccatgcgcaacctggacatcgccgactcccgcgccaagctggagcagtacgccgcgatgggcctcatcggcgcgggcacgcccgccgtcggtgccgcgcaggccgccgcgaccgggctgatcggcagcatgccggaaggcggcgccgaggccatcgcctcccgcggcgaaggctccgacgacgcgatgctggaccgggccgcgatggaatccggcacggactgaccccggccggccctcctctcggctctcgggcacacggcccggcaccgcctccgcgcggcgccgggcctccgtcgccggccgccccggaaggcggagcggctgtacgcgcgtcgccgcccggtccgggacggtgcggcgtcttcccgccgttcccgccggtcacgactcgtccgtatcccgccgcgacatcctgccccctcatttgcccgaaagttccttgcccccggcgcccgcgccctcgtcccatgggaggaggactatcggaggagtggactgaccgtcatgcgtgcgcgcccgcaggagaactcggagcgagagccgggcgccaggcccgcgaaggcccgtccggccgtcccggccaccccgacggccgcctccctcctcgacctccaacgcacggcgggcaacgaggcggtggcccggatgctcgacctcggacgccacagccacggcccgggctgcgggcacgacaccgcgcagcaggaggcggcgccggtgcagcgctcggccgtgcacgacgtgctgcgcacgcccggtacgcccctggagccggtgctgcgggccgagatggaaacccggctcggcgcggacttctcggacgtgcgcatgcacaccggccaggccgcccggcgctcggccgccgagatcggtgcccgcgcgtacacgtccggcagccatgtggtcgtcggtgagggcggcgccgaccggcacaccctcgcccacgagctgacgcatgtcgtccagcagcggcgcggaccggtcgccggcaccgaccacggcgacggcctgcgcgtcagcgaccccagtgaccgcttcgaacgcgaggcggaggccaacgcccaccgcgccctggccgccgcgctccccacggccccgcggacggaggcgcccgaggtcggcgccccgggccgggagcagcaggctccggccgccccggccgtccagcgggctcccgtgttccaccagaccaaggagaccgccgagtccgaccgggacgtcgccctgcggatgctggaccgtatcgcccgtaccgccgagcgcgtcatcatcgccacggagccgagggccaaggccaagttcacccctcatctggccgtcaacctgctgcccggcggcaccctgggcatcgcgggcaacacaggcaagcggctggtcaccgaagagcagcgccagaagatcgacgccgaggtccggaagttcgccgacggcagcgcacccagggccggtcaccacggttggggctcgacctcgcgggagcggcggcgggagcggcaggaccgcagcaaactccgtgccctggagcctggatcgtacgaagcggcccatgccgagtcgcccgaactgtccgccatccgggaggcgttgcagaagcctctcacctggttcgtcgtcgggcagaaggacaagaagaagcccgcccagcacggcgagatgaccctcctgggcgagcaggtggccgactggaaaaagaaccccggggacccgaacgcgccccggacggtgcacatgggcggcgtcaaactggcctgcctcgcctgccagtgggcgttcgaggcggtcaacaagcacatcggcgagccactcggctacagggtggtcgccgccggggcccacgggcagttcttccccaactgggccatgcccgagtggatgaagaaggaggccgctgtggtcgacgagatcggcgccagggcgcgcgagatcggtgccgaactggtcgacggtgcggtcaggggggacatggccgaggggaacttccaccacgatcccgcggattccgactcggagtacgaatcggactccgcctgagcccgcgcgcaagtcagttgactatcagtcggaaggcgaccgccatgtccgaccggacacccgcccgccggcccacggcgctggtggtcggtgcgagtgcctcaggcctgttcgccgcggcggcgctgaccgagttcgccgacgtcacgatcgtcgagcgggacagcctccccgccggcgtcgcgccgcgccgcggtgtgccgcaggcccggcacgcgcacctggtgtggagcggcggggtgctcgccttcgacgaactgctgcccggtgtcgtcgacgaggtcgtggccaggggcggtcggctcgtccgcatcatgggcgacatggtctcgcgggcccccaacgaggtctggttccgccgcttcctcgccccgcaccaccgcaatctggtcagctcccgggacctgctcgacgccgtcctgcgtgaccgtgtcctcgccgacccgcggatcacgctccggcaaggcgtcaccgcccttgggctggagggtgacgcccgccgcgtcaccgggctccgcatccgcgaggccgccggtgaacgcaccctggcggccgacctcgtcgtcgacgcctcgggccgcggctcccgtgcgccgcactggctcgaagccctcgggctcccgcgcgtcaccgagctccgggtcgacgccggcgtcacctacgcgacccgcctctaccgtgcccccggcaccgccgccggcaccggcttccccctcgtcaacgtgcaggccaacccctctaaggcgccggggcggggcggcatcatcctgcccgtcgagggcgagcgctggatcgtcaccctcgccggaacccggggcggggaaccgacggacgacccggacgcctttctggagttcgcccggcgcctcggggatcccgtcatcggcaggctgatcgagaacgccgaggccatcggcggtgtcgccgtgacacgcggcaccgccaaccggcgtcgccactacgagaaggcgaagcgctggccggacggcttcctggtggtcggtgacgcggtcgccgggtacaaccccgtctacggacacggactgaccgtcgccgcacagagcgccgtcgccgtccgcgacctcctgcgcggtaccggcgtcaccgtccccggcggcgggcgccgactccagcgtgccgccgcccgcccggtctcgggtgcctggaacctcgcggtcggacaggacgccttctacccggacgccaccgacacccctcccggcatcgcgcagcggctcctcgcgcgctacgtcgaccgtgcggtggccacgggagcccgcagcccgcgtgccctgagcgccctgctggacgtcatgagcctggagaaacccgccacccggctgttcgcacccgacatgctcctccccatgctcttcggcccgaagaagaagcacctccccgggcccccgctgacccggacggagtgggaggcggcccggccgtagcccaggaacggcgggagccggcaagggaccgccgggctcacttgtactgggcgatctggatcagattgccgcaggtgtcgtcgagtaccgctgtgatgaccgggcccatctccaccggctcctgggtgaagcgcaccccgaggtcgcgcagtcggctgaactcggcgtgcacgtcgtcgacggcgaaggaggtgagcgggatgccgtccgcgaccagcgccgtctggtacggcttcaccgcggggtggctgtcgggctccagcaccagttcggtgccgtcggggtcgtccggtgacaccacggtcagccaccggtgctcgccgagcgggacctcgtgcttcttcacgaagcccaggacgtcggtgtagaagcgcagggctttgtcctggtcgtcgacgaagacgctggacaggtggatcttcatggcgtgctctccggcgcatcgggcctgagccatcgggtcatgatgtgctcaagcggtgcagtgttcaggtcgtggaacttgtagcggccctcgcgtcgtacgcggaccagacccgcggcctccagcaccgcgaggtgctggctgaccgcctggcgggacagcccgaggccgtgcctggtcgtcaggcgcgcgcatatctcgaacagggactgcccgtcccgttccgccaactcgtcgaggatgcgccggcgggtggggtcggccagcgccttgaagacatcgtccggcacggctccacgataggcaagtcaccacttgcctgacaacttctccggggcggcgcagtcaggcccggggtgccagcaggtcgtccagctcggccgcgaagagcagggcggggtcgaagcccatgccggtgaagtggccggccagctccagggacaggacgccgtgcagccgggtccagaaggtcagggcccggtggagggcggcgggcggaccggggtggtcgccggtgcggtcccgatggttctcgaggtgggtgccgaacggtgtcgcggggccgtccgacacccgcgccgcccaggcgtcgagcagcaggttcatgatccggtccgagatgccggtgatgtccgccggggcgcggtaaccgggcacgggggtgccgtagatcaggaggtagcgctgagggtccgccagcgcccagtcgcgcagcgcgtgcgcgagtccggccgggtcggcggggccggtgccgccggggcaggtcgcggcgagggtgtcggccaggctgcggtacgcgtcccggacgagtccggtgatcaggtcgtcgcggctggcgaagtagcggtagagcgcggggccgctcatgcccatgcgcttggcgatcgcgttcagggagagcgcggacacgcccgccgtggcgatctgctcccgggcgtgttccttgatctccgcgcggacctgggcgcgatagcgctcgcgtgggctctgtgcgtccgactccgtcatggccccggctccgcctcctgcccgctcttgggctacgacttcaagactcagtcagtagctatcacgcaagctgctgacctcccgcgtcacgcaccgtcatagcctctgacgaaaacccatgcctccagcgctcaagggctatgtcatgtcctcccgcctccgtggcaccgccgtccccgccgccctgctcgccctcccgctggccgccgggctcctcggcaccgccgccgcatccgccggggcggccccggtcactcagccgggtccctcacctgcggaggcagggcgtcgacccgcccacgcgggcccgctaccggaccgggaccgtgacccacgccccgctgctcaccgtctggaatccgcagatccacgtggagcgccggccggcccggcaggctcgcgtcacgacgaggagagccacaccggtgctgctcgggctcggggggcccgacacgaagccgccgcccgtggaagtacaggatcgtgccggcgcgctcggcggtgtcgaccggctcgacgagcagcacgggatcgtcacctcgcagtacgagttcctgcgccacctccgtgaccatcccggggcccgcgtggccgacctcgccaccgcgttcgccgtcggcatcgggggcgaccagcaagagcgtcgaccgtgtggagaagcgcggctgggtcgtccggcagccgaacccggcggaccgccgctcgtcgctgccggccctgaccgacgacggcacgcacctggccgaggcggcggagcgaaccttcaccgagcggctggccgaactggtccgaggcgccctcgcgagtcctgctgcccgcgtggccgcgcggcccaggcgcgctcggaactgcgtgccgcgctcgaacgcgaccggatccgcatgccgacaggctgacggcgctgaccccgcaggcggtgctacacccgcttcccccgcccgaacttctcgaccgcctccggggagaccggcgtgaagaagttgacgaggttgccgtccgggtcgcggaacagcagggagcggttgccccagggcatggtggtgggcccgctgacgaggtcggtgaggaggtcggtcatgttctggtgcacccggtcgacgtcgtcgaccaggaactcgatgatcatgctgtggttgtcggccgggcgcgcggagtccggcgcgaagagcggaacggtgcgggtactggcgatggcaagggtcgcacccggggtccggatttcggcgaagtcctcggtggcccaggccgccgtcgtgccggtggccttctcgtagaacccgacgaggcgtgcgacgtcaccggtgatgacgcggaccgagacgaagtccatggtgttctcccttgttgagcggtggttccgtgctgagcggtgtttccgttgcgtcctcgaaggtagaacaaatagaggacagaaccggtccagtattctcagtagacttccgccatgtcccgacccaccggccgcgtactcacccttctggaactgctgcagtcgggcggcatccggaccatgaccgaactcgccgaccggctgggcgtcgacccgcgtaccgtgcgccggtacgtggagcacttggtcgacctcgatgtaccggtcgaggcggtgcgcgggcgctacggcggctaccgtctcgcgcccggtcaccgcctgcccccgctcatgctcagtgacgacgaggcactcgtcgtactgctcggcctggccgtcgcgcgccggtc

SEQ ID NO: 477 - DNA, 4343 bp, Unknown
  Kingdom: Bacteria, Phylum: Actinobacteria, Class: Actinobacteria, Order: Streptomycetales, Family: Streptomycetaceae, Genus: Streptomyces
agcgagcggccggggcgagggccataggagcgcggacaggcgtgccgcaggacgtggcgctgcgggccctcgccgagggcgtggaggcgtgcagtcgctgtcggccggacagcaagctcggcttcatcgacagctaggagttggccagccgatcattgacggtgtgcgtctggccgctacttgaggcgcctgtgccggcagcctgaagccgattgccagaggtctgctggggcgcgaccatcctcggatggatacagagaagggccgaaagctggtgcgggttgcgcagacgtgttctgcctgcccgtcgcagtgggatgcctggacggcagacggccagtacttgtatctccgataccggcatggcgaaggctccgtcgagtggcatcccgaccctgagttcgatgacactccggagtcgcggaacgagggccgctcggggctcctgatcgaatgggacgacggcaccagtagcggtgtcatcggccttgaggacttcctcgcggcagcgggcctggccttggcgccgggcgcctcggtgagctgacgtcgcggcacacggtcatgtgcggagccagatgaccaggcggctgcggtgacggtgccgaggaagacgtacccgcgcttgtcgtaaccggtcgtgacggcacgggagttcttcagcttgttgatggtcttctcgacggtgttgcgcttcttgtaccgatcctcgtcgaagcctggtggccgtccgccacgcgatccttgcgaaggcgggcggcctgactgtcggccttctccgggatcgtgtgccggatgctgcggcgccgcagatactgacggcagggaccgttgctgtaggccttgtcggccgcgacgctgtcggcttcctgcgaggtggcctgcccaacccgagccgggggacccggatcttctacaacaccggaacgaactgagtgcagtcggcctgctgccccggagtgactatcagggacagcgggcgacggtgcccatccgcgctcaggtggatcttgctggtgaaaccgccgcgcgagcggcccaggccctcgcctcccgcaccatccccaccaggcggccgacgaggctctgccatggagtttcgtcctggtgttccaccagctcgtccccctttgatccagcaagggccggcggcgggtcggtgcgggcgccggccgggtgctggtgagcgcgcacgtgggtggagtccaccgagatgtcccagtcggtctcgtccgccgcgtcggccgcggcctggactcgccgcagcagccgttcccgggtgccgtccgccgaccacagccgatggcgctcgtagaccgtcctccacggcccgaaccgctccggcagatcgcgccagtgaacccccgcccgaacccggtgcagaatcccgtcgatcacctgccggtgatcacgccaccgcccgcaccgaccattgctcaccggcaggaacagctgtagcccctcccactccgcgtccgacagatcaccacgttcaccctgccccatacacaggccaaccatccgaccaggcgacagtcacatgatcgaccgcacagctcctagccagtcctccagccgggccctgacctggtgcacctgttcttcgtcgtggcagagcactacgaagtcgtcggcatacctcaccagcactggggtggctggcatcgcgccgggctcacgcccggcccgcaccgtgtgcggctgacgctactcggtgatcaccggatggcgcccgcacctgctttcgaggctggacgcgctgtcagctcaacggcggccgttggcggaccagctgggctgtcagccggcccttctcgcggctgccgcctgcgggccgcttccattcggcgtactcgtacaggccacacgactgccggcggtgggccgggctcacgaaattcacctgctctggcagcgccaactcggcttcgacctgggccgcccgctgggggattcttccctggtgtggccgaccccagggacgccaagctgctgggatggagtcggtcagcgagcggaccttgcggcggatggctgccgagcagcgggatcacggccgctccgggcgagttcctcaccggcggcgaggcaggacccagtaccgcgccggcgtgatcgatccgcacacgttcggcatggccggcacagatcacgcatggggaccgcatgagatcagcggcaacgccgtccgcgacctcaccgcgctctgcaagcaggagacctgcgccggcctgccacctcccggtgccttcaggcaggctccgcgggtgcgggccccagagcacggatcgcgaaatcgatcgcggtggtcaggcgctcgatgtcgtggccggcgcgttcccgcacccgtaggccgagcaccgtggtgaacagcagctccacggcctcgtcgatgttcaggccggcggccagctcgccacggtcacagccctcggccagcgccgagcgaagggcctgccgggtgacctcgaaggcggcctcggtccgctgacggaccttctcgtcggtgacgccgagctcggtggcggtgttgaccacgaagcacccgcggccggacctgccgtcggccgggcaggtgaccagccacagcatccattcccgcagtacctcgcgaacgggacggtccgccgtgtccagccgctgccgggcctgagccgactcggtggcccggtagtggtcgagtgcgcgcaggaacagcgtgtgcttgtccgtgaacgtccggtacaggctgctgggcgtgagcttcagctcgtcacccaggtcgcgcaccgaggtggcgtggtaaccgcgtcgccagaacagctcggtcgccgacgtgaccgcgttcttctcgtcgaactgtcgggggcgtgccatgtattcaccttacccaacttgtggagcgatcgctcccatattagtgtgcccagtatgggagcgatcgctcccgaatcgttgaggaggctccgttgacgaccgcagaagagacccccactcagacacaggaaccacaggccccggagagaagtcgctggatggcggtctccgcggtggctctgggcaccttcctgctggtgactgccgagcaactgccgatcggtctgctgacctccgtggggtccgcgctgtcggtctccgaggggacggcggggttgatggtgacggtgcccagcatcgtcgccgcgttcgcggcgccgctggtcccgatgctcgtcgggtcgatggaccggcgcatcctgctgctcggactgatgaccctgatgaccgtcgccaacctggcctcagccctggcaccgaacttcggcgtcctggtgggctcccgggtgctggtcggtatcgcgatcggcggcttctgggcggtcgccagcggcctggccgtccggctcgtcgcccccgcggacgtgccgcgagccaccgcggtcatcttcggcggcgtcggagcggcgaacgtgttcggtgtcccgctcggcaccctggtcggtggcctcaccggctggcgcatcgccttcaccttgctcagcgcgctggcgcttgtcacgctcatcgccctgctggcggtactgccgggcctggtcgcctcacaggccatccgaccgaagctgctgatggagcagttcggcaaccctggcgtgcgtgtcggcatcatcgcgacggccctgatcgtcttcggccacttcgccgcgtacacgttcgtgagcccggcactgcagaagttgtcgggcatcgacgagcgctatgtcggcccgctgctgttcgggttcggtgtggccggcatgatcggcaacttcgtcgctggctcggcgctctcccgccgggtgcaccgaagcgtgctgatcatctcggtggccctggcggtcgcgatgccgctcttcctgctgctgggccagaccgcggtcggcggcgccatcctgctgatcgtctggggtctgtcctacggcggtgtctccgtgggcctccagacctggatgatcaaggccgcgccgcgggcggtggaagcggcttcctcgctgtgggtggcggtgttcaacctgtccatcggcctcggtgcactggtcggcggcgtcgtcgtcgacacgctcaccctccagggtgtgctgtggctcggcggcgcctgcgccctcctcgccgccctggcgatctggaccgcccgcaccagcgacgcccttcgctgaccgagccctccacagggtccaccggccgtcggcatcgacccgcctgtccacccagccagacctcgccgtcccccaacaaaggcaaccgaggccaagctgggcgccgtcgtggacgacacgcggcgccgggccgacaagctgcccgatgagcagcgggcggagtggaccgcgctcgggatgcgctggtagcgg

SEQ ID NO: 478 - DNA, 1720 bp, Unknown
  Kingdom: Bacteria, Phylum: Actinobacteria, Class: Actinobacteria, Order: Streptomycetales, Family: Streptomycetaceae, Genus: Streptomyces
  misc_feature (1248)..(1377): n is a, c, g, or t
cggatcgccgactccgcgtgccgcttggccagttggagggtggccgtggagttgcggccgagggcctcgcggacgtagcggcgggccgtggcgaggtcggcggcgggtccgaggactcgtgcgacggcctcctcgcgcaggacgacgctgtgctgcgagacgacggtgacgccgtcggtgtcgggcaccacggaccattcgccggtgtgggcgtgcatgagggcgggggtggccgtctgcttgtagacgatgcggcccgcgtgcgggaagcagacgcggacggactcggtggtgtgcgcgctgccgtcggcggtcaccgtgtccatggacatgacctgcacgccgggggtggtctccgtcaggtcgagccgggagacgtgcgggatcaggtcgggccagtcaccggcccggtagaggaagtcgtagaccagctcggccgggccgttgacgcgtaccgagtcctcgaaggacagcacgaggtcgtcgaggcgctcccagcgttcggcgagctgcttcagattgccgagttcggcgcgggagttggtgtcgcaggcacgctccacccaggtcacgtcgccggggtggtcgccgacgacggtgaagtcgtgcagcagggtgagccggctggtgccgccgccgcgttcctccacgatccaggttccgtccatcgtctcgacgggggcctggggacgggtctggcggaacgtgatgcggcgcccggcggggtcctgggtccgctcggagatccaggagcgcacctcgccgttggcggtcgcccacatgcgcagccgctcgtcgcggccgtcgaactccagccgctccacatggacgttgggcgggaagaacagcggccagcgcacggcgtccgcgatcagtccgtagacgacgcccggctgggcgtccacgtcgacgctgtgcgtcgtccggtgcacacggtcgttgggcaccacacacctctttcgttgcttcggtggctcgaatcgcccggtcgagttcagaagttgccgaggccgccgcagacgttgagggcctgcgcggtgatggaggcggcgggctcggaggcgaggtagccgacgagggcggcgacctcctggggggtcgagtagcggccgagcgggatcttcgcctcgaactgggcctgcacctgctcctcggtcgtgtgccaggcggccgcgtagccctcgcgcacccgctgggccatcggcgtctcgacgtagccggggcagacggcgttgacggtgacaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggaacacgctgttgaggttggtctcgatgacgtcgtaccagagttcgtcggtgaggtcggcggtgactccgccgccgctgcggccggcgttgttgacgaggacggtgagcggcccgaaggtgtcgacggcggcccgtaccagggcggtgacatcgctaccggagcggacgtcggcggcctgcccggcgacctccagtccctcctcgcgcaggtcctcgacggtctgcttgacggcgctctcgccccgggcgcacaggaagacgcggtgccccgagcggccgagggtacgggccacctcgaggccgatgccgctcgtggcgccggtgaccagggcgacggg

SEQ ID NO: 479 - DNA, 3625 bp, Unknown
  Kingdom: Bacteria, Phylum: Actinobacteria, Class: Actinobacteria, Order: Streptomycetales, Family: Streptomycetaceae, Genus: Streptomyces
tgatcgggctgaccctgatcaccggcatgacggtgatggcgggcagcctccagcacgcgatcgacaagatggcgtcgtccgcgatccgcgccgactacgtggtgtcgatggccaacggcaacggcctctcgcccaacgtcgccgagaagctgcacgacgccgacggcgtcaccgccagcagcccgttgcgcaacgcgccctcccgcatcggcggcgagaccgagtacctgaccggcgtcgacggcgcggccatcggcaagctgaccgacgtgaaggtgcgggacggctccttcacggtgggcggcacccgggtcgtggtcgacgacaagaccgcgaaggaccaccactggacggcgggatcgggcttcaccgtccactacgaggacggccgcaggcagaagctcacggtcgccggggtctacgagggcaaccagatgatccgcgggatcatgctcgacaacgccaccctcgccccgcaccagcacgacgcgaccgacatgcaggtcatggtcaagacggccgacggcgcctccgaggccgccaaggacaagctggtcaaggtgctcggctccaacccggcgatccaggtccagagcaagaaggacatctccaacggcatcgctcaggcgttcacgctgatgctgaacatgctctacggcctgctcgccatggcggtgatcgtggcggtcctcggggtcatcaacaccctggcgatgtcggtcttcgaacgctcgcaggagatcgggatgctccgcgcgatcggcctggaccgcaagggcatcaagcggatggtccgcctggagtccctggtgatcgccctgttcggcggggtcctcgggatcggtctcggcgtgttcttcggctgggcggccggtcagctgatcggctcgaagatggcgacctacgaactcatcctgccctggggccggatggccgtcttcctggtgctggccgcggtggtcggtgtgctcgcggccctgtggccggcccgccgcgcggcccgcctgaacatgctgcaggccatcaagtcggagtgacccggcacgcacacgcgaaggggcccgttccaccggaacgggcccctcagcgcttccgggccgctacgacgcgtccggcgcgccccacgtgcgggcccgcagcggcattcccgagtcacccgatacgggagtcttcaccgcgagcacctggttgacgccgatgcggttgtgctcgaaggcgagcgcggaggccgccatgtacagccgccagacgcgggcgcggccggggctggtgagccgtacggcacggtcccagtccgcctccaggttggcgacccagcggcgcagggtgagcgcgtagtgctcgcggatcgcctccacgtcgcgcacctcgaacccggcgcgctccaactgggtgacggtggtgccgatcggggcgagttcgccgtccgggaagacgtaggcgtcgatgaactcgtccacccggtacgccgactcgtcgccctgcgggcggcggccgatctggtggttgaggagccgcccgcccggcttgaggagggcgtacaggtcgttggtgtactccaggtagcgggcggcgccgacgtgttcggccatgccgatggaggagatggcgtcgtacggcccgtcggacacgtcccggtagtcctggacgcggatctccacccggtcggtcagcccctcgtcggcgacgcgcttcctggcgtacgccgcctgctcctgggagagggtgacgccgacgacgctcaccccgtgctcgcgggccgcgtggatggccatggagccccagccgcagcccacgtcgaggaggcgctgaccgggcttcaggtccagcttgcggctgatgagttcgagcttgtcgcgctgggcctcttcgagggtggcgtcgggctccggggccggccagtaggcgcaggagtacaccatggaggggccgaggacgagttcgtagaagtcgttgccgacgtcgtagtggtggctgatggcctgcttgtcggtgcgcttggtgtgcagatggccggggcggcggcggacctcctcggcgggcggagcgggcggcagcggcggtccggccagtttcaccaggcccgcgacggcggagcggaccgacgggtcgcgcagcgcgcgggtcaggccgcgggtgtcctcgccgcgttcccagatcagtccggagagcaggtcgagggcggtgtagaggtcgccctccacggtcaggtcacccgagacccaggcgcgggccaggcccagttctcccggtttgaagagcaaccggcgcagcgcgcggcggttgcgtacgacgagtacgggcgctgcgggcggccccgcctccgtaccgtcccaggcgcggatacgcaccgggagcggtgtccccagcaactgttcgagcagtctcgtgagccgcagcgcggcgtcgggcatggtgcacacacctccgtgacggcgaacgccggatgtcatccaccacgtaaacaccacgagggccgcagcgcagtcccgcaagcgggttacgactgggcaaagtagttgcagcgaccacgcatttcggtgttccgggtccggcatccggcgtccggcacacgacggccggcacacgacggccggcacgcggtgtccggcaggcgggacctgcaggcagtgccctggaacgccgaaggggccgcccgcaccacggatggcgggcggccccttcgggctgttcggtgacgcggcgacgcggtgccgcgccggccggagggtcaggaggtcaggacgccttggccttttcctcggtcttcggcgcggcggcgaccggggcgggcttggcggcctcgtagaactcctcgcgggggttctccatggcgccgagcgagacgacctcgcgcttgaggaacatgccgagggtccagtccgcgaagacgcggatcttgcggttccaggtcggcatggccatgccgtggtagccgcggtgcatgtaccaggcgagacggcccttgagcttgatcttcatcttgcccatgacgatcatcgcgacgcccttgtgcaggccgagacccgcgaccgcgcccttgttggcgtggctgtactccttctgcgggaagccccgcatgccggagaccacgttgtcaccgaggacccgggcctggcgcagcgcgtgctgggcgttcggcgggcaccaggcgttctcgttgccggccttgcggccgacgaggtccgggacctgggcgttgtcgccggcggcccagatgtagtcggtgccctgcacctggagggtcggcgcgcagtcgacgtggccgcgcgggccgaggggcaggccgaagcgggacagcaccgggttgggcttgacgccggccgtccacacgatggtgttggagtcgacctcgaggccgttcttcagcacgacgtggccgtcgacgcaggagtccatggaggtggagaggtagatctccacgccgcggctctccaggtgctccttgccgtacaggccgagcttggggccgacctccggcaggatcttgtcggcggcgtcgacgaggatgaaacgcatgtcctcgcgggacacgttgctgtagtacttggccgcgtcccgggccatgtcctcgacctcaccgatggtctccgcgccggcgaagccgccgccgacgaagacgaag

SEQ ID NO: 480 - DNA, 5902 bp, Unknown
  Kingdom: Bacteria, Phylum: Actinobacteria, Class: Actinobacteria, Order: Streptomycetales, Family: Streptomycetaceae, Genus: Streptomyces
cccccggaaaccgacgccgatcgccccggccccgccgccggctccgcctcccgctccgcttcctcgtccccgtcgttctcctcgccgcgctgatggcgatgctggtgcttcgcgggtacgtgcacagcgagatcctggccgatcaccgcatccggcccgaggcggccaccgacaccgtgccggacaagatcctcgacggcgggccggtcatcgacacccgccacgggcagacgaccagcctgggcgtccccgaccaccgcctcgtcctcaccttcgacgacggccccgacccgacgtggacgccccaggtcctcgacgtgctcaagaagcaccacgcgcacgccgtcttcttcgtcaccggcacgatgacctcgcgctacccggacctcgtccggcgcatggtcgccgagggccacgaggtggggctgcacaccttcaaccaccccgacctgtcctaccagtcgaagcagcgcatcgactgggagctgtcgcagaaccagctcgccatcaccggcgcggccggggtgcgcacctcgctgttccggccgccgtactcctccttcgcgaacgccatggacgaccgttcctggccggtgaccgagtacatcggcagccgcggttacatcaccgtcgtcaacaccctcgacagcgaggactggcagaagcccggtgcggcggagatcatccggcgggccacgcccaaggacggcaagggcgcgatcgtactgatgcacgactccggtggtgaccggcaccagacagtccaggcgctcgaccgctacctgccgcaactccaagcccgcggctaccggttcgacaacctcaccgaggcgctcggagcgcccagcgcgctcaccccggtcaccggcgccgacctgtggaagggcagggcgtggatcctcctggtccgcgcctccgacgacctcaccgacgcgctcggcgtgtgcctggcgctggtcggcgccctggtcatcgcacggttcgccctgatgctgctgctctccgccgcgcacgcccggcgcgtgcgccgtcccggcttccgctggggcccgccggtcaccgaaccggtgacggtcctggtcccggcgtacaacgaggccaagtgcatcgagaacaccgtccgttccctgacggccggcgaacacccggtcgagatcgtcgtcgtggacgacggttcgtcggacggcacggcggacctcgtcgagtccctggacctgcccggcgtgcgggtggtgcgccagcgcaacgcgggcaagcccgccgccctcgaccgcggtatcgcgcacgcctcccacgacctgatcgtcatgatggacggcgacaccgtcttcgaaccctccaccgtccgcgaactcgtccagcccttcggcgactcgagggtcggcgcggtcgcgggcaacgccaaggtgggcaaccgggactcactgatcggcgcctggcagcacatcgagtacgtgatgggcttcaacctcgaccgccgtatgtacgacgtcctgcgctgcatgccgaccatcccgggcgcggtcggcgcgttccgccgctcggcactggaacaggtcggcggcatgagcgacgacacgctcgccgaggacaccgacatcaccatggccctgcaccgcgccggctggcgtgtcgtctacgccgagaacgcccgcgcctggaccgaggcgcccgagtccgtccagcagctgtggtcccagcgctaccgctggtcgtacggcaccatgcaggcgatctggaaacaccgcggcgcgctcctggaccgcggcccctccggccgcttcggccgcctcggcctgcccctggtctccctcttcatggtggtcgccccgctccttgcgcccctcatcgacctcttcctcctctacggcgtgatcttcggcccgaccgggaagacggtcgtcgcctggctgggcgtgctcgccatccaggcgttctgcgcggcgtacgcgttccggctggaccgcgaacgcatgacccacctgatctcgctgccgctccagcagctcctctaccgccagctgatgtacgtcgtcctgctccagtcctggatcaccgcgctcaccggcggccggctgcgctggcagaaactgcgccgcaccggcgtggtggaggcaccgggcggtcccgtgtcccccgacgcgatcaacccgctgagcgccgtgtccccccggaggccggtggcatgacccagaccctcgccccgaagcccgccgccaccggcccgcgcggaccggccggccgcgaccgctacctggacctcctacgggccctcgccctgttccgcgtggtcctctaccacctgttcggctgggcctggctgaccgtgctgttcccgtcgatgggcgtgatgttcgcgctggcgggctccctgatggcccgctccctgaaccgccccgccctgagcgtcctcaagggcagactgcgcaggctgctgcccccgctgtgggcgttcggcgcggtcctgctcccgctgatgctgctggccggctggaacccgctgggggacccggacctcgggggcaccctgtgggtgtccaagctcctgaactacgtcgtcccgctcggcgccccgccctaccccgcgcacctgggctccgactccggcctgctggagtcgaactggccggacgacgcggcgggcccgctgtggtacctgcgcgcctacctctggttcgtcgtggcgtccccgctgctgctacgggcgttccgccgcgtaccctggccgaccctcctcgccccgctcgccctcacggcggtcctcggtacgggcctggtgcggatccccggcgagacgggcgaggcggtgacggacttcgcggtgtacggcggctgctggctcctgggcttcgcccaccacgagggcctgctggcacggatcccccgctacctggccgtctccgcctccgccctgctgatgtcgctgggcctgtggtgggccgtcggccaccagggacccgacggctgggacctgaacgacatcccgctcgcccaggcggcctggtccttcggcgcggtcgtgatcctcctccaatactccccgtcctggcgggagttcccggcccggctgcgccgctggcgcaagctcatcaccctcgccaacaaccgggccgtgaccatctacctctggcacaacttcctcatcaccgtctcggtcccgctcatcgaccaggcgtacaacctgccgttcatgcagagcgaccgcgcgtcgtcgatgctcgactcgacgtacagcctgtggatgttcgtcctggtgtggccgctgatcggcctcgcgatcctcgccttcggctggatcgaggacctggcggcgaagcggaagccccggttgtggccggacggcgcggcaagcgcaccccgtgacaggtgacctggcagagcgcttgaccttaccctcaagggcaaggtttagcgttcttcgaggtgaggggcatgaggatcggggagctggcccggcgcgcgggtgtgacgaccaaggcggtgcgttactacgagtcgctggggctgctcgcgccggtccggttggccaacggttaccgggactacggcgagcacgacgtacggctcgttcaggagatccgggcgctgtgccgcctgggcatcccggtcgaggcgacacggccgttcctggagtgcctgacctcggggcaccggcacgcggacgactgcccggccgcgctggccgggtaccgggacgccatcgacgagctcacgcagcggatcgacggcctcaccgcccgccgggcggtgctggaggcacacctgcaccaggccgctcaccgccacagccgcctctcaccggccgccgaaggagaggaacccatgaccgatcacctgagcctgcccgccgacctgcccgttcccgaggacgacggcgccgccgcccacctgcccggtgcgagaatgccgcgcctcagcctccggacgaccgacggcgcgacggtcggtctcgacgcgttgggcgcggggcgcacggtgctctacgtctacccgctgacgggccgaccggacaccgatctgcccgagggctgggactccatccccggcgcccgtggctgcaccctggagtcgtgcggcttccgcgaccaccaccaggacctgctcgcggccggcgcggcacgggtgtacggcctctccagccaggacagcgactaccagcgtgaggtcaccgaacggctccgactgccgttccccatgctgtccgaccccgcacggagcctggccgaggcactggacctgcccaccttcaccaccggcgggctgacgctgtacaaacggctcacactgatcgtcgaggacaacgtgatcgagcacgtcttctacccggtcttcccgccggacaagcacgccgagcaggtcctggcctggctcgacgacggcgacgcccaccggctctgacacgccgggtagggccgccgtttcgccggccgagcccgcagacctcacccaccttcgtcagacgtggagttcgggcgggaggcccgtccagcgcagctcggcggggaggtggcgggtgtcgttgaagaccaggaccgccggggggcggtcaggtgagtaacggatgacggtcagggccgcgttggcgtggttgatgcccagccagcgccacttcggcgcgtcgagagcggcccggacgagccagccgacgaggaagttgtgggtgacgacgagttcgtgccgcggttcgtctccgacgacaggtccggtgaactccgcgagggccgccgccgcgagcccgggaccctgctcacgctcctcggcagtgaactggcccaggaactccgtccagtcatcggctgcctccggtggcagctcctcgcgcgccgggaggtaggggacgtagtcgcccgccgcttcggaacgacggcaggcaaccccgtcgagctgctcaccgatcagccgggcggtctcttcggcgcgggcgaggggtccgtggtggatcgccgccaacgggacctgacgcagccgctcccccagcagggcggcctagcggcgacccgcgtccgacaacccactctcgtccggcgttgcctcgccgtgacgggcgagatacaggtaacgggcggccgtaccggtcatggaagcgtcctccgacgaagccgatcttgcggggcgcagggaaggacaccgatccacaggccccggttccaggagggcggcgccgggcacgatgtgacgctttccgtcgcaggagccaagtagaggtgtaagccagtaacccggctctcccaaggagcgtgcgtgcccccggaacacccgacagccccacccgtacgagacccgtcagggttcgcggagttctaccggcagaacttcgacgcggtcctcggcttcgtcacccggcgaaccgaaagcgtccatctggccgccgacctgaccgccgacatcttcctgaccgcgctggaacaggcggacacctacgacgcccggcggggcacgcccaccgcctggctgtacggcatcgcccgtaacctccttgccgcgcacttccgcggcatcgcccgggaacggcgggccgtctcccggatcgccggccaccggatgctggacgaacaggacgtcgccgtgatcgaggcgcgtatcgacgcggcccgcgccgcccgggagttggccgggcaccacgccgccctctccgaaccgctgcgcgccgtgctggacctggtgaccgtcgacgggctgaccatccgcgaggccgccaaggtcctctgcatcagcaccgccaccgcccggatgcgtctgcaccgggcccgcaaggcgctgcgccacgccaccccgccgtccgaaccgtccctgaacgccctcctggaggccgcctcgtgaacgctcccgtcaacttccagcagcgactcggcgacgaactggccgcccgcgccgcggcccagcccgccctttcgccggcccc

SEQ ID NO: 481 - DNA, 8294 bp, Unknown
  Kingdom: Bacteria, Phylum: Actinobacteria, Class: Actinobacteria, Order: Streptomycetales, Family: Streptomycetaceae, Genus: Streptomyces
ccggcctcgccgtgcccgaggagtacggcggagccgggtgcggtgcggtggacgtgcacgtggtgatggaggagctgggccgggtgctgagccccgtccccctgctgggctcggccgtgctcgcggcgcaggcggtcctcgccaccggtgacgacgacgcctgcgcacgcctgctgcccggtatcgccgacggcagcaccgtggcgtccctggcctgggcggaggacggctcgtgggagccggccgggatccgtgcgacggccgcgagcggcgtggacggcggctggctcgtccacggcgtcaagcagtacgtgctcgacggcgtcggggcggacgtactgctggtggccgcgcgcaccggccccggcgtctgcctcttcgaggtcgccccggacgacccgcacgtccacggcgagaccctcgtgaccatggacgagacccgccccctggcacggctgaggttcgagggtgcccaggggcggctgatcggcacggccggcgacggcgaacgggtcctgtcccacgccctggacctcgcgtgcgccgccctggccgccgagcaggtgggggccgcacagaggtgtcttgagctgacggtcgcctacgccggcgagcgggtccagttcggccggcccatcggttccttccaggccgtcaagcaccggctggccgacgcctacgtcctggtggaggcggcgcgctcggcggcactgggcgcggcgttcgcggccggcaccccggacttcggcaggtatgtgtcggcggccgcatcggcgtgtgcggaggcgttctccgcggtggcgggcgagatgatccagctgcacggcggcatcggcatcacctgggaacacgacgcccaccgctacttcaaacgtgcgcacggctcctcccagctcctcggagccccggccctgcaccgggaacggctcgcccgcgatctggggctgaccgtaccggcgagccggccgctgtcacccgcctcccggtaggagggtcggcttcccggccgcgggcagtggtggtgccgactgcccgcggccggaccgccgggtcagcggacgtgcaccgtcacgacctcagaggcgtgcaagcgtacggggtgctggtcgtgcctgctggtcaggccgtacagcacggcgcggaaccgcaggtccccgcggcgcgcggacgtgcccttcgcagtcacctgcgcgtcgcccttgcgcacgacgctgcagttctcctggtgccatccctcgccgaagccgttctcctccaggcacagctggtgcaggtagccggcgctgtcgtcgtcaccgtgcgccgtgaccgtgatcgtcttgccgacgtgcgccgtgcggggcgccgtgatgtcgacattgcccttggcgaacgccggtactgcggccagcgtcaccgaggccaggcccagtgcaccgatcacggccatccggccgccccgcgccttcatcccggtcttcttcgtcctggtcatggacgtccttcccgcgggtctcctccaccatggtgagacccgctcccctgatgtgcgcgacggcgcctggttgcgcccccgccgatcagtcagatgaccgggcgttgccgctcgttgcactcgcccggggccgttacagatccacgacaaatccgtcggcgggcccgctcctgtcgacagccccgggaagtgaccgaccggtcaggcgtcggcgatcgggctggtgcccaggcggacgttgtcgatcgcccagaaccagttgttgcccgcgttgaacatccggaacttgaccttcgccgaggtggcgccggacggcacgggacaggagaggcggacgagccggttctcctggtccttcccctggttggcgttgccggaggaggcgctgctgtagtggagcagctgcacgctcgcgcccgagtcgaactcgacgaccacctctgcctcttgggggctttcctgccggtagtgggagtcgaatcccagatgcagggtggaggtgcccgaggggatggtcacgggcgggctggtcagggtcgagtcgaagcggccccgggcggacgggctgccggtgtcgtcccagtcgtcggcgtccgcgacggcgacgatgccgagggcccgggtgaagttcgcgcggtcctgtccggcggggaaccagaactgcttggacaggaaggtccagccctgcagctcccgggtgccctgcggcatggttgccgcgttggtgaccgtccagccctcgggcgcggacgcggtccatccgagcaggccgggccggctgaggtcggccgcgggcgcgagagcgggggcgagggactcgaagtcctccgcgagcaggtgtccggtcatgagcggtccggtcctggcgggcagggacgcggacacctccacggtccggcccttcagcttcgccgtgacggtggccttgagagcggccgtggtgcgggccgccgagacgggcgcgagtacgtcccaggccagtttcacggacgagcgggccgcgacggacgccggtgcggcgcccttcgccgtggcgctccagccctccgggagagccggcgtggcggccaggtcggtgaggggtgtgctgccggcgttggtgacggtggctgtcaccgtggcgggtctgcccggcgagaggacggtgccgtcggtcccgggtgagctggcgggtccggtgagcgcgatgctcagggcgggggcgaccccggtccggacgcgcgcgtccgcgaccctgagcaggccgccgccttcggcgtgtgcgacggcggccagccggcccacggtggcgtcgtcggtgggcgtgaccgtgaagcgcacctcggccgattcccccgcgccgagccgcctggggaccgctccggtgcgctccaccgaccagccggagggggcgagcagggcgacggagagcgcgtcgagccggccgctgtcctgattccgtacggtgacgacgacctcggtcgggtttccctgcgtgaacggtgtgtccaggggagggagcgcggcgggcagaccgatcgtcgcggccagcgccggcgtggtgccgttcgccgggtcggtgactccgggttcgccgtccgccacgcggccggtcatgcggcgcaggaacgccggatcgtccctgtcgaggaccgcgatgtcgtaccagccgtggtccgggaggcggagccggacggtacgggacctgccgggcgcgagcgtgacggtgcggacgggatcgccgtgccggtgggcgtagagcgactcaccgaccaggagcgttcgggtcgtccgggaggggttggcgcacaccacgtcgacatggccgtcggcggggtgctcgacgaggtaggcgtcggctcccacgccggatccgcgcagttcccatgtggaccagccggggccgtggacctgcaggtcgtacccgtcgtcaccgtactcgaccgtggtgtcggtgctcttgcgggcgggcaccgtccaggcgcgcggagcggtgccgtcgccgggataggcggtgatggcggcggcgacggtgccctggttgccgagccggagccgcagtccgccaggggtgacgtcggtgcgcagggacagccggtacggcaggggccgggtcggacgtgtgccgctctcctgcttcggctgcgtctggtccttgggcggtacggggttccagcgggcgaccgccgcggggaccggtccgggctgctccacgtcgggctgccggtggctgcggcggaagtcgaaggcggaggtcaggtcgccgaacacgctgcggcgccaggcactgatgttgggctcgtggacgccggtccactgctccaggaaccggatgaccgaggtgtggtcgaacgcctgcgagctgacgaacccgccgacggtccagggcgacacgatcgtcatcggcacgcgcgggccggggccgacgggactgccgttgaaccagtcgtcgctgttgccggagggcggctgcggagcgaggggtgcggggacgtgatcgaagtagccgtcgttctcgtcgaagttgatgaacaacgccgtcttcgaccaggtctccgggtcgctcgcgatggcgtcgaggaggtcgtagacgaggttggcgctgccgacgggggtggagctgctggggtgttcggagagggccgccgtcggcaccacccagctgaccttcggcagggtgccctgcttgatgtcggtccggatccggtcgacgagcgtgtccggctcggagcggtaggcgccgcgcaggaagagcctgcgctcggactcggtcaacgcgtcgacgcctcgctggaattcggccagcgcggacttgcgctgctccggggtcctgctccacaggctgtcgtagaactgctcggtggtggagtaggtaccggtgaccttggagaggatcttccgtccgatctccttccagggccggaagtattccaccgcgttgtcggtgaagttgtcccactcctggtagatctgccaggagacgcccgcggcctccaggcgctcggggtacgccgtccaggtgtagccggggtggctgtagtcgtaggcggcgttggtgacggcccggctgacgccgtccgcctcgtagccggtcgtgccggaccacaggtagaggcggttggggttggtcgaaccgtagacggagcagaagtaggagtcgcagatggtgaagcggtcggccagttcgtactgcagcggtatgtcctgccggtcgtagaaggccatggtgctctgcgtcttggcggcgatccagtcgttccaccagcccttcgcccgggcctggttggcgtcggtaaagccgtgcgcgagcgatccgagatactggatgtcgctctccttgcggcccgcgtcgaccgccgcccggcgggcggagaacggcagcacggtgccgccttgacgccggggctgctcgaagacgctgttcccggtgggcagccgcagcggtgtgcggtcaccgaagccgcggacgcccttgagcgttccgaagtagttgtcgaaggaacggttttcctgcatcaggacgatcacgtgctcgatggcgcgcatcccgccgcgcggcatgggcgcggccatcgcctggtgcagcgacgggggaaggagggagagggcggcgccaccggtgagggtgccgaggaccttgcgacgggagacatcagacatgcgccgtaggctagatcgtcttcaccgcactgcagaagcatgtgaaccaggatttcgccggccgttcagccgacgacatcaaccgttctcctgaccctgtgccaagcagtcgtgcccgtcacccggcagacccatgctgttcagcacgggttcctcgccgtcggggatcacgaaggtgaagttcgctccggtcgggactgcgaggagtgagcactgatcgccgaaggtcgtcggaggatacggctcccaggagcagccggccctgtccagggcggagacgacgtccgtgtgggtgagcccggtggggaagctgcccgtcccgccggcgaccgacgcaggcagctcgacggcgtcacgccaggtctggacgcagatgagggagaccttgcggcagccgcagacactcagctccaggtcgccgtagccgaagagccgcggccactttctgcgccggctcatcgttcccacgtcccgcggctcgccgagagctgcggtcacatcgctccagtcggcacccctgaacaccgggcccagcctgcccgtcttcgccatgtcggccaggacatcgagaatctccacgggcggagcctgtcaggtgccctgagcagcggtccagcggtttcagcggagcagcggacggaacagggcctgtcccaggatcgcggcgcgcgcctgcggcgggacgaagcctcaccgtcccggctcgcgccgccccgcgagcggccggcagcggatggcgggctgccgccctcggacggcggaggacggcagcggggacagcagcggacggcgggctaccggcagcggacggcggagggagttatatactttccatatgcacataccttccgatgccgagagcggcctgccgcccgagcagcggatcgagaatgccgcgcacggcctgctgcgcgacctcggcagactgaaccgggcgctgttccgcgccggtgacttcgggctgacccggagtgaagtgtccgtgctcgacgccctggcggccgcgccgctgcgcgtcaccgaactcgcccggcgcaccgggatggtccagccacgcgtgaccgtgctgctccagaaactggagggccgggatctggtcgcgcgccatcggtgcgcgaccgaccggcgcgcggtggagaccgccctcacccccgccggacggcgactgctcgagcagggacggcagcgtatggccgagtccttgctgcgggccctgcacaccacccccgtcgacgactgcgaagcagccgtgtgcgccgcccggcagtccgtcgcggcgctcaccgaagccatggaaccggaggccacttgaccagcccgaaaaccgcccggcggccactgggtgacagcacggacgcgagccccgccaagggcctgcgcgccgacgtcgtcccacgacgggtcaccggtccgcgccgatggtgggaccgggtcctggtcgccgatccaggccttgggcagttgcaggccggctggcggacgctggtcgccatggtcacctccctcgcggtcggctacggcatggcgcacgccctcgccgttccgacgatgatcgccatgatggtcgccgggatgatgggcctgatgagcgccttcgcggtcgccgggaacagctggggccagctggccaggcccattctgtggatgccgttcccctacacggcggtgctctggctcgccgccgccctgcacgacgaccgcgctctggagatcggcctcgacgccgccgcgctcgcgctcaccttcctgctggcccggttcggcccgctggccctgctgaccggcatgatgatgttcaacggcctcatggtcggcatcatcgcgaagatccccatggcgatgatgtggcaggcgttcgccgtcgccctggtgtccgccacggcggtgctggccacccggctgctgctctgctatccgatgccgcgcgaggacctgctgcgcacgcagcgcgccttcgtcgtcgaggcgcgccggctcgccgacaccatggtcgaggcgctggaccccgacgccgacctgaaccgcgtcgagcgccggatgaaccgctcgctgcgccgcctgaacatcgtgacgatcaccatcgacgggcgtctcgcgcagccggaggcggccaccgaccccggcgtcgccgagtcgctgcaccgccacctgttcgacgccgagctggccctgaggggcatcggccaggcggtgcgggtgctggcgggccagtcgccgcccgaaccgttgcgccaggcgctggcggtgggtctcctgctggcccgtgacacccctgtggcccacgccggtgggctgcggcccgcggtggggacgatccgtgagcaggccgacgtgatcctgcgcgacccgcacgccgacccgagggccgccgagtccgcggccctcgcccgccgggtcgccgaactcctcgactccctggcggactccctggtcagctggctgaccctcggcgagcaggcgcccgcctcctccgccgcggtgcccttccagcccgccgtcgcgctggagaacaaccggataccgggttccgccgcaccgatgcggcgcgtgctcagcgcgcggacgcagagcggctggcagcgtgccgtcccctacctgcgggccccgctgcacgcgggggtcgccgccgcgatcgtctgtccgatcgccgacgccatcgacccccggcgtttctactggggtctggtcggcgtgatgatcacgctgttcggcacgaacaccacccccgagcggctgcgcaagttcggccaccgcatgatcggcaccgtcgtcggcgcggtgatcggcgtactcctgctccatgtgaccggccacgaccacgtccactggacgctcgtcgtcatcgtcgccggtctctccttcggttcctggggcctgcagcgggcgtacgccctgtgggtcgtcgggctggtcgtcgcgctcgtgcagctctacgggctgaccacgccggacagcggcatggaccacctgctcggtgaacgcctgctggacaacggcctgggcgtcctggtcgcgacggcgtgcgccgcgctgatcttcccgctgtccacccgggcggtcgtccgcgaggccgagcacggatacgtccaggcggtccagaacctcctcacccaggtctcggcgcgctgggaggagccggacagcccggtgcggctgcgcggcgcggcacgcgtggtcgacg

SEQ ID NO: 482 - DNA, 7961 bp, Unknown
  Kingdom: Bacteria, Phylum: Actinobacteria, Class: Actinobacteria, Order: Streptomycetales, Family: Streptomycetaceae, Genus: Streptomyces
aggtcggtgagccgccgtggccccgaaccgcagcggcctcggcggctcaccgacctgggaacgctccagctcctccagtcgtcgggcggcgttgcgcacccgccgggagatctggctctgcacccggccggcccggtggccgtagcccatcttctcgttgtcgcgcggcccgcggtccggcgccacccggcgcgcggtcacctgggccgtgaccctgagcgccgccagttcctcctgttcctccgcccagcgtcgctcccaccgctcccgctcggcatgtttctcggcaaggtaggcgctgtagttgccgccgtagcggacggggccgtccatcgacgggtcgaggtcgatcaggtccgtgcacaccgcgtccagaaaggcccggtcgtggctggccagcacgacgaccccgggcaggccgcgcacctgttcctcgacgaaggcggcggcctcgtcgtcgagatggttggtcggctcgtccagcagcagcgcggagggccgccggatcagcagcgcggccagtgcgagccgcccgcgctgcccgcccgacagcgacccgaggctccgctcgtgtccgaagccgccgaggccgaggccgtccaggacgagtccggcacgccggtccgcgtcccaggcctcccgctcctgggcctgttcgagccggacaccgtacgcgtcgagcagtacggcgtactcgggcgcgtcctgcgcggtgcgtgcgagctgttcggtgagccgttccagttcggcgaggtccgcacgggcctcgcgcagggcgtcgtcgagcacgtcggcgatggtcgtcccggcctcgtacggcatctcctgctggaggaagcccaggtcgggtgggcgggtgatgctgccggcgtcgggttcgtccgtcccggccagcaggcgcagcagggtcgactttccgacgccgttctccccgatcagaccgatccggtgcccgggggaggcggtcagggagacgccgtcgagcacccggcggtcaccgagggtgcggacgaggtcgcgggcgagcagggcagggtgtgacatggggaaccgtccgaggcgatcggtggtcggcccgcggggcggtgtacgcctcggtcgcgggccaggtcggcacaccggccgctcacacctcgggcgccgccgtctcctgcagctcgccgtcggccaggcgcagccaccggttcacaccgatctcacgcaggaaccgctggtcgtggctgaccaccacgaaagcgccctggtaggagtcgagggcgctctccaactgacccgcgctgaccaggtcgaggttgttcgtcggctcgtccaggagcagcaggtggggagccggttccgcgcacagcacacaggccagggtggcgcgcagccgctcgccgccggagagcaccccgacgggcaggtgtgcgcgggcgccccggaagaggaagcgcgcgagcaggttcatccgctcggcctccgggcgctgcggcgcgtagtcggcgaagttctcggcgaccgtgcggtccaggtccagcaggtccaggcgctgcgagaggtaggcgacgcggccgtcggcccgcttgatctcgccctcgtccgcgagcaggtcgccgctcagcagccgcagcagcgtgctcttgccggcgccgttgggaccggtcagcgcgatgcgttccgggccccggacggtcaggtcgacgcccgccccggcgaacacgtccttgtcaccgagccggacgcgcagcccctcgccgaggaacaggttccgtcccgccggcacgttggtgtcgggcagctcaagggtgatgcgctgctcctcgcgcagcgcgcgcccggcctcgtccagcttggccttggcctcgctgacgcgtcccgcgtgcacctgtccggaccggcccgcggactcctgcgcgccgcgcttcatgttgcccgcgaagatacgcggcagacccgcgttcttcaggttgcgggcggcgttgctctgccggcgctcggcgcgctcgcgggcctgctgcatctcccgcttctcccgcttcagctcctgctcggcgttgcggacgttcttctccgcgacctcctgctcggcccggacggcttcctcgtattcggtgaagttgccgccgtagaagcggagttcagcgcggtcgagttcggcgatgcgctccatgcggtcgagcagggcgcggtcgtggctgaccaggagcaggcagccggtgaagtctcccagcacgtcgtagagcttgtgccgggcgtcgaggtcgaggttgttggtgggctcgtcgagcagcagcacgtcgggccgcttgagcaactgggcggcgaggccgagggagatgacctggcctccgctgagggtgctcaggctccggtccagggtgaggtcggccaggccgaggcggtcgagctgggcgcgggtgcgctcctcgatgtcccagtcgtcgccgatggtggtgaagtgctgctcgtcgacgtccccggcctcgacggcgtcgatggcctggatgaccgcggccacacccagcacctcggcgaccgtgagatcaccggtcagggggagggactgcggcaggtagccgagggtgccggagacggagacggaaccgctgccggggcgcagttcaccggcgatcagcttgagcagggtggacttgccggtgccgttgggcgctacgagaccggtgcggccgggggtgacggtgaaggacaggtcctggaagacgggggtgtcgtcgggccaggcgaaggacaggttcgagcagacgacggaggcgtcggacatggaggtgacctcgtgaggagagggcggggcacggaagacaggtgtgccccggcggaagacaaggggcgtgaggggacgacagagagaccacttcggcggcgcctcgtacgcaccggccggtggcctgtcgggtccgggtatcacccggagatgtcgtcgtccaccaccatgtctggtctcctcaggaatgggtcaacgtccgtatcagcctaacagcacgggcgcggggaccggcttgtgatttcgccgtccgcgcggggggtccgcgcgcggacggcggatcgggtcatggctcaccgcccgcgcgggcgggaaccgcgcgggcggctccccggccggtcgtcctgcgcccctccggacaggcacctctcgggcaggcctgtctcaggacagacacatatcaggggcagtcgcctctcagggcagtcgccgctcagggcaggagcagcagcttgccggtggtcctgcgcgattcgatgtccctgtgcgcctgcgccgcgtccgccagggcatagcggcctccgatgcgtacggtgagcttcccggccaggatcaggtcgaacagctcgccggtccgccggaccagggcttccctggtgggtacgtgatcgaacatcgtcgggtacgacagcaggatgctgcgcggcatgtcggtcggccggagtgtgggaacgcccatgacggggccgtagtaggcgtgcacgccgtgccggcgcagggagtgctgcgaggagcggaacgtctcggtgccgccgccgtcgtagacgacgtgggctccctcgccgccggtcagctccatgatccggtcctcgaagccgccgccagaggagaccaggacgtggtcggcgccggcctccttggcgatggcgaccttctcctcacgggagacgaggccgatgacgttgccgcccctggccttgatcaactgggtgaggagcaggccgactccgcccgccgccgcgtgcaccacggccgtgtcaccgggtttgatggcgtaggtctcggtgctgaagtggttggcggtgagcccctgcatcatgatggcggcggccgtctcgtccgtgatgccgtcgggcaccttgaccagcgagtccgtggggatggcgagcagttcggcatagctgccccggtggtagaaccacgccacccggtcgccggcggccaggtcctcgacaccgtcgcccagggcggtcacgtagcccatgccctcggcgccgaggacgagcggcgcggcccagccgggcgcgccctggccgcgggcgcccgtgtccatgtagttgacgcccgtgacaccgagcctgaccagcacctcgccgggaccgggcgtcgggtccggcagctcggtccactccatgacctcggggccgccgtgttccttgatgtggatcgcatgcatggggtgatacctctctgcggagagaaacgtgtcgtgaagcggtagtgatacggaccgtagaagccagaaaatggacctgcaagtccaaaactgccacggcagcccaccgcggtcggcggcgagacgctcgaagtcaacaggcgccagaagggcgccggagagcgggccgccctggagatctggcgcaccggcgcccggaagcagagcctggatctgctggccgaccgcggcagcctccacgccaccgatagcgccgaagaggcccgccgcggcatcctcaccgcctggaaccagacccgcacccgctacggcgacgcgcacgacatgctcgacaaccttgttgtgctggccgcacgcaaccacgacgtcaccctgctgaacgccggagcacaggccctgcgccgggccgccggcgaactcggccgcgcccaccgatacgccggcggcgacgctctcaccctggccgtcggcgacatcgtgcgcgtacgcgccaacgactaccgctcccgtcgtggcaccgggcccgacgtcccaggccgaccacagggctgtgaaagccgaggccaaggactcgtcgaaggcccggcggtagcccggactaccgggagcccgccacaggctgccgcttgtagaaggactcctccaggtaggcggcctcgtgcggcaggtagggctcctccaggtaggcggcctcgtcttcgtcgagttcgacgtccaccgcggcgagcgcgtcggtcagctgggccggcttggtgaccccgacgatgggcgaggtcaccacagggttgcgcatgacccaggccagggcgacctgggccgcggacagaccccgcttgcccgcgatctcgtggacgcgttcggccaccgcctggtcctcgtctcggtagaggatcttgtcgcccgcgtcggtctcggcacgcgccgtggcggtgtcgcgaacccgcgtcagcctgccccgcgccagcgggctccacgggatcacgccgatgccctggtcggcgcagagcgggagcatctcccgctctgcttcccggtgaatgaggttgtagtggtcctgcatcgacacgaaccgggtccagccgttcaggtcagccaggtacagggccttggcgaactgccaggcgtgcatggaagaggctccgatgtagcggaccttcccggacttgaccgcgtcgtgcagcgcctcgagggtttcctcgatcggggtgtcgtagtcccagcggtggatctggtacaggtcgatgtagtcggtccccagccgcttcagggaggcgtcgagctcggtgaagatcgctttgcgggacagcccggcgccgttcgggccggggcgcatccgcatccagaccttggtggagagaacgacctcctcgcgccgagtgaagtccttgaccgcctggccgacgatctcctcgctgcttccggcgctgtacccattggccgtgtcgaggaagttgacgccgccctcaatggcctgcttgatgatgtcccggctggcgtccgcgcccagcgaccagggctcgccgccccggtccggctcgccgaagctcatgcagccgagggtgatggcggagacttccagtccggtcgttccgagtttgatgtatcgcatgcctccgaacctaggaactgaagtgcgctctaacacaaattcgtctcggtccggagaagtgcgctggctgcaactgcagcggcccctgccagcatggcccaccaacgcaagaaggatcatctctgaccggcatgtactcgcccaggcgattcgcgcccccggcggtacctgggatccgcagcgtgccatcaaggctctgggcgaccacggtcacacgtgggaagaccaacaggcagcggagaatcgggtccggcaggtcctgcgcgacttgtgcgcggacgggctcatcgtcacaaccgaccctcaacgggctgtctacgacctcgttcaggagtagagccggagacgcgacggtacccatcagacacagatcacctggcgccagggcggccggcaggccaccccttggggatccgaagaccttggctgaaagggtggcaaggtcgtcggggtcgccgtccgctgaccaagacggagaacatcgcattccgggccgcggcgtacctggtcgcctctacagttgcgacatggagttcaaccggggtgactggatctgggaactgatgctgacgaggcgtccctccgacacacacttctcggagtcgagcactccgggtggagagagtccgctggcgcgggacgacgacaacaagctcgtcacgcacgccgtgctgttcgacgggaccaaggcggccctggtgatcctcggcacgggcgtcgcgctgggggccgccgcgatgaaggccgcgccgcacgtcaagagcgggctggtcagccttaagtcgaagctacgccgccgaggggaggacactcccgacgtcgagacccccgttcccctcacggtggttgcggaggtcgagccagagcagccggactctcctcgactgcgcgctgtctgaccgtcaggccaggcgccggcgcgtgcccgggtagatccgcatcacagactgtccagcacccttgcggtacccgcatcactgcgactggcgcggtgcgggcggtgggtccccgcactccccgggccagggcctcggctctggcccgtacgtcctcgggggacctcgccaaagcctcccaggtcgacggcgcctacaccgagagccccgccctggagcaggcccgccgtcttgacgtgctgatcgccctgaacatgcagacaagccgatcgcccacgaacacggcgggccggttcggctctgcgtggcccccacgtacttctgcaagtcggccaaatggctgtccggcatctcggtcaccgacacggtcgtcccggcttctgggaggagcgtggtcatgcgatcgacggctggctcgacggcgccgaccggcacgcggcctgaaggatccggccgcatcaggccgttcacccccgccgaacgatgggtccaccgggccaccggtcacctgatgccgctgtgcctggtcaccgcggcctgtctctccttcgggccgctcgcccagctggtcggacggcgccacaccatggtcaccgtccacgagcggtcgggcatcctgctgcccgtgccggtcctgctcggcctgttctcgcccgccttccgcgcggacctgcgcagactgaaccgtttcgcggtctacgacagacggtggctgcgcgcggcccgccgccggctgcgcgcgccggaagcacggcctgccgggaagttcaacgcggaccggaagctctacgcgggccggaagctctgcgcgggctggatcgccggtgtggtggtggtgatgacgttcaccggtccgctcatgtggatcacggcctgctgcccctcatctcccgcaccagcgcgatcttcgtgcacgacctactggcctgggcgatcgcgttcgtcctcctcggtcacctgcgcaaggcgcacgaggacctggaggcgaggctgggcaggcgcaccggttacgtcgaccgcgtctgggcgacacgccaccacgccaagtggctggagcaggaacccgtgggtaacgtgtccggaaagacacgtgagaactgtgggaacacggacgacggcggagacatgcgagtacacgtcgcccgcccgagcgccgcgagcaacgcggacgacggctgacacgggatcccggtccccctcccctggagcaggaaacacctccgtgagcggcagcagaccagtccaggacgaccacgagggcggccccgccgggaccctgggcgatgacctggcggcggc

SEQ ID NO: 483 - DNA, 5552 bp, Unknown
  Kingdom: Bacteria, Phylum: Actinobacteria, Class: Actinobacteria, Order: Streptomycetales, Family: Streptomycetaceae, Genus: Streptomyces
caccacccgcgtgctgcccgcgggccagccctgcgggcagcacgcgggtggtgtaacggcgttcggactccaggcccttgccggcgccgacgctgcgcgcgaccagggccttggacaggccctcggcgtaggcgcgggtgcggaagtacccgaagtgctcgcgcgcccgcggcacccggtggtggatgacggcccggtcgtcgatcaggaggatcgcgtcgggcagggcccgggtgaggcggatgcacagctccgtctcctcgcagcccaggggccgccggtcgccgtcgcggccgatgccggtggcgaagccgcccgccgcgtcgaaggcgcagcgccggaaggaggcgttgccgccgaggacgttgcgcacccggacccggcccggcggcaggcccttgtaggtgcagcccaccacccagtcgaattcctccgggaaccagagcggacggcggcccgaggcccaggcgggcatggtccggccgcccacggccatcacccgcgggtccgcgtacccctcggcgaagcggcgcagccagtcccgttcggccaccgcgtcgtcgtcgaggaaggcgatgacctcgccgcgggaggcggcgatgcccgtgttgcggccggcggacagtccgcgcgggcccgcgttggcgagcacccgcacgtccccggcctccttgtatcgcctgcccagccggtccaggagtgcctggttgtggtcgacgaccagcagcgtctccagggccggccgggactgcgcccgcaccgaggagacggccgcgaggatgtcctcccagcgctcctcggtgtagacgcagatcacgacggagatgccgggaccgctcaagacgtctctcccaggtccggcgggaaggaggcgagcacgggggagtggcgttcctgccggcgcagctcacgccggttggaacgctccgcgaggatcaccctcagcacccgcaggccgtcgcgcacggcgcgcaggttgctggcgccgtggatgcgcaggtactcgtagctggggatctcctgcaccttcagcccggccttgaccactctgatgttcatcagcgtctcgacctcgaagccggtgcagtccagctcgatcttgtccaggcagtgccgccagaacgcgttgtacccgtagcacaggtcggtgtagcgggcgccgaacttgcggttgacgacggtgcacagcgcccagttgccgagcttgcggacgaaggtcatgtcgtcggtgccgccgccgttggcgaagcgggagcccttggcgaagtccgcgcccgagaccagcgcggagacgtagctgacgatctcgccgccgtcggccgagccgtcggcgtccaccatgacgatgatctcgccggtgcacgcctcgaagccggtgatcagggcgtcgcccttgccctttccctgctgccggacgacccgcacctcgggccacagatcacgggccacttccacggtgttgtcggtggaatttccgtccacgagaacgacttcgtgtatccaccggggaagtgtcttgaaaacgtagggcagattttccgcctcattcatggcggggatcacgacgctcacctcaggcgcgatggccagatgagaggagatcggccggtattgcgtgtcgatggacggatcccggcccgaagacggcgggtggagaacggaactcatgactggtttccctctcgtccggcggaccgcccgcccctcgggcggcccggctgtgtgtccggttcgaaaggggggttctcatccggaacgcgacggaattgatctccggaccgatcacggacacggaattgctccccgtgtcgctcgcggtgtcgatctccgtatcggtatccgtgcgtgacggctgagttggcaaagctggccgacgtgccggaaaacggcagccgaccgcgcggcacggcccggtcacactgtgatcaccgggcacggcacccccctaccgcgccccgcgccggatcgccgtggtcctcgagccctccccatgaaccatgtgccgacgaccgatgcgggtgagatgtacgacggtattgacgattgaaccattatggcaagccccggaacgggcctcacgtttttgttggttctgccgttgcccaattttgggccgtcgattcaattcctcgaacggatcttccctatccgtctcagaattctgtccgcgggttcgaacagttccggccgtgactgcaccgcattgcgcagtgcccgcaccggagcgcgtcgagcccggtgtcccagcgccaccggatgacgtctggtcacccacccctccgacacgcggagttcccgcgtcttcagggagtccttgtattccttctggccccggccgagatcgagatgggcgatgccgtccgcggcggccgcctcggccatccgcaggtgcagaacgagcccgggggagtacttcgcgtacgccgggtcgtaggccgggaaccagcacgccagcacccgctcggtgcgcagcccgaagtgggcggcgacgggccggccgtccgcgtagagcaccgacaggatcccggcgaacggctccgagcgggtgtggaacagccgggtgaccagctgggtgatccacgcgtgcgcgaagcggtcactgcgcccggtccgccggtactgcgccgacttccaggccatcagggtgtccagtacggccgggtcgcgctcgtcgtggacgtacctcaccccgcccgcgtcacggcccagccgccgctccttggcgagcgtggtcctcgcgaacttcggtgagcgggcgcgcagttcgcgcagatagacgtcgtagccccggtcgacgtccatgaccggggacgggaaggtgccggaggcttccgcctcgaacggccgctggccttccaccaggtgatcgaactcccatacggcgagcccgcaggcccgcagcagttcccgggcgtcccaggtgaacccgggccggtgcaccatgccctggcagtcggagacgccgagcccgacggcccggcccaccccggcggccgatctctggaacgggaagaaggcggccggctcaccgccctcgcggatcaccgcgatccgcaccccgcgtctgcaccgccccacggccagcgcgaactcgggggagaggaacgggttcgccaactcctcggctccgtgcagatgagccttggactgcatcgccgtccacgccgcccggtcggcggcgctcagctcaccggcccggtacaccctgatgtccacgtcacgatccctgtcttctcgccgtacggccgcgtggccgccgcagggacgcgagccccaggacgagggcgctgaacacggccacggccgcgatcccgccgtccacggaccagcggtgcaccgccagcatcgcctgggccacgagcatgtcgagggcgaccgcgcccgccagcgaggcgagcacgcgaccgaaggggtcgaggccgcgcaggcaggccgcgatggccccggccggtgccgcgagcaggaagaacagggccaatgggccgcgcaggacggagccggagccggtgagcgcgaggaacgcgccgagggccgcgagggccgtggcggcgcccgcgagcagtggcgacaggcccctggccggactcggtcgcgcgcgctcggcgccgtccgttgaagtggtgttgacgcgtaacgtctgcattggcgactttgccccccgaagcgccggatgccgggcttcaatgtcgcgcagccgcgcgggggccgtcaagacggcaaggtcgcccatacgggttcttgtcatcctttgacccggtgttcaccgaggtagccgacagggtgccccgagcgtccctactcccttcgatttcccttgagttcgcgacttctttggcatgaacacttccagtcgacgcgcgtagctgctaccacgggatgcggcagagaagctgctaaagggaggttccatgagacgttcccgaattgccgcacatgtcggttcacttctcctgaccgtcggtctcgtcctcaccgggacggccgcggcgcaggcagcgcaaccggccactacggggggctatgtggccctcggtgactcctactcctccggagtgggcgccggcagctacatcagctccagcggcaactgcgaccgcagcacgaaggcgtacccctacctctggaacgccgcccacgccccgtcgtcgttcgccttcaccgcctgctccggcgccaagacggacgatgtcctcgccaaccagctcggcccgctcaactccaccacatccctcgtctccatcaccatcggtggcaacgacgccgggttctccgacgtcatgacgacctgtgtgctccagtccgacagcacctgcctctcccgcatcgcgaccgccgaggcctacgtcgactcgacgctgcccggcaagctcgacaacctctactcggtgatccgcggcaaggcgccctccgcccacgtcgtcgtcatcggctacccccgcttctacatgctcggccagacctgcctcggcctctcggagaccaagcgttcggccatcaacggcgcggccgaccgcatcgacgccgccatcgccaaggtcgccgcgaaccacggcttcacgttcggcgacgtccgcaccaccttcagcggccacgagatctgctccggcagctcctggctgcacagcgtcgactggctcaacatcggcgactcctaccacccgacggccggcggccactccggcggctacctgccggtgctcaccaacgccgcctgaccgcctgcccgccgaggccgggtacgtgagatcggccacgttccggcggtggtgaggacagaggtacgcgacgcccgtccccgggtccggggacgggcgttcgcgcacccgggacacgccctcggtccaccacggtcccagcggagtgccgcatcactcgccgtgaccgtacaccgctgcccgaagaggccgcgggccgcctgccagcccttgtccaactcgccgcggaaccggtcgcattcggagagtagtcgtcaacccccttacgcagaaggtgaatcctgtgaccgtgatacacgcatgcccgtgcggggcgatagggttactctgcccgggccgggtggactcgtacgggtggggagtgacatggagcagataacagtgcgcagcagggcgagagtccctgcgatcacctgcggaagcagcgcgaccagctcgcgcctcgaccgccatctcgcggtgctgggcggtcccgccgtcccgcagcgtgaggcagccgaggcgacgctgctgatgcgtgaactgaccgcgcgtgacgtgcacgaccgcacgggcaggggtgcgcggatgcgccgggtgtcgctgttcgcgcccctgcgccggctgcgccgctcgctgttcggcgggcactgagcgacaccgccgtctccggcctctccggcactccggagggtgccgtggacgttcctggacctgcgtcccgaaggacccgggtccgggaccggcacgcgaccggatcggcccgttcgaccggatcaccacgccgtccccgcgcggcgccgcgccttcgccgtccaccgtccgtcatccccacggcgcgcggggacggcgtggtga

SEQ ID NO: 484 - DNA, 5076 bp, Unknown
  Kingdom: Bacteria, Phylum: Actinobacteria, Class: Actinobacteria, Order: Streptomycetales, Family: Streptomycetaceae, Genus: Streptomyces
gcgggcgacgtcgcccgctggtaccaccccgtgctgcgacggcacctgcggatcgaacaccgcatgaacgccagcgagcagggcctggccgccgcccgcaacctgctggccgagctggatccggagcgcttcggcgaacgccgtccgttcgcgccggtgccgtacttctggtccgaccagtacgacctgaagctccaggcgtacggcgtcctggccggcgcggagcaggtccaggtgctgcgcctcggcaaggacccgctgcggctggccgcgctgtacggcaggtccggccacgccaccggagccctggccatcggtctgccgccacgccaggccaggtccctgcgcgcactggtcgccacgccgtcggcctggccggaggccgccgcacggctggctgaggcagtggagggctgagccggtggacggctgagtcggctgcccggtccgcgtgagcggggcggccggccggtcccatgcggggtgccagacctgcccggcagggcccggatcgcgcgacgcaccggctcggtgacggggtgtccgacggaaaagtgggcgcggatgccgcgcgagcgcagggcacgtcaggggatgccgcagcgacgccaccgggcaggggcgggggcaagatcgatcttgcccaattgtcgcaattgtgcagaaacgatcttggtaagcggcctcgctccccgcgttcccctgctgcacgggcggcgtagcggtccggtgtgtcgactggtcgggcatgctggaggtgttccgccctgtgacggggacggagcggtccggggcggtcgacttctgccgatgctgcggccgccccggacactgcccaccgcggtggtttgctactcgatcgggtcgcctgacgtggccgaggtcggagtagggcgctcaccccaggctgagcaggatgatggcggcggccgaacccaccaggcccgtcgcctgtgcccgggtgaccttctcgcgcaggaccgcgagtccgaggatcgtcgggacggccgggtagagggaggccaggacgacagcgatggccagcatctgcagtcgcgtggcccacaggtagaggatgaggccgagggcggctcccgccccgatcaagaccgcccagcccaacgacctggcggatcgcctgaactcagcagtgtgccgccaggtggtcggcagaaggagcagcacggcggcgaggcggccgacggccacgggccagagaccactcgccggatccacctgggcgaggccgatgtattgcacggccacccccaagctggcgaccaggccatctgtcagtgccggaccggactgcgtccctcggtcgggtccgcggccggtgccgccggcggagacgagccacagggcgggcacggtcatacagatgcccagccaggccagtggtgtgggacggtcacccaggaacaacaccccgcaccatacggagagggccaccccggtgacggcgctcacgggcatcaccacgctcatggcaccgcggctcagaccgcgattgaggaaatgcatggccgtggcgctgcccgcacccgagagcattccccacatcacatcaggcggccggaccgcgtcggcggacaacagaaaagcggctccgagcgcgagcagcaggcctccgacctgcccgaggaaggtgaccacggcgaagtggacccgacgagacagcagcccgccggcgaagtcgacgaagccgtagcagaccgcggaagccaacgcgagaaaggcacccatctgctccctgtgcccagcgccgccgtctccatccgccggggtagtcacgcttcgccgcccggcctgctctccacgacagcatcaccgcgctgctttcccagagcggacacgcatgcggagtgatgtgggtgtcggtccgtcaggcgttgagagtccgactctcgccccacttgcttggagatcaacttgcttggagatcaaccaagtggcggaagatcagacaaggatcgtgccctcctgctgaggtgttattggggcggagcggtgtcgtagtcgtgccgggcctgctcgaccttgtccaggttggcggcggcccattgggcgaggtgcgcgaagagcggggccaggctgcggcccagctcgctgatctcgtattcgacccgcggggggacctccgggtggtaggtacgcacgaccatgccgtcgcgttccagctgccgcagccgctgggtcaggaccttcggtgtgatcgtgccgatccgtcgttgcagctcgacgaaccgctgtcggccgtacgtgttgcgagtccacaggatcggcgtggtccaccggctgaacacgggccgtatcgggagtggcccttggggtgtctcgttaactggagcgggcaagtttgcctcgcaagatcggcagcggccggtggccgagtgctggtagtagtcggccatggcaggagacctgtggaccccggtgatttcgatggtcggtgtggctgtgggaggtgcgttgacgtatctgacccaacgcacgacgcagcgggcagccgaccgcactgagcaacgaagacgggctgcgacgctggcgcaggagcggcgtgccgagcagatcaggaccctgctggagttcatccggtgtgcgttggaggccgagggcgtggctcatgcgcggccgccccagtgggaggtcggtgatgagtggtacgtgacggccaggccggcgatggacggtcttcgcatagccgagaagggcgtcgagctgctgtgtgcgcccgacctccacggaccgacggccagctatgcccgcgccctcaaccaggcggtctggcaggagcctgacggcgggaacctggccgagcgcctggaaccgcacaaggcggattttctcgctgtcgcacgccgcagcctggcctgacaccgctggtcacagccactcgttgatcgcggccaccagcacggtcgcttcgtagcgcacggccggcttcatgtcgcgcggccaccgccctgtgcctttcgaggcggttgatgccgcactcgacggcatggcgctcgcggtagaggtccagcggttccgtgagcccgggccgtctgccgacggaaccgagggcggcgaggaggcgcagtgccgagccgcgggctcgtgggtcggccgcaccggccctggtcagcttgtcgtggacgagggtcctggcctggtcagggctgccgagacgcagggtcgcggtatgcggtggtcccggtcgaagggcgtgacaggctgagccgcgtccggactcacagggagcccagccggcgatcgagcgcggcgccgacgtcggggcagttctcgcggacgcagtcgaggaaggcacccaggacgggcgagcggtcccggtcggggaaggacaggaccaggtcgggaagcgccgtgcgcggggtcacttcgcagaaccgggtccccgggcgcggggcggacagcatgcgagagggcccgaggcccacgccgaccccgcaggcggccaggccgatgatcgtgtgcacgtccctggcgatggtcgcaccgtccagtgcggcggcgtcctggtccagcaggatgcgcaacccggcggcgaccgcgggctcgtcctctccggcggccacgatcagcggctgcctgcgcaactgatccacgctcaccgacgcctgacccgcgtaaggatgcgcgctgctgacgacggcgatcagacggtcgtgccctaccgggacggacaccaggtgctcggccccggccccgcggggcggtcccagggtgacggccacgtccagttctccggcgatgagtgcggtggcgctgcggccggatgccatctcgtgcagttccagccgtacatcgggccgctcgcggccgaaccggcccagaacgtccggcagcgggtcgagcaacgcggaggccacgaagcccaggcgcagccggcccgtctcgccgcgtgcggcccggcccgcgtcgaccgcggccgctgtcatctcctccaaggcccgtcgcgcccgggcgaggaacgcctcgcccgcagcggtcgggaacacgccgtggtgcgtgcggtcgaacagccgggcccccatctcgcgctccaggtcggcgatctgtttggacagcgggggctgcgcgatgcccagcgcgcgggcagcccggccgaagtgtccgtgctcggcgagagcgagtgcataccgaagatgccgcgcctccatgcccctcctccatacacaaaaggtatcgccggccagtgtgtcatctctttcactggatggcgttgccgtcgccgactgggatgggagccgtgacagcccttctgaactccgcgaaaaccgatctgcacaacaccgtcttcgttctcgtccacggcgcctggcacggctcgtcacagtgggcggcgacgcagcgcgcactcgccggtctcggtgccgcgagtgtggccgtagacctgcccgggcacggcttcgacgctcctgtgcccagtgggtacctgctgcctggccggccgggtctgctgaccgagaggtcgcggctcgccgacgtgacgatggacgactgcgccgatgccgtcctggacacactgttccgggtccgccgctacggccgtgtggtgctcgtcgcccacagcgcgggcggcggccccgcgtcgcttgccgcagagcgcgcgcctgaactggtcgaccgcatcgtctacctctccgcgttcgtccccgccggccgcccccggttcttcgactacctcggcgcccccgagaactccaccgcacggggtcagggcctcaacctcggtgatcccgaggcgctgggcgccgtacggatcgaccccctctcgccggaccccgcctatgtcgaggagttgcggcagacccactaccacgacacgcccgccgaccgcttcgaccgctggcgctccgcgctcagccccgacctgccgctggccctgccggcgacgcccgtcgtcctgaccgcgggtcggtgggggcgtatcccgcggacctttctgcgctgtgcggaggaccgggcgctgccgacggccgcacaggacctgatgatcgcggaggccgaccgggccatgccgggcgagccgttcaccgtccgcaccctgccgggcagccacagcccgtt

SEQ ID NO: 485 - DNA, 12129 bp, Unknown
  Kingdom: Bacteria, Phylum: Actinobacteria, Class: Actinobacteria, Order: Streptomycetales, Family: Streptomycetaceae, Genus: Streptomyces
  misc_feature (663)..(664): n is a, c, g, or t
ccccgcgcggggccggcacgtacccggccggacggaaggcaggtcagtggtgtccgcttggatgttccccatgaccgtccacgacgtagctcgcagtctgcccgatgttccctccctgcgcgatctctgccgcgccctggcgatggccgaagccatcgtgaaccccggcagcgacgagcggatccacacgttccaccccagctggtcgcagacagaagaactggcctcgatgctgaacggctcgggggacgagttcgctgtcgtcttctcggccgccggcgcctacatacgcggcttcgatcacgagtcaccgctcagcccctaccgccacgacgacacccccgagccctggcccggggtggtggaccacgtacccgcggccttccggcagtacgtacacgagcccgccttcacggacgaggacggcacccccgtggtgacggtgtgcctgtggcacgaggcaggcacgggacgctgggaggccggagagatcgacttccccgaagggcacgccgatcccgacggctcgacctggctgttcggactcctgacggatccgacccccgaagccttccaggccttcgccgaggactactacgggatcgcggtcgacgttgaggccgtacggcgcctctaccgtcagtgcccgctggaccgggcccnntcggctaccccgtgggcccggcgctggcgtccgaggccggctgacgcccggccccggctcagccggccggggcgggcgtgggcccggcaggatgctcgcgccgtacaccgacctctgtgcgccaggcggtgagttccgctgtctcgccgtcttcgtcagcccggcgccggccgcagcctcagccggccggcgccggcttcttgaccgtgagcggcagcagcttccgccccgtagggccgatctggatgctcgtgtccatggcagggcacacgccgcagtcgaagcaaggcgtccagcggcagtcctcgacctccgtctcgtcgagggcgtcctgccagtcctcccagagccagtccttgtccaggccggagtccaggtggtcccagggcaggacctcctcgtaggagcgctcgcgggtggtgtaccagtcgacgtcgacgccgaagggggccagtgccttgtccgcgcaggccatccagcggtcgtaggagaagtgctcgcgccagccgtcgaagcggccgccgtcctcgtagaccgcgcggatcaccgcgccgatgcggcggtcgccgcgggagagcaggccctcgacgatgccgggcttgccgtcgtggtagcggaagccgatggagcggccgtacttcttgtcgccgcggatcttgtcccggagcttggccaggcgggcgtcggtctcctcggcggagagctggggcgcccactggaagggggtgtgcggcttggggacgaaaccgccgatggagaccgtgcagcggatgtcgtgggagccggagacctcgcggcccttggcgatgacgcgggtcgccatgtcggcgatctgcaggacgtcgtcgtcggtctcggtgggcaggccgcacatgaagtacagcttgacctggcgccagccgttgccgtacgcggtggcgacggtgcggatcaggtcgtcctcggagaccatcttgttgatgaccttgcgcatgcgctcggagccgccctcgggggcgaaggtcaggcccgagcggcggccgttgcgggtcagctcgttggccaggtccacgttgaacgcgtccacgcgggtggagggcagcgagaggccgatcttgtcgtcctcgtagcggtcggcgaggcccttggcgatgtcgccgatctcgctgtggtccgcggaggagagggagaggagacccacctcctcgaagccggtcgccttcaggccctgctcgaccatgtcgccgatgcccgtgatggagcgctcgcgcaccgggcgggtgatcataccggcctggcagaagcggcagccgcgcgtgcagccgcggaagatctccaccgacatgcgctcgtggacggtctccgcgagcgggaccagcggctgcttggggtagggccactcgtccaggtccatcacggtgtgcttggacacgcgccagggcacgccggacttgttggggacgacgcgggcgatacggccgtcggggaggtactcgacgtcgtagaagccggggacgtacaccccgccggtcttcgccaggcggaagaggagttcctcgcggccgccggggcggccctccgccttccaggcgcggacgatctccgtgacctccaggaccgcctgctcgccgtcgccgatgaccgcgcagtcgatgaagtcggcgatcggctccgggttgaaggcggcgtggccgccggccatgacgatcgggtcgtcgaccgtgcggtccttggcctggagcgggatgccggccaggtccagggccgtgagcatgttggtgtagcccagctccgtggagaaggacaggccgaacacgtcgaaggccttcaccgggcggtggctgtccaccgtgaactgcgggacgccgtgctcccgcatcagcgcctccaggtccggccacacgctgtaggtgcgttcggcgaggacgccctcccgttcgttgagcacctcgtagaggatcatgacgccctggttgggcaggccgacctcgtacgcgtccgggtacatgagcgcccagcggacgtcacactcgtcccagctcttgacggtggagttgagctcgccgcccacgtactggatcggcttctgcacatgcgggagcaaggcttcgagctgcgggaaaaccgactcgacagtcatcgcggggaactttcgtgagctgacaggggtgaccctcaagcctaacccggccggaggactgccccgaacggtagcgggaggggacgtcaccggcgcccgccccccgacggggccggcgccagtacggtacgtcgtcctacgccgacatcggccgctgcaccctgatcgactgcagcaggcccaccgccacccagaccgcgaacatggacgagccgccgtaggagacgaacggcaggggcaggccggtgaccggcatgatgccgagcgtcatgccgatgttctcgaaggcctggaaggcgaaccaggcgacgatcccggcggccacgacggtgccgtacagctcggtggtctcgcgggcgatgcggcaggcacgccacaggacgacgccgagcagcacgatgatcaggcccgcgccggcgaagcccagctcctcccccgcgaccgtgaagacgaagtcggtctgctgttcggggacgaactggccggtggtctgcgagccgtggaagaggcccgcgccggtgaggccgccggagccgatggcgatgcgggcctggttggtgttgtagccgacgccggacgggtcgaggctggggttggcgaaggccgcgaaccggttgatctggtactcgtcgaggatgtgcagctgccagatggcgatgcagccgaccgcgcccgcggcgagcaggccgaacacccagcggttggaggcgccggaggcgagcagcacgcccaggatgatggcgaccaggacgaggaccgtgccgaggtcgggcatgagcagcacgatcaggatgggtacggcggccagtcccagcgcctgcaggaccgtgcggtggtcggggtactccttgtcgcccgcgtcgacgcgcgcggcgagcatcatcgccatgccgaggatgatcgtgatcttcacgaactcggagggctggatggagaagccgccgccgagcacgatccagttgcggctgccgttgatggtggcgccgagcggggtgagcaccagcaggatgccgaagagcgaggcgccgtagaggatcgggacggcgctgcgcagcgtgcggtggcccagccagacggtggcgatcatcagggcgaggccgatgccggtgttgagcaggttgcggacgaggaagtagtacgggtcgccctggttgatctcggtgcggttgcgggtggccgagaagacgagggcggtgccgatcccggagagggcgagcgccgacagcagtatcggccagtccaggcggcggacgacggagtcacgggcgagcagccgggtccagccggcccgctgggggccgtacccggggacggagaagttgttcgcgccggtcatgcggtggtcctccggcttcccccgcggtctccccggcggcgcgggcgcctgcgggtgtcgcggttgcccgtgggtgtgttggtggtcgccggtgtctgctggtcggcgggggcgttggtggtgccctgttcggcgacctgcttggcgatcttctcctggtccttggcggggtcgccggggatcttcggggcggggatgctgccgtcgggctggatcttcggcaggctcttctgcggggtgggcaggagtgccttcttgttgtcgatggagccgtcggcctgcacgccgtacagggagctgtagatgttgcgcacggcctcaccggaggcgccggagccggtaccggcctgggcgatggtcatgatgaccgtgtagtccttggtgtaggtggcgagccaggacgtggtctgcttgccgtagacctcggcggtaccggtcttggcgtgcagcgggatcttgtcctgcggccagccgttgaacttccaggcggcggtaccgcgggtggcgacgccggcgagcgcctggtccatcatgttgcgggtggccttggtgatgggcagcctgccgtgggcctggggcttgatctcggtgacgtgcttgccgtcggggctgatgacggccttgccgatggtcggggtgtacatggtcccgccgttggagatcgcaccgtagatcacggcctcctggattggcgtgagcagggtgtcgccctggccgatggagtagttgatctcgtcgccttcgcgcatcttgttgccttcgaggcagttctcgtaggcgatcttctccacgtaggtgccgttcttcttgccggacttgcaccaggcgtccttgttggcctcccagtagcgctgcttccactggcggtcggggacgcggccggtgacctcgttgggcaggtcgatgccggtctccttgccgaggccgaactggtgggcggtcttgaagaaccagtccttgggcttgcccttcttggggttgatgccgccgtccttcttccactcactgtccgcgaggccgtagaagacggtgtcgcaggagacctccagggcgcggccgagggtgatgtcgccgaagttctcgccctcgaagttcttgaaggtctggccgccgaccgagtaggagctggtgcaggggtaggcgccgttgaagtcgtagccggcctggaccgcggcggccgtggagaccaccttgaaggtcgagccgggcgcggactggccctgggtggcgcggttcagcagcgggtagtcggagttcttgccggtgagcttggcgtagtccttggcggagatgccgccgacccagacgttggggtcgtacgtcggcgcggacgccatggcgacgacccggccggtcttggcctccatgacgacgacggcgccggagtcggccttgtagttggtgccggtgatgctgtcgtactgctggcgggccgccttcatggccttgtccagctcgtactcggcgacccgctggacgcgggcgtcgatgctggtgaccaggttcgaaccgggctgggcggcgtccgacttggccttgccgatgacccggccgaggttgtcgacctcgtagcgggtgacgcctgccttgccgcgcagttccttgtcgtactgccgctccaggccggagcggccgaccatgtcggagcgcaggtagggcgaggaggtgtccttggcctgctggatctcgtcgtcggtgaccggtgagaggtagccgaggacctgcgcggtgttggacttgccggggcccgcgtagcggcgtacggcctcgggttcggcggtgatgccggggaagtcctcggcgcgctcgcggatctgcagggcctgcttgggggtggcctcgtcggtgagcgggatgggctggtagggggaaccgttccagcagggctgcggggtcttggcgtcgcagaggcggaccttctgctggatctcctgcgggtccatgccgaggacaccggcgagcttggcgaggaccgccttgccgtcgtccttctgcttgagcaggtcggtgcgggaggcggagaccaccaggcgggtctcgttgtcggccagcggcactccgcgggcgtccaggatggagccgcgcgtggcgggctggacgacctgctggacgtggttgccggacgcctccttctggtagtgggcgccctcgcggatctgcaggtaccacagccggccgccgagggtgccgagcagggagaggacgaggatctggatgacgaccagccgggtctggacccgtggagtccggccggtctcgggaatgttggtcactggtgctgcctccccctctcagtgtgtggacgagccgtgtccgcacgcggcgtgtacgcgggacgcgtcgtgccccgaggcgtcgtgtccggcgcagccgtgggacccggttccgttcaaccgccgtgctgtcacaggcgcttgacccccttgatgcggccgacccgggtggtgcgggtgcgggccttcgtcttcaggccgccgagcgcgccgcgctggccgccgatgcgcagtccggtgccggaggagagccagccggaggagatgtcggacttcttcgaggaaccggcctcggcgagcgggtcgttctcggcgcgccgggccagcgccatgatgccggggacgacgaacggggcgagcagcaggtcgtagacggcggcgctgatcagcaggccgggcaggcctacgtggcgggcggcggtgtcaccgacgagggcgccgacaccggcgtagagcagggtggagccgagggctgcggcgaccacgacggccatcgggccggtggcggacttgacctggccggtctcgggtttgatgagtccggcgaggtagccgatgacgcagaggacgagggcgtagcggccggcggcgtggtcggcgggtggggcgaggtcggcgaggagtccggcgccgaagccgacgaggcagccgccgacgtggccgtagaccatggccaggccgagcacggtgagcagcagcaggtcggggacggcgccgggcaggtgcagccgggccaggacgctcacctggatcaccagggcgaggacgaccagcacggtggagagcaggatccggttgagacgcatggggacttttctcgctcctactgctgctggccgtcggtggactgcgcgtcggggctgccgccgtccgtggactgcgcgtcggggctgccgccggcggtcgcggacggggtgaccgtcacggtgaccgtgggcgtcggggtcggcttgggcttgggcggcaggaccgcgtcgcgcgggtccttcttcggtgcctggacgacgacgccgacgacgtcgagtttgctgaagccgacgtacggcgtgacgtagacggtgcgggtcaggtcgccgccggaggggtcgacgcgggagacgacgccgaccgggacgccgggcacgaacggcttgtcggactgcgagccgaacgtgatgagccggtcgcccttcttcacctccgccttgccgttgaggagctggacgcgcatcgggcggtcgccctggccggaggcgaagccgagttcgtcgctgccctccatgcgggtgccgacggtgaagtcggggtcgttggcgagcaggacggtcgcggagtcggggccgacggtggtgacgcggccgacgagcccgtcgccgttgaggacggtcatgtcgcgctggatgccgtcgtgggagccgacgtcgatggtgatggtccaggagaagccctgcgcggctcctatggcgatgacctgggcgcccttgatgccgtactggccttcgccggccagcctcagcatcttgtcgagctgcttgagccggctgcggttgcggtcgtcgctgccgagcttggccttgagcgccgcgttctgcttctccagtgcggcgagccggtcgtggcggtcgccggagtcgcggaccgcggagaccgcgttgccgaccgggtccaccgcgcccgacacgccgttctcgatcgggccgaagacggtggcggcggcccgtcgggcgccgtccaccggggagttctccccgcctcggatgtccaccgtgatcagcgcgaacgctacggcgatcagcagcaccaggagcagccggctctctttcgtgtccctcacgtgcggcggccgtgcccttcctcgtaggaattcgggtggcccctggtcggcgccggtggcgaagcgcagacccgaggggcccgtttgtgggagcttatgcctctatatcaacgatccgccgtacgagaggagatcatctcgtacggcggaatcgaaaagttgcgtcatcggcgcggctgggcgtccagtacctgctgcagcgcctcgaactcctcgacgcacttgccggagccgagcgccacgctgtccagcggatcctcggcgatgtggatcggcatgccggtctcccggcgcagccgctcgtccaggccgcgcagcagcgcgccgccgccggtcagcacgatgccccggtccatgatgtcgccggacagctccggcgggcacttgtcgagggtggtcttgacggcgtcgacgatcgcgttgaccggttcctcgatggccttgcggacctcggcggccgagatgacgacggtcttcggcaggccggagacgaggtcacggccgcggatctcggtgtgctcgtcggcgtcgagttcgtacgcggaaccgatcgtgatcttgatctgctcggccgtgcgctcgcccagcagaaggctgtactccttcttgacgtgctggatgatcgcgttgtccagttcgtcgccggcgacgcggatggactgggcggtgacgatgccgccgagcgagatgacggcgacctccgtggtgccgccgccgatgtccaccaccatgttgcccgtggcctcgtggaccggcaggccggagccgatggccgcggccatgggctcctcgatgatgtgcacctggcgggcgccggcctgcgaggaggcctcgatgacggcgcggcgctcgacgccggtgatgccggagggcacgcagaccacgacccgcggacgagccagataccgccgcttgtggatcttcaggatgaagtagcggagcatgcgctcggtgatctcgaagtccgcgatgacgccgtccttgagcggacgcacggcgacgatgttgccgggcgtgcgcccgatcatcttcttcgcctcggcgccgaccgcgaggatgccaccggtgttcgtgttgatcgcgacgacggacggctcgttgagtacgatcccgcgacccctgacgtacaccagcgtgttggcggtcccgaggtcgacagccatgtcacggccgatgaacgacattgagttccccatcaggattcgtctggccttccctgggagcttttgagggcatttcaggtacggcgaggtgggtgctgtgacgtgaaggcttccatcgtaaacgcgcctgcacgaacactgcgcgagggtcttcgccattgtcagcagatggcgtaccgcctcgcttgtggagacggcccatcgggggcacgcgttcccccgatcggcatcgggtatgccgctgggcggccggatttggacggccgcccaggtcaggcagtcagatgaactgacggtacgtcagaaagtgtgaatccccggcgccccgggttcagccgcggtccggctcagccgcggccgggaaagaagatcttcacctcgcgctcggcggactcctcggagtcggaggcgtggatcaggttctcccgcacgatcaccccgtagtcgccgcggatcgaaccgggcgcggcggcgatcgggtcggtcggaccggccagggcacgcacaccctcgatgacccgctcaccctcgacgatcatggccacgaccggaccggaggccatgaacgccaccagcggctcgtagaacggcttgcccttgtgctcgccgtagtgctgctccagcgtgtcctggtccagggtgcgcagctccagcgcggtgatctgccagccggccttgcgctcgatacggctgatgatctcgccagtcaggccacgacggacggcgtcgggcttgaggaggacgagggtgcgctgggtcacgatggactccttctgctgtacagatgtgcggtgggaagaccctacaaggtctccgtcacacagcgtcagcctgggcggagcctgccccggcggtcccggcggaccgggcgaagccggcctcggcggcctgggccgcgaatctcgccttcgccacgtcgatcttccgcccgaagtgcacggacgcccaccacagcccggcgaacaccgcccccaggaagtacatcaccggcacgacgaagccggaggcgatcagcgcgatctgcagcgcccagccgagcgccacgccgccgggccggttcagcatcccgcacagcagcacgcacagcaccatcgcgatgccgctgaccgtccacacggtcgacagggaaagacccgggtccttcatcgcgaccagcgcggcgaagccgatgacgaagaactcgccgatcaaggtcgaggaacagagcgtacgcacgagatgtcagcccctcccgaggagcagtcgggcctcaccgacggtgatgacggaaccggtgacgaggacaccgccaccggagaactcgccctcttcctcggcgagcgtgatcgcggcctccagcgcgtccggcagccgcggctcgacctggacgcgctcctcgccgaacacctccacggcgatcgcggccagctcgtcggcgtccatcgcgcggtggctggagttctgcgtgaccacgacctccgcgaagatcggctcgaacgcctccagcagaccgcgcacgttcttgtcaccgctggcgccgaccacaccgatcagccggctgaagtcgaacgcctcccgcacggcctccgccgtcacctgcgcgcccgccgggttgtgcgcggcgtccagcaccacggtcggcgaccgccgcacgacctccatccggcccggcgagctgaccgacgcgaacgccttgcggacggtctccgcgtccagcggctccgcgcgctgcgcgcccaccccgaagaacgcctccacggcggcgagcgccacggccgcgttgtgcgcctggtgcgcgccgtgcagcggcaggtacacctccgggtactcgccgcccagaccgcgcagcgtcatcagctgcccgccgacggccacctgccgcgccacgacgccgaactccagcccctcacgggccaccgtcgcgttgacctccacggacttcttcagcagcacctgggccgcgtccaccggctgctgggccatgatcacggtggcgtcccgcttgatgatcccggccttctccccggcgatctcacccgtggtgttcccgagccggtcggtgtggtcgaggccgatcggggtgatcacggcgacgtccgcgtcgatgacgttcgtggcgtcccagctgccgcccatgcccacctcgacgacggccacgtccaccggcgcgtcggcgaaggccgcgtacgccatgccggtcagcacctcgaagaaggacagccggtactcctgcgcggcgtcgaccatctccacgtacggcttgacgtcctggtacgtctcgatgaaccgctcggccgtcaccggcgcgccgtccaggctgatccgctcggtgatcgactgcacgtgcggcgaggtgtaccggccggtgcgcagctcgaaggcgccgagcagcgcctcgatcatccgggcggtggaggtcttgccgttggtcccggtgatgtggatcgacgggtacgaccgctgcggctcgcccaggatgtccatcagcgcggcgatcctgctgaccgacggctccagcttggtctcgccccagcgggtcgccagctcggcctcgacctcgcgcagtgccttgtcgacctcggggtcctcggggcgcgcgggcacgtcggcctgctgcgggccgccctgagtgcgcagggtgcggctgccggcctcgatcaccgcgagatcggggtcgcgggtcgtctcggcgtcgatgatctcgtcgaacgagtcgagggggtcgggctgctcgctgtcgtcgtacggggggaggtcgctcacggggcccagtgtacggagc

SEQ ID NO: 486 - DNA, 3596 bp, Unknown
  Kingdom: Bacteria, Phylum: Actinobacteria, Class: Actinobacteria, Order: Streptomycetales, Family: Streptomycetaceae, Genus: Streptomyces
gacaacgcccgcgcccaggccttctacgcccgccagggctggtaccccgacccggagaacccgcccgtcgaagggggccaccacctggacctgcggttcaccgtgcccggggaatgagccgggggagggaccggagggagtgggccggggaatgaacgcggctgcttgaacgttcacgcatcggccagggggccccaccgggtcccctcccagacccctggcacccgtacgacctggagaagagcccacagcatgcgcgtcgaaatctggacggatatcgcctgtccctggtgttacgtcggaaaagcccgtttcgacaaggcgctggccgacttcccgcaccgtgaccaggtcgaggtcgtgcaccgctcgttcgaactggacccgcagcgcgccaagggcgacgtggagcccgtgctcaccatgctcaccaggaagtacggcatgagcgaggcgcaggcgcaggccggtgaggacaacctcggcgcgcaggccgccgccgaggggctggactaccgcacccgcggccgggaccacggcaacaccttcgacatgcaccgcctgctgcacctcgccaaggagcacggcaggcagggggaactgctggacgcgctgtaccgggcgaacttcgccgaggaacggtcggtgttcaccgagggcgacgaacggctcgtcgagccggccgtcgccgccgggctggacgccgccgcggtccgggcggtgctcgccgacccggccgcctacgccgacgaggtccgcgccgacgagcaggaggccgctcagctcggcgccaccggggtgcccttcttcgtcctggaccgcaagtacggcgtctcgggcgcccagcccgccgaggtgttcacccaggcactcacccaggcgtggggcgaccgcacgccgctgaccctgctccaggacgggaacgtgagcggggacggcggcgccgcggcctgcgggccggacggctgcgcggttccgcgggcctgagtccggccgggccgccgccggggggcatccgcccaggtcaggtgccatgcataagaagcccttcggggaacagggcagaaatgcgcgatggacttcgacttcaccgggccgcacagtggtcccatggagaccttcgagagccgcgtccgtgccgagttcgccccgaagaacacctacctgaacaccgcgagcctcgggctgctgccggtccgtacggtgacggccctgcgcaccgcggtggaggcggcggccgacgggcagccgaccgacatgttcgccgacgtcgaggcggcccgcgcgagtttcgcccggctgaccggggttccggaccgccgggtggcggccggcgcctcggtcgccgtctacagcggggtcatcgccgcctcgctccccgagggggccgaagtcctcaccgccgagggcgacttcagctccgtggtcaaccccttccacatgcgccgcgacctgaaggtgcgcagcgtgccgctggagcagctcgccgaggccgtacggcccggcaccgcgctggtcgcggtgagcgccgcgcagtcggcggacggccgggtcgccgacctgtccgccctgcgcacggcggcgcgtgaacacggggcacgcacctacgtcgacgcctcccaggccgccggctggctggacctcgacgcggacgcctacgactacgtcgccgccgtcgccttcaaatggctgctgtgcccccggggcgtgaccttcctggtcgtccccgacgacctcggcggtctcgacccgctgttcgcgggctgggtggcaggggagcggccctgggacagctgctacggccccgtcggtgaactcgcccgctccgcacgccggttcgacgagagcccggcgctcttctcctacgcgggcggccgtcgctccctggaactcgtcgaggagctgggcgtggccgccgtacgcgcccacgacctcgcgctggccgaccggttccgcgccggactgcgctccctgggccacgaaccggtccccgcgcccgcgtccccgatcgtctccgtgcccggactcggcgaccggcagggcgagctgagcggcgcgggcatcgaagtgtccgcccgcgcgggcaacctgcgggccgcgttccacctgtacaacacggaggcggacgtggaccgcctgctggacgtcctggcgggctgaccacagacccagggcggccacgggaaaggggcctcccgtcccacacgagaaggccccttcccagctcaccgacaggtcacctcaccggagtgaagtcctgcgctccgatgaagtcggggcgtcgtacgggtgccgcgaacggctccaccgccgtgttctccacgctgttgaacacgatgaagacgttgctgcgcgggtacggcgtgatgttgtcgccggagccgtgcatgcagttgcagtcgaaccaggtcgccgaaccggccttgccggtgaacagcttgatgccgtgctcgcccgccagcgcggtcagcgcctcgtcggacggcgtacccgcgtcctgcatctgcagcgacttcttgtagttgtccttcggcgtctccccggcgcagcccaggaacgtccggtgcgagccgggcatgatcatcaggccgccgttggtgtcgaagttctcggtcagcgcgatcgagacggacaccgtccgcatgttcggcaggccgtcctcggcgtgccaggtctcgaagtccgagtgccagtagaagccgctggcgccgaagcccggcttgacgttgatccgggactggtggacgtacacgtccgagccgaggatctgccgcgcccggccgaccacgcgcgggtcccgcaccaggttcgcgaacacctcgctgatccggtgcacctcgaagaccgagcggatctcctgcgacttcggctcgacgatcgaccgctcgtcggcccggatcgccgggtcggccaccagccggtccagctcctgccggtagacgccgacctcgtccgcgccgatcagctggtcgacggcgaggaatccgtcgcgttcgaacgactcgaggtcggccttcgtgatcggcccgggcgtgtccggggcgccccagaggaccgggtcctggcgggggacggtcacctcggtggcgccgcgggtcgggtagaggtccttcacggtggcggtggtcatgggttcctcacacctcctcgggctcggtgagcagcgggtagacgccgttctcgtcgtggtcctcccgtccggtgacgggcgggttgaagacacagatgcagtggaagtcctccttgaccttgagcgtgtgccgctcgtggccgtcgaggaggtacatggtgccgggcgtgatgtggtacgtcttcccggtctcgcggtcggtcagttcggcgtcgccccgggtgcagacgacggcctcgatgtggttggcgtaccacatcgacgtctccgtgccggcgtagaggatcgtctcgtgcatggagaagccgaccttctccttggcgaggacgatgcgcttgctctcccaggtgccggacgccgccttcacgtgccggtcggtgccttcgatctccttgaacgaacggacgatcacggtggtacgtgcctccttgcgggggtttctcgatgggtacggccggtcttgcgg

SEQ ID NO: 487 - DNA, 2176 bp, Unknown
  Kingdom: Bacteria, Phylum: Actinobacteria, Class: Actinobacteria, Order: Streptomycetales, Family: Streptomycetaceae, Genus: Streptomyces
gccgagcgcccggccgagatcgctccgcgccggtgcggagcggcgtcgcaccggtgctccgccgccggtcccggcctccgggatccgcggtgatccgccgccggtccccgcctccggaacccgtttgtcagtcccgagccgtagggtggtcgcgctatgacgaagccctcactccccgaactcctgcatgccgccgtcgctgccgtcggcggcacggagcgccccggccaggtgaccatggcccaagccgtctccgacgcgatcgacgacggttcgcacctgctggtccaggccggcaccggcaccggaaagtccctcggctacctggtgccggcgctcgcgcacggagggcgggtcgtggtggcgacggccactctggccctgcagcgccagctcgtcgagcgggacctgccacgcacggtcgacgccctgcacccgctgctgcgccgccgcccggagttcgcgatgctcaagggccggtcgaactacctctgcctgcaccgtctgcacgagggggtcccgcaggacgaggaggagggtctgttcgaccagttcgaggcggccgcgccgaccagcaggctggggcaggacctgctgcgcctgcgcgactggtcggacgagaccgagacaggggaccgcgacgatctcactccgggcgtgtcggaccgggcctgggcgcaggtctcggtctcttcccgggagtgcctcggcgcctcgaagtgcgcctacggggcggagtgcttcgccgagatggcccgcgagcgcgccaagctcgcggaggtcgtcgtcaccaatcacgcgctgctcgcgatcgacgccatcgagggtgcgccggtcctcccccagcacgaggtgctgatcgtcgacgaggcgcacgaactggtctcccgggtgacgggtgtggctaccggcgagctgaccccgggccaggtcaaccgggccgtgcgccgtgccgccaagctcgtcaacgagaaggccgccgaccagttgcagaccgccgccgagggcttcgagcggctgatggagctggctcttcccggtcgtctggaagagatcccggaggacctcggctatgcgctgctggcgttgcgggacgcctcccgcaacgtcatctcggccatcggtgccacccgtgacaagtcggtccaggacgaggacgcggtccgcaagcaggcgctcgcctccgtggagaacgtgcacgatgtggcggagcggatcaccaacggttccgaatgggacgtggtctggtacgagcgccacgaccgcttcggtgcctccctgcgcgtcgccccgatgtccgtgtcgggcctgctgcgggagaagctgttcacggaccgttccgtggtgctcacctccgcgaccctgaagctcggcggcgacttcaacggcgtcggtgcctcactcggcctcgcccccgagggcacggagggcgatgacatgccgcagtggaagggcgccgacgtcggttcgccgttcgactaccgcaggcagggcatcctgtacgtcgccaagcacctggcgcgccccgcgcgggacggcgaccgcgtggacatgctcgacgagctgacggagctgatccaggcggcgggcggccggacactgggcctgttctcgtcgatgcgggccgcccagctggccgcggaggagctgcgctcccgtgtcccggagttcccgatcctgctccagggcgaggagacactgggcgagctgatcaagaacttcgcagccgatccgaagacgtgtctgttcggcacgctctcgctgtggcagggcgtcgatgtcccgggtcccagctgtcagctggtcgtcatggacaagattcccttcccgcgcccggacgacccgttgatgagtgcccgccagaaggcggtcgaggacgccggcgggaacggattcatggccgtcgccgcgacgcatgcggcgcttctgatggcccagggtgccgggcgcctcgtccgtgcgtcgggagaccggggagtggtcgccgtactggatccgcggctggcgacagcccgctacggcggctacctgaaggcctcgctgccggacttctggtacacgaccgaccgcaatcaggtgcggaagtcgctcgcggcgatcgacgcggcggcgcagcaggcggagggcgagcgggccgagaagtgatcgcggggtagcctgagcggcgccgctcagg

SEQ ID NO: 488 - DNA, 1148 bp, Unknown
  Kingdom: Bacteria, Phylum: Actinobacteria, Class: Actinobacteria, Order: Streptomycetales, Family: Streptomycetaceae, Genus: Streptomyces
ggagccggagccggagccggtgggggagccacggctgtcgcggacgcggtgcggctcgtacccggtcacacctaccgcggttccctgccgcggaacggcaggctctcctaccgcctcgacctcgacgccacgtccaccgtctacgtctccgccacggccgtccccggcgcgggcaccacggtcgccgccacggacggcctcagggtctccgtgcacgacgcccagggcgcatcctgctcctaccaggcggcccggttcggcacgagtcgcagtgcgcaccccatcgccgcgtggggagcccgtgaggtctcgccgggtcacgcgctgtgccagggcgcgggcacgtactccgtgctcgtcgagcgcatcggcgccgccggctcctcgccggacacctggcccctggagctgtccgccgtctcggagccgcccctcgcacgggccggtgccacgagtccgcccacgtcatgggactcggcctcgcccgagccggtcaccgggcagccggtggaccgggcgggcggcaccgggttcgagcgggccaccccggtcgggcagggggtctggcgggaccgcgtccggcccggcggaacgctgttctaccgggtccccgtggactgggcgcagcaactgagcgccacggccgacctcgcgggtgtgaacggcggcagcggctacgccgacggggcgctcacgctgtcgctctacaacccggtgcgcggttacgtggaagaggcgtacgccggttacagcggtcggcagacgtccgccgccctcgcgcccctgccgcccgtctcctacgcgaaccgctacggcttcgccgaccaggccagggccatgcggttcgctggctcctactacctggtcgtgcacctcgcggcccagactgcgggggtgttcggcgaccagccctacggtctgaccctgcgggtgcgggtcagcggcgcggcggggtcagggccggggtatgcgggccggtccgagccgggcggcctgttcgcggtcaccgcgcgtgaccggagcgccgcgagcgtccgtggtgctggggcggcgcgtggctccacggggctgcgggcgctggcggtcggcggcatcggcacggggaccgtgctgctggccgttctcggggtgtggacgctggccgcccg

SEQ ID NO: 489 - DNA, 905 bp, Unknown
  Kingdom: Bacteria, Phylum: Actinobacteria, Class: Actinobacteria, Order: Streptomycetales, Family: Streptomycetaceae, Genus: Streptomyces
cacggtgccggcggtgccggccacccaggcggtgcggcgactgacggcggacaggccgcggaagcggacgtcgggcgtgccgccgtcctcgatccgccactgcggtgaggggtgccgctgcgcgtgcgtcccggcgtgcccccggccgtccgcccgaccgtccgtccggccgttcgcctggccacccgcctgggcgggcaccgccgccagtacggccagcgccgccacgcccacggccacggccggcacccggccggccatccggctggtccgggtcagccagttcgcccctgccccccaccgcgtccaggggacccggctcgtccggctcgtccggctcgtccggctcgtccgtcgcatcgttcccacgcgcgtcagcttcatggcgggcgaagctagcccactcccccggcggcgtccagacggccgcaggactccaactccccacgtgcgtagggcgggtcagccacggccgtaggcccgcgaaccgtgtcccgggggagacacccgtcacttccatgcatgaacgcggtgaccgaggtcactcgcactctgtgtgcactcaacggccgaatcagtcgtctcttccagtgcccggtgcccggcttcattcacccggacgtgtcctcagccgtcagacgtcacaagggagcaaggcgttgtccaccgtcatcgagcagaccgtcgaggcgcgcctggtcgccgccgcgccgcggatgcccagcattccggccacgctgcactacgaccggagcgacccgttcgcggtccgcatgaccttccccgcgcccgcgaccctggaaggcgtggaggtctgctggaccttcgcccgcgacctcctggcggccgggctgcgggagccggagggacacggcgacgtccgcgtgcggccgtacggctacgac

SEQ ID NO: 490 - DNA, 3513 bp, Unknown
  Kingdom: Bacteria, Phylum: Actinobacteria, Class: Actinobacteria, Order: Streptomycetales, Family: Streptomycetaceae, Genus: Streptomyces
cgaggacgactggaacgccaccgccggctccggcatcacgctccagggcaacgccctgcgcgttctgcgcgaactcggcgtctgggagcaggtggaggcgtccggcttcgcattcggctcggtcggcatcaccgcccccgacggcaccgtcctgcacgtccaggacgacctgcgcaccggaggcgacgacctgcccgccaccgtcggcatgcaacgcccccggctccagcggatactgatcgacgcggtccgcggcagtggtgcccgggtccggctgggcatccgcgccgagtcccttacccaggacgcctacggcgtgaccgcatgcttcaccgacggcaccgagggccgctacgacctggtgatcgccgccgacggcctccgctcccgcacccgcgccgccatcggcatcacggccgagccggagccgacgggcatggccatctggcgcgccgccgtgccacgcccggccggcctcacccgtaccgacctcgcctacggcggcccggcctacatcgccggctactgccccaccagtgacacgacgatctacgcgtacgtcgtcgaggcgaaccgcgaccgcggctcgacaccgcgggagacgtacgccgacgagatgcgccgtctggcccgcgcctacggcggcttctggccggagatcaccgagcacatcagtgatccggcgaaggtcaactacacctggttcgaccggttgctggtggagggctcctggcatcgtggccgcgtcgtgctgatcggcgacgccgcgcactgctgcccgcccaccctcgcccagggcgccgccctgtcgctggaggacgcgctcgtgctcgcccagctgctcaccgggtccgagacctgggacgacgcgctcttccaggcgtactacgagcgccggatcacccgcgtccgcccggtcgtggaggcatccgtccagatcgggcagtggcagctcgacggcgtccgcgacgccgacgtgcccggtctgatgggccgcacgatgaccatgctcagggacttgccgtgacctcccacccgggcaccctgtcaccgcacctcgccgagcgctgacccgcgcccccgcccgaccgtcgacgtgcacgccctcgtcctgctgcccgagatcgaggcccggtggccggccggcccggacacgccgaggccagggcactcgacgcccggggcaacggtcccgccgcgcccgccgtcagcggcccgagggggcgtgagcgtgtcccgcggctgaccgtcgtgccggtgcggctggccgtgacggacgcgcagggcgtggacgtccagctggtcagcccgtcaccgtccccctaccactactggtccgacgaggagaccgcggagaagctgtaccggatcgccaacgaggcgacagcggcgcgctgttcggcgcgggagcgcacccgccgtccggacacgtcggcggcggcgcggccagcagcgccgtgctgcccggtgtcacctcgctcacggccctcctcaaggagaccggcgggctgccggaactgctcgccgacggtgcggcggcactcgacgcaccggccggcccgcacgtctgcgaggtacgcctgctgccacccctgcagccctcgtccgtacgggacttcgtgacgttcgaagagcacgccgacggcgttcgccgctccgtcgacggggtggccgacgtctcggagcagtggtacgccgcgccgacgttctacttcacccacccgcacccggtccacggcccgcaccagctccacctggcccttgtggtggacggcgtagcgggcgttgtggaagaacgtgggcagcgccgggtcgagacccaggccgccgagcacctcggcacggtcgacgccggccgggtcccaggccagccactggtcggagatggcgcagccgccgacgaacatcttgtgcgcgttgcgccgcaccacgtcggcgatcggcagccgccggaacagccgctcgaacggggtgtcccggaaggaggcgtagaagtcgagctgccccggcgagaggaagtcgatcaggtcggcgtgttcggcggtcagctcgtagagcgccacgtggtccggcgggtaggtgtagtgcaggtgcgtgagctgctggtactggacgacggccgcggggacgtccggctcggcgtcaggaccgggcagcttgacgtccacgccgagcaggtcgaacaggcgctgcacctcgggcgcgtacaccttcttcgcgatcggcatgttgctctgcacgttgctgacgaccagcttggtcgggtccgcgcgcagggcggccggcagcaggtagtggtagtacggctcgtgcgcgtgcacgatcgcccgctcctcgccgaaccaggcgcgcaggaaccgcacgcagtccacctggaacaccagcggcttgaagaagaccaggtcccgtcccttggaggagtagggcgggtagaaggtgtcgggcagccggtccaggtactcgttggacaggaagtacaggtccacgccgtcgagccggatgcggtgcgcggtggtgcgcagcggcagccgcacctcggacgggaagtcccgccacacccgggcatcgagcgccaccggcagggtgtacgcgtcctcgtagggcaggtcctccacgtcgtagcggcggcgcaggtcgtcgaggcggccgtgcgcgggcgtcacgatggagacccggtgaccgcgtgcggcgatggtcctggacaggttccacaggtagacggaggtgccgccctgcaggaaggtgtggtcgaagccgcagcactcgaagtacgtctcgatgacgtgcatccggggcgcgggggaggtgcggtgcggccggggcgcgttcacgacggtcatgtcctcgctggggtcgtcggggcgggctgtgtcggggcggtgcccctcgcctgcgcgagcgcgtgacgcaggtcgatcgcggcgtggtaggggcgggcgtggtcgtggttgtagcccagctcgtgcagcaggcgccgcaggtagagcaggcggcgcagcgggctgtcgggggtggggccgagcagcaggcgcagtacgtgctcgcgccagatgtcggcggtgcggaacacggcgtccatcactgcctgttcggcgggcgtcaggtcgtgcgggcggtcctcgcgggtgtacgcggaggtctccagggaggcgtacatggtcagcgtcgcgtcgacgccgaggcggcgggcgctctcgaaggcggcctcgtcggccgcgaagtactccagggcgcgctgcacggcgacgaggtcctggaggggcgactgggcggcgtaggcggggtcgtccggcgacacggcgggcgtggacaggtcgatgacgctcatccgccagggggcgccctccgtgccctgctcaccgcacagcaggtgggacaggtgcaggtcgccgtggcagggaccggcacccggggccgtctcctccccggcgaactccgcctgcagcgcggccacttcacgctccagcgcggcgaaggcggcggcgcgtgcggcgggcggcagcggtgccaggg

SEQ ID NO: 491 - DNA, 8301 bp, Unknown
  Kingdom: Bacteria, Phylum: Actinobacteria, Class: Actinobacteria, Order: Streptomycetales, Family: Streptomycetaceae, Genus: Streptomyces
ctgcgcaccgcggtgcacaacttctccacgctcgacctgccccccgacgaactgctcagccacctggacgacctggtcggccgcatcgaccaggacgaggcctgcccgcaggccgccgcggacatcgtcggcgccacctgcctgtacgcggtctacgaccccgtcagccgccgctgcgccatggcgcgcgccggacacctcgcgcccgccctggtccgcccggacggcagcgtcgacttccccgacctgccgtccgggccgccgctcgggctcggcggcatgccgttccgcacggccgaactggacctggaggaaggcacccagatcgtcctgtacaccgacgggctgatcgaggaccgccaccgagacctggacgaagggatggagctgctgcgcgaagccctcgcggaccaccccgagcggacgccggaacagagctgccaggccgtgctggacgcgctgctgcctgcccggcccaaggacgacgtggccctgctcgtcgcccgcacccgcgcactgcccgccgagcggatcgccgactgggacgtgccgcccgacccggccgccgtcgcgggaatccgcctcgccgcctgcgccaagctcgacgagtggggcctcgccgaactgggcttcgtcctggaactcgtcctcagcgagctcgtcaccaatgccatccgctacggctccgcaccgatccacgtccgcctgatccacgaccgcaccctcatctgcgaggtctccgacggcaccagcgcctccccgcacctgcgctacgcggcgaccacggaggaagggggccgcggcctgttcctcgtggcgcggacgaccgagcgctggggcacccggtacacccccgagggcaaggtgatctgggcggaactggcgctgcccgaggatccccggccggcctgagcatcctcacgccccctgcgagcgggccaccgagacgatcacctcccgcaactgctccacgtacagccgcatgttcttgtacgcgatgtcggtgtccggatagcggctcgcgaactgcagcccctcgtgcaaccggttgatccacgcgcacacctggtcgccgtaggagaccctgatcagaccgtaggccttcagctcggcccagcgctcggaccccgggatgccccgggcgtcgacgaacgagacgatcgaatagaggtcgggggaggtcggacggaagtcggaccccagcaggcgcagcacgcgggccagcggcatccgggccatggacctgttggcgcgcagctgcgtgctcaccgtccgcagcagtgcggggaagtccgcggccccggcggtgtcgatctcgagcggcgcgccgccgacgtaccaccccaccgagtccagccactgcgacttcctcctggtgtggaaggggacgacggtccggtagaccggctgcccgccgatctcgtggacgatgagactcgtggccgccagaacgccgaccagacttccgccgaagggacggcagtacgcctcgaaaccggccgcgtcgtcggcgtccacgagcatgtcgtgcatgagtttctgacggggcagcgggccgccgggctccaggcccagatccagggggaagttcggcagccggccgtcgcaccggccgatgaactcccgccagcgtcccacgacggcgtcggcgccgtcgatctcgtcggcgctcgcccgctcggtccggcagaagtccacatagctgctcaccggactcggctcggcacgctcgcccgcgacgccggcccggtacagctcgtggatctcgcccgggatccgctgcacggagtaggagtccacgttgctgtggtcgaacgccatgtagacactcgcgccgtcgtccctgaccaccgcggagaagatgaagttcggccagcgcaacgcgtccgccgtcacgtcgaaacggtcctgcaggtaccgcaccagcgcgtccgggtcggggaagtccccgaccgtctcgcgccgcagcgccacgtcgtcggcgtccagcgtgaaccggcgcatgtcgtcaccggcccagcggaagccgctgcgcagcgtctcgtgccggagcatccagccgcgcagggccgcaccgagggcgtcgagatcgactctgcccggaatgtcgaacgcggtgcccagccaggtcggtacgaacagcccgtcctcgcggaccgaccgggccgtcctgatgtgcgactcctggatgtacgccggcggtcgggagtcgtcgggcagagcggacgcggcctcgacggcggccgggtcgagtgtccactcgaccagccgtccgggccggacctcgcagcgctggatgtcggtcatacgcaagagaagcctccgttgcagagggggtacacggagccaactgcgtacgggcacgccgggttgcgggtcgccggacgccgatcgctccccggcgctcttccgtcggggtgccgccccgttcgcggcacccctttggcagtggtgtctcagcgggcggacaaccggtcgtaggtccggaacgtgtaggtcgcgtcgtagctcatcaggttgccgctcggcgccggcaggccgagtctttggccgagcgtcctcgtcagcggaccgcagtgctcggcggccggagcggcgaaggtgtcgtcgtacgccgagaacctgatcaggggcgggtccgtcgagatccattccgaagggctcggccgcttcagggcgaagtcgaccggttcggccgcgccgatcacgcagtcccggggcagcagcgggccgaccagacggaagcggaggctgaaccgtcccgtgtagaagtcggaccggccgccgtactcggggtgtatcgcgaggcccagcaggggcgtccggtcggcggcggccgtgccggtcaggccgccgggaacgggggtcgccgcgctgtgcatcgcgccccacacctgacccggcgaaccgtcgggcagcggaccctcggcgtgggtcatcatgatcggcgcgagcgtcaccgcgatgcctcccatcgacaaccgcggtgccgcggtgtgcacttcgcacctccaggcgcccggatccacgccggccgggagagcgggacagtaacggaagccggccgccaggtcctgcgaagcccatccggtcttcgcggtctgtgtggtctgtacggtctgtgcggcgctcgcggggagggcgctcgcgaggcccagcagggcgaccgcaccggccagggcggctccggcgcggtgcgcgaagcggaaccggcggccggtgcggcggccggccgccgtgcggaaggaacggggaccgtgaacagtggtctcgtgaacagtggtctgcgacatgatccaagcctgccgccgcgcgccggaccgtcaccatccgtgacgtccctggccctcccctgagcagcccctgacaccttgtcaggggccgaccccgagatccgtcacccggcgctcgccgcggtacgccgcagggtgagcacggcggcgaagccgaggacggcgaccgccgcgaagaaggagaagccccacgggtggccgatgcccgaggtggccagggctccgatcgacggacccacgatcgaaccggtgcggccgatcccggaggccgagccgagagcggtgccgcggacgccagccgcagcagcgcgagcatcgtcaccgaaccggccagcggcgccagcagcgtgaggacggagaacagcagctccgagccgatgaggagcagccgccgccccagccggtcggccggcgggcccacacacggcgccgatggccatgccgacgagggagagcgccgcgatcgtggtggcgtccccggcggtcatgccgagatggtgggtcttgagcagggtcgggatgagcgcgccgaggacgacgaggtcgtagccctccagcatgacggtgatccagcacagggccacggtccggacggtgtgccgcgaggcgccggttcgcgccggggcgtggcaggagacggtggacgccctcggacatacccccgggggacggacgggtacgggaacgagcgggcggtgccgagcggtggtacgtgccgagccgtggagcgtgccgagccgtggagcgtgccgagcggtggtacgtgccgagcgctgaagagccgctgtgttccatgtcaggacggagccgtgagcgccgtgtccacctggaccaaccgcggcccgtccgggcgttcggcgaggacggcccgcagctccccgggcccctcgacgtgccgggacgggacgccgtagccctccgcgatccgggtgaagtccaggcccgggatgtcgaggcccggtgcgtcgggcacgccgagcacgccgctgaaccagcgcagcgcgccgtacgtcccgttgcgcagcaggacgacggtcagcggaacgcggtagcgggcggccgtccacagggcggtgatgccgtagttggccgagccgtccccgatgacaccgacgaccggacggtccggctgtgccatcgcgaccccgacggccccgggcagcccgaagccgagcccgccggcggccgggaagtagtaggagccgggccggcgcaggtccatctggcgccaccaggaggagttcgtcgaggtcgactcgacgacgtacgcggtgtccccgggcagtgcgtcgcgcagtgcggcgaagacctgctcggggtgcagacgccgtccgtcaccggcggcgggctcgggcacgggccggtacggaccgagccggtcgcggggggcggcgggggcgccgagccgctccgtgagcaggccgatgaccgcagccgggtcggcgaccagcgcctcgcccaccggggcccgggcggcagcggcggcgtcctcggtcacctggacgagccgtgtgccctcgggcaggtaccggccgggcaggtactcgtggtagcggaacaccggcgcacccagcaccagcaccaggtcgtgccccgccaacgcctcgcacacgggtgcgatgccggcgggaagtactccgcggaagagcgggtgccggttcgggaagggcagccggaacagtgagggagccgcccacaccggcccgcccaggcgctcggccagccgtaccgcgtcgtcgaagagcccggccgagtcgatgtcgccgcccagcaccagggccggccggcacgccgaggcgacccgctcggccagccggcgtgcctgctcctcgcccggcacgccggcgcgctcgacctgccggtccagtaccgcaagggtgttgtcgtcgacgtcggccgcccagtcgtcgtacggcacggacaggtacgtgggcctgcgctgcagccgcgcttcgaagacggcctgggcgagcgcgcgcggcacgtcctgggcgcacgccggctccgccgcccagccgaccagcggcttcatcaaagtggcggcgtcgacgttggccaggttcgcctccgggccgacggcgggccgcacctgctggccggccacgacgaccagcggggtccgcgcggcgacggcgttggtcagcgcgcccatggcgttcccggaaccggcggccgcgtgcaggttgaccagcacgggccgtccggtggcctgcgcgtagccgtccgccatgccgaccacggcgccctcgtggagaccgaggacgtaacggaaaccggcgggcagaccggcgaggaacggcaactcgttggagccggggttgccgaagacggtggtgaggccctgacgcttcaggaacgcgtgggagacgtgacgtacggagggcaccggatgttcctttcggaaggggtgcaccgcacgctaggcaacccccgccacgggcaccaacagatgtgccgggcctacgccatggagccgatcggcatggggaccttcggcccggcctcggtcggaagagcccccacgccgcgccctcgccgggatccacggcaccgtccgccgggccgacgccccgacggagtaggccgaccgagtgcaatccgggccggtgttgggccatcccggcgacggcagacggcacttcgcgcgccccgggacgcaaggattgggcacgagccctgcggacagtcccgcggaactcacgcatccgtgtcttgagagaaagcgtgtaacgggccgcatgacagacgttcagcacatcacagcggaaaccgccgttccccgtcgtcgcctgcgcgccggagcggtggtggtgaagtgggccacgacgaccgatcacaagacgatcggatcgctgtacctgatcacctcgttcgcgttcttcctgttcggcggcatcctggcgctggtgatgcgcgcggagctggcccgtccgggcctgcagatcctgtccaccgaccagttcaaccaggcgttcacgatgcacggcacgatcatgctgctgatgttcgcgacgccgctgttcgccggcttcacgaactggatcatgcccctgcagatcggcgccccggacgtggcgttcccgcggctgaacatgttcgcctactggctgtacctgttcggctcgctgatcgccgtgggcggtttcctcacgccgaacggtgccgccgacttcggctggttcgcctactccccgctgaccgacgcggggcactcgccgaacatcggcggtgacttctggatcatgggtctggccttctccgggttcggtacgatcctcggctcggtcaacttcatcaccacgatcgtctgcatgcgcgcgcccggcatgaccatgttccgcatgccgatcttcgtgtggaacgtgctgctgaccgcggtgctggtcctgctggccttcccggtgctggcgggcgcgctgctcgccctggaggcggaccgcaagttcggcgcccacatcttcgaccccgccaacggcggggccctgctgtggcagcacctcttctggttcttcggccatccggaggtgtacatcatcgcgctgccgttcttcggcatcgtcacggagatcatcccggtcttcgcccgcaagcccatcttcgggtacatgggcctggtcggggctacgatctcgatcgccggcctgtccctgacggtgtgggcgcaccacatgtacgtcaccggtggtgtgctgctgccgttcttctccttcatgaccttcctgatcgcggtcccgaccggagtgaagttcttcaactggatcggcaccatgtggaagggctcactgtcgttcgagacgcccatgctgtgggcggcaggcttcctggtcaccttcctcttcggcggcctgaccggtgtcatcctggcctcgccgccgctggacttccatgtctccgacagctacttcgtggtggcgcacttccactacgtcgtcttcggcacggttgtcttcgcgatgttcgccggcttccacttctggtggcccaagtggaccggcaagatgctcgacgagcggttgggcaagatgaccttctggatgctgttcgtcggcttccacaccacgttcctggtgcagcactggctgggcgcggagggcatgccccgccgctacgccgactacctggcggccgacggcttcaccgggctgaacatggtctccaccatcggctccttcctgctgggcctgtcgatgctgccgttcctctacaacatctggaagacggccaagtacggccggaagatcgagatcgacgacccgtggggctacggacgctcgctggagtgggcgacctcctgcccgccgccgcggcacaacttcgtcaccctgcccatgatccgcagcgagtccccggcgttcgacctgaaccacccggaggtgtcgctggcggaccggcaggagaacctgggcctgccggcatgacggacgcggccggacgcacgggcggggagccgctcagccccgcccacctggtcaaccaggtcgagggctacctgctgtggcagtcccgcgtcgccgaggccgaggagcgggcccgcgccttcaccgagccgctgcagtggctgaccaccgcgcagcgcgaggagatcgaggagcactacgtccgcgactgcctggcccgggcccgggcggacctgcaacgcgtcgcggaccgctgccgggcgctgcgcgaggagtacgaggagcgctaccggcggctgcgggcccgctgcctcgcgttctcgatcgccggactcaccgtggtcgccgccgccgtgctcctggcggtcgccgtcactcagtcctgacccgcgcggcggcggtcacccactcctggcccgtgcgggtggccgtcgcccctgcctgacccgcgcggtcgccgtcacccagacctgacccgcgccgccacaccccgcccgcccgcgctcacaactgaccgcggatgccgggctcccggggcggccggggctgccgggcgccccgggagcccgccatccgcggtcagttgtgagcgcgggcgggcggggtgtggc

SEQ ID NO: 492 - DNA, 4640 bp, Unknown
  Kingdom: Bacteria, Phylum: Actinobacteria, Class: Actinobacteria, Order: Streptomycetales, Family: Streptomycetaceae, Genus: Streptomyces
gtactgcgtgctcgctccccgcgaccgccggtcccggggagcgagcacgcagtaccgcctcccctggccgcgccaccgtcgcccggagctaccgcttcgaaatcgtcaagctcctctcccagtggcgggtccgcctcctgctcatcgcctgctggatcgcgccggcgctgttcgtggccggggtgagcgtgcagagcacgctgcccacggacaccctcttcggccgctggatgcacgccaccgggtgggcggggccgctggtgacgctcggcttcgcgggcacctgggcgcttccgctgctcacctccgtcgtcgccggcgacgtgttcgccgccgaggaccggctcggcacctggcgccatctcctcgtcgccgtccgctcgccccggcggatcttcgcggccaagacgctggccggcctcaccgtcatcctgttgctcgtggccgggctggccgcctccagcacggccggcgggctgctggccgtcggcgaccagccgctcgtcggcctcgacggtcatctgctcgcgccggccgaggcagccggcaaggtcctgctcgcctgggcctgtgtgctcaccccgaccctggccctcgccggaatcggactcctcggatcggtcgtgctcgggcgttctccgatgggcctgctgctgcccgccgtcgtcgcactggcgatgcaactggcccagatgctgccgctccccgtcgccgtccgcctcgccctgcccggcggcgccttcgtcacctggaacggcctgttcaccggcccggcgcagctcaccccgctcctcatcggcatcgttgtcagtctcctgtgggccgtgacggcgacggcgctggcgtacgtcctcttcctccggcgggacttcaccaaccccaccgatgacggcgcggtgcgccacgcggtcacccgggccgccctgccgctcgcggggctgctcggcgtgacggtcgcggtggtggcggcgacgacttcggccgccggctccgggatagagcaggccaaggtgcagcacgcgctcgccaccgagttcgcccacctgtaccgcctgcagaccgcccagctccaccggcccgctgtcaccgaggcgcagctgaggaccacggcgaaatgcacgaaggccggtgtcgaggacggcgcccagggtccgggcaacgactggcggtgcgtcgtctcctggcatctgccgggcgtcgaggcccccgggtcggccgtctaccagctcgacatcacctcggacggtcgctacgtcgcggacggcgacgggccgaaggaagtcaacggctacttcctggtgcggacttcggaccaggacgcacccaacccgctctggcagttcgacggcaacgtcgacctgctgtccgccgccccggccgccgggactccctgacctcggcttctgcgggcggactcccctgaactcctgctccccggccaccccccgacgctccgatacccgaaggaatgaactcatgcagatagcacgccgccgccggcaggcggagaagaagtactacgacctgctgggcagacgtgtcagccgccgggcgacgctggtcaccgcatgcatcgccacggccgccctggccaccgggacggccgtggccgacacccgcccgttcggcaccgaccaggtcggtcaggtcaccggcaagggccaggtcgtctccgccgaccagtacatcgccccgtacggccaccgcctcgtcatcgacgacggcaagatcatgtcgtcgacggtcagcccggacggcagccacctcgccgcggcggtcaccgacggcgacgccgccctcgtcgtggtggacctcgcgaccgggcgcgtcaagcagcgggtcggcaccaacgccgccgacgacctgcgcatcgcgaacggctccgtcggccaggagggccccgcgtactcgcccgacggcaagcagctgtggctgggccaggccgacggctacaccaagttcaccgtgaaggcggacggcaccctcgccgacccggtgaccgtcaagatcccggccgacggcggcaagcaggccctggtcgcggcggcggtgttctccgccgacggctcgaccgtgtacgccgcggtcaacggccagaaccgggtggtggccatcgacgcggcgaccggggccgtcaagcggagctgggcggtgggcaacgccccgcgcggcatggcccgggtgggcggaaagctctacgtcagcaacgagggcggccggcccgcgaaggcgggggagcccaccctcaactcctacggcacccaggtcccggcagacccgaagaccggcgccaccacgaccggcacggtcagcgtcatcgacctggccgacccgtccgccgccgtcgccaccatcggcgtcggcctgcacccgaccgccgtgtacgcccggcgcggcgcggtgttcgtcaccaacaccgccgacaacaacgtgtcggtcatcagcacggccaacgacaaggtcgtccagaccatctccacccagccgtggccggaggcctcggtcggctacgaacccgacgcggtgaccctcaccgacgacggccggctgctggtgacgctcggccgcgccaacgccgtcgccgtctaccgctacacctccgcgcaggagccggtcagctacgtcggcctcctgccgacggactacttccccgccgagatcaccaccgtcggcaaggaggtcgtcgtctccaacacccgcggcatcgacgcgcgccgtcccggcggcgccggtcacggcacccatgacacgacctccagcctgacccggttcacgctgcccagcgaccgtgtcatccgctcgcagaccgccaaggtgttccggcagaacggctggagcgccgggtccgtccggctggccgagggacacggccgcaccaaggcgcagccggttccggagcggatcggcgacccgtcgacgatcaagcacgtcttcctgatcgtcaaggagaaccgcacctacgaccaggtgttcggtgacatcaccaagggcaacggcgatgcgtcgctggcgcagttcggtgcgaacgtgacacccaaccagcacgccctggcagagcagttcgggctctacgacaacacctacgacatcggcaccaactccgccgagggccacaactggctcatgcaggcggacaatcccgagtacaccgagtcctcggccggcgagtacaagcgcagttacgacaccgaggacgacgccctcggccaccagaagaccggcttcctgtggacgggcgcgcaggcggccgggaagagcgtacgggacttcggcgagttccagcagttcctgaccaagccgtccggcgccagttggcagaacctgtactgcgacgccaagaacatggacgccaccggccaggacaccgcctaccccctgaactcctcctcaccgatcccgtcgctcaacagcgtctcggtgcccggcttcccgaagttcgacaccagcgtcccggaccagtaccggtacgagatctggaagaaggacttcgagaagaacgggccggcgaacctgaacatgttctggctctccagcgaccacaccggcggtccggcgagcccggccgcccaggtcgccgacaacgacctcgccaccggcaagatcatcgacaggatctcgcacagcaagtactggaaggactcggcgatcttcgtcgtcgaggacgactcgcaggccggcctggaccacgtcgacggccaccgcgctccggtgcagatcatcagcccctgggtccggcgcggcaccgtcgacagccactactactcgcagatcacgatgatccgcaccatcgagcagatcctcgggatccacccgatgaaccagaaggacagcgcggccacccccatgcggggcgtgttcacccggcaccccgactacaggccgttcaccgccctgcccaaccgcacctcactgaccgacggcctgaagaccccgcctgcctgtggcgtggacacccccgcagcccaggaccgcaaggcggcggccgtaccgccggcgaaggtaccggaggacaagaagtccctggccgccgcgtgggacgcctggaagtcccagcagcgtctgaccggtcccaacgccgtccccgactacgccaacccggcccagatgaaccacctcacctggtaccagagccacaactgggctcgtccgtaccccggtgagaagaagatctacgccccgaacgacgtacccggcgcctacatcccctcgccggagtccgacggctgacacacgctccgcaccgcacaggtctcctgccaggccgaccgccgggagcgcgatgcgtgagcggtgccaggggctggagcggcggagcatggcgtggcccgcgctgcgcaggagaatgatgccggcgcgggcccgctttggcgtagtcgccaaagcgcggggactggtgaccgggtcgcgctcgcctgcacgacgacggcgcgctcaccgctcaaccgcgtggcgggttcgccctgtggcagccgtggtctgtggcagccagggggcgagagcgaggacaccgcgtacctgggggtgggaagctgcccgcagggctgcccgtcctcccaggacgaggtgaggatccgcgcgcagcggagcgggtcccggggcatcccccagtgccccaccccgtcgggggccgcgacgaagag

SEQ ID NO: 493 - DNA, 5200 bp, Unknown
  Kingdom: Bacteria, Phylum: Actinobacteria, Class: Actinobacteria, Order: Streptomycetales, Family: Streptomycetaceae, Genus: Streptomyces
cgcccaccccatcggcacgttccgcgccccggtcggccggtggcgccaggtcctgccggccctcctggcggccctcggactcgccctggccttcctcgccggccttccggcgtccgcgcgcgccgacggttcgctgccgtgcgacatctacggtgccgccggcaccccctgcgtcgccgcgcacagcaccacacgcgccctgctgtcctcctacaacggccccctgtaccaggtcacccgtgcctcggacggcgcccggtccgacatcggcctgctgtcccagggcggttacgcgaacgccgcccgacaggacacgttctgccaggacaccacctgccgcatcaccaaggtctacgaccagagcggacggcacaacgacctgacccccgggccggccggcacgtccggcatgggcgccgaccgcggggccgacgcgggcgagatcgcggtgaccgcgggaggccacaaggtctacggcatctggatctcacccggcgtgggctaccggtacacgggcgtcgcctccggcgtcgcggtcgacggacacgccgagggcgcgtacatggtggccagcggcacgcacgtgggctccgcctgctgcttcgactacggcaacgcggagagcactcccgccgacaccggcaacggtcacatggacgccgtgtccatcgcgaccacctgctacttcgcgccgtgcaccggatcgggtccctggatcgaggccgacatggagaatggcatgttccagggcggcaacggctccaacaccgcgaacaccggcaacaacagcccgttcgtgacggccgtgctgaagaacgacgggcagacgagatacgccctcaagggcggcaacgggcagtcaggagggctgtcgacctggtgggacggcgcgctgccgacccgcggcggctaccggcccatgcaccaggaaggcggcatcatcctgggcaccggcggcgacaacagcaactggaacaggggcacgttcttcgagggcgtgatggtcgccggttatccgacggacgccgccgagaacgccgtgcagagcgacatcgtctccgtcggttactccggtgagacgaacgtgcccaacggcccgcagggcaccatcacgggcccgggcggtcagtgcgtggacgtcgccggggacgacaccggcgcgaaccgcacggcagtccagctgtggaactgccagtcctgggccgaggaccagtactggcaccaccacaccaacggctccctgagcaccatcggaaggtgcctggacatcaacggcaacgggaccgccaacggcaccgaggtcgagctgtgggactgcaacggagtcggcgggcaggtctggcagcagcgctccgacggctcgctgttcaacccgcagtccggtcgctgcctcgactcgcccgacggggccaccgccaacggcacccgcctgcgcatctgggactgcaacggctcggcggcccagaagttcaccctgcactgaggtcaccaggcgcggcggcccgccggtggcggaggactcaccgctgtgtccggtgagcagcgaccgccggcgggagaggcccgcgcgcaccatgcgtctcgcaagaccgcgagacgggacagtgctcaggccaggaagtcggtcaacagccggttgaggccgacgggttgttcggtcggcagggagtggtgggaggcgccgggcagtagcttcaccacggcacggggcaggaggcggccggcccgcaccgcgacgcgtcgggcgtcgtgggccctgctgcgctcggccaggagcaccagggccgggacggcgcaggcccgcagttcccgtgccttgggccgtcgcatggcgacgaccttcgaccgcctggccgtggcggtgctctccaggaacgctgcccataccgcgtcctgcggggcacgtcccgtctcccaccggtggaacgcccggatggttcggggactgggcctcagcagcatcggcagggcccgtacgagataacgcgcgctcacgccgccgaagcagccggtgggatcgagcagcgcgagccggcggacccggtggggcgcgtgcagtgcgtacctcagggcgatccaggcgccgtaggagtgaccgcacagctggacgctgtccaggcccagttcgtccagaacgccgtcgagccatgccgtcaggtcgccggcgccgcgcaggggcgctccctcgtgcacggtgcggccgaagtcgcccatcaggtcgagggcgtagacccggtgggtgcgcgccaggtcaccgacgaccgcgaaccacgccaccgaggtcgctccgccgccgggcagcagtacgagcgggacgccgtcccgcgggccgcagacctggacgtgggtggtgccgtaggccgacgggatctgccggctgagcacctgcacgggccagcgacgcaggacggcgtcgtacgcctcgaagaagtccgttgcctcggatcccgaggagtccgtccggtcgtccatggttcccgcctcgatgcctcgccccgatgattgctcgacgtacgataatctcgatgaacgagagattgaaggcctgcgccggaggaggaccgtggagcacgaggagcccggcctgcagctggtgcacctgctgcgcgccgtgaccgtcgaactgaacctgtcagcggccgagttcgccgcgcacaacgggttgcataccacggacgtacgcgcgctgatcactctgctggacgcggaccgtgacggcgtgaccgccaccgccggctggctgggttcgcagctgggagtcaactcggcgtcgaccaccgctctcctcgaccggctggagcggctccaactcgtccgccgcgagcgggacacccgcgaccgccgacgagtcctggtcgccgtcaccgaccaggccgtcgctctggggtggtcgttcttcgggccgctgatcagggagatgatcgccgcgatgggctccttcgacgcggcggacctggcggtggtacgtcgtttcctgctggccatgcacgatgtcgccgccgcccggcgacaggccgggcgagagggatccgccggccggtgatcgcggggcgccggcaccgcgggaggcagggacgcggcgtggagccggtgatcgcggacgcagccggacaggccctaccgcccgtccgggtcctcggccaccgcctgatcccacggggccggtcccgtgccgtcgcaccatgccctcagctcgcggccgttgacgcagatgatgccgcactgccgtgcgtacgcgagcgcgggtgcggtgaagtcgctggtcgtcacgaccgccgcgacgtcggcctcatggatggtgaagcaggtcccgccgaagcgctgcatgtcctgtgagccgaccttgttcgccggttcgtagtgcttgcactggatcaccacacgccgaccgtcctgcgtgacggcggtgacgtcggcgcccaagtcacctgctccgcccaccacttcgacgtccgcgcaggcgtcgcgagcgcacaggtcggctatggcctgctcgaaaccgtcggggtcgagcgcgccgtggaccgccacatggccgagggaatcgcggccggtgcctgccggcgcggtggtggagaccggctcggccgacgcgccgatgtccgcggcggacggtgccgcctgttccgcagccgtggcgcggagactgtcggacgcctgctcggccgcctcctccagcgccctgcccgcccggcgcgcgtacctcgccgccgagaagcggcgccaccgggagcggaggagcagggcggccaccgtgccgagcagggccagtacgccggcccagagcggacggcgttcgaacacgcctatcgtgagccgtacgaggaacgcgaagacgcacaggacgatcgcgagcagcaggaacaacagggcggtcgtccgcagatcgaagcgccggtcgcggcgcacacggggaacacggctcacgggttgggtcatacggctgagacctgcttcctgggcgaggaggatcggtcctcttcgcatgcccgagatcaggacagctacggccaacaggtcgccaggtaccgtacttgatgccgcgtcaggcctcgggcgcgtcgtccggcgccgggggccggaagcaggcggtgaccatcttgccgtcggggcacgggtgggcctgccacgtgtcggccagcgcgtcgacgaggaacaggccgcggccaccggtgcgtccggtgctcggcggcctcggcgcgggcatctgaggtgaggagtcgtggacgctcacgtgcaggcaccgctggtcccaggtcatgaccacctgggcgctgctgcgggcgtggacgtgggcgttggttaccagctccgagacggtgagcagcacgtcgtccgccgtctcgggcaggcttgtggtccagcccaggtggtccaggtgaccgcgggcccactcccgggccgccttgacgccgctcgagatgggcagcgaccgcgcccaccccaccgcacgtacggacgctccgctcacggggtccctcctcggtccgtccagcctgtgtgtcttcaccgcctaccccggacgcggcgcctcagtgccggcgggccctgtccgtgcgtcgtcagagttcacgccagcgggcgttgcaccacgagaaggcgccgaacgcggtcaggcccagggcgatcagggcgagcagccagggaccggccggcagatcccggaacgcacgcaaggtgtcgtccatgcctttggccctgccgggctggtgccggacggctgccacgagggcgaacactccggcgacggcgaacacgacgccgcgggccgtgccgcccgccaccccgaggaagtcggtgacctggcgggcccggggggacatggccccggtgcgcagtcgccggcggaacttcttgcgcgcggcccggaccgagatccacagtccggcgatcaccacggcggcgcccgcggcaccgacgatccactggccggccggccaggtcagcaccgttgcggtcacgtcgtcggtctgccggtcggatgatccgctgccgctgcccttgtccccggccgcgtaggagagcaccgagaaggagacgaaggcgtagaagacgcaacgggccgctgccgccgcccgtttggacggcttggtaccgtcgcggcccgcgccgccggccaccgcctccgacagccgccacagcgccatgccggcgagcgcggtacccacggcccacagcatcaccgacccgaggggccggc

SEQ ID NO: 494 - DNA, 4583 bp, Unknown
  Kingdom: Bacteria, Phylum: Actinobacteria, Class: Actinobacteria, Order: Streptomycetales, Family: Streptomycetaceae, Genus: Streptomyces
tgcggccccctccccggggcgtcaggttccggtctcctcctcgaccagtgccgtctgcatcagccgcgccttgcggcgggcgatgtgcagggcccggcccggggggaggttgcgcggcttgacgttgccgaacagatggccctcactgggcgggcaggacatcagcagcgccggggtgttgttctcgtcgagacggcgcagcagtgcttcgttgagtccccgtccggcgcccatggcgctgcgtgcgacgaccatgtgcagacccagttcgaagccgagcggcagatggtcgaggagcggttcgaaggggccctggaaggtgggaccgccgaccatgtcgtagtcgtcgacgaggacgaacagccgggggccgctccaccagtcgcactggcgcatccgggcgggcgcgatgtccgggccgggctgccgggtcttcagggcgcgggcgacgccgtccacggtctcgcgcaggttgtccagggacaccacgtggccgatgcggtactcctcgggcaccgcgtcgaccagttcgcggcggtagtcgaccacgatcaccttcgcctcgaggggtgtgtagcgggcggtgattcctgcggcgacgcggcgcagcaggttggtcttgccgctctcggtgtcaccgaccacgacgaggtgcggggtgcggctgaagtcgtgccagacgggttccagtgcctcctggtcgagtccgagcgcgagccgcatgcccccgccttcggtcggtgccgggccgggcagatcggccaccgggagccggtgcggcagcatccgtaccttgggcgcgcacgggccgtgccattcggcggcgatccgcgtcaccaggtcgccgaccccgtcggcgaggtcgtcggtgccgctgccgccgtccagccggggaagtccggcgaggaagtgcagcttgctgtcggaggtgaggccacgtcctccggtgcggggcaccgagcgggccttgcgcacgtccacctcggagtccatcgggtcgcccatccgcagttcaagccgggtggcggcctggtccctgacctgggcggacagctcgacccagcgggcggtggtgacgatcaggtggatgccgtagttcaggccgcgggtggcgatctcgctgaacttggctatgaggtcgtcgtagtcctgccggaccgtggaccagccgtccacgacgaggaagacgtccccgtggcgttcgtcggggaactccccggcggcgcggcggcgccggtaggaggccatggagtccagggtgtggtccacgaagaactgctcacggcgggccagcagcgccatcacctcggcgacggtgcggtgcacgcgttcggggtcgagccgtgccgcgaccccgccgacgtggggcagtccggtgaactgggccaggccgccgccgccgaagtccaggcagtagaactgcacctcgtccggggtgtgggtgagggcgagcgcgccgatgagcgtgcggacgagggtggacttgccgctctgcgacccgcccgcgaccgcgacgtggccgcctgcccccgacaggttcacgaccagcgggtcacggcgctgctcgaacggcttgtccaccagcccgaccggcacccgcagcgtgccgtgttcgttccagccggcagcggtcagaccccgtcgcggatcggtgcgcagcccgcagagcagttcgtccagcggggcgggctcggtcagcggcggcaaccagacctggtgggccggggggccggcgtcgcgcagccgggagaccgccacttcgatcagcgtctcctcctggcccgtgtccgcctcgggctccggctcggtgtccgggacgacggtgcggggcaccacccagccgctggtccagggcaccacctgactggccaccctggcctgcacgaccgcgccggtgcgccgccggtggacgccggaggagtacgcggcgcggaaccggaccagcggctcgacgccggacttgaggtagccgctgcccggctgcccggggagctggtaggcgtccggcacaccgagtacaccgcgtgactccatcgccgagaacgtccgcagtcccacccggtaggacaggtggctctccaactggtgcatgcggccctcgtcgagccgctgcgaggcgagcagcaggtggacgcccagcgaccggccgagccgtccgatcatcacgaacaggtccatgaactcgcggtgcgcggcgagcagttcgctgaactcgtcgaccaccacgaacaggctgggcagcgggtcgaggtcggcgccctgtgcgcgtgccttctcgtactccagcgccgaggtgtagttgccggcggcgcgcagcagctcctggcggcgcagcagttcgccgtggagggcgtcctgcatgcgctcgaccagggcgacctcgtcggcgaggttggtgatgacggcggaggtgtgcggcagggcgtccaggccgaggaaggtggcgccgcccttgaagtcgacgaggacgaagttgagggtctcggaggagttggtcagggccagtcccagcaccagggtgcgcagcagctcgctcttgccggagccggtggcgccgatcagcatgccgtgcgggcccatgccgccctgtgctgactccttgatgtccagctcgaccggacgcccgtcgaccccgaccgcgaccgggacccgcagccgggcggcgccggtgttcttctgccacagggtgtgcgggtcgtgccggtgcaggtcggggatgccgagcagggtggtgagttcgacgtcggtctccagcggctgggcgatgtcaccgcccaggctcatccggtaggcggagaccatccgggccagggactcggcggagacggcacccatgcggtcgggcacacccagtgccgtcgtgcgttccttgcggctgcggtcggtgcgcaccaggccggcctcgtcgggctcgacggtgaggcgcagggtggagcgcccgggccgccagcgcaacgagccgccgacgtccaggacgaccgcgttgcggtacccgtggccgtcccagcggtggccctcgggcacggtgacgccgtccaggaccaccacggcgtacggctcctcacggccgggcaccgcgtccgggtcgaaggaggggcgttcggcgaactccgcgccgagcagttcgtccagcccgccgatgtcggagttgatccggcgcaccggtcccgcgccgtcctcctcgtgcggatgcagcgcgtgcggcagccacttgacccactcccactcggcgcgccgttcgtcggtggtgcacacggcgatccacagttcctcgggggcgtggaagacggcgagctgcccgagcatcgcccgcaccagcccgcgtacggcctcgtcgtcgccgcgcagcagtacccgtgcggcggagcgcaggtacagcccgatgggctggtcgggcacggtggagtaggcgcgtacgaaacggcggagcgcgtgtgcgcacagcggctcgaggtcctccaccggccgggtggagacgggggtgagggcgagggccatctgctgctcgccgacggcgagccggacctcgccgaagtcctcgtcggccggacggcgttcccacagccgggtggtgcgcaccagcgagcgcagcgaggacggctgggggtggcgccaggcgagcgcacgctgctgctcgacgatggtctgccggacccgcttgcgggtctgggcgaggtagcgcaggtagtcgcggcgctcgcccttgaggcgttgcttgcgttcgccggagcggcgcatgaactgccccaggagcatcgcggcggcggcgagcatcatcccgcccatcgcgatgtacgtgaagacgccgggcgagcgtccctggcggaggaacatcagcatcatcgacaccgacatcatcgccatcggcaggtaggtccagacggccgaggagtccgggacggtctccgcgaggaccggtggctcctggagcgtcaattgcccctccggcatttcgggcccgcgccggcgtgcgggcctgcgaaacagaaccacgctcaagggacagctcctcctggctcgttggaattgctccggcgtccggcgccgctcgcgggaagacccgatgcgccgtcaatgcagcgcactctgccatgaattcgtccggggccgcgaaaaggccggtgaacacttcgggagaatggggcgagacggtcagtggtgtgctcgatgtgagggaagtccggcggtgacatcgcccgcggcaccagtagtctgcactcctgaccccgctcgtgtccgtgtgggggccatccatccgtcaggctttccgtggcagcgagcatgaccgagtccgaaccgccgatacgcccccgcacgttcccgtaccgcccggcacgacggcccgcagcggcgccgtgtcccgtgccggggaacgcgggtccgtcgcgccctgcccggccccgatgccggggccgggcagggcgcgacggacccgcgttccccggcacgggacacggcgccgctgcgggccgtcgtgccgggcggtacgggaacgtgcgggggcgtatcggcggttcggactcggtcatgctcgctgccacggaaagcctgacggatggatggcccccacacggacccgagcg

SEQ ID NO: 495 - DNA, 2605 bp, Unknown
  Kingdom: Bacteria, Phylum: Actinobacteria, Class: Actinobacteria, Order: Streptomycetales, Family: Streptomycetaceae, Genus: Streptomyces
gtcggcggcatccggtgggtgacgtcgttcgcgccgatcatgatcacgcagacgtccggcgcgtcggacgggtcggcgagcaccagcgccacctggcggtccaggtcgtccgagcgggcgccgggcaccgcgacgttgcgcagccgcaccggacgctcggccaccgccgcaagacccgacgccagcagcgcgcccggcgtctgcccggcccggtggacgccctgccccgcggccgtggagtcaccgagcatggtcagccgcagcggcggctggccgggagcgtcgtacacctggccgtacaccccggccgcgaccggtacgtggttgtccgtgccgttgcccacatggcgcctggccatctgcacctcggccaccagcagccccagggcggcggcgccgaccagcccgagcccaccgcccccgtacgccgcgccggccgcgatccgccgggccacccgagccctcgacatgctcgtcatgccgccgccacctcccgcatagccgtccacccactccttgccccgtaccgacggtcgcccaatctcgacagcgagtgaacgaccgccccgggccgacggctggccgtaggctggcggaaccaccacgaccaccccttttgcagcgaccggagacaacggtgcaattccacgactcgatgatcagcctcgtcggcaacacgccgctggtacggctcaacagcgtcaccaggggcatcaaggcgaccgtcctggccaaggtcgagtacttcaacccgggcggctccgtgaaggaccgcatcgccctgcgcatgatcgaggcggccgagaagagcggcgaactgcggccgggcggcaccatcgtcgagccgaccagcggcaacaccggggtgggccttgccatcgtggcccagcagaagggctacaagtgcatcttcgtgtgcccggacaaggtctccaccgacaagatcaacgtgctgcgcgcgtacggcgcggaggtcgtggtgtgcccgacggccgtggcgcccgagcacccggactcgtactacaacgtctccgaccggctcgtccgtgagacccccggcgcctggaagcccgaccagtactccaacccgaacaacccgctctcgcactatcactccaccggccccgagctgtgggagcagaccgagggccggatcacccacttcgtggcaggtgtcggcaccggcggcaccatctccggcaccggccgctacctcaaggacgtcagcgacggccgggtcaaggtcgtcggcgccgaccccgagggctcggtgtactccggcggctccgggcgcccgtacctcgtcgagggcgtcggcgaggacttctggcccaccgcctacgaccgggacgtcgccgacgagatcgtcgccgtctccgacaaggactccttccagatgacccgccgcctggccaaggaggagggcctcctggtcggcggctcctgcggcatggcggtcgtcgcggcactggaggtggccgagcggctcggcccggacgacgtcgtcgtggtgctgctgccggacagcggacgcgggtacctgagcaagatcttcaacgacgagtggatggccgactacggcttcctggaggacgagggtccgagcgcccgcgtcggcgacgtgctcagcgacaaggcgggcggctccatcccctccctcgtgcacatgcacccggacgagaccgtcggccaggccatcgaggtgctgcgcgagtacggcgtctcgcagatgcccatcgtgaagccgggcgccggtcaccccgacgtcatggccgccgaggtggtcggctccgtcgtcgaacgcgagctgctggacgcgctgttcaccaagcgcgccgcgctggaggacccgctggagaagcacatgtgcgccccgctgccgcaggtcggctcgggtgagccggtcgccgatctcatgacggtgctcggcgccgccgacgcggcgatcgtcctggtggagggcaagccgaccggtgtggtcagccgtcaggacctgctggccttcctcgcgaagggcggaaagcagtagcggaccccgggcaccgggcccggctgccgcggggaacgcacggggacctgcggcaccgggcacggtcgcgcaagcgccacacgcgtgtcacgtgcacgcagcacccgcttaacacgcgtccggaacagtggagggtgccggcagggggacggacccaccgtccgggcgtcaccgcacgctccgggagggcgcgtcctcggggccggcgacccgatacggcgtcaaggacctccggagcggctcccggacctccatggacgccccggacgcagagcccggcctgacccggcccgcgtccctcgcggggaccgccgtcgtcccgccccccattgctgggggtgcggcggtccccgcgtatcttcctgcggtcctgccggtcctgccggtcctgccggtcgccttcctgtcagtcgtcccagtcgtcgttcccggcggaacggcggcgccggccgaacaggcccggggtggtgcgggcggcctggacggcgttgacgccgacgatgccgacccaggcgacgacgagtccgggcaggtgagcgctggcggcgccgatggcggagagcggcacggccagca

SEQ ID NO: 496 - DNA, 6724 bp, Unknown
  Kingdom: Bacteria, Phylum: Actinobacteria, Class: Actinobacteria, Order: Streptomycetales, Family: Streptomycetaceae, Genus: Streptomyces
gcttcctccgcgtcgggcggctccggccgggacccgggcgcacggggcggggccggcgccgtccgccccgggatcgccgggctgtccccgcgctacgcggtcgtcgccgtcctggcgctcgcggtcgtggcggtggtcgcctgtgtgcacgtcgggatggtgttcctgcacatcgctccttcgaacacgctgacgaagcagcacggcaaggccatcgacgaatggatctatccggagttcgagcagaactggaagctgttcgcgccgaacccgttgcagcagaacatcgtcgtccaggtgcgggccgcgacccgcgggccggacggcagcagccgcaccaccggctggtacgacctgtccgcacaggacggccgggccatcgacggcaacctgctgcccagccacacgcagcagaacgagctgcgccgcggcttcgacttctacgcctcctcgcacgaccggcagaaccgcccgctggggctgcgcggcacgctgtcgcaggagtatctgcgtcgcgtcgtcgtcctgcgactggaccgcggacaggtggccgggccgggcggtgccgtcgaacgtgtccaggtgcgcgtgcgcagcgccgccgtaccgccgcccgcgtggagcggggagaaggtgtcgaccgcggcctcgtaccgcatgctgccctggtggtccgtcccggccggcgaggcgcggggaggtgtgaagtgaacagtgcttcgctcgcggtctcccggggggtcgcccgggtcaccgaggcggccctggggccctggcaggccgccgtgatacgcatcggcttctccgcgacctggctgctgttcctgctgcgcgagtggccgcaccgccaggagatgtacggtcccgacgggccgtggagctggggcctcgcgcggcggctgaccgaggacaacggcgccttcacggtcctgatgtggttccggggccagttctggttcgagaccgtctatgtgctggcggtgctctccagcctgctgctgatgctgggctggcgtacccgcacgatgtccgtgctgttcatgctcggtgtgctctcgctgcagaaccgcagcgtcttcatgggcgacggcggggacaacgtcctgcacctgatggcgatgtatctggtcttcacccggtgcggccgggtgtggtcgctggacgcgcgccgggccgggcgggcgcgggcggcacgcacgcggggggagcggatgcccgaccgtgtcggacccgtcctgtggtgcgtgttcggggcggcactgatcgcggtcaccgcggcgggccgggtccagggcgagtggctgatacccgcgctcctgtggggtgtgtggacggcccaggcggtgccctggctggtcgggcggcgcgcgcggtcggcggagccgcggatcctgctcgacgtcgtcggcaacatcgtgcacaacgccgccctgtgcgtgatcatggccgaggcgtgtctgatctacgcgacggccggctggtacaagatccagggatcacgctggcaggacggcaccgccgtgtactacccgctccacctggactacttctcgccctggccggcgctggccgatctgctgtcctccagtggcacgatgatgatgctcgtcacctacgggacggtgatcgtgcaggtcgccttcccgttcacgctgttcaaccggcgggtgaagaacgtcctgctggtggccatgatgaccgagcacgccgtgatcgccgtcgtactcgggctgccgttcttctcgctggcgatgatcgcggcggacgccgtgttcctgccgacgccgttcctgcgccggctgggcggtgcggcggcacgcgcgcgtgcgcggctggtgcggcgcgcgggcggtgccgtgcccgagcagcccggctccccggaggagggcgaacccgcccgcgtaggcttcccggcatgaacgaccccgtgggcacctggcaccggctcgccgacagtgccgtcctgctcgacggcttgcacgccctcaagcacgcgctccggttcggtgccgaggtgccggtggcggtcgccgccgaccggcaggcggcgctcgccctcgccgacgagctggccccggacgtacgggacgccctggacaccctcctggtggaggtggggcgcgagacgtacgcgtcgctcgtgccgcgcccgcatcccacggccgtggcggcgctcgccgtacggccctcccgcgaggccgggctgcgggcgctggcgcacatgccccgcagcgcgcccgtcgtcgtcctggaccagccgcgcaacctgggcaacgcgggcgcggtgatccggctggccgccggtttcggagcgaccggcgtggtcaccaccggcaccctggacccgtggcacccgacggtggtgcgcggcggggccgggctgcacttcgcgacggtcgtggagcggctgagcgtgcagacgctcccgcgcgggccgctgttcgcgctcgacccggagggcgaggacatccgcgggctgaagctgcccgacgacgccgtcctcgccttcggctccgagcgcagcgggctgagtgccgagctgcgcgagcgcaccgaccacctggtggcgctgccgatgcgcccccaggtctccagctacaacctcgccaccagtgtggcgatgacgctgtaccactggagcgccggcgggggcgcgcccgcgcgttgacgggcctgagaccgtcccgggagggctcaggcctggcggcggacctccaccacccggaagcggttggccacgaacgccccgtcggtcagcgccgcgttggccgccgggttgccgcccgagccgtggaagtcggagaaggcggccgtctggttgacgtacacccctccggtgaggttcagcgacagctgggcggcctcctccaggcacacgtcctggacggcctgctcgacctcgtcgtcggtcgtgtaggcgcccaccgtcatcgcgcccttctcgcggaccgtgcgccgcagcagctccaccgcgtcggcggccgagtcgacggcgaccgcgaaggagaccggcccgaagcactcgctcaggtaggcggcctcggcgtccggcttggcgccgtccagcttcacgatcaccggagtgcggaccaccgcgtccgggaagtccgggtgggtgacctcgcgggaggcgagggccacctcgccgagggccgcggcggcctccaggcgggccttgacgtccgggttgacgatcgcgccgagcagcgcgttcgcgcgggcgtcgtcgccgagcaggccgtcgaccgccttggcgaggtcggcggtcacctcgtcgtaggacttggggccctggtcggtgcggatgccggtgcgcgggatcagcaggttctgcggggtggtgcacatctggccgctgtacagggacagcgagaaggccaggttggcgagcatccccttgtagtcgtccgtcgactccacgagcacggtgttgacgccggccttctccgtgtagacctgggcctggcgggcgtgggtctccagccagtcgccgaaggcggtggagccggtgtagtcgatgatgcggatctcggggcgggtggccagggtcttcgcgatgccctcgccgggccgctcggcggccagggccaccaggttcgcgtcgaagcctgcctcggcgagcacctcccgggcgatcgcgaccgtgagggcgagcggcagcaccgcgcgcgggtggggcttgacgaggacggcgttgccggtggccagggaggcgaacagacccggatagccgttccacgtcgggaaggtgttgcagccgatgaccagggcgacgccccgggggaccggggtgaacgccttggtgagggcgagcgggtcgcgcttgccctgcggcttggtccactcggcggtgtccggcgtgcgcacctgctccgcgtaggcgtacgccaccgcttccagaccgcggtcctgggcgtgcgggccgcccgcctggaacgccatcaggaaagcctggccggaggtgtgcatcacggtgtgcgcgaactcgtgggtccggtcggcgatccgcttgaggatctccaggcagaccgccgcgcgggcctcggggcccgcgtcgcgccaggcgcgctgcccggcccgcatggcgggcagcagcacgtcgatgtcggcgtgcggataggtcacgcccagttcgatgccgtacggcgagacctcgccgcccacccagtcgtcggtgccgggctggccgaggtcgaggcgggtgcccaggagggcgtcgaaggcggccttgcccgcggcggcgtccaggctgccgtgctcgccgtaggccttggggtgctcggggtggggcgaccagtacgcgcgcgtgcggatcgcctccagcgcctggtcgagcgtgggccggtggcgggcgatcagctcgtgcgtcgtcggttcggcggccatgcgggaccaactccttgtctcaagagctcctcgtcgagctcatgacctggcagaaacatgggcagggacagccggtcagagttagagtaaccgaacgatcggtcgggacaagggggtccgccgcatctgtggagaagtcgggccaggggggtccgccgcgcctgtggaaaacgccgtgcgggaggatcgcgcacatgacagcactggacctcagcagccccgtggccgtcgtcggtaccggcaccatgggccagggcatcgcccaggtcgcgctggtcgcgggccatgccgtacgcctgtacgacgccctgcccgggcgggccgcggaggcggccgccgcgatcggcgcccggctcgaccggctcgtcgagaaggaccggctcaccggcgccgaccgggacgcggcccgcgcccgcctgaagcccgccgacagcctcgccgacctggccgactgctccctggtcgtcgaggccgtgctcgaacagctggacgtcaagcaggaactgctgaaggagctggaaggcatcgtcaccgacgactgcctgctcgccaccaacacctcctccctgtcggtcaccgcgatcggcggcgcgctgcgcaaccccggccgcttcgtcggcctgcacttcttcaacccggcgccgctgctgccgctggtcgaggtcgtctccgggttcgccaccgacgtcacgtccgccacgcgcgcgtacgagacggcccgcgcctggggcaagacgccggtcgcctgcgccgacacccccggtttcatcgtcaaccgcatcgcgcgccccttctacgccgaggcgttcgccgtccacgagggccaggccgccgacccggccaccatcgacgcggtgctgcgcgagtgcggcggcttcaggatgggcgccttcgaactgaccgacctgatcggccaggacgtcaacgagtcggtgacgcactccgtgtggcgttccttcttccaggacgtgcgcttcacgccctcgctcgcccagcggcgcctggtggagtcgggccggctgggccgcaagagcggccacggctggtacgactacggcgacggcgccgagcgtcccgagccgcacaccgccgagcccgcgcagccgcccgcccacgtcgtcgccgagggcgatctgggaccggcggccgagctgctcaccctcatccgcgaggccggcatccccgtccgcgaggaggacgaggaccagggcacgcgcctggtgctgccgagcggcggccagctggtcctcgccgacggacagacctccgtggagttccgcgacgtcgtctacttcgacctggcgctcgactaccgccgcgccacccggatcgcgctgtccgcctcccaggacacctccccgcagaccctcgcggaggccaccggcctcttccaggcgctcggcaaggacgtcagcctcatcggtgacgtgcccggcatgatcgtcgcccgtacggtcgcgcggatcgtcgacctggcgcacgacgccgtggccaagggcgtggccaccgaggaggacatcgacaccgcgatgcggctgggcgtcaactacccgctgggccccttcgaatggagccgccgcctcggccgcacctgggcctacggcctcctggacgacctgcacctgcgcgacccgtccggacgctacgccccctctctcgcgctgtaccgccacgcgtacgccaccgacaagcgggagtccgcctcatgaccaccgccagacgcgacacgtacacgccgcagacgctgctctcggtggccgtgcgggtcttcaacgagcgcggctacgacggcacctccatggagcacctgtccaaggcggccggcatctccaagtcgtcgatctaccaccacgtcgccggcaaggaggaactgctgcgccgcgcggtcaccagggcgctcgacggcctcttcggaatcctcgacgaggagcacgcgcgcgtgggacgcgccgccggacgcctggagtacgtcgtacggcgcatggtcgaggtactcatcgccgaactcccgtacgtgacgctgctgctgcgggtgcgcggcaacaccgagaccgagcgctgggcgctggaacggcggcgcgagttcgaccaccgggtggccgggctgctgaaggcggcggcggccgagggcgacgtgcgcgacgacgtggaggtacggctcgcgacgcggctggtcttcgggatgatcaactcgatcgtggagtggtaccggcccgacgcgcgcggggcgagcgagcgggaagtgggcgacgcggtcgtccggctggtcttcggcgggctgcggcagtccggctgaccgccgggtccggcggtctgagcagccgcacggaccgcggct

SEQ ID NO: 497 - DNA, 5039 bp, Unknown
  Kingdom: Bacteria, Phylum: Actinobacteria, Class: Actinobacteria, Order: Streptomycetales, Family: Streptomycetaceae, Genus: Streptomyces
cgccggtcgcgcagttcgtacgccggtacgccgaggtagccgggcgccgtgcccgggaagaaccgcaggccggcccagtgcgcgggcggccccccgggggcgtacgcccgcgtgtcgggcccggcgaccagcagccggccctcgctccacaacaggtccatgcacccgtccggcaggacgagtccgccaccggcaccgacgtcggcacccgcatcggcaccggccaccgggaccttcgtccacaccaccgcgccgggcagccgggcggcccgttcggtgtacccgctcaccgcgctcacgcccctcgccccgggcacgccgccaacgccgctcaccgcgcgcgctccgctcactcgccggagtgcgcggcccgcgtgcggtgttcctgcgggctgacgccgtaggcgcgtttgaacgcggtggagagcgcgaaggcgctgccgtagccgacctggcgggcgacggcggcgatggtctcgtcggtgtcgcgcagccggtcggcggccagcgccagccgccagttcgtgaggtacgtcatcgggggctcgccgaccagcgcggtgaagcgccgggcgagcgcggcccgtgagaccccggccttcgcggcgagcgccgcgacggtccaggggtgcgcggggtcgtcctggaggagtcgcagcaccgggccgacgaccgggtccgcgagcgctccgtaccaggccggtgccgccgcgtccggccgggcgaaccaggcccgtagcgccgcgatgaccagcaggtcgaggagccggtcgaggacgacctcctgaccgggttcgtcccgcacgatctcgtcggccagcagcggcgtgagcgggcactgccacacgtccgaggtcagggtgagcagcggcggcagcgcgtccagcagccggttgctgatctcgcccttcatgaggtaggtcccgatcagcatcaccgtcgcgccgtcgatccggtcgccccaggtgcgtacgccgaggtccatggagccgttcagggagcggccgtcggggtggctgcactcgccgccgggcaggatcagcgcctgcggcgcggtggcgggctcgtcggcgcaggtgtacgggccggggccgcgcgcgatggcgaggtcaccggggccgatgcgcaccttctcgccgctgtcgggcacgatccaggcgtcgccgcgggccatcagcatcaccgtgagcggggcctcgtcctcgacgcgtaccgcccacggcgggtccaggcaggcgcggatcatgaaggcaccccgtgcgcgggggccctccaggaggccggcgagtgcgtccatggggacagcgtagacgtgcggtggacgcgcgctcctgtgtccgggccgcggctgccggggttcggcgacgcggtcgggcgggacgccgccgcggcggcgtcccggggcggtcaatcgtgcggcggcgccgagccgttgtggccctccttgtgcgcgtcctccttgtgcgggccgcgcgcctgggtgctcttcgcatgggcccgcaggcgtgcggtcacgtcctccgggggcaggaaacgcgaccagcgttcggggaactcggagggcatgtcggcgtcgccgatgccgtcgtcgtcggtgtcgtcgtcgaaggcgtccgggtccgtctcgcggacggcggcggcccgcgcgacgtactcggcgatctgcgcctcgcgcacccgttcgttggcggcgcgggccgcggcggtcgcggcggccggccagacccggtcgatggcggcgttgaccgcggccccgacgagcacggcgaacgcggacacgccgatccacagcagcacggcgaccggcgcggccagtgacccgtagatggtggggccctcgacggtgctggtcaggtagatgcgcagcacgaagctgcacaccacccacatggccagcgcgaccagcgcgccgggcacgtcctcgatccacggggagcgcacgggcacggacacgtggtagagcgtggtgaggaaggcgacggacagcaggatgaccacgggccagtacaggacctgcacgacggtcgtcgaccagggcaccacccgtaccaccgcgtccgggcccgccaccatcagcggcagcgcgaccgagccgatcagcagcgccaccacgaacagcaggaaggccatcagccgggtcctgacgatgccgcgcacgccgtcgaggccgtacatcacggtgatggtgtcgatgaagacgttcaccgcgcgcgagcccgaccacagcgcgaacacgaagccgatggagatgatgtccggccggccgccctgcatgacgtcccgcaggatcggctgggtgatctccttgacgccctggtcggacaggaccgtgcgggaggcgtccatgatgttgcgttccaggctggcgatggtgtgcgcgccggtccaggagtcgacgtagaagagcagggcgatcaggctgagcagcagcggcggcacggacagcagggtgaagaacgcggcctcggcggccaggccgaggatgcggtactccatgcacgagttgacggtgtccttgagcagcagccaggcggtcctgcgcttggagacgttccggtagagggcgcgggcccggtggaaacggccggtcggcctgtcgggggtttcactggctggctgcacgacccaaaggtatccctgtcctgccctgtccccctcatccaccggcgcatcacgagtcccccgcccgccggtgtggtggccggtgccgtgacgcgggtaggttccgtgccatggcagcccgcactcactccgtgaccaaccaggtgcccccgctgaccggctacgacgtcttcaccgccgaccgggcgctgaccgaggcggtcgaacggcatgtcaccgccggtgcccacgagggttccggcggcaccggtgccgacgccgccggtgccggtctgctcgacgaggtccgcggcgagctgtccgcgctcggccgggccgcgggctccgcccagctccaggagtggggcgcgcaggccaacgagaacccgccccggctgcgcacccacgaccgctacggccaccggatcgacgaggtggacttccatcctgcctggcaccggctgctcggcaagggcgtctcggccggcctgaccgccgcctggacccgcccggccgggcatgtgcggcgggcggcgggtttcctggtgtggagccaggtcgaggcgggcaacggctgcccgctgtcgatgacccacgcggccgtgcccgcgctgcgcgccgacccgcacctcgcggccgaatgggagccacgcctcacgtcgacggtctacgaccgcgggctgcggcccgcgcacctgaaggccggcgccctgttcgggatgggcatgacggagaagcagggcggcagcgacgtcagggcgaacacgacggcggcgcgcccgctggccgaggacggcacgtacgaactgaccgggcacaagtggttctgctcggcgccgatgtcggacggcttcctggtcctcgcccaggccccgggcggactgacctgcttcctcgtcccccgcgtactggccgacggcacacggaacgtgttcctgatccagcggctgaaggacaagctgggcaaccggtcgaacgcctcggcggaggtcgagttcgacgggacgtgggcacgccgggtcggcgaggaggggcgcggggtgcgcaccatcatcgagatggtggcggcgacccggctggactgcgcgctcggctcggccgggctgatgcggcaggcggtggcgcaggcggtgcaccactgcacgtaccgggaggcgttcggcgggccgctgctcgacaagccgctgatgcgcaacgtcctggccgacctggcgctggagtcggaggcggcgaccacgctggtgctgcggctcgcggcggcctgggacgacggcggcgagcaggagcgggcgctgctgcggatcgcggtgccggccgcgaagtactgggtgaccaagcggtgcgcgccactggtggtggaggcggcggagtgcctgggcggcaacgggtacgtcgaggagtccgggctgccccgcctggtgcgggagtcgccgctgaactcggtctgggagggcgcgggcaacgtccaggccctggacgtgctgcgggcgctgcgccgcgagccgcaggcgttcgacgcctacctgcgggaggtgggcctggcacgcggcgccgatcaccggctcgacgccgcgatcaagtccctgctcaccgaactcgccgacctggagggcatcgaggcccgcgcccgccgcctggtggagcggctggcactcatcctgcagggctcactgctggtgcgtcacgcaccgcccgaggtcgccgacgtcttctgcgcctcccgccttggcggcgaccacggcgcggccttcggcaccctgccgcccaccctggacctggcgtccctggtggaacgcgcgcgtccggtgtcctgagaagcgccgaggcgcctgcgggacgctgagaggcggccctgcggggcactgaggagcgccggcaggcactgaggagccctggcgggcggcgcagggcaagtcgcaagcggcgcggcgcgattcaccaggccgtgaagggttctcccgcatgtttgcggggtcttcgccatacggcgcgccggactgccgtagcatcgctgtgggtcgccccatccgctcctcgctcaacgctgggaacccgcggcgcagttggccagccggtcggcgggcgtcccggaggcgaaccgagccctggaacaagggggttggatgaagcaacgcgggcgacaccgccggcgcagacggggcagggcgctgcgcgcggtcctggccggagccggactcgcgctgaccgccaccgccaccctgatcagcgcctcgcaggccacggtcaccgacgatccgggtgctctgcagccgctcacctcggccgccgaactggccgggctgcggctcaccgaacagcccgtgcccgcccgctccctggaccggctcgccgcggtgatgggccggccggtcgacgccggtacggtgctcagcggcgccgaccgcaccctgcgcgacgccgccggctgcacgggtgag

SEQ ID NO: 498 - DNA, 2119 bp, Unknown
  Kingdom: Bacteria, Phylum: Actinobacteria, Class: Actinobacteria, Order: Streptomycetales, Family: Streptomycetaceae, Genus: Streptomyces
gttcggcacgctcggcggggccgcgtccggtcgccgtcacgacggccatctcccagtcgccgtcccagcgccgggtccgcgggtgtacggcctcgtcctggcgccgctggcgctccagcaggcggtcgctgagaccgtgcacgccgtccgcgcgccgcagatcaccggcggccaccatccggctcagcgccgcccgcagcgtcgacccgccgacgcccaagggttcgactgcccgtacgaggtccttcaccggcaactccggcgggtgggtgcccagcagcaggctcagcacgacggaccgtaccgacagcgggcgcaggtcgagtgcggcgggctcctggacgtcgttcatggtcccgtactgtacggatctcccgttgttgcaccattgctgcagtcgtagcgatagtgcaacactgcgagcatgacctcccgcatcgcaccgccacacgcaccggacggcgtacagccaccctccgagccgcagggatcaccccgcaccccgtacgccacccacgaggtgaccaaccaggctccgcccctgaccccgtacgacgcgtccgacgacgccgcgctgctggaggggctgcgccgagggggcgccgcgtgggccgaggacgacgtgcgacggctcggggtgcgggccgggagcacgcaggtgcaggagtgggccgatctcgccaaccgccatgagccggagttgcggacccacgaccgctacggcaaccggatcgacgaggtcgacttccatcccgcctggcaccacctgatgcggaccgccgtcgccgagggcctggcgggcgcgccctgggcggacgaccggccgggggcccatgtggcccgcacggcgggcggcctggtgtggggccacaccgatgcggggcacggctgtccgacgtcgatgacgtacgcggccgttcccgccctgcgcgcccagccggagctggccgccgtctacgagcccctgctgaccagccgcgtctacgagccgggtctgcgggcaccggccggcaaggcgggactgctggcggggatgggcatgacggagaagcagggcggttcggacgttcggacgaacacgacggccgccgcaccgaccgcggaacccggcgtgtacacgctgcgcggccacaagtggttcacctcggcacccatgtgcgacgtcttcctggtgctggcccaggcgccgggcggactctcctgcttcctggtgccgcgcgtcctgcccgacggcacccgcaacaccttccgcgtccagcggctcaaggacaagctgggcaaccgctccaacgcctcctgcgaaccggagttcgaggggacggtggcctggcgggtcgggcccgaggggcgcggcgtcaagacgatcatcgagatggtcaactgcacacggctggactgcgtgatgatgtcggcggccctcatgcgcaagaccctcgtcgaggccggccaccacgcgcggcaccgccgggccttcggcgcgctgctcgccgaccagccgctcatgcgcaacgtgctggccgacctggcgctcgagtccgaggccgcgacgacgctcaccctccggctggccggtgcggccgaccgggcggtacgggacggcgcggcggcaccggaggaggccgcgttccggcgggtcgccaccgcggtcggaaagtactgggtcaccaagcggggtcccgccttcaccgcggaggccctggagtgcctgggcggcaacggctacgtcgaggagtccggcatgccccggcactaccgcgaggctccgctgctgtcgatctgggagggctccgggaacgtcaacgccctggacgtgctgcgggcactgggccgtgaaccgggcgctgccgaggcgctgttcgccgaacttgccctcgcccggggcgccgacacccggctggacgccgccgtgtcccgtctgcggcagggcctcggcgaagcctcaccggtgggcgcgcgccgcctggtcgagctgatcgcgctgaccctccaggggtccctcctggtccggcacgccccggccgccgtcgccgacgcgttctgcgcgacccggctgggcggggactgggggcactccttcggcacgctgcccgccgccgcggacctcggcgcgatcctgggg

SEQ ID NO: 499 - DNA, 8431 bp, Unknown
  Kingdom: Bacteria, Phylum: Actinobacteria, Class: Actinobacteria, Order: Streptomycetales, Family: Streptomycetaceae, Genus: Streptomyces
gcccgcaggcaccgggcctggcgcagcgagcccacggcccaggcccggtgcctgcgggcgtacaccacgaccagcggcggcggccacacgacggtgagcaccaggctgcaccacgtgtacgagttcaccacgcccgagggccgtgccgtgcggttcgcggagagcggcggcccggcgacgatcctcgagggggacctggtcaccgtgcgccacccggcgggtcggcccgagcgcgccacggcgcatcccccggcgacgggctggctcgcggccggtcagggatgtgcctgcgccttcctcggcgtgttcatcgccgggtgcctcgcgttcatggccgtcgtccacgcggccttctcggtgttcggcgacgccctgccgtgaggcccgggtgcgcgaaagcggtgaggccggtccacgtctgacgtggaccggcctcaccgttctgtgcgccgccagggactcgaaccccggacccgctgattaagagtcagctgctctaaccaactgagctagcggcgcatgactcccgccgtccgcttcccgcggtcggcgacgaagaaaatactacccgctcctcgggggtgcttgtgaccacccctgaggagcggggccggccgtcccgtcacggcggtcacagcaccgcgctgaggaactcccgcgtccgttcctgctccgggtcgccgaagatctgctccggcgggccggactccacgacccgtccggagtcgaacatcagcacctggtcggagatgtcccgggcgaagcccatctcgtgggtcacgcacagcatcgtgatgtcggtggagcgcgcgatgtcccgcagtacgtccaggacgcccgcgaccagctccgggtcgagcgcggaggtcacctcgtccagcagcagcacctgcggccgcatcgccagtgcccgggcgatcgccacccgctgctgctggccgccggacagctgcgcgggccgcgcgtcgcacttctcggcgaggcccaccagctccagcagctcgcgcgccctgacctccgcctcgtccttggacatgccgagcacggtgacgggagcctcggtgatgttgcgcagcaccgacatgttcgggaacaggttgaagtgctggaagaccatgccgatcttcttgcggatctcccggacctgcttctcgggcgccgggaagagctgctcgccgtcgacggtgatggtgcccgcatccggcctggtcagggtcatcagcagccgcaggatggtcgtcttgcccgacccggaggggccgatcagcgtgacgtgctttccggcgtcgacggagaagtccaggccgtcgaggaccgtgtggtcaccgaaccgcttggtcacgttctccagccggaccagttcaccgggcgcggtgacggcggccggccgctgcggtttcccgaagaccccgggggtctcgggtgtctcggggttctcggggttcttcgtggcgtcaacggacaagacgtcgctccagtgctcgcaggaggagggaggccaggtaggaaacgaggatgaaggccgcaccgatcacggtcagcggctcggtgaactggaagtgctgctgcgagaacaggcgcgcctgcccgagcatctccagcacggtgatcgccatcagcagcggcgtgtccttgagcatcgagatgacgtagttgccgagcgccgggaccacgcggcggatcgcctgcggcaggatcaccgccgtccaggtccgccgccgcggcaggttcagcgccgtcgccgcctcccactggccggcgggcaccgcctcgataccggcgcggtagacctgcatcgtgtacgtcgagtagtgcagcccgatcgcgaagacacccgtggtcagcgcggagaacgtcagaccccactcgggcagcacgtagaagaggaagaacaactgcaccagcagcggggtgtcccggacgaactccgtgaccactcccaccggccagcgcacccaccgcgtcggcgcccgcatcagcagcgcccacaccaggcccagcgcgaacgagatcaccgagccgaggaccagcgcctgcagcgtgacgagcagaccgtcccagaagtgcggcatgaagtcgcgtacggcgccccagtcccagttcacgccacaccgcccttgaccgaggtgcccaccggttcgggcgaggtcatggccccgccccgcgccgccttgccgacgccccgcttcagccgcttctcgaggccgcgcatcagccgggtcagcgcgaacgcgatcacgaagtagatgagcaggacgtacgtgtagatgtgggcgctctcctggagcgcgagccgcaccaggttgccgctgaacgccaggtcgcccatgcccgtgatcgacaccagcgaggtgcccttgagcagctcgatcagcaggttgctgaacggcgggatcatctccggcaccgcctggggcagcaggatcagccgcatccgctgccaggacgtgaagctgagcgcgatgccgccctcacgctgcgcggggtccacggagttcagcgcgccgcgcacgatctccgagccgtacgcgccgtaggtgagccccagcgccagcgtgcccgcccacatcggcaccagctgccagccgaaggcgggcggcagcacgaagaacacccagaagatcatcaccagcgccgaggtgccgcggaacacctcggtgtagaagcccgcgaggaagcggacgatccacagccggtgggtgcgcgcgacgccgaccacgaaggagacggcgcaggccagcagcgcgctgaagaagagcagctggagggtgatccacacgccctccaggacgagttcccacagtcctttcgtcatccggcgcacagctccttcgcggtcagatccgtcatctcgtccttcgagaacccgaagggcttcaggatccggaacagctcgccgctcttcttcatcttgtgcagctcggcgttgaaggcgtcccgcagcttcgactcggtcggccggaaggcgaaaccgccgccgtcgacgtgcggcttgcccttcaccagcggcgcgaacggcttggtggcctccgctttcgcggacttcttcaccaccgcgcgggtggtgagcgccgtaccggcgaagacgtccacccggccggcctcgacggcgttcagcccggccacctggtcgggcacgatcaggatgtcgctctgccggtacccggcgtcgatcgcgtactggatctcggcgtagccggtcccggtggcgaacttcgccctcttcgccacgacgtccttgtagtcgtgcagccccttcgggttgcccttgcggacgatgaaggagtcgagcatctggtagtcgggatcggcgaagaggacctgttcgcagcggtcggcgttgatgtacatcccggcggccacgacgtcgaactgctgggagttcaggcccggtatgagcgagccgaactccgtgggcaccggctgcacccggtccaccccgagccgcttgaagatcaccttggccagttcgggcgcctcgccggtcaccttcccgtccttgccgatgtacccgaacgggatctcgcccgcgataccgagccgtacgaccccctgggccctgagccggtccaggaggtcgccgccgccgtccgcggacgccgtggccacgcgactgcacccggccgcacccagcgctccggccgccgcgacccccgcgagcagcgaccggcggctgggccgcccgggtatgcgtctgcctcttccaagtccatgtggtggagccatgagcgcgccgctacccaagcgaatcgaagttatgcgaagcaaaatcggcggccttccgggtacccgcaccgcgacggctcccggcgacggccccccggcgcgggccctgacggcagcgcgaccacaccagaaaggctggacatgaccgcactcggattcctctacccgggccacttcgccgaggacgactatccgcgcatcgagcagctcctgggcagtgacatccgggtcgaactcgcccgcaccgggatcagtgaggacgcgtaccggacggaggtgctgcggggggccggttcggccgaggagctggcgcgcaccggtgaggggctgcggctgtccggcgcggaggcggtggtctgggcgagcaccagcggcagcttcgtgcacggctgggacggcgcccacgagcaggtacgcgccctggcccgggcggtcggcatgccggcgtcggcgacctccttcggcttcgtgcacgcggtgcgcgagctcggggtgcggcgggtcgcggtcgcggcgacctacccggacgacgtgacggccctcttcacggacttcctgcgcgccggacaggtggaggtggccgccgcgcacagtgccgggatcgccacggcggcgcaggcggcggcctggggcgagccggagatcctcgccctggcgcgggccgccgacacggcaggggccgaggcggtcctcctgccggacaccgccctgcacaccgcctcccacatcgcggtcctggagaagcagctcggcaagcccgtcctcaccgcgaaccaggtgaccgtctgggaggcgctgcggctcaccgaccgccgcgtcaacgccccggagctgggcgccctgttcacccgggaaccgatcgtccaggtgtgagggccgtatgaggcgcggagcgcgcttgcgggggccgccgcacaggcgttacctggaagtgtccggcggtgcggcgagaacgccccgtgcccggcccgggcgcgcaccggcacaccggtggtcttcgcctgtccgtgatcctgcccgcgtgccccgcccccgtgtcccgcccgggtggcgctccgtcgtcgccgctgtcgtggagcgatgacgcggaggtgaccgaaggtgaaagccgtcgtctacgaaaagcccttcaacgtgacggtgcgcgatgtcgacgatccccggatccagcaccccaacgacgtgatcgtcagggtcacgtcgagcgcgatctgcggatccgacctgcacatgtacgagggccgtacggccgccgaggcgggcatcgtcttcggccacgagaacctcggcgtcgtggaggagaccggcagcggcgtgacctcgctggccgagggcgaccgggtcgtgatgccgttcaacgtcgcgtgcgggttctgcaagaactgcctggccgggaagaccggattctgcctcacggtgaacccgggcttcgccggcggcgcctacggctatgtcgcgatgggcccctacaccggtggtcaggccgaacgcctgcgcgtgcccttcgccgacttcaactgcctgaaactgccgccgggcgaggagttcgagactgacttcgtcctgctcgccgacatcttcccgaccggctaccacggctgtgaactcgcccagctcacgcccggcgagtccgtggccgtcttcggtgccgggccggtgggcctgatggccgcgtactcggcgctgctgcgcggcgcgtcgaaggtgttctcggtggaccgggtgcccgagcggctcgccaaggcagaggagatcggggccatccccatcgacttcaccaagggcgacccggccgagcagatcaaggaacagacggcaggcgagggcaccgacaagggcgtggacgccgtcggctaccaggcccagtcgcacaaggacgtgagccacgaggagcccgccgtcgtcctcaacacgctcgtcgagacggtacggcccaccggcatgctcggcataccgggcctgtacgtcccctccgacccgggcggccccgacgagcacgccaagcacggccagctgctggtctccatcggcaggatgttcgaaaagggtcagcagatgggcaccgggcagtgcaacgtcaagcggtacaaccggcagctgcgtgacctgatcatcgccgggcgggccaagcccagcttcgtggtctcgcacgaactcccgctcgaccaggcgccgcaggcgtacgagaagttcgacaagaggatcgagggctacaccaaggtcgtcctccacccgggccacgcgctggcggcgtaggtcgtacgcacggagacgaggcgcaggacgtacgcacggaaacgaggtggagtacctgccacggaaataaacggggactgtctcctgttggcacccgggagaacgagccaaccagcaggaggcaccccgtggcggcagacgagatccgaggcgagggacacggcaccgcacccgtgcccctctccgtcctggacctggtgacggtgggcgccggccacaccgccaccgaggcgctgcgcaccagcgtcgccctgtcccgcctcgccgagcgccgcggctaccaccggtactgggtcgccgagcaccactccatgcccggcgtcgcctcctcctcaccggccgtgatcctcgcccacctggccgcccacaccgagcgcatccgcctcggctccggcggcgtcatgctgcccaaccacgccccgctggtgatcgccgagcagttcggcaccctggaggccatggcccccggccgcatcgacctcggcctcggccgcgcccccggcaccgacggcgccaccgcagccgccctgcgccgcaccgatcacctcaacgagggggccgacgacttcccgcagcagctcgccgagctgacccggttcctcgacgacgacttccccgacggccacccctaccgccgcatccacgccgttccgggcccggtgcaggcgacctcgccgggcggcgtccagtccccgcaccgcccgccggtctggctgctcggttcctccggtttcagcgcccggctggccggcatgctcggcctgcccttcgccttcgcccaccacttctccgcgcagaacacgatccccgccctcgacctctaccgcgagtccttccgcccgagcgcggtcctcgacgccccgtacgccctcatcggcgtcgccgccctcgccaccgaggacgagcgcgaggcccgccgccaggtcctggccgccgcgctgaacatggtccggctgcgcaccggccgccccggactcgtccccacgcccgaggaggcggaggcgtacgagttcagcccgatggaacaggacttcatcacctcctggaacgccaacgtcatccacggcacgcccgacgaggtccgctccggcctcgacgacctccacaagcgcaccggcgccgacgagctgatgatcaccgccaacgcgcacagcggtgacgtacgcctgcggtcctacgaactcatcgccgacgcctacgggttgcccaccgcatagcggcccgcccggcgcgcagaggctcaggcgcgtccgcaggcgtggccgtcgagcagttcggagatgcggtccggtgacaccgggcgggagtagagccagccctgcccggtgtcgcagccgatgcggcgcagccggctcgcctggtccgaggtctccacgcactcggcggtgacggtcagtcccagtcggtgggcgagctggatcatcgcctcgacgatcatctcgtcggcggggctcggcgcctgcgcggtctcctgagtcgttccctgggccgtctcctgggctgtccccggggccgtgcccgggcactgctgcccgtactggaagccccggacgaacgaaccgtccagcttcagtgccgacaccggcagccggctgaggtaggccaggttggagtagccggtgccgaagtcgtcgatggcgatgtgcacgcccatgtcgctcagggcgcgcagggcctccagcggccgtccggccgaacccatcaccgccgactcggtcagctccagctggagcaggcccggcgcgagcccggtctccgccagcaccgccgccacgtccgcgaccaggtcggagtcccacacctggcggaccgcgacgttgacgctgacgaagatcggcggctcgtccgggtggtccagctgccagcggcgggcctggcggcaggcggtggccaggacccagcggcccagcggcacgatcgagccgtcctcctccgccagtgtgatgaaccgattcggcgtcaggacgccgaactccgggtgccgccagcgcaccagcgcctccaccccgcgcagccgcccgtccgccatggcgaccaacggctggtactccagcgtgaactcgccgcgctccacggccgcgcgcagcgtggagaccagcgcctgacgggtcatgcggtgcgcgttgcgctccggatcgaacagggtccagcgggccctgccgtcggccttcgcccagtacagggtcgtgtcggccgcctgcatcagggcggtggccgaggtcccggccgcctgccgttcgaccacgccgatcgacgccgagaccgacagccgcctaccggcgatctcgaacggtgcctgcagggcggtgagcgccgactcggccagatcggccagttgttcggtaccggtggagtcctccacgagcagcgcgaactcgtcaccgccgagccgggccaccagcggcgcgctgccccggccgtggccggcctcgtgcgcgcagccggtcag

SEQ ID NO: 500 - DNA, 1291 bp, Unknown
  Kingdom: Bacteria, Phylum: Actinobacteria, Class: Actinobacteria, Order: Streptomycetales, Family: Streptomycetaceae, Genus: Streptomyces
  misc_feature (162)..(282): n is a, c, g, or t
gcaggccggacttgatcgccgtgcccgacatggaggacgaggccgaccccatgccgctgcgctcggccgcgagggccacctgcagagccttccagccctggccgggctcgccgatcatccaggccgccggcacccgcgcctcggtcaggaagacctcgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcctgccaggtcggagccggcgcccggctcgctgtagagcaggcagccgacgccgacctccccgttgagcagccgcgggaggaagtactccttcacctccgcgctgccgaaggccagcagcgggttgccgagcaggtgcagccacgggtagtcgtggaacggtgccatgtcctggcagccgccgggcgcccccgcggctcggaactcctcggccaccgccttggcggcctcccggctcagtccgcgcccgtaggtgtccgcgggccaggtcggcgctgcccagccggcgctcaccacggcgtcgcgccagtcggcgtcatcggcgccgtgccagtgatcggacagccacgaccgcgcggcttcccgcgcctcgtcgggtgacatcgtgctcttgcccatcgtcggcctttctccgtgcagtacagggggtggtatgcggcgacggtaatacggacggacaccgttcacaatatcctcggccctattttttgtcgatgtccgtccgtaatggagttcgcacggcggtgaggcagagtagaagcgcggcagcggtgcgccccccaacggcaccaggggcttgcttgcagtcggctcttgtttagagttctcgcctgcgggccggtgcgaccggacagcctcggaggtgtccggccgacgcccgccccggaacggaacggacgtgacaaggaggtcgcggtcgtatggacctcgcgaagctcaccgccttcctcgccgtcgcggaggagcggaacttcggacgggcggcggagcggctgcacgtgactccgtcgccgctgagccgacagatcgcccagctggagcgggagctggggggagcgctcttcgtccgtgagtaccatcatgtggccctcacgccgatgggtgaggcgctggtggccccggtccggagaattctcgagcagaccggggaactgcggctgatcgccgcggaggcccggggagaggtacgcccgctgcgcgtcgcggccaccacctgggcgccgacg

SEQ ID NO: 501 - DNA, 1109 bp, Unknown
  Kingdom: Bacteria, Phylum: Actinobacteria, Class: Actinobacteria, Order: Streptomycetales, Family: Streptomycetaceae, Genus: Streptomyces
ccgcacccgtcctcggcgccgcccccgtccaggcggccggcctcggccacggcgacgacaccgagcacggccccggcaaggacagcgggcacgccctcgtccccgcggacaagcgcggcatcatcctctacaccgtccgcgacgccaccggccgcgacccgctctccaccagcctgccctccgggttccgcgccgtcttcgcccagctggcccgcttcggctaccggcaggtcgagttcgccggctacggccagcacggcaacgcgcccggcggcgcggacctggagaacgtgcagggcgcccggctgctgcgccgatggctcgacgagtacggcctgcgcgcccagggcaaccacggcttcatccccggttcctggccgctcacccccgcggacctggacaccttcaagaagcacctggagatcgcgaacatcctcggcatggaccacatgggcaccggtggcgacccgaccagcagctcctaccaggccgactgggacgtggccgccgacaagtggcacgccctcggcgagatcgcccgccgggcggggatcaagctctacacgcacaaccacgacgccgcctacggcttcctgctcgacggcggcccgctcgacgcccagggccggcccacccgctcctccggcatccgcaagctggagtacttcctgtcgatcaccgacccgaagctggtctggctggagatggacatcttctgggcgcacgtggcccagtacaagttccgctcgtacaccgcccacgacggcaccacccggcagaacgtcttcgacccggccggcctggtcacccgccacgacaagcgctacccgctcttccacgccaaggacggcgtcgtcaacaccaccaacggacagggctacgacatggtcccgttcggcaccggcgtcatcgactacacgacgttcttctcccgcgtcggccaccgcaactaccacaacccgatggtcgagcaggacaacgcgcccagctccaccgacccggcccagtccctgacccacgccaggatcggctacgacaacctggccgccctgcgccgcaggtaaccacccccgacaggacgcggcccctccccgcggagggcggggagg

SEQ ID NO: 502 - DNA, 7990 bp, Unknown
  Kingdom: Bacteria, Phylum: Actinobacteria, Class: Actinobacteria, Order: Streptomycetales, Family: Streptomycetaceae, Genus: Streptomyces
tcgaggacaaccgcatcctcgttcaccggcatcgcggcggccgccgtcaccaccgtgctcgcggtcgtcgtcgccggtcaggtcaccgacgaccactccgaggccggggcgcggtcgcagacggccgccggcgaggacaccggcgtccgctccgtcgccggcccggacggtccggcgaacccgtcgccgtcgtccagcgcgaagccgctgacgtacgaccagaagatggacctgaagtacgaactcagccccaccctcaagggttcgggcaggttcgacgtggtccccggcttcgcgaaggcgccgggccgggggcggaagtacacctaccgggtcgacgtggaacagggcctcggactcgacgcccggctcttcgccgacgccgtgcagaagacgctcaacgacaaccgcagctgggcccacgacggagcccgcaccttcgagcgcgtctcctccggcgcgagcgacttcgtgatcacgctggccagccccggcaccaccgcggcctggtgcgccaagtccggcctggacaccaccgaggacaacgtctcctgcgactcggccgccaccccgcgcgtgatgatcaacgcctaccggtgggcgcagggcgcgaagaccttcggtgaccggatgtacgcctaccggcagatgctgatcaaccacgaggtgggccaccgcctcggccacaaccacgtcacctgcgagaaggacggcgagctggctccggtcatgcagcagcagacgaagttcctcgaccacgacggaatccactgtctgccgaactcctggccgtatccgaagagttgacacgggagccggtgggcggtccgcggatcatgttgacaatgcgccgaaccgtcgttcatatttctgcgcatgtggacccgtcacgcctccagcagcgccatcgagatggcgctcctcggcgtgaccgccctctgcgtggccgacatccactgttgctgacgcccgccaccggcgtgcgcgtcgcccgcttcacctcttcgccctgagcacccgctggttccgcagctccgtgcgctcctgttcgagcgccggtgcgcggcctggcggctcctcgtggtccgacgacccgccgccgaggcagacgtctgttcagattcgtctcacccctcgtcccttcgtctcgcgatccgagacgaactccggtcctggggcattcctcccgagaggtcgtcattccgatgcgccaaccgtccgtgtcagcccgccgcgtggccgcggtatccgtcagcctggtcgtggcagcgggcgccgtcgcctgcgggccggagggcagcgatgccaagggcaccggcggcgactcccagccccacaagggcggcaccctgaacgtcctgaacgcccagccgcagcaggacttcgaccccgcccgcctctacacctccggcggcggcaacgtcccctcgctcgtcttccgcaccctcaccacccgcaatcgcgagaacggtgccgccggcgccaaggtcgtccccgacctcgccaccgacaccgggcgccccagcaaggacgcgaccgtgtggacgtacaccctcaaggagggcctgaagtacgaggacggcactcccatcacctcggccgacatcaagtacggcatcgagcgctccttcgcccccgaactctccggcggggccccctatctgcgggactggctggtcggcgcggccggataccaggggccgtacaaggacaagaagggcctcgccgcgatcgagacgccggacgcccggacgatcgtcttccacctgaacaagcccgagggcgagttcccgtacctcgccacgcagacgcagttcacgccggtgcccaaggccaaggacacgggcaccaggtacgaggagcacccggtctcctccggcccgtacaaggtcgtcaggaacgagaacgacggcgagcacctcgtcctggagcgcaacccgaactggtccgccgccaccgacgccgaacgcaaggcctacccggaccggatcgacgtacgctccgggctggactcgtccgtgatcaaccagcggctctccgcgtcccagggaccggacgccgccgccgtcaccacggacaccaacctcggccccgccgaactcgccaaggtcaccggcgacaaggaactggccgcgcgcgtgggcaccggccacttcggctacacgaactacatagccttcaacccgaaggtcaagccgttcgacgacatcaaggtccgccaggccgtctcctacgccatcgaccggtcctcggtcgtcaacgcggccggcggcagcgccctcgccgagcccgcgaccaccttcctcccgaaccagaggtccttcggctacaccccctacgacctcttcccggccggcgcctccggcgaccccgcaaaggcccggcaactgctgaaggaggccggctacccgaacgggctcaccgtcacgctcacgcactccaacagcaaggacttcgagaccagtccggagatcgccaccgcggtccaggacgcgctcaagaaggccggcatcacggtcaggctccagggtctggagaagaacgactactccgacaagacccagaacgtgaagaccgagccgggcttcttcctcgcccactggggtgccgactggccctccggcggccccttcctggccccggtcttcgacggacgccagatcgtgaaggacggcgccaacttcaacagcggccagctggacgacaagtccgtcaatgacgagatcgacgcgatcaacaagctgaccgacctcggcgccgccgccgcgcgctggggcgccctggacaagaagaccggcgaacaggccctgaccgtgccgctgttccaccccgtctacaagcgcctgtacggcaaggacgtcaagaacatcgtcatcagcgactggaccggtgtgctggacatctcccaggtcgcggtgaagtgacgccgtgagcgaggcacttgccgcctccccggccgccgggacggacacacccgtcccggcggcctcgggggcccgtcagttctggcggcggctgcgtgcgcaacgcgccgccctcgtcgcggcggtcgtcgtcgcgctgctcgtcctggtcgcgctcgccgcgccgctgctcaccgcgctggagggccaggaccccaccacctaccaccccgcgctcgtcgactccgcgcgcggcggcgtgcccatcggctccttcggcggcgccggcgccggccactggctcggtgtcgaaccgcagaccggacgcgacctgttcgcccgtctggtctacggcgcccgggtctcgctcggcgtggccctcgccgccaccgtcgtacagatcgccatcggcgtcgcggtcggcgtcacggccgcgctcggcaaccgctgggtcgaccagctgctgagccgggccaccgacatcatcgtctccatgccgctgatgatcatggccctggcgctgctcgcgatcgtgccgtcgagcttcccacgcccggtgctggtcaccctggtcatcggcctgatcgcctggggcaacatcgccaagatcgtgcgcgcccagacgctcaccctgaagggcctcgaccacgtcgccgcggcccggctcagcggatggggcaccgtacgcatcgcccgccgggaactgctgcccggcctagcggcgccggtcatcacgtacgccgccctgctcgtccccgccaacatctccgtcgaggcggcgctgtccttcctcggcgtcggcgtgaagccgcccacgccgtcctggggacagatgctcaccgcggccgacgtctggtaccaggcggcgccgcagtacctgatgctgcccgcgggcgccctcttcgcgaccgtcgtcgccctgaccgtcctcggggacggcgtccgcaccgccctcgacccgcgcgcggcctcccgcctgcgcatcggcaccggcggcgggcgcgagtccggcgtggacagcgcggccgacggctcgtccgctgacaggcggaaggaggtcaccgcatgagcggctccagcggattcggcggcctcggcggactcggagggttcgtcctgcggcgcgccctcggcgccacggtcaccctcctcgccatctcggtgatcgtctacgtcgtcttctacgtcacccccggcaacgtcgcgcagatcacctgcgggccgcgctgctcgccggaacaggtgcaccaggtcgcccagcaactacggctcgacgacccgctccacctgcgctactggcacttcctgcaagggctcgtggtcgggcaggactactcgaccgggacgtccgtggagcactgcccggcgccctgcctcggggtctcctaccagaccggccggcaggtcctgagtatcatcctggccaagctgcccgtgagcctgtccctggtgttcggcgcgatggtgctgtggctcgtcctgggcgtgggcaccggtgtgctctccgcctggcggcgcggccggatctccgaacggctgctcacggccgtcacgctcgccggcacggccacgcccgtcttcgtcatcggcctggtgctgatgatcgtcgtctgcggcgagttccggtggctgcccttcccgcagtacgtgaacctcaccgacgaccccgagcagtgggcgtggaacctgctgctgccgtggctgtcgctcgccctgatcgaggccgcgaccttcgcccgcatgaccagggcggccatgctggagaccctcgccgaggaccacatccgcaccttccgggcgtacggggtgggcgagcggtcgatcgtcggccggcacgcgctgcgcggcgccctggcgcccgtcatcgcgctgaacgccaacaacttcggttcggcggtcggcggcgcggtgctcaccgagacactgttcggtctgcccggcatcggccaggaactggtgcacgcggtgaacgtcgtcgacctgccggtggtcgtcggcatggtcctggtcatcggcttcttcgtggtcatcgccaacgccgtcgcggacgtcctgttcgcggtggccgaccgacgggtggtgctcgcatgagccaggggaatgagaaggggctcgtgagccaggagggtgagaagaggcccatgagcactctggggagcagcgacgggaagggcccggagagccttgttcgctcggaaagccttgttcactcggagagccttgtccgagtgacggacctgaccgtcgagtacgggtccctgcgtgccgtggacgggctctccttccggctgccgcggggtggcgcgctggccctggtcggcgagtccggctcgggcaagtccacggccgcctccgccctgctcgggctgcaccgcgggaccggggcccgggtgcgcgggtcggtcgaggtcgccggcgccgacgtccagcgggcctccgaggaggaactgcggcggctgcgcggcgcgaaggccgccatggtcttccaggacccgctgtcgtccctggatccgtactacgccgtcggcgaccagatcgccgaggtgtaccgcacgcacgcgcgtgcctcacgacgtgccgcacgcgcacgtgccgtgcaggtgctggaccgggtcgggatccccgacgccgcacggcgctcccggtcccgcccgcacgagttcagcgggggcatgcgccagcgcgccctgatcgccatggccctggcgtgcgcgcccgacctgctgatcgccgacgaacccaccacggcgctcgacgtgaccgtccaggcccagatcctcgacctgctgcacacgctgcgcgaggagaccgggatggggctgctgctggtgacccacgacgtgggcgtcgccaccgagagcgtcgacgaggtgctggtcatgcggcacgggcgcgctgtggagcacgggccggtcgcggccgtcctgggcacgcccaccgcggcgtacacgagggaactgctggcggcggtgccgcgcgtggacgccgggcccgccacggcaggggtcccggccgaggcggcaggctccaccgaggcagccggttgcggtgaggcagccggttcggcggaggctgccggttccggtgaggcagccggttcggcggaggctgccggttccggtgaggcagccggttcggcggaggctgacggttccggtgaggcacgcggttccgccgaggccgccggttccggcgaggtcgtgctggaggcgagcgggctgcggcgcgagttcgggcggggcaggcgggcgttcgcggctgtggacggcgtatcactgacggtgcgccggggcgagaccctgggggtcgtgggggagagcggaagcggcaagacgacgctgggccgcatgctcgtcgggctgctggagccgaccgagggcgaggtgcggttcgagggccgcgccgggtccggtgtgaacccggccgtgcagatggtcttccaggaccccgtctcctccctcaacccccgccgcaccgtgggcgagtccatcgcggacccgctgcgggcgcgcggtgaacgggacgaggagcgcgtccgggggcgcgtgggcggactgctggagcgcgtgggactcgacggggcgcactacgaccgctacccgcacgagttcagcggcgggcagcgccagcgcgtcggcatcgcgcgggcgctcgccgccgacccgcgcgtgatcgtgtgcgacgagcccgtctcagcgctcgacgtcaccacgcaggcccaggtggtcgccctgctcggcgagttgcagcgggacctcgggatcgcgatggtcttcatcgcccacgacctcgccgtggtccgccaggtcagcgaccgggtcgcggtgatgcgccggggccggatcgtcgaggagggcccggccggcgaggtctacgacgcgccgcgggagccgtacacccggcagctcctggccgccgtaccagcgctcgaccccggggccgcggcccggcgccgggccgagcggcgggagctggccgcggcctgacgaaacgtgcccggatgatctcctagcgcgacgaaacgcgctccgcacgggaaagttacgaccgttcaccccttctggtggcgcgacggacaaccgtccgtcgcgccaccggcatgtccgcatacgttcgtcccgctgcgagccgccggtgcgacggcggctctccacacgggagagaacgggggtgcacgcgtgcgcatcggactggtgacggagggcggctacccgtatgtgagcggtgacgccggactctggtgcgaacggctcgtgcgcgggctcgtgcagcacgagttcgacctctacgcgctcagccgcagccgccggcaggaggacgagggctgggttccgctgccccggcaggtcagccgggtccgtacggcccccctgtggacggccgaggacgacggcgtacgcctcggacgccgtgcgcgccggcgcttcgccgagtgctacggagaactggcggccgtactgtcggcggcgagcggcgccggcctccgcgaccgggacccccgggactcggacggttctcagggctctcagggctttcgggagtgccgggacggcgaggcggaccgtttcgccaccgcgctgtacgggctcgcggaactcgcccgcgacaccggcggcctggcaggcgcgctccgctcggagaccgccgtccgcgcgctggagcacgcctgtcacgcacccggcgccccgcgcgccgcgcgcgaggcgcgcgtgccggatctcctcaccgtcgccgcgcacctggaacacgccctgcgccccctctcgctcgactggtacgaggacgacggcctgggcgccgccgacctctgccacaccgcgggcggcggcaccgcggccctgcccggactgctcgcgcgccacttctgcgacgtcccgctcctggtcaccgagtacggcgtgccgctgcgctcgcactacctgacctccgccgccgacggaaccgccccggccgcccgcgccctgctcgccgccttccacggcagactcgctacggaggtctaccggcaggccgccgtcctcacccacggcaacgcccacacccgccgctggcaggagcgctgcggcgccgaccccgcgaggctgcgc

SEQ ID NO: 503 - DNA, 3040 bp, Unknown
  Kingdom: Bacteria, Phylum: Actinobacteria, Class: Actinobacteria, Order: Streptomycetales, Family: Streptomycetaceae, Genus: Streptomyces
tctcgtgggctcggagaggtgtataagggacaggggcggggctgacggcaaggcgctggcgctggtgggcgggctggcgtcgacgcctgagcggctgcggagtccggccgccgacgggccgcgcggtcggggccgtcgggtcaggcggtgtgcttggtgacgaagtcggtgatggcctcctccatctgccggaggccggggtcttcgaggggatagtggccggcgttgtcgagcatgacggtgtcgatagggaccttggtgatgcgggagaggacgggaacgctgaggtggtggggggtccagcggtcctcggcgggctgggtgagcaggacggggcaggcgtcgaagtcgggcggctcgacggcggggacgtaggtggcgtagctgtcgaggaagcggacgctgacccagttggcggcggaggtgcggtccttcatgaggaccttcatggcgtccgggttgttggcgagcgcggacatcttggaggcgaggctcatcgggtacttggcggaggcggcgggtgtcttggcgagcaggcccatgagggggacgccgaggcgggcggtgagcttgtcgtgggaggtctcgtcgcggacctggtggtcgcgctggtcgaggaaggtcatgccgacgatgccgcgcagggtgccgcggggggccttggcggcgacgtggtaggtgagcatgccgccggcgctcagcccgtacagcacgatcgggcggtcgtcgcgggactgctcgtaggcgaggaagtcgacgaccaggtccacccagtcgtcgtacgagggggtggtgccgggcttgacctgggtgagaccgtagccgaggttgtccagggctacggtctcgaagccgcgcctggcgagtggggcgccgaggatgagggacatctggcggccgttggtgcccacgccgtggtgcaggacgaccttggccttcgcgtccgggttgcggtagcggtcgaggtggacgcggtggccgcgccagtcccagaactcctcctcgggcgcggtggcgtcggtcagccgcagtcgctcgggcaggaactgctggaggtcgcgccaggcctgctggtcgcggtagagggtgggggcgggggcggtgttcatgagggtgcgcctttcgggcgtgcccggcccctgtggggtcaggcgggagtggaggcggggcgggtgagcgccccgcgggtgatcatccgcgcgccggccttgagttcgccgcgtacggcgtctgcgtcgcgcaggtcctcctccaggccgcgggtgaaggtgagcaggacggcggcggcctgccgcgcgttgtctccggcggcctgtgcgagggccgcggccaggagctcggccaggtggtcggtgtaggtggtgaccaggcggggggcctgggcggtggcggcggacagcagctcctgcgcgtgcgcggggctgtcctgccagagccggatggcgacctccagcttcaccgtgagcacggcgaggaccttctcctcgggcgtgcccgcagtctcggccgccgcccgggcagccgcgccggccttgtccagcagcgactggacgaccttgacgatcgcctcctccttgctcccgacgtacttgtagaccgtcggacgcgacagctgcgcctcctcgacgatgtcggagaccgtggtgcggcggtaaccgttgcggcagaagcagcggtaggcggcatcgaggacgagctgggaggagggagccttcggcatggctacgaatttaacactcacctctaactgtgtaaagtcatgagtgttcccggagccctccccgcacgaaaggcgtcatcgtggacaagcgcagaatcatcctgctcggagcgaccggcttcaccggccggcgcgtgctgcgcgagctgatcgcccggggcgagaagccgacgctggtcggccgcagccgcgcgaagatgctcgccctggccgaacacctccacacggacctggacgtcgtcgaggccgacgccacctcgacggccggcctcacccgcgtcatcgagcacaccgacgtcgtcgtctccaccgtggggccgttcacgcagctcggcctgcccgcggtcaccgccgcggccagggccggagcccactacctcgactccaccggagagcctcccttcatccggcaggccttcgccctgaacgccgtcgccaccgccagcggcgcgagcatcgttccggcgttcggctacgactacgtcccgggcaacctcgccggagccctcaccctcacccgggccggcgaacaggcgcgccgcgtcgagatcggctacttcctcacccgctccggccacggcgacgaagtgcgctaccgcagcaccctgcgcgacgccttcaccctcaccaccggcggtacccgcgcctcactcgtcggctccgccgtcgaggacaccttcgcctaccggcgcccccgcaccggcggccccgcccgcctcaccacggaacacaccggcgcccgcctgctcaccttccaccacgcgggcatcacccgcaccgcgctgaccgtcggcggctccgaacacctcggcctgcccgaatccttccctcacctcgacagcgtcgacgtgggcctgggctggttcggccgatcgacctccctcgtccaggccaccgtccacctcgccgcacccctcctgcacaccacggcgatccgccgctgcgtcaccaagctctcccaccgcctgcccggatccacgcgcgaacccgacaccgacggccgggccctcgtcatcgccgtcgcccgcgacgccgcaggcaaggccctggccacaaccgcgctcaccggccctgacccctacgagatgaccggctccctgctcgcctggggcgcgagccacgccgccgcccccgatgccgccctcacccccggcacccacggccccgtcgcagccatcggactccagacactgcgccacggagccgcccaagcaggcctgcacgagaccgagcggacagcggtcccgaagtaacgacgaaggggcgaatcaggcccactttcgaaacacgccctgccgaggggtcggccagccgccggac

SEQ ID NO: 504 - DNA, 650 bp, Unknown
  Kingdom: Bacteria, Phylum: Actinobacteria, Class: Actinobacteria, Order: Streptomycetales, Family: Streptomycetaceae, Genus: Streptomyces
gccagggacagtccggcgccgatgcccttgtgcagcgcgagcatcagcggcaccaccgcctcgtcgttgacgggcgcgctgcacgccaccacccccgccgtgcccagcggcagcagagcggtgaccaggccgagcagctcgtccgcgccgaccgaggcgaagcgggcggtgtcgcagcaggacaggatgatccggtacgggctgcggtccaggcgctcgaagtcgtgcacgatgagcgggccgtccgccatcgtcagcgacgagaacagcgggctgtccgcgcggaaggtgccgtgcgcggcgatgtgcgcgagcgcggccccgtccagctcgcgcagcacccgcgacacgtgcgccgcgccctcctccagcaccgtcgccgtgccgtaccgcccggccagctcgggcacctccgcgccgccggtcgcaagtcccgggccgcgcaccaggaccgggcgggtgaccggcggcggtgcggtctcccgggcgcgcagccagctgctcgccgagggggacacgctcagcacccgctcgcgcagcgacggcagcagcgcccacggcacccggtgcagcgagccaggcggcaccaccacgaccggcccggagcccagctgccgggcggccgggccgagcagcagctcctccaggcg

SEQ ID NO: 505 - DNA, 6166 bp, Unknown
  Kingdom: Bacteria, Phylum: Actinobacteria, Class: Actinobacteria, Order: Streptomycetales, Family: Streptomycetaceae, Genus: Streptomyces
gtgacggaggtggccggcgagcgtggacagcagccgctgggcgaccgaggtgtcccagccgaactcgccggccacctccgtcacaccccagtcgggccgcgaacgctcgaaggccagcagcaccagcagggcgcggtccacggtctgcagggctccggcgggagtcctgcggtcggcgggctgaccggacaccggcagctcctctcacttgctcattggctcgcccgctcccgcatctcggcatacagacacgtattgcagatagcgggaaacagttgcggagaacgttagctgctcccgaacctgctgtcagcaccgccccgggtgcggatcaggagaactgcccatgttgaagtacgtcctggacctcgtcgacctgctcgacgaccccgacgtcgacggcaagcgcgtcgccgcccacctcgacaccctcgcggggcccgagggctccggcgcgcaggtcaccaccgtcaccggcgagcgcggctcgacggacttcgtcctcgtgcggatagcgggccgcgacggccgcgcccgcggcggtacggcccgcaccctcggggtggtcggccgcctgggcggggtcggggcgcgcccggagatgaccgggctcgtctccgacgcggacggcgccgtcgccgcgctggccaccgccgccaagctcctcgacatgcgccgccggggcgacgtcctcgacggcgacgtggtcgttgccacccacatctgcccggacgccccgaccgccccgcacgacccggtcccgttcatggactcgccggtcgacatcgccaccatgaaccggcacgaggtcaccgccgacatggacgcggtgctctccatcgacaccaccaagggcaaccggatcgtcaaccacaagggcctggccctgtcgcccaccgtgaaggagggctgggtgctccgggtgagcgagcagctgggcgagctgctcgcagtggtcaccggtgagccgttggtcactttcccggtgaccacccaggacatcaccccgtacggtaacggtgtacaccacatcaattcgatccttcagccggccacggcgacctccgccccggtcgtgggcgtcgcggtcacctccgcggcggcggtgcccggctgccagacgggcgcgagccacgagggcgacatcgcggcggcggcccggttcgccgtcgagaccgcgaaggcgtacggcggctcacgcctcgacttccacgacgaggccgagttcacctccctcgtctcccgctacggctcgctggcccacctgcagaccctcggcaacacttccagggagtcgtgagcatggcgtcacatgagaacacggccgcaccgccccggacaggtgacgccagagccctcggcagcgacgactacgcgctgtcccgcgtcccgcgcgacgagcggctcggcttctggaccatgctgctccagtggctggcccagtcgggctccatctcgcagttcaccctcggcgccaccatcggtgtgggcatgtccttcgccggcgcgttctgggccttcaccctcggcgcggtgatcctggaggtcgtgatcttcgcgatcggcctggccggcatgcgcgagggcctggcgaccccgctgctgacccgctgggccggcttcggccgcaacggatctgccctggtcagcctggtcatctcgatcagtctcgtcggctggttcggcgtccagaacacgatcttcggcgacagcgtgtcctcgctcgtcggcgggccgtcctggctgtggtgcgtggccgccggcgtcgtcatcaccgtcctggtcatcttcggcttccggtacatggccgtcttcgccaagatcgtgaccccgctgttcttcgcgatggtggcctggtcggtcgccgacgccctgagcaagcattcactgtccgagctgatccactccccggcgccgggcaaggcgatcccgctctccgtcgccgccaccgccatcgcgggcggctacatgaccggcgcgatcgtctcccccgagatgacccgttacaaccgcaggggcagccacgtcctcctgcagacggcctcctcgatgatcctctccgagtacatcgtcggcctgaccggcgtcctgctcgggcacatggtcggcaacggccaggtctcgcagatcgtgctctcgacctccggcgtcttcggtgtcctggtggtcctcatgtccaccgcgaagatcaacgactggaacctgtacggctcctcgctcggtgtcgtcaacttcttccaggtggtcttcgccaagcgcctgcaccgcggtgcggtcaccatcgtcctcggcatcgccggcactgtgctgtccgccgtcggcatcatgacccacttcaccgacttcctgtccgtgctcggcgtcgccatccccccggtgggcggcatcatcgtcgccgagtactgggtcgtgcgccgcatgcgcgccccgctcgacgccacccgcgacgccggaaccctgcccgccacctcgccggcctgggtcccgctgtccctggtcatctgggccgccgcgttctgcgtcggcaagttctacgacggcggcatccccgccctgaactccctgctgaccgccttcgtcctctacgccgtcctcggcctcgccggctggatcaggccgtacggcaccaccaccctggaagaccagcccggtgaggccggcgccacggccccggccgcctccggcacggcccccgtaggagcaccatgaccagcaccgcccccgccctcgtccccgcctccgacgaggcgcagaacgaagtcgtcgacctgtgcgcggagctgatccgcttcgacacctccaaccccaccagcgacgagcgggcctgtgccgactgggtcgtggcccggctcaccgaggtcggcatcgcctcagaactggtggagagcgccccgggccgcgccaacgtcatcgcccgcatccccggcaccgaccccgcgcgcggcgccctgctcgtccacggccacctggacgtcgtacccgccgacgccgccgaatggcaggtcccgccgttctccggcgagatccgcgacggctacctgtggggccgcggcgccatcgacatgaaggacacggtggccgtcatgctggccaccgcccggcacttcgcccgcaccggcacccgccccgcccgcgagatcgtcctcgccttcctcgccgatgaggaggcgggcggcaggttcggtgcccactggctggtcgagcaccggcccgagctgttcgccggcgtcaccgaggcgatcggggagggcggcgggttcagctacgccctcgacgacacccgccgcctctacccgatcgagaacgcccagcgcggcatggcctggatggagctgacggccaccggacgcgccgggcacggctcgtccccgaacaccgagaacgccgtcaccgacctcgccgagtccctcacccgcatcggccgccacaccttcccggtccgcctgatcgccccggtgcgtgccgtgttggaggaggccgcccgcctccagggcgtcgacgtggacctggacaccgaggacgccgaggaactggaggcggaactggccaagctgggccatgtcaccgacttcctccaggtggtcctgcgcaactcggccaacccgaccatgttctcggccggctaccagaccaacgtgatcccgggccgggccaccgcacgcgtcgacgggcgcttcctgcccggccacgaacaggagctgatcgacaccgtcgacgcgctgctgctgccctcggtcacccgcgagtgggtcaaccacgacatcgccatggagacctccttcgacggcccgctcgtcgacgccatgtgcgccgccgtgcgcgcggaggaccccgacggccaccccgtgccgtactgcaatccgggcggcaccgacgccaaggcgttcaccaagctggacatccgctgcttcggcttcaagggcctgaagctgccccacgacctgaactacagccgcctgttccacggcgtggacgagcgcgtgccgctggaaggactgcgcttcggcgtacgggtgatgacccggctgtggcagggctgctgagcggcgcgcggcccgcgtcggggaaagctccggcacctcatggcccggccccgcgtgcggcggggcgggccgtgaggtgccgggcgggctgagcaccgcctggcgggccatgcggacttcggcgagcgctgtgacctcttcgggtgtgcgggtgatggcgttggcggcgatggtctcccgggcataggccccggtcgcgagcaggccggggacggaggggccgggattcctggtctgctggtgcgtacggggcagtggcggtgtagagaggagggatgtcgcaaggtctcggtgggcgcggtcaaccggtgcgtgcgggcgggtccatggtcgcgatcccgatcgcgtggatcgtcgtggtgtccgtgatcgacatgctggtgccgccccacatccatctgggtccgctgctcgtcgcggccccggccgtcacgccgtcgttcggcggtccgcggacggtgggtctggtcgccgcactggcggtgcttgcgcaggcggtgatcgggtcgctgcgcgattctgacgaactgctctcggccaaccacgaggcgcagatccttgccctgatcgtggtcggaatcagtctggtcgtcttctgcgtcgtgcgggaacgtcacgcaaaggaactggagcaagtccggtacgtgtccgaggccgcacagcgtgtggtcctgcctcccctgcccaaacggctcggcccgctgcacaccgccgtcatgtacctcgcggccgaggcagaggcccagatcggcggtgacctgtacggggcggcgcgcaccacctccggcacccgagtgatcgtcggcgacgtgcggggcaaggggatgaccgcggtcagtgacgcggcgctcctgctcggagcgttccgtgtcgcggctcaccgccaggcgcccctggacgagttggtggcatacctcgaccggagcgtgcgctgggacgtgatcgagccgggggagacgggccgcttcgacgagacgttcatcaccgccaccgttctggagattcccgaccggggcacccgggtccagatgatctcctgcgggcacccgccgccggtcgtcctgagcgggggccggccggtgacgatgagcgctcttcgatccgcccctccgctggggctgggcgaactggcagacccgcggtaccacgtcgagagcttcccgttcgagccgggagatctcctgctgctctacacggacggcgtcactgaggcccgagacgcagccggcaccttctacccgctgaccgagcgcatcaccggctggacggagaacagctgcgacgccttcctcggccgcttccggcgcgacctgctgaaccatgtcgacggacatctggacgacgacgccgtcatgatcgtccttgagcgtcccgccgtgcgccggccctgatcacccgaactttccagcccgacctgccctctctgcatctgcccagccaagtatcggtatgtgcccggccaagtaccggtgtcgtcgagttctgttgagagctcccgggtgggcggcacaggcggcagcggccctgcgggcggtgcccacagcggggtcgtgcaccggacctcaactggcgaaccggcgccctctcagcgtcctctcagcacgtgtcctgcaggctgaagaagtgcctgggaaacgcgcgcccggccacccgcaccactcccggaccgcgatccagggggaacgccatgatttccgacaccgccgctccgccagtcgccccggccccgggcagagcgctgccggccggcgagggcgtcgccgggttgaaccggttcttcgaggacgcctgcgaccgaaaccccgacgctgtggctcttgaatgcggcggccgaactctgacctacgccgaactggacgcccaggccaaccaggtcgcccaccggctgcgccgtctcggcatcggcccggacagtcgcgcggcactgctcctgccgaggtccgtggagatgtacgcgagcctgctcggcgtgtgcaaggcgggtgcggcgttcgtcccgatcgatccggaagcgccccccgaccgggtggcgtgtgttctccgggacgccggtgtggacgcgctgctgacctgctccgtccgctcggccgacgcccggcaggcgatgccgcgcgaggcgtgcg

SEQ ID NO: 506 - DNA, 4644 bp, Unknown
  Kingdom: Bacteria, Phylum: Actinobacteria, Class: Actinobacteria, Order: Streptomycetales, Family: Streptomycetaceae, Genus: Streptomyces
gccctgctggccgccgtcggcgcggcgcacggccgtccggtcctgctgcacggcacggagggcagcacctggccggtactgcgcctggccggccggctgggcctggccacccgtatcggcctggaggacacactggtcctgccggacggacaacgggcttcctccaacgccgagttggtcacgcagggcctgcgcctgcacggagagggaagccgggagcgctaggcactgccctgccttcacaccgggccggcggagccgggcggcagcgcgggattcaggccgggtcgcggcgggtggtcgtggtgccggtgccgcgttccaccatcaggcgggagcccgtgcgctgttcaccgaaggcgtcgtccgggttggacaggacgcaggtgtccagggagaggcagccgcagccgatgcagtcggtgaggtggtcgcgcagccggttgagctgcttgatgcgctcgtcgagttccgtgcgccaggccgccgagaggcgggcccagtcctcgcgggtgggcgtgcgctcctcgggcagctccgcgagcgcctcgcggatcgtggccagcgggatgccgacgcgctgcgcggcccggacgaaggcgacccgccgcagcgtgtcgcggctgtagcggcgctggttgccggtggtgcgacggctgctgatcaggcccttggcctcgtagaagtggagggcggagacggcggctccgctgcgggctgccatctggcccacggtcagctcgtggatcttctcgggaatctgcggcactccgcagaccctacccaccgcgcccgggcccggctccgttgacagggacctccgcaccgagcatgctaagcagttgcttagacatgacgtacgcgcgatgcgagaggccgggcacatggcagagccgaggatcttcacctccgtcgacgagctgaaggcggcggtgggcgagcagctggggtacaccgactggctggagatcgaccagaagcggatcgacctgttcgcggaggcgaccggcgaccaccagtggatccacgtggacccggagaaggccgccgcgggccccttcggcacgaccatcgcgcacggctacctgaccctgtcgctgctcccgctgttcgggccgcagctgatccgcgtcgagggcgtgaagatgggcgtcaactacggcacgaacaaggtccgcttcccctcccccgtcccggtcggctcgcggctgcggtccaccgccacgatcacgggcgtggacgacgtcagcggcggcgtgcaggtgaccgtcgccttcaccgtggagcgcgagggcggcgacaagccggtgtgcgtggcggagtcggtgtcccgctactacctctgagccgcgctacggcctctgggccccgcccgtacgggccccgaccatgcgcaggacgaggtcggcgtagagcgcgccgacctcctccggggtgcgggggccctcgacgttgaaccagcgggcgacgtcgatgcagagggagagcacggccagggtcgtgccgcggacgtccgggacgtcgaactccccagcggtcacgccctcctcgatgatgccgcgcacctcggcgtcgacccggcgccgcagcgcgatgatctcggaccgggcgtccgggccgagggagtccagttcgtactggacgacacgcgcggtggtgcgcccgcgcgcgtgccagcgcacgaaggagctgacggcgtcggcgagccgctcggtcgcgctgccctcgcgccgggccgcggtgcgcaggatctccagcgccttcgcgtggccgatccggctgatgcggtggagcagctcttccttggtcttgaagtggatgtagagcgcggcggggctcatgccggcgcggccggcgatgtcgcgggtcgtcgtcgcgtggtacccccgctcggcgaaggcctccacggccgccacgagcagccgccgggccgcgtcaggggtgacctcggcccacggctgcgcgtcttcgcccgccgtctcctccgccgtactcatcgctcgttcgacccctctctgcgtcaggggctccaccataccgccgaagctgagcgggcgcttagcgtccccggtcggcggcgtgcggacggctggtgacgacggctcgcgccgacagctgccgccgacggcttcagagcttctcgaaggggtcgtgctcggcgagcagcttctccaggcgggcctggtcgacccggctgacgatctgcccggcctcctggcggtcccggatcaccttggcgagcgtgaaggcggaggtgacgaggtagaggacggcgatggcgaggaaggaccggacccaggcattggcgtccagccggaagatgccgatggcggtggccgtcatggcgacggcgaacgaggcgacggcctggccgtagaaggcggccgtgctctggtgcttgaccggtgtgtcactcatgcggaacagcatcggcggatgtggccgccgccacatccgccggaatactcagaccgggtactcagaaaccagaaacccgccgggccctccgctcctccctctctcccccccggacctcagaaggccgagacgccggtcagcgcccgtccgatgaggagtttctggatctggctcgtgccctcgtagagggtcatcacgcgggcgtcgcgcaggagtttgcccaccgggtactcgtcgatgtagccgtaaccgccgaagacctgcagggcgttgttggcggcgcgcacggcggcctccgaggcgaagagcttggccttggaggactcgacggcgaacggctgcccgcggtcgaccaggtccgcgacccgccacgtcagcaggcgggcggcgtcgacgtccacggcgatgtcgctgatcagctcctggacgagctggtggtgggcgatggacttgccgaactgctcgcgctcgccggcgtgccggaccgccgcgtccagcgcggcctgggctatgccgacgcagccggccgccaccgacatccggcccttggccagcgccgacatggcgacggagaagcccttgccctccgggccgagcatcgcggaggccggtacgcgcacgtcctcgaagaccagttcggcggtggcctggccgcgcaggccgagcttgccgtggatggtgcggcgggtcaggcccggagtgtcggcgggcaccaggaaggcgctcacacccttgtggccgggggcgtcggtggagcgggcgaagagcaggacgacgtcggcccaggtgccgttggtgatgaacatcttgctgccgttgacgacgaagctgtcgccgtcgcgcacggcccgcgtcgtcaggttgcccgcgtccgagccggtgccgggctcggtgaggccgaagcagccgacgtactcgccggaggtcaggcccggcagccagcgccgcttctgctcctcgtcgccccaggcggcgatcgtcttggcgaccaggccgagcgagacggagacgatgccgcgcacggaggagtcgccgcggcccagttcctcggtcaccaggcagtaggagaggtggtcgccgcccgagccgccgtactcctcgtcgatggtcagcccgaggaagccgacctcgccgagcttcttcacgatggaccggtccacgtcctcggcgcggtcccaggcgacgacgtggggggcgatctcccgttcgacgaagtcccgggcgagctgccgcaccgcggtctgctcctcgctgaggccgaggttcatgacggatcaccccacagatgacggatcttgaaagccgtacatttaaattatcactgctagttttacggcgcagccctactatgtgcgccatggcccgaccgcgcaagcccctcctgagcaccgaccgcatcgtcgcgacggcgcgggacctcgtggacgcggagggcctggcggccgtctccacccgccggctcgcggccgaactcggcgtcagcggaccctcgctctacaaccacttccgcaccaaggacgagatcctggaggcggtcgcggactcggtgagcggacaggtcgacctgtcgatgttcgaggacggccgcgactggcggaccgcgctgcacgactgggcggtctcctaccgcgccgccctgcgcgcccaccccaacatcgtcccggtcctcgcccgcggccccggccgccggccggccgcgctgcacctggcggacgccgtctacggcgccatggtcgacgcgggctggccgcccgcgcaggccacctccatcggcgcgctgatgcgctacttcgtgatgggctccgcgctcggctccttcgcgggcggcttcgtggacgacgccggcgcctacgaccccgccgactacccgcacctcggccaggcccacctgctcgccgaacaacaggagaagatcgacgagcgggccttcgagacggggctcgcggcgctcctggacgggctggcgcagcagtacggaacggacgagagggccgggcgggacgcttagcgcacgcgcccgctcttcggtggtcaccgaagtgtccgtgtcgcatcctgggacacatgaccgcgaacggacgcgtcaccccgacgggacgcaggagtgcgcaggacccccaggcgcccgggctggcggcgctcgccgggctgatcgccgacgagacccgggccgcctgtctgctggcgctgctcgacgggcgggcgtggacggccggtgagctggcc

SEQ ID NO: 507 - DNA, 12311 bp, Unknown
  Kingdom: Bacteria, Phylum: Actinobacteria, Class: Actinobacteria, Order: Streptomycetales, Family: Streptomycetaceae, Genus: Streptomyces
caccgcgacccccgcgccagcggccccgcaggccccgtcaccgaccgctccgcaggccccgtctccgcccgccgcccagggcccggctcgggccgccgggaccgaaaggcgagacggggctgaccacgatatgaccggcgggtagggtctggtgccgtgccgaagcccctcagtctccccttcgaccccatcgcacgcgccgacgacctctggaagcagcggtggggaagcgtgccgtccatggcggcgatcacctccatcatgcgcgcgcaccagatcctgctggccgaggtcgacgcggtggtcaagccgtacgggctgacgttcgcgcgctacgaggccctggtgctgctcaccttctccaaggccggcgaactgccgatgtccaagatcggcgagcggctcatggtgcatcccacgtccgtgacgaacaccgtggaccgcctggtgcggtcgggcctggtcgccaagcgccccaaccccaacgacggccgcggcaccctcgccgtcatcaccgacaagggccgcgaggtggtcgaggcggccacccgcgacctgatggcgatggacttcggcctgggcgcctacgacgccgaggagtgcgcggagatcttcgcgatgctgcggcccctgcgggtggcggcgcacgacttcgacgaggactgacgcgccggtcgccgcagcgcgacccggggcaagatctcccggaacgggcggttacgctcgactccatgaagaagagcgtgctgacccgctaccgcgtcatggcctacgtcaccggcgtgctgctggtcctgctgaccctcggcgtgatcgccaaatacggtttccagatcgacggggcggcgaagttcaccaccgtgatcggcatcgcacacggctggctctacgtcatctacctcgtcgtcgccttcgacctgggctccaaggcgaagtggccggtcgccaagcagctgtgggtgctgctcgccgggaccgttcccaccgccgccttcttcgtcgagcgcaggatcagccgggagctggaggccaaggtcaccgaccgcgccccggccgtcgcagaggcgtaacaacaccgccgtaccgcacgcgtacggcggtcagccgtcgacatttactaggacgtcctagtaaatttggagcatggacgctgacgccatcgaagagggccgccgacgctggcaggcccggtacgacgccgcacgcaagcgcgatgcggacttcaccacgctctccggcgaccccgtggagccggtgtacgggccccgggagggggacacgtacgagggcttcgagcggatcgggtggcccggcgagtaccccttcacgcgcgggctgtacccgaccggctaccgcgggcggacctggaccatccgccagttcgccgggttcggcaacgccgagcagaccaacgagcgctacaagatgatcctcgccgcgggcggcggcggactgtcggtcgccttcgacatgcccacgctcatgggccgcgactccgacgagccgcgctcgctcggcgaggtcggccactgcggggtggccatcgactccgccgccgacatggaggtcctcttcaaggacatcccgctcggcgacgtcaccacctcgatgacgatcagcgggcccgccgtgcccgtcttctgcatgtacctggtcgccgccgaacgccagggcgtggaccccgccgtcctcaacggcacgctccagacggacatcttcaaggagtacatcgcccagaaggagtggctcttccagcccgagccgcacctgcgcctcatcggcgacctgatggagcactgcgcctcgaacatccccgcctacaagccgctgtccgtctccgggtaccacatccgcgaggccggggccacggccgcgcaggagctggcgtacaccctcgcggacggcttcggctacgtcgagctgggcctcagccgcggcctcgacgtcgacgtcttcgcgcccggcctgtccttcttcttcgacgcgcacgtcgacttcttcgaggagatcgccaagttccgcgcggcccggcgcatctgggcccgctggatgcgcgacgtgtacggcgcacggaccgacaaggcgcagtggctgcgcttccacacccagaccgccggtgtctccctcaccgcccagcagccgtacaacaacgtcgtccgcacggccgtggaggcgctcgccgcggtcctcggcggcaccaactcccttcacaccaacgccctcgacgagaccctcgcgctgcccagcgagcaggccgcggagatcgcgctgcgcacccagcaggtgctgatggaggagaccggcgtcgccaacgtcgccgacccgctgggcggttcctggtacgtcgagcagctgacggaccggatcgaggcggacgccgagaagatcttcgaccagatcaaggagcgcggtctgcgcgcccaccccgacgggcagcacccgatcggtccggtcacctccggcatcctgcggggcatagaggacggctggttcaccggcgagatcgccgagtccgcgttccgctaccagcaggcgctggagaagggcgacaagcgggtcgtcggcgtcaacacggcgaccggttccgtcaccggggacttggagatcctgcgggtcagccacgaggtggagcgggagcaggtgcgggtgctctccgagcggaaggcggcgcgggacgaggcggcggtgcgctccgcgctggacgcgatgctcggtgccgcgcgctccggggccaacatgatcgagccgatgctccaggccgtacgcgccgaggcgaccctcggcgagatctgcggggtgctgcgggacgagtggggcgtctacacggagccggcgggcttctaggcgcctgcctgtggggccgtcaggccccacagcagtacccgtgtcaggcccctcacccactcctcgttcgccggttccgcgctgacgagggtgcggtggacgaccgcgcccgcgacgacgtcgaagatcaggtcggccgtgcgggcggcctcccgcgggtcgctctccagagggagttcgccgcgggcctgcgcccgcgcccggccctccaggaccagccgcttctggcgttccacgatggagccgcggatgcgttcgcgcagcgcgtcgtcgcgggtcgactcggcgacgacggccatcaggccgctcttggcctccggccgggccaggatcgccgcgaactggaggaccacgccctcgatgtcggccgccaggctgccgaggtcgggcagccgcagctcgtcgaagagttcggccacggcgtcgacgaccagttcgttcttgcccgcccagcggcggtacagcgtcgtcttcgcaaccccggcgcgggtggcgacgtctcccagggtgagcttcgaccagcccagctccaccagcgccgcacgcgtggcgtccaggatggccgtgtccgcggcggcgctgcgcgggcggccggcgcgggcgggcggcgtgcggctctgcatcccatgaccatatccgggtgatctgtcgggctgggccggatgggaaaccggcgggtcctgtggggccgtgagggagatcaccgggagacggtttcgcggaggcactccgcgccattacgctacgggtcgtagcgaaagcgcgggcgcggcccgtgcgagcgacgaccacggcagcatcacgcactcagcacacctgaagaccggcgcccggtggggaccaggcgaccggcacggtccggttcatccggccgttttcactcagacacgcggaacgggggaggatagacgcatgcagccacggaacatgtccatgagcggagtcgtcgacctcgccgcggtgaaggcggcccaggaggccaaggcgaaggcggagcaggcgcgcgcccaagcggcccgcgaaggcgggacgggggccgtgtcgcccgccgatctcgtcatcgacgtcgacgaggccggcttcgaacgcgatgtcctgcagcgctccgccgaggtaccggtcgtcatcgacttctgggccgaatggtgccagccctgcaagcagctgagcccggtcctggagcggctggccgtcgagtacaacggacgcatcctcctcgccaagatcgacgtcgacgccaaccagatgctgatgcagcagttcggggtccaggggatccccgcggtcttcgcggtggtcgccggccaggccctgcccctcttccagggagcggcgggcgaggcgcagatccggcagacgctggaccagttggtgcaggtcggcgaggagcgcttcggcctgaccggtctcaccgtcgacccggacgccgagccgggcggtcagacgcccgcgcaggccccggccgccggtccgcacgagtcgctgctcaatgcggcggcgcaggcgctggacgccggtgacctcgccggcgcggtccaggcgtacaagaacgtcctggccgatgacccggcccacccggaggccaaactcggcctctcgcaggccgagttgctccagcgggtgcagaacctggacccgcagaaggtccgtcaggaggcggccgagaagccctcggacgtgcaggcccagatcaccgccgccgacctggacctggtgggcggtcatgtgcaggacgccttcggccggctgatcgacaccgtgcggcgtaccgccggtgaggaccgggacgcggcgcggctcaggctgctggagctgttcgaggtcgtcggggcggaggacccgcgggtgagcgaggcgcgccgggcgctggcacgggccctgttctgacccctgccggggccggggcaccgaccggtcgccggaccagtcgctaaacgccgcggcgtgtgatgcccgggtgaaagatctgccgacgagtcaccacagcggccgcgctttgccaaaacttggtaatcgcggccgctgttactgcgagtaagagcaggctgtcggtctgcccggttccgtccggggatcaacatctttgttctgcccattgttgccacccagtgtcgccgttcgggatcagcgcgtcgaacgacggttatccggccgttactagcgagtaacgaacccccttgtgcgggcggcgagaatgcaccacgatcggcgacgctcggtccattcccgtaccccggcagccggccgggacgcgggaagtctgggtccccaccgagcagggccggcgacagtggcgtcggtccgaggacaggggggtcttcgccgtccggcgaagcctgtccagcagggttgtgcgtgatgcgtgtcaggcgcgaccagtggttgtcgctcgggggtgatcgccggtgattcgggcgcgttgcgcgccaccgagcgcgggcgctctccttcccgaggacgtagcacttctcccatccctgcccggcccagcccccgacgggggcgaagcggggtcaggagatgtacgtccgagaaggaggaaatatggagtcccaggtgcgtggcgggaccagatggaagcggttcgctgtggtcatggtgcccagcgttgccgccacggcggcgataggcgtggccctggcccagggcgcgctggccgcttcgttcagtgtgtcggggcaggagttcaaggtcacggccgacgaactgaacggccagaagttcacgcagtacggagcggtcgaccccggctacacgctttcgggtaagcagaccgctcacgccgtagcggtgtcgtcgttcgaaagcgcgacgatcaagaacctctgccagtcggtcgtcactcccgacatcccgttcgtcgggaccatcaccctgaagctgcaagccggcgacagcgatgaagcgaatcagcaggtctcggcggacaagctgttcatcgacatcgcggacctgaagaccaccggctacgcccagttcggcaacatcgacatcggtgtggccgccaaggacacgggtgacccgaaggccggtggcaagggcatcggcatgaagggcggcaaggaacaggccaacggcaacggtttcgcccagcaggccgacaaggccaagctggtcggggtgcagcagacggcgtgggccacgaccgcgggcaccttcacgctgcccaagctgcacatgtcgctgcacagcggcagcggcaggggcatcgagtgctactgagcacacgctgacgggtggggggaggccgaaggcactccccgcccgtccactcccgagccgcgctttcaccccccacatctccaccgcaccatcacccacagcaacgctgcaccagggagctgttttccatgagcgccgagacttccgccgtacccggccagttcacccgccggaggctgcagttccgcgcctggcgaggcagtcggcccttctgggccggtctgttcgtcctgctcggtggctttccgatcatgtacttcccgtacgcgcatctccaggtcggccacctgaccctcgccatggccaccacggccggcgcgggctccctgatcatcggcgtgctgctcatcgtcctgggcatcagcctctggttccagaagcacatccgggtcttcgcaggcgtcgcgtcgatcctgctggcgttggtgtcgctcccggtgtccaacttcggcggcttcctcatgggcttcctgctcgccctcctcggcggtgcgatggccgtgtcgtgggcaccgggcaagccgcccgcgccggaggcggccgaggagaccgggacggcgagcgcgatgggtgagtcgaacgacctgtcaggaacgagcccggccaacggggcgaacgggaggcacagtgccggctgacgaggggacccacggggctgatgtggaagagtcccgtgcgagaaccgggccgcgccacgcggcacgcaagaagccgctgttcaccaggttccacatgccggcgggcaaggcgatagccagcgtggcgatgcccacggcggtcctcgtggggatgggcttcacgtcctcgctcgccctcgccgacaacaaccacgcctcgaccaagtccgcgtcgtcgtccgagacgatgtcgcccgaggactacaagaactgcgtcgaggcgctggagaagtccaaggacgactcctctgcctcgcccacgccttcggtctccgcgagcgccaccgacgccgcgaaggacaaagagaaggacaagggcaaggacggggagacggccgaggagaaggacggcaagggcggtacgccgtctccgtcggccaccacctccaccggcacgccggagacgaaggacaaggccgcctcggacacgacctcttcgtcggattcaggttccgacgacaaggtccggcccacggcgtccgcccccgcgtccccgtccccctcggcgtcggcgaccaagaacggcggtctgctcggcggcctcggcgacgccctcggcgacctcctgaccggcggcaacaaggactccggagccagcgaccagaccaccaccccgtctccgtccgccaccccctcggcggacgggacgaagaaggacctgggcgcgaccgcgtccgacaccgtcaaggacaccaccaagaaggtcaccgacacggtcgacggcaccgtgaagggggcgaccgacgcggcgaccaaggcggccgaggacaccaccggcgcggtcaaggacaccgtgaagggcacggtcgacgacgccaggaagaagaccgaggacgccgtcaaggacgccacctcgtcgcccagcccgtccgcgagcgcgagcgcggacccgggggactgcccggcggccaccgacgcccaaggcggcgtcgacaacaagatgcccctggcggacgacccctggtacctggacgccagctccctgctgctcaagggcgccagctacaagggcgtcgtcgaggtcaggacggccaacggcagcgtcaagaaggtgctgaagtacgtcatttcgcacggtaccgacatcggtgacctgcaccagaccgtgaaggacaaggactccggcaagacgtaccacgtgcaggcggccaagggctcgacgtccacgatccgcgacggcgacacggtgatgtacaccgagagcctgtccggcaacctgctcggactgatcccggtgaccttcagcccggacaacccgcccccgctggacattccgctgatctacttcaccaaggtgcacgtggtgcaggcggctcagttcggcggcacgctgacggtgcccggaatgcacctgtacaccaccgactgaccgggagccgcgccacgcgagggcgcccccgccgatcccggcgagggcgccctcgtgtgtacgcgaacccgtacggaccccgtcccggcgacgtcagtcgcggccgccgccgcccaggtggtggacgcggaccatgttcgtggtgccggggacgccgggcggggagccggcggtgatgatcacgatgtcgccctcgttgaaccgcttgagcttgatcagctcctggtcgacgaggtcgaccatctcgtcggtgctgttgacgaacggcaccacgtgcgactccacgccccagctgagcgccagctggttgcgggtggactcgtcggtggtgaaggcgaggatcggctgggccgcgcggtagcgggacaggcggcgggccgtgtcgccggactgggtgaaggccaccaggcccttgccgccgaggaagtcggcgatctcggcggcggcacgggccaccgaaccgccctgcgtgcgcggcttcttgcccgggaccagcggctgcaggcccttggagagcagctcctcctcggccgcggcgacgatcttcgacatcgtcttgacggtctcgatcgggtacgcgcccacgctcgactcggcggacagcatcaccgcgtcggcgccgtccaggatcgcgttggcgacgtcggaggcctcggcgcgggtcgggcgggagttggtgatcatcgactccatcatctgggtcgccacgatcaccggtttggcgttgcgccggcacagctcgatcaggcgcttctgcaccatcgggaccttctcgagcgggtactcgacggccaggtcaccgcgggccaccatcacgccgtcgaacgccatcacgacgtcctgcatgttctcgaccgcctgcggcttctccaccttggcgatgaccgggacgcggcggccctcctcgtccatgacgcggtggacgtcggcgacgtccttggcgtcccggacgaaggacagcgccaccatgtcgcagcccatgcggagggcgaaacgcaggtcctcgatgtccttctcgctcagcgcgggcacgttcacggccgcgccgggcaggttgatgcccttgtggtcggagatgacaccgccctcgatgacgatcgtcttcacccgcggaccctcgacgtccaggaccttcagctcgacgttgccgtcgttgatcaggacctggtcgccgcgcgagacgtcacccggcagccccttgtacgtcgtgccgcagatctgcttgtcgcccgggacgtcctcggtggtgatcgtgaactcgtcaccccgctccagctcgacggggccctccgcgaaggtctcgaggcggatcttcgggccctgcaggtcggcgaggacggcgatggcccggccggtctccttggacgcggcgcggacgcggtcgtagcggccctggtgctcggcgtgggtgccgtggctgaagttgaagcgggccacgttcatgccggcttcgatcagcgcgacgagctgctcgtgggagtcgaccgcggggccgagagtacagacgattttcgaacggcgcatggggcgatcctatcggtttgtttcgctgcggaatattccgtctggcggaatatacaaatgggcgggtctgcgctcagtcgagtgccgctggaagtgccggtggggatgccggtcgaattctgttgttcgctcctgttcgctacttgtcctttccgacgagggcgtaggtctgtgccgcgatctccatttcctcgtccgtggggacgacggccaccgcgacccgcgcgccctcgggcgagatcagccgcgcctcgtcaccgcgtacggcgttgcgcgcgccgtccaccgccaggcccagtccttccaggtccgcgagggccgccgcgcgcacgaagtccgcgttctccccgaccccggcggtgaaggcgaccgcgtccacggtgccgagtaccgcgtaataggcgccgatgtacttcttcagccggtgtatgtagatatcgaaggcgagccgtgcctgctcgtcgccctcgtcgatccggcgccgtatctcccgcatgtcgttgtcgccgcagaggccgaacagaccgctcctcttgttgaggagagtgtcgatctcgtccatggacattccgccgacgcgctgcaaatggaagatgaccgcagggtcgaggtctcctgaacgcgtgcccatcaccagcccctccagcggggtgagccccatggaggtgtccacgcagatcccgccgcgcaccgccgaggcggaggcgccgttgcccaggtgcagcacgatcacgttgacgtcctcgggggccttgcccagcagctcggccgtcttgcgggagacgtaggcgtgcgaggtgccgtggaagccgtagcggcgcacccggaagcggtccgcgagcttgggctcgatggcgtagcgggcggccgactccggcatggtggtgtggaaggcggtgtcgaacacggcgacctgcggcaggtcggggcgcagcgccgtggcggtgcggatgccggtgaggttggccgggttgtgcagcggcgccaccgggatcagccgctcgatctcggtgaggaccgcgtcgtcgatgacggtcggctcggtgaagaacatgccgccgtgcaccacgcggtgcccgatcgcggccagttcgggggagtccaggccgagcccgtccctggccagttcctcggcgacggccttcagcgcgccgtcgtggtcggcgatcgggccgttctgctcccgggtctcgccggtggtcaggcaggtgtgcttgagccgggaggtctgctcaccgatgcgttcgaccaggccgacggcgagccggctcgcgtcgcgcatgtcgagcagctggtacttcagcgacgaggagccagagttgaggacgaggacacgggtcgcgttcacggtgttcaagggttctctctacgacgtcagggggcgggcgtgccgggagcggcgggcgtggcggaggtgcgggcctggtcctgggcctggatcgcggtgatggcgacggtgttgacgatgtcctggaccagggcgccgcgggacaggtcgttgaccggcttgcgcaggccctgcaggaccggtccgaccgcgatcgcgccggccgagcgctgcacggccttgtacgtgttgttgccggtgttcaggtcggggaagaccagcacgctggcctgcccggcgacctccgagcccggcagcttggtcgcggcgaccgacggctccacggccgcgtcgtactggatcggtccctcgatcatcaggtccgggcggcgcagccgcaccaggtcggtcgcctcgcgcaccttgtccacgtcggcgccggagccggacgtgccggtggagtacgacagcatcgcgatccgcggctcgacgccgaactgggccgcggtggccgccgactggacggcgatgtcggcgagctgctcggcgtccgggtcggggttgaccgcgcagtcgccgtagacgagcaccttgtcggccaggcacatgaagaacacggaggagacgatggacgcctccggcttcgccctcccgtcgcccgccaccgccctgcccgacgcgctgcgcgcggccccccttgtcttgatgatctcgaaggcggggcggatggtggcggccgtggagtgcacggaaccggagaccatgccgtcggccaggccctgctgcaccatcagcgtgccgaagtagttcacgtcggagaccacgtcgtacgccagctcgacggtgacgcccttgtgggcgcgcagccgggcgtactgctcggcgaaggcgtcgcgcagctcggagacggccgggtcgatgagctgggtgtcaccgaggtcgataccgaggtcggcggccttcttgcggatggtgtccaccggcccgagcagcgtcaggtcgcacacaccgcggcgcagcagcacctccgtcgcgtgcagcacgcgttcctcggtgccctcgggcaggacgacccggcggatgtcggagcgggcctgttcgagcagcttgtgttcgaacatcatcggggtgacgcggtcgctgctcggcgcggagacccgcttgttgaggtcggtggtgtcgacgtaccgctcgaacaggccgagggcggtctccgccttgcgcggggtggccgcgttcagcttgccctccagggagaacagccgttcggcggtggggaagctggtgccggacaccgagacgaccggggtgccgggggcgagccgggcggcgagggtgaggatctcct

SEQ ID NO: 508 - DNA, 9334 bp, Unknown
  Kingdom: Bacteria, Phylum: Actinobacteria, Class: Actinobacteria, Order: Streptomycetales, Family: Streptomycetaceae, Genus: Streptomyces
cagctcctcgcaggcgcgccggatacggttcgcggcgcgcctgcgaggagctgatcgagcaggccagggtcgagatcaacggcgagatcgtcatggagcagggccgccgggtcgacccggagaaggacgaggtcaaggtcgacggcctcaccgtggccacgcagtcgtaccagttcttctcgctgaacaagcccgccggtgtcgtctccaccatggaggaccccgagggccggcagtgcctcggcgactacgtcaccaaccgtgagacgcgcctgttccacgtcggccggctcgacaccgagaccgagggcgtcatcctgctcaccaaccacggcgagctggcgcaccgcctcacccaccccaagtacggcgtgcgcaagacctacctcgcgcacatcgtcggcccgatcccgcgcgacctgggcaagcgcctcaaggacggcatccagctggaggacggctacgcccgcgccgaccacttccgcgtcgtcgagcagaccggcaagaactacctggtcgaggtcaccctgcacgagggccgcaagcacatcgtgcggcgcatgctcgccgaggccggcttcccggtcgacaagctcgtgcgcaccgcgttcggcccgatcacgctgggcgaccagaagtcaggctggctgcgccgcctgtccaacaccgaggtcggcatgctgatgaaggaagtcgacctgtaggcggtacgcctccgtcctgggcccggtcctggacccgggacggcggtggacccgggacggcggtgaggacaggggcggggcgggtgccgccggacgcccgtgtccgccggacaggccctaggccggttcgtccgcgtgccgggtgagggccgaggcgtggcggacgcggatcaggaggtcctccacgcgtcgctggtcgggctccgcgggcagcggggtgcgctcagccgcccgctcggcctcgtccgccagacgggccgtccaggactccacctcggcccaggagacctcgccgcgcttcacggccagccaggcggggccgggcgtcgcccacgtccagcgtgaggcggcccgtgcgcagcaggtcccgggcggcggccagcagccgcagcaggtgcatggcgtgcttccagcgcggggcgccgtgcgtgcgcacgtcggcgtcgagcctgcggcgctggtcgcgggcgtagccgatgaaggtggcgtacaccctgcgggagaggaacgcctcgcgcagggcgagcagttcgcggccggtgccgtcggcgtgctccacgagcggggagtgcaggcactccaggatgttcgggttgccgcgcagcgccagtgcgcagaagcgttccagttcccagctgaactgctcgggcagcgggccctcgacgtgcgccggaggcttctcgaagcgccagaagagcggtgcgggggcgacgaagacgccacggcggtccgtgtcgctgtccttcgtcaccagcccgaacgcccgcgagcccatcacacaggagtagatcgtgtggtcgcgtaccaggtccccgggctgcatgtccgggagcgtacgcggatcctcaggccaggcggatggaatttccctccacctggatcttcttggcggccagcggccgggccgccgggccgtgggccaccgagccgtcggcgacgtggaacatgctgccgtggcaggggcagtcgatggtgccgtcggcgaccttgctcaccgtgcagccctcgtgggtgcagaccgccgagaacgccttgaactggcccttcaccggctgggtgacgacgaccccgtgctccttgatgatcttgccgccgccgaccgggatatcactcgtccgggtgagctccgcgccggcggccatgctgtgcgagggggaagcggcggcggccgtgggcggggccgaggacggggtctgcggtgccgacgagacgtcgtccgccgcggacgagctgccgccgcccgatttcgagtcgctgcaaccggcggcgagcgccgccgccgcgcccgttgcgagaaccgtgcgccgggtcgatccctgagtcatgccgtcactccgaggggtgccgaggtggggggagccgctccgagcggagcggaagcatcttcgcaccgaagactcccaagtcgaagtaaatcggcgtcgactagcgcaaatggtgcagcggtgcgtgctcgccacctcgccccggcgtgtccgcaccccgtctcagccggcgggcgccgcgcctgccccgcgcgccgcctgactaggctggtcggccgggaaccaccgagacacacgtcagcgaggagcagcgccgtggcggtacgagcggtccggggggccgtccagctggagcaggacgacgccggtcacatgagcgagcaggtcggggcactgctgaccgccgtcctggagcggaacggcctgagcaccgaggacctgatcagcatctggttcacggccacccccgacctgcacagtgacttccccgccgtcgccgcccgccggctcggcatcgtcgacgtaccgttgatctgcgcgcaggaactggacatcgagggcgcgatgccccgtgtggtccgcgtcctcgcgcacatcgagaccgaccggccgcgcgccgagctcgcccacgtctacctcggggcggcggccgccctgcgcaaggacatcgcccagtgaggaacgcactcgtcatcggcaccggcctgatcggcacctccgccgccctggccctcgtccggcgcggggtgggcgtgcacctcaccgaccgggaccccgagcaggtccgtacggccgtggcgctcggcgccggcacggacgaggcacccgggggacccgtcgacctggcgatcgtcgccgccccgcccgcgcatgtcgccggggtgctcgcggacgccatgcgccgtggcgtggcccgcggctacctggacgtggccagtgtcaagggcggcccgcgccgcgagctggaggcgctgggcctggacctcagcgcctacatcggcacccatcccatgtccggccgggagaagtccggcccgctggccgcgaccgccgacctcttcgagggccgcccctgggtgctcacccccacccgcgacaccgacaccgaggtcctcaacctcgccctggagctggtctcgcactgcagcgcggtcccggtcgtcatggacgccgacgcccacgaccgtgccgtggccctggtctcgcacatgccccagctggtctccagcacggtcgccgcgcgcctggagcacgccgaggaggcggccgtacggctgtgcgggcagggcatccgggacgtcacgcggatcgccgcctccgagccgcagatgtggatcgacatcctctcggcgaaccccggcccggtcgccgacctgctcgccgacgtcgccgccgacctggacgagacggtacgggccctgcgggcgctgcagtcctccgacgaggcgaagcgcgtcgagggcggcgcgggagtcgaggacgtgctgcggcggggcaacgccgggcgggtccgggtgccgggcaagcacgggtccgcgccgcgggcgtacgaggtcgtcgcggtcctcatcgacgaccacccgggtcagctggcccgcatcttcgccgacgccgggctggccggggtgaacatcgaggacgtccgcatcgagcacgcgaccgggcagcaggccggtctggtgcagctgacggtcgagccgaaggccgtccccgtcctgacggcagccctgcgggaacggggctgggcgctgcggcagtgaggcggagcgccgggtggtgcgggcagcctgcggcggtgaggccatgaccgtgccgtgaggcgacgaccgtgccgtgaggccatcaccgtgccgtgaggccgcgaccgtgccgtggtgagggccgtaccctccggcagtcggagggtgtcctggcagccagtaaccttgtgcgggggcccctggctcccgcacacccgcccgccacccttcaccaggaaggtgccccgctgtggaacacggcgccgcccggaccgcccagcccgtgattgtcgccatcgacggcccctccggcacgggcaagtcgagcacgtccaaggccgtggccgcgcagctcggcctgagctacctggacaccggcgcccagtaccgggcgatcacctggtggatggtgaccaacgggatcgacatcgaggacccgaccgcgatcgcggccgtggccggcaagccggtgatcgtctccggcaccgacccgtcccacccgacgatcaccgtcgacggcacggacgtggccggcccgatccgcacccaggaggtcacctccagggtcagcgccgtcagcgccgtgccggaggtgcggaccgtcatcaccgagctgcagcgctccctggccggcgccgccgaggacggaatcgtcgtcgagggccgcgacatcggcacgaccgtgctgcccgacgccgacctgaagatcttcctcaccgcctcgcccgaggcccgtgccgcccgccgcagcggcgagctgaagagcaccgacgtgcacgccacccgcgaggccctgatcaagcgggacgcggccgactccagccgcaagacctccccgctggccaaggcggacgacgcggtcgaggtcgacaccaccgacctcacgctggcccaggtcatcgagtgcgtcgtcacgctggtcgaggagaagcgggccgccggccggcgggccgtcgaggagaagcgggccgcgctgtgagtcttccgtcggagcgtacggcggatcttccgtcggagcgcggcgcggacgtcgggcgccgcatcggcgtcgggctgatgtacgggctgtggcgcccgcgcgtgctgggcgcctggaaggtgcccgcgaccggaccgctgatcttcgccgtcaaccactcgcacaacgtcgacggcccgatggtcatgggcgtggcaccccggccggtgcacttcctgatcaagaaggaggcgttcgtcggcccgctcggctccttcctgaccggcatcggccagctcccggtggaccggcacagcgccgaccgcacggcgatcacccgggcgctgggtgtcctggaacagggcggcgtcctcggcatctttcccgagggcacgcgcggcgagggcgacttcgcggcgctgcgcgcgggactcgcctacttcgccgtccgcagcggggcgccgatcgtcccggtggccgtgctgggaagctccgagcggcgcggacggttgataggagggctgccgccgctgcgctcacgcgtggacgtggtcttcggcgagcccttcgaggccgacggaggggcgcgaagctccgacacgggtggtggtgggcgacgggcgggcggcagcggcaggcgcacccggcaggcgctggacgtggccaccgagcacatccgcaagcagctcgccgaccacctggaagacgccaggcgcctcaccaggcgctagaggacacttgagtagtggatcagcacgggaccgtggtgatccaccgaccaccacgatgaactacgaggtacggacttcatgaacgacgacatccagcccgacggctcggccgagcacgagtacgagcacggggcgctcggcgacgccgagtacgcggagttcatggagctcgccgccgaagagggcttcgacatcgaggacgtcgagggcgccatcgaggccgccgggcacggcccgctgcccgtcctcgccgtcgtcggccgccccaatgtcggcaagtcgaccctggtgaaccgcatcatcggccgccgtgaggcggtcgtcgaggacaagcccggcgtcacccgcgaccgcgtcacctacgaggccgagtgggcgggccgccgcttcaaggtcgtcgacaccggcggctgggagcaggacgtcctcggcatcgacgcctccgtggccgcgcaggccgagtacgccatcgaggccgccgacgcggtcgtcttcgtcgtcgacgccaaggtcggcgccaccgacaccgacgaggccgtcgtccggctgctgcgcaaggccggcaagcccgtggtgctgtgcgccaacaaggtggacggccccagcggcgaggccgacgccgcctatctgtggtccctcggtctcggcgagccgcacccggtctccgcgctgcacggccggggcaccggcgacatgctggaccgggtcctggaggtgctgcccgaggcgccgcgcgagaccttcggcgccggcggcgtcggcggcccgcgccgcatcgccctgatcggccgccccaacgtcggcaagtcctcgctgctgaacaaggtggccggcgaggagcgcgtcgtcgtcaacgagctggcgggcaccacccgcgacccggtcgacgagctgatcgaactgggcggcgtcacctggaagttcgtcgacaccgccggcatccgcaagcgggtccacctccagcagggcgccgactactacgcctcgctgcgcaccgcggccgccgtcgagaaggccgaggtcgccgtcatcctgatcgacggctccgagtccatctccgtgcaggaccagcggatcgtcaccatggccgtcgaggcgggccgcgcgatcgtcctcgcctacaacaagtgggacaccctcgacgaggagcgccgctactacctggagcgggagatcgagaccgagctgggccaggtcgcctgggccccgcgcgtgaacgtctcggctcgcaccggacggcacatggagaagctggtcccggcgatcgagaccgcgctggcgggctgggagacccgggtgccgaccggccgcctcaacgcgttcctcggcgagctggtctccgcccacccgcacccgatccggggcggcaagcagccgcgcatcctcttcggcacccaggcgggcaccaagccgccgcggttcgtcctgttcgcctcgggcttcatcgaggcgggctaccggcgcttcatcgagcgccggctgcgcgaggagttcggcttcgagggcacgccgatccacatctcggtgcgggtgcgcgagaagcgcggcgcgaagaagaagtgaagcgggcgcgcggatgacgcgcgcgacgtgaatgggcggcccccgggtgcgggggccgcccattccgtgttcgtacgtctgcgccgtccgcccctcggaccccgtccgcgagccgtccgtgggccgctgtacgccggtgtccgtgggcccggcgtcccggagggtcagcttccgcggcgggcgggcggcagcgccgccgggacgtgctgcatgccggtgccggtctcctgccgcccgagcgttccgacgcgctgccactgcgtctgctgctggccgccggtgccgtgccgggtgccgtaggcccccgcgccgtaggtgatgtacgcgttcgcacccgtgccgtgcctgaggttcccgaacgcgacgaagcccaggtcctcctcgccgctccggtcgcccggcagcgtccggaaggacctgacgtactcggtgtagagcgcgtcgtagatcggcgtggccgaggggccggccggagactcggccggtcgcgcggaccggatcggctggtagggctggcggcggggaacgtcatattcgtgcacgtatgtccaaacgaccccgaaccggaagggatgcggctcaggtcccggcgagcggcagcgtcgccgcgaccagcctgccctgtgccgccgccttgtccagggcgttgcgcagcaggtcctcgcgcggctggcggccgatggagccgaccggcgccgcgaacatcagcacctgctggtgcttgttggccgccgcccgccagccctcggtgacctggaggggctggtgcgcctgccaccaggccgccggccggccgccgtcggcgcccggctggagaacggcgtgcagctgtcccatggccagcagcaccgaccagccgtgcaggaccggcgggacggactcgaggtcggccacgggcacatagccctgctcggtcagcagcgtcaggaagtcgtcgccgggaccggtcgtgcccggccgcacgatgggcgccgtcggttcgacgaccagcgcgggatgcagctccccggcgaccaggacgagaccgctggtcacgccgagcacggcctgctcctgcgccgcctgccgctgagcggtctccggcgcggcctgctgcggcacgcccggggcgggcaccccggcggcgtcctggccgcccgtgtccgcgtggatggagcggaccgcgccccgcagctgctcctcggtgacctggaccacctgggagggcaggcaggtggcgtgggcgaaggcgaggacggcggtctcgtccccgacgaacagaacggtgctggtgcgctcctgtgcggagtcgccgggggtgcggcaggacgtgcagtcgtaactgcccggggcgttctctccggcgagcagccggtcggcttcttcgtcgccgatctcggcgcgtacggcgtcgctgacgtcgagcatgcgcggcacgggtggctcctcgggatgcggtgcgtggcgggaccgggtggctcccggcccatgaaccgggagggcccccggctcatgcagaagacaacggccgatccgcggagggagtcacgccctgcggcggacggaatcgaacctcccgcacgcggccatcacgcagagtttgcgcaccatcacgcatcgtaaactcccggtgtggcggtggaccttgaccggtctcgcagggagtgtcgtacggggggcggagcgagccggaaggctgtcccgaaccagtggaattcctgtgcggggccggtctcgcgggggcccacgccggagcgaagcggaatgccacttcgcgcgtactccgagcccggccaccgggcctttccgccatctcccttctcctccctccttcttctccgggtgtttccgccggagaatttccggagtgcgtccacggtgtccgcgaattgcgttcgaatgagcgcggaagagggacggaaccgctcgcgcgggtgacggagtccggcgccgcccaccgtggtgatcttgtgacgtaaacgtgacaggggaggcgcattagagctgatgtgactactgagtacgcagcggacttcctcgcgaaggaggcggacgggaaggggacggcagggcctacggtgggggcatggcacccatccccactccgcccgcggagccccaggacagtcccgaacggtacgtcggtctcgaggccgggcaggccgaacggctcgcgcgggagcagggctggtccacggtccgttcgctgccgccgggagcgatcatcaccatggagtaccgggtcggccggctcaacttcgaggtcagtgacggccgggtggcccgggcctggaagggctgagcggtccgcagagggctcggcggcggcgttggacgcgggtcaggagcgggccgggtcgggagcgggccgccgggccggtgcaggggcctgtgc

SEQ ID NO: 509 - DNA, 6595 bp, Unknown
  Kingdom: Bacteria, Phylum: Actinobacteria, Class: Actinobacteria, Order: Streptomycetales, Family: Streptomycetaceae, Genus: Streptomyces
gcgggtccgctgcggcggcgcgcggtgccaggggtggcagcagggcggcggcgagggccagggtcagggcggttgcgttacggcgggcggtgccgaccacgtgaggtgtctcctcgggttctcggtgcggcacacgggccggtcccccgccgtgggggcaccggcccgtgccgggacctcggtgggcggctcgtgccgtacggcggtcagccgcccgggtgggcggctgcgcgtcgtacggtggtcagccgcgccaggtgtcgtgcagggtgagcaggccggtggtgccgacggtggcggtgcggttggcgccgctctcccaggtgacgttgccgttcgcgtccttgcggacgtacttgtactggaaggacgtgccggcgggcagggagacgtcgagcttccacaccgggtagctcgcggggtccagcttcagggcgttggcggtgttccagttgccgagcgcggagttgtcgccggtgacgtagatgttctcgccccactgggtggtggcgttgacctggaaggacgcgccggtggcggtgttgccgccgccgttgtcgcctcctcctgggttgccgccgcaggtcctggcgtccacgtgcagggcgagcgcggtgttggcgccgagggtggcggtgaactggccggaggagttcacggtgacgcccttgccgctctgcacgtcgcagtagtcaccggcgggcagggaggtctggaaggtgcgggtcagtgcggagccctcgtggttgatggcgacgtacgccttgtcgccgcggccgaaggcgatctggttgccgccgttgtcccaccagttggtcaccgcggtcccggcagcggtgttgcggaacttgaccatgctcgcgatctcgcgccaggcgtgctcgcacttccatccgtcggtgtaacaggcgtcgacctggccgttgtcggggccgcccgcgtccttgtcggtgaactcgtagccggagtgcacgtcgggcgagccgtagggccaggccagcatgaagacgtgcgcgagggtgtagacggcgccgtccttgtaggtgagggtgccgccgttgcgctccgtgtcgtggttggtgatgaacacggacgccttgtcggagcggaccaggccccaggcctcgccgaagttcttcagctccgagagcttctcgttgttgaagacacgtttgaggtcgtaggcgtagttgaactcctggacgtcgccggtgccgtagtactcggacggctggaccgcctcgccggccgcgccgatcgtctcctgcttccagtagacgccggagttcgtcagccgggacttgatgttcgcgaggtcgtcctcggggatgtgcttggcggcgtcgatgcggaaaccgtcgacgccgagggagagcaggtcgttcatgtacccggcgatggtcttgcggacgtactcctcgccggtgtccaggtcgggcaggccgcccatctcgcagtgctgcacgttccagcggtccgcgtagtcggtgacgggcgtcatgcagtcgtccatgtcggcctgggagtacgtgcccgggtagttgtacttggtgaacggcgacccggcggtgccggtgccggaggcgttcgccatgtggttgatcacggtgtcggcgacgaccttgacgccggcggcgtggcaggtgtcgaccatgctcctgaacgcggcgcggtcgccgagcttggtgccgatcttgtagctgaccggctggtacgccgtccaccaggaactgccctggatgtgctcgttcggcggggagacctgaacgtatccgtacccgtcggggcccagctcgtccgtgcaggccttggcgacggaggcgaagttccactcgaacatcaccgcggtgacgtccttcccgcccggcgccgaggcctgcgcgggggtcggtgccgtgacggccacagcggctcccgccacggcggcgagtgcagcggccacggtctttctggccatggtttctccagttcgtgagtggggtgataccggagcagcagcctcgagtggcaacgcgccgtgccggagaaggccgtagggactcttgccgcggagtgtttcttgctgcaagagattgcggccgagaacgtacggcgccgcattaccgccggtcaacccctcgcgcagaaaagcccgttcagcaggcagccgccgcctgccgagtaccgcaaggcctttcgcaagaatttcaacgatgctacgttcgtcgaactccggcccccggccggggggtcggaccgccggtcagccgccgggccgcccctacgcgcccggccggcggccggagtgccgggcgccccgtcgttctcgaccgtcagctcggccctgccgtcgctcacgcgcaacgagatcacgcactgccgcggccctccggcccggtgcacgaggacatcaccctgagcgaggtcacttcatgacgatgccaccggctcccgtccggctgctgctggccgacgacgagcacctgatccgcggggcgctcgccgcgctgctctcgctggaggaggacctgctggtcgtggcggaggcggcgagcggacccgaggcgctggcgatggcccgggcgcacgagcccgacgtcgccgtactggatctgcagatgccgggcgcggacggtgtgaaggtcgccacatccttgcgggcggagctgccgggctgccgggtgctgatcgtgaccagtcacggccggccggggcatctgaaacgggcgctcgcggcgggggtgcgcgggttcgtcccgaagaccgtcagcgcccagcggctcgccgagatcatccgcaccgtgcacgccgggaaccgctacgtcgacccggagttggccgccgacgcgatctccgccggggactcgccgctgaccgcgcgcgaggccgaggtgctggagctggccgccgacggcgcaccggtcacggagatcgccgagcgggccgcactctcccccggaaccgtccgcaactacctgtcgtcggccgtgacgaaactgggcgcggagaaccggcacgcggcggtacggctcgcacgcgagcgaggttgggtatagttgctctcgcgccacggcgcaatgcggacgtagctcagttggtagagcgcaaccttgccaaggttgaggtcgcgagttcgagcctcgtcgtccgctccgcagagaagccccccggtccaccaccggggggcttcctcgtgcgtcaggagcctacgaccaggtcgtcccggtcagccgctcgtacgcctccacgtacttgccgcgggtcgcctccaccacctgctcgggcagcggcggcgggggctgttcgctcgtgcggtcccagccggactcggccgaggtcagccagtcgcggacgaactgcttgtcgtacgagggctgcgcgcgtcccggctgccactggtcggcgggccagaagcgggaggagtccggcgtgagcacctcgtcggcgaggacgagcgtgtcgccgtcgtagccgaactcgaacttggtgtcggcgaggatgatcccccgctccttggcgatgtcccgggcccgtccgtagacggcgagggtcgcctggcgcagatgggcggcggtctccgcgccggcctggcgggccacctcctcgtaggagacgttctcgtcgtgctcgccgacctcggccttggtggccggggtgaagatcggtgcgggcagctcggaaccgtcgaccaggccctcgggcagggcgaggccgcagaccgtgcgggaggcgttgtactcggccaggccggagccggtgaggtagccgcgggccacgcactccacggggaccatccgcagcgacttgcagaccagcgtgcggccggcccagtcggcgggggcgccctcggggacgtcggtgctgatgacgtggtgcggggcgaggtcggcgaggcgctcgaaccaccacagggagagccgggtgaggatgcggcccttgtcggggatctccgtgggcagcacccagtcgtaggcggacatgcggtcgctggcgaccatcacgaggtcgcccgcctcgttctggtacagctcgcgcaccttgccggtgtgcagatgcaccagacccggaacctggatcggctcgggcttttcgacgaatccggacacggttcctccccgtggttctgtccaatgccccgattctcccgtatcgggggtggggcgaggacagcgggtcagtcgcgcttgcagatgcggtccaggaggttggcggtggcgcgctggatgcgggggtcgacgtggccggggcggtccagcgccggtgaccaggcgaaggtgccggacgcgaagacgagggcgccggacggggcccggtacagggacgtctcctggtggcgcggggcgccgtcgctgtcggtgtacggggagtgcgcgaggaggatgcggtcctggtggtcggggagcggggtgcgcgggaagtagcggtcggcctcgcctgcgaccaggccctcgatcccgtcgccctcccgcgctccggtcgcctcccacagccagtggtcggcgttgcgcacgatcagcgggtgcggttcggggacgcggcccgcgtactggatgccgacgagctgctgctcgggccggtcgatctcccgccagagcaccggccggccggggcccttgcgtttgcggcaggtcagcaggcggtcggggacaccggccggggacgggcccagctcgacctgccagtacatggtgttggcggagaggaagaccagggacgtgccgtgctcgcgggcgagttcggcggtgcggcgcatcggggccgaccagtactcgtcatggccggggaagaccagcccgcggtaacgcgtggggtcgacgcggccggcgtgcaggtcgcgggcgtcggcgtaggcgaggtcgtagccgtagcgctcggcccagcggatgaagtcgtaggcgtggccgacgtgcagcggcagtcccgcgcccgcgtacggccggtcgaaggagaccgtggtcgccgcgtccgcctcgccgagcagccggccctcctcgtcccaggcgtggtagaggctggccccggtgtggccgtcctccgggtagaggttgtaggcctgccaggtgacgtcgggcagcagcaggagcaggtccgccgggtgggtgtcgcggaccgtgaacgggatgtgggagcggtaaccgtcggcggtggtcagcacggcgacgtacgcgccgatgctccagtacgacgggatctgcagccgccaggacagccaccagtggtggcaggacacggtgcggtccgcggtgagcggcgggggctggacgatgccggagagccgcggactggtggtgatcttggcggcgccgtcaccgccgtagtggccgatgcggtagatgtcgacgctgaactcctgcggcgggtccaccgtgatgtggaagtcgatcgcctcgccgggcgtgacggcgccggtggaggcgaagcccttgatctggcggcgtacgtcgtcggccgagcgggggccgcctccgcaggcgcggggagccgggatgcggggtgcggtggccgtcgcaccggcgccgcccggcgtgccgggtgcggagtgcggggccgggtcgacgtaccaggggacgacctggccggtgtcgtcgaagtacgtctcgctgccgcgcagccaggggacggggccctggccgaaggggtccgtgacggcgtgcgcgagtgctcccgactcccagcggcggacacggtccgatcccatggctgtccccctccctcgtgcccccgtgctctgtcgtgcggcggtgcgaatgtgtcgtccggggcggctgtacggcggtgcggatgcggcggtgttggtgtgcgggcgggggcctgggtgccccggggcggccgttcctcacggtacggccggacatgtccgcgcggctgtcgtatgtcgtacgcgcttgccacgtgcgcggccggtcccagcacatcacataacgcgcgcatcttgtcactactcgttccgaattggccgaaagtggaagcagcgcatccggtagtccttcctccggatcggcacgggccgaggtcaggccagccgtacgggcttttccggacgtatgcccgcgtcgatgagccaggtccgcaacgggagggggtcgccgtcctcgacgagggcgaggaccctggggccgaggtcggcggctctctcgccgtcgatgaggagggcggggccgtcgagccagtcgaggcccggagtggctcccgcggtgtccatcgcggcgcagcagaccatcgcggtgacgtggtcggcgaggagttcgcggccggtgcggggcggctgaagcgggaacaggggcagtgcggcctcgtcccaggagagcgccgggagcgcgccggcggcctggccggccgcttccgccggatccgtgcggaccgccggtgcggtggcctcctcacgggccagttccgcgctgaggccggcggcgagcgccgcgctccgctcgttgcccaggccggcctcgtcgtccggctcctgggcctcggcatgggcttgggcccgggcttgggcgtcggcatgagcccgggcttcagctcgggcctcggggtgggcgaaggcccggctcgtgtctttcgtgccggtcgcgtcgtcctcggcggcgaaaggggtgtgcggtgtgtgcggtgtgtg

SEQ ID NO: 510 - DNA, 4228 bp, Unknown
  Kingdom: Bacteria, Phylum: Actinobacteria, Class: Actinobacteria, Order: Streptomycetales, Family: Streptomycetaceae, Genus: Streptomyces
ggccgagccgaaggggacctgggcgtcccgctccggctcggccagcacccggcgcgcgttggcgagcgagaactcggccagctccggatcgagcgccagcggccggcccagggcctcgtcgaggtcccaggagtgggtcaccagttccatcacatagccggtgagcgcggcgcggccggtcacctcgccccacggtgcgcgcgtcgtcgccgccatccgctcgtcgctcgcccacgccttcaggacacgggtgcggacctcctcgtaggcggcgggccagccgtcgtcggcgacgccctccacggtggtgtcgacggcgagcccgtcgccgccctcgccgatgaccgcgatccgacggctgctgccgaccacgtgcgccagcagcgcccgcacgtcgtactccgtgcacggcgtcggatcggtcagctgttcgggccggacggtcgcgatcagcgcggcggcctgctcggtggcgcgtgagtagagagggcgggggtcgggggagttcatgtgctgcctcttccggttcggcgaccgggcccgctgcccggtgctgagtccacagtcggccgaaaacctgacagccgccgtcagcatttgatccggggctccacgggcccgatccttgaggccgtgaagtccgaccgcctgctgtcgatcctgctgctcctgcagacccggggccgggtgcccgcccatgaactcgccgaccgcctcgaagtgtcggtgcgcaccatctaccgcgacgtcgaggcgctgtcggcagccggcgtcccggtctacgccgaacggggccggcacggcggcatcgccctgctcgccgggttccgcaccgacgtcaccggcctgaccgccgacgagtcccgcgccctgttcgtgctggccgcacagggggcgcacgccgcccttggcctcgactcggcgctcggttcggcgctgcgcaaggtgatggcggcgctgccggccccgcaccggcccgccgccgaggaggtcagccgtcgcatcctggtggacgccacccgctggaagagcggcccgctccggcccgtcgacctggacgtcctccaggacgcggtgttcagcgaccgccgcctgcggctgcgctaccggcacagcggcgacgcccggccgcggacgtacaccgtcgacccctacgggctggtcgccaaggcgggcgtctggtatctggtcgccgaccggcgccgcgggccgcagctgttccgggccgaccgggtgcactcggcccgggtcctggacgaaccggtgcggcgcagagcgggcgtcgaactcgccgacgtgtgggaggtgctgcgccgccgtgtcgaggagcggcccggtggcgtggaggtcaccgtacgggtgcgccgcgagcgcctggacatgttcctgcgcctgtacggcccctcgctgaccgggcatcccgaggacggcggggagggcgagtgggtcaccgcacgtctggtgtaccccgcggtcggcgcggtgcgccaactgctcggtttctccgaccaggtggaggtcgtggcgccgcccgaggcgcgtgcggaactgctcgccgcggtggcctccgtcggcgcgctgtacgagcgcggggcgggggacggggcctgaccctcactccctccagtgccggcggccgatgctgatcagccgcagctgccgggtcgcgagccgggcggcccgttcgcgttcctcgggggagtcgggcgcctccaggaagagcgaggcggtgatcagcatctggtcgacgtagaggtgggccagcatgagcaggtcgtcgtcgctccacccggcggcctggctgtccttggcgagttcgtccctcacctcgtgggcgaaccgggccagttgctcgcgtatggcctcgcgcaccggctgcaccccgccgtgccgctcgcgggcgacgaaacggacgtgggccgggtgctccgccacatgacgggcgatcaggccgacggcacccgcgatgcgttcctcgctgtcgtccgccgtggacaccgtggacctgatcatcggatgcaggctgcccagcgcctcctcgaccagggccaccccgaggtccgcggtggagcggaagtgccggtagaaggcggtcggggccacaccgacggcccgcgtgacctcgcgcagacccaggctgctcaggctctgctcctccagcagcgccagcgccgcgtccagcagggcctggcgggtcttctgcttctgggcctgccggacaccgagagtgtgactcatgccatacagttaacaactgttctctggaatttccaagcgatgggcgacgctagactgggtagtcagtgaacaactgttaccgcaagcgtccgccggaagagtaccggccggcgccgaagggggatccgatcccatgctgttcctcgtcgccgcactgctgctgttcggtgtggccctgggcaccgtcgcccacgtgccgctcggcttcaccgccgtggccgccgcggtgatcgccgcctggctcgcagtcttcgcgctccgcgagcgccacgcccgccgccgcggcacctcccactgacccagccggcccgccggccccgccgacctgactggtccggcgctcccgcccggccctctccgaccgtccgtacgaccgcaggagccacccgtcatgcagctcaccgcaccggccacgcgccgcaccctcccgcgcgacgccgacggcatggccgtcgcgtccttcatcctcggcctgctgggcctgctcgtcctcaatctcgtcctcggccccatcgccgtcgtcctggcggcggtggccctctggcgcggcacggcccgccgcgggcgcgcgctgctcggcctcaccctgggcatcgccgacctcgtcgtcctcgtgtccctcatgcaggtggaccacacggtctcgtggagcttctaggtcctgccccgagccccggccgccgcgacggcgattcggcgcgaccttgccccagggtccccggtgagcgccccgtagaatcagcctcaccatggcttacctcgaccacgccgcgacgacccccatgctcccggaggcggcagaggcactgaccgccgcgctgggcgtcaccggcaacgcctcctccctccacgcgtccggccgccgggcccgccgcaccgtcgaggagtcccgcgaaaccctcgccgaagcgctcggcgcccgccccagcgaggtcgtctacacctcgggcggcaccgaggccgacaacctcgccgtcaagggcctgtactggtcccgccggggagccgacccggcccgcacccgcgtcctggccagccccgtcgagcaccacgccgtcctcgacgccgtccactggctcggtgagcacgagggcgccaccgtcgagtacctccccgtcgactcccacggccgcgtccaccccgaggcgctgcgcgaggccatcgcccgcgaccccgacgacgtggccctggccaccgtgatgtgggccaacaacgagatcggcacggtgctgccggtgcgtgaactggccgccgtcgccgccgagttcggcgtcccgctgcacgccgacgccgtccaggccttcggccaggtccccgtcgacttcgccgcctccggcctcgccgcgatgaccgtctccgcccacaagatcggcggaccgtacggcatcggcgcgctgctgctgggccgcgagtacacccccgtgcccgtgctgcacggcggcggccaggaacgccacgtccgctccggcaccctcgacgtccccgccatcgcctccttcgccgtggccggccggctcgccgccgagcggcgcgagtggttcgcccgtgagatcggcgcgctgcgcgacgcgctggtgaccgccgtgcacacggcggtcccggacgcgatcctcggcggcgaccccgcacccgaggggcggcttccggccaacgcccacttcaccttccccggctgcgagggcgactcgctgctgctcctgctggacgcccagggcatcgagtgctccaccggctccgcctgcaccgcgggcgtcgcccagcccagccacgtcctcctcgccaccggcaccgaccccgacctggcccgcggcaccctccgcttcaccctcggccacacctccacgcaggccgacgtcgaagcggtcgccaaggccatcggcccggcggtggaacgggcccgcgcggcgtgcgtggcggacgtggtgggtgcggcggacgggggacgcggggtgggcgcggtgcgcgcccggcgcaccagccgcaggtagcg

SEQ ID NO: 511 - DNA, 4636 bp, Unknown
  Kingdom: Bacteria, Phylum: Actinobacteria, Class: Actinobacteria, Order: Streptomycetales, Family: Streptomycetaceae, Genus: Streptomyces
tcggcggcgacgaggtagtcggcgcggacggtgtggcgctggtcggtggcgcggtcgcggacggtggcggtgacgccgtcggcgtcctgttcgaacgtctccatctcgtgggagtagcgcaggtcgccgccgagagtgcgggcgccttcgaggaggacgggttcgaggtcgttctggctgcacaggcaccagccggtggggctgaacctggccatgccgccgccggggtcgatgtgcttgaagagccattcgccggcgtcgccgacgagggtgggggtctggaggatgccgtggttgtcggcgaggagtgcggccgcgtccttgatggcgtcttcgatgccggccacgcggaacagttccatggtgcgcacgttgttgccgcgtccgcgggggtggatggaggtgccggagtgccgttcgacgagcaggtgcggtacgccgaggcggcccaggaagagcgaggtggacaggcccaccagtgagccgccgacgatgaggacgggtacccggtggtcggcttcttggtgcatcggtgtctccagggcggtgtggggcggggctgcgcggggtggctgcgcgggggagtccgtcggtgtctccatgcccggcgcggggccggtccgcgtgcgtcggcgggggcaatcacccgtgtgatcacccgcgtggttcatacgagtcgcgcactgatcgcaaccggctcaggatcgagatcaggctgacgtcgtgtcatgcgtggcaggccgtcagttccgcgaagtcctccaagcccgtcaccgagtcccgtcaaggagacgtacgcagatgaccgccatctctgagcgtgtttcagaaccgatcgagcagcaggcctcgaaacgtgtctcccagtccgtgttcgacggctcccggctccgggtcgtcctgctggtggacgtctacgacggcgcccagcagcagttcctggaggcgtacgaggagatgggcaagcaggtctcgtccgtgcccggccatgtcagtgaccagctgtgccagtcgatcgagaacccttcccagtggctgatcacgagtgagtgggagagcgctccgccgttcctcgcgtgggtgaacagcgaggagcacgtgcggatggtggagccgatgcacagctgcatccgggacacccggtcgctgcgtttccacatcgtgcgggagaccggcggggaggcggcgcgtgcggggtcgggtgagcggcggctgcagacgtcgccgcggatcggtgacggggtgatccggcacgcgctgacgttcacggtgaagccgggcagtgagaagaaggtcgccgagctgctggcgaactacgagtcgccgcaggcgcgggtggacgacacgacgcggctgtgccgtacgtcgctgttcatgcacgggaaccgggtggtgcgtgccatcgaggtgcgcggtgacctgctggcggcgctcaggcatgtggcgcggcagccggagatccggaaggtggaggaggccatcaacccgtatctggagcaggagcggaacttcgccgaccaggagtcggtgcgggtgttcttcacccgggcggcgctgccggccgtgcatcacgtgaccagcggtcaggaggacgagcgggcggaccggcacgcgctgtactacccggcgcgcccgggtatggggatgcggctcgcggagctgctggcgcagcacgacgagcgggccgcggacgacgcgggcagtccgatcctgcgcagcacggtcttcgagcgggacgacgtggtggtccgcctgatcgacgtacggggtggtctggaggcggacccggccgctgcgctgggtctcgcggacgcggcgcaggtgtcggagctgacgacgctgctcgacgagggcgcggcgaagaaggacggcgacctggcgcggctgctcactctcgcccggatggacctcgtgaccgaccgccggtccgcgccggacgcctgacgccccccttcagccgacgtacacatcaccggaggaacgacgtgatcaagaccaggcccaagatcgtggatctcagtgacacggagcccaacacccggcgcggcggtgatctgcgcgccatgctcaccccggcgacggtgggttcgaccagcggtttcatgggggtggccctggtggcgcccggggatcgcatcggggagcactaccacccgtactcggaggagttcgtgtacgtggtctgcggtgagctggaggtggatctggacggtgagccgcatccgctccggccggagcagggactgatgatcccggcttacatgcggcaccgtttccgcaatgtgggcaaggtggaggcgcggatcgtcttccacctcggtccgctggcgccgcgtccgcagctcgggcacgtggacacggagggtacggaggtggcgccggcggcgggcggcgaggagccggcggcggtgccggccgaggcggcagaggcccgctcatgacccggcgggtggcggtcacgggcataggcatcgtggcgccgggcgggatcggcgcgccggcgttctgggacctgctggcgaacgggcggacggcgacgcggggcatcacgttcttcgatccgtccggcctgcggtcgcagatcgccgctgagtgcgacttcgacccggtggcggcggggctgtccgaggagcaggtggcgcgctgcgaccgctacatccagttcgcgctggccgcggggcaggaggcggtgcgggactcgggtctggacttcgcggcggagaacccgtggcgggtcggggtgtcgctgggcacggcggtgggcggcacgacccggctggagagcgactacgtcctggtcagccatggcggtgagcgctgggacgtggatcacgagcgggcgcagccgtatctggagcgggcgttcacgccgagcacgctggcctcgacggtggcggagcggttcggtgcgcgcggtccggtgcagacggtgtcgacgggctgcacctcgggtctggacgcggtcgggtacgcgttgcacacggtggaggagggccgggccgacatctgcatagccggtgcgtcggactcgccgatatcgccgatcacgatggcgtgcttcgacgcgatcaaggccacgtcgccgaacaacgacgacccggcgcacgcctcgcggcccttcgacaacgaccgtgacgggttcgtcatgggtgagggcggcgcggtgctggtgctggaggagctggagcacgcccgggcgcgcggtgcgcacgtgtactgcgagctgagcggttacgcgacgttcggcaacgcgtaccacatgacggggctgaccagtgagggtctggagatggcgcgggcgatcgagacggcgctggaccatggccggctggatgccacggagatcggttacgtgaacgcgcacggttccggcacccggcagaacgaccggcacgagacggccgcggtgaagcgggcgctgggcgcgcacgcctatgacacgccgatgagttccatcaagtcgatggtgggtcactcactgggcgcgatcggggcgatcgaggtggtggcgtgcgtgctggcgctggctcaccaggtggtcccgccgaccgcgaactacacgacgccggaccccgagtgcgacctggactacgttccgcggaccgcgcgggagcggaagctggacagcgtgctctcggtgggcagcgggttcggtggtttccagtccgcggtgatcctgacccggggaagggagagggcacgatgagcgcacctgcgaagcggcgggcggccgtcaccggtatcggtgtggtggcgcccaacgggaacagcacggagacgttctggaaggccacgcaggagggtgtgagcgttctcgaccgggtcacgcgtgagggctgtgaggggttgccgctgaaggtggcgggcgaggtgcgggccttcgatccgtcggtgacggtcgaggagcgctacctggtgcagacggaccggttcacgcacttcgcgatggcggcggcggacgcggcgctggaggatgcgcggctgggccgtgccgacacggacgaggcgccgttctcggcgggtgtggtgacggcggccggttcgggcggtggcgagttcggccagcgtgagctgcagaagctgtggggcaagggccgccggtacgtgggcccgtggcagtcgatcgcctggttctacgcggcgagcaccggccagatctccatccggcgcggtttcaaggggccgtgttcggtggtcgcggccgacgaggcaggtggtctggacgcgctggcgcacgcggcgcgggcggtgcggcgcggtacggacgtgatcgtggccggttccacggaggcgccgctggccccgtactcgatggtgtgccagctcggttacggcgagctgagtccggtcaccgatccgcagcgggcgtaccggccgttcaccgaggcggcgtgcgggttcgtgcccgccgagggcggcgcgatgctcgtcgtggaggcggctgaggcggcccgggagcggggcgtgccggtgcgggcgacggtggccgggcacgcggcgacgttcacgggtgcctcgcgctgggagctgtcgcggcaggggctggcggaggcgatccgtgcggccctggcggacgcggactgcgcgccggaggaggtcgacgtggtcttcgcggacgcgctcggtgtgcccgagg

SEQ ID NO: 512 - DNA, 3412 bp, Unknown
  Kingdom: Bacteria, Phylum: Actinobacteria, Class: Actinobacteria, Order: Streptomycetales, Family: Streptomycetaceae, Genus: Streptomyces
gcccatgccgtcgttgccgagcgcgatcggcaccatcccggcggccaccgcggcagcgctgccgcccgacgacccgcccgccgtgcgcgaggtgtcccacgggttgcgggtggtgccgtgcacgccctccgtggtcccgaagacgcacagttcgggcacgttggtcagccccaccacgaccgcgcccgccgcccgcagccgggcgacggtgacatggtcgcgggcgttgggcaggtccgaggtggcggcggaaccgttccgggtggactcaccgcgtaccgcgaggttgtccttgacggccaccggcaccccggccaggggcagttcggccaggtccggccgggcgccgatctcgtcggcctcgtcgagcgcggcctgtgcgcggacggtacggaaggcgccgatccggccgtccagccgctcgatgcgggcgaggtgtccggccaccgcctcacgggcggtgacccgtttctctcgtacggcggcggcgatctcgacggcactcgggccggcccagtcggtcacgggcgctcctcggcaggggcgggcaggttcgtactcgcgagtacgcaggacgaactctgcccgcggacgacctgccgcgtcgaggggtctttctccatcatccgaccaatgtcccaattgccttgcgtggaggccccattgacagtcaatggcgtccgttcaatcatcagacctccgatgaattcggggctgctcatgagcacgtccccgactcggcgcccgtcccgccccttccacccctgaccccaggagacgcacccgtatgcccctctcccgacgcctcttcgtcgcctgcaccgcctccacggccgcgctcgcctcgaccggcctggtccaaccggcgtccgcgaccccgcagtccgcggcgggccaggccgcggatccgcgcaaccgcatccccgtcggccccgacgacagcgcacaggacctggtccgcaaggcctcccgggtccggcccagcgcacggcagatcgcctggcagcgcctggggcgcaccgccttcctgcacttcggcgtgaacaccttcaccggcctggaatggggcaccggcgacgaggacccggacgtcttccggcccgaccgtctggacaccgaccagtgggcccgcgccctgcgcgacggcggcttcaacctcgccgtcctcacggtcaagcaccacgacggcttcgtcctgtacccctcccgctacaccggccacaccgtggcctccagcggatggcgggatggccacggggacgtcctgcgctcgttcgccgactcgatgcgcaagtacggcctcaaggtcggcctgtacatctcaccggccgacgagaaccagtacctccacggcgtctacgccaacggcagcgcccggaccccgcgcaccatccccacccccgtccccggcgacgaccgcacgccccggcggacgtacaccctgcccgccaccgactacggcgcccacatgctcaaccagctccacgaggtgctgaccgagtacggtccgatcgacgaggtgtggttcgacggcgcccagggccgcatccccccggacaaggtcgagaagtacgactgggacagctggtacgccctcgtccgggccctcgcgccgggcgcggtcgtcgccgtctccgggcccgacgtgcgctgggtcggcaacgagggcggcctggcccgcgaggacgagtggagcgtcgtaccggtggcggagcagcagtacggccgcaccgactacgcactgccctacgacgcacccgaccagggcagccggacggcactcgaagccgcccgcccggtcgccgactacctgcagtggtggccggcggagtgcgacgtctcgatccgggacggctggttctaccacgccgaccaacagcccaagagcgtcgagcggttgacggacatctacttccgttccgtgggccgcaacgcggtcctgctgctcaacatcccgccggacacggacggcctgctcccggcggccgacgtggcgcggctgcgggagttccgcgagcgcatcgacggggaactgccggaggacctggcgcgccgcggccgcaccgccgtcgcaggcggccgggtcaccgtggacctcggcacggagcgggaggtggaccgcgtccggctggcggaggacgtccggcacgggcagcaggtcgaaagcttcgtcgtcgaggcgtacgacggcaccgcgtgggtccaggtgaccggggcgggcacgatcggcgcgagccggatcctgctgctgccgcgtcccgtgacggcccggcggtggcggctgcgcgtgacctcggcccgcgacgaggtgcacatcgccgagttcggcctgtaccggtcgcggacctgagccgcgaaggcccgcgagcctgagccggacaggctcgcgggcccgggccgggaacgtccgggtgcgtccgacgcgtaggcggctcgcccgggtgggtctaaggtcggaagcacaggacgagcacgaggggaagtagtcggcgatggcgcaggacgaggccgtgatcggctgcacgggggagcttctcatcggcacgcgcggatccgccggtcccggcgagatcctggtgcgggtcagaggaggatccgagaccttcctcgcctggtcgcaggaaccgttgccgatcggtgcgacggtcctcgtggtggactcccgtggatgccgtgaggtcgacgtcatcgagtgggccgaccccttggacaggttgcgcgacgatgcggccgacgcaggctaaggagaacaaaccatgttcggttaccgcgttcccgcccccgacgaggcgatgctgatctcgggtggcaggcggggactggggggcgcgccgttccgggtggtgacggggcacggcaagttcgtgctcccggtcttccgcaaggtccgcttcctcactctgtcgatgtgcgagtccgaggtcgtcgagacctgcgtgaccaagcagggcatcgcgctgcacgtgcgtgccgtcatcgcgttcaaggtcggcaacgacaccgagagcatcatcaacgcggggcagcggttcctctccgaccaggaccagatgtccgtcctgaccggccggatcttcgccggtcacctgcgggccatcatcggctcgatgacggtcgaggagatcgtcaccgagcggcagaagctcgccgccgaggtcctcgacacctccaagacggagatggcgaagatcgggctgatcgtggactcgctgcagatccagtcgatcgacgacggcgacaccggttacatcgacgcgatgtccgcgccgcacaaggcggccatccagcgccaggcgcagatcgcccaggcacaggccaaccaggccgccgccgaggcgcagcaggaggcggcgcgcaggcaggccgagtacgcccggcagaccgccgtggtgaaggcggagtactccgcctt

SEQ ID NO: 513 - DNA, 5967 bp, Unknown
  Kingdom: Bacteria, Phylum: Actinobacteria, Class: Actinobacteria, Order: Streptomycetales, Family: Streptomycetaceae, Genus: Streptomyces
ctggaggacgccgtcgtcctcgcgaaatgcctgcgcgacatacccgaccgcacccgcgcgctcaccctgtacgaatcgctccgccgtccccgcaccgagcacaacaccgccgtcagcggcggcatctcccgcggcacgcactccccgtccccggccacccgggcgaccgcgggcggaacccggagtcccgacaccgaagcacttgtccgcctcctggactggagcaccgacatccaggaccgcggccccggaccggacagagcctagcctcgccgtttcggtcggggtgatgagacgtcgctgttcgtccgccggcgcgggggccgtccacgataccggggaggccccgcacggcctccccgggaggcacccgcggcttcgttgccgcccgacccggggctgaacagcggccttccaccgttccgacggcaacatgagcaccccgggcagtggaatccggcgcccacccgacgcgacagacgggcggctcgcctgcccaccatcggcgccggaaggggggaaagggcccaccggcaccgtcggcggaccctggcgcaggttcgaggcctgcgcgtgcaatcatgctgaattccaagtgagttgcgggagctcgaacaggggtggcgtggcggcgctgtggtggtcggtggcggtggtggcgttcttcgcggtcgcggtgccttgcccgcagctgcagtggctgagacgccttcggctcgcgcaaccaccccggcgacaccctgcgttcgtgatcggaccgctccagcgacaaccgtttcggaccaggcgtcgccccaccccacaaccgctggcgcacttccccaacgacacggcccaggagagcgttcatggcgtctcgctcagaagcggacaagaagaagaatccggatcggtccactgcgggtcgggcagccgccgcgagccctccggccggtctcctcgctctgcagagaagcgtcggcaacgccgcggtgagcgcctggctggagacctctggtgtggcgcggtcggcgcaaccgggccgagatgaccaccagcactcgtccggctgcggccacgagacgcgcgcccagcccggcgcggccaccggggcaggctctcgtgcgccgcgttcgtctgggcccttggaggcagtgggtatcaccgcgctacagcgctgcgtcggcaatgccgcggtcagcacagtagtcagccgctccgtcagcgcactggccgaggcaggtgaggaaacgacgggccaggaacggtccgaagagcctcaggtgcagcggctggccatccatgatgtgctccgctcgccgggtcggccactggattccggtatgcgggaggagatggagcagcgcttcggcggagctgatttcgggtccgtgcgcatccacacgggggaccaggccgctcggtcggcggacgaattgcaggcccaggcctacaccatgcacaaccacgtggtcttcaataagggcgtcgagagcaacaagcgggttgtcgcccatgagctggcgcacgtcgaagagaacatgaagggatcgtcgttccggtctgtcccctacgccggcggggtcaatgtctctgaaccggacggcgcatcggagatcgcggccgagcagaccgcacaccgtgtcatgaattcacctgttggtggcccgaccgtctctcggaaagagatcaagggaggcggggaagccgcgcactcaggaactccgggagtgcagcgactgctcaaggtcggcgagcgggactacagtaaggagtacaagcgggaaactgctcggcttccggaagcgcagcagcggcaggtcctcacgaggatgatgaaggaggtgagagattacttctacaatgatgctgcgcatgatttcagtgaatcggagcgcaggagtttcctcaatgaagagggaaggatcaattggcagttggccaaggcgatcgtcagccccgtcgggatgaagaacgagtaccacccggtactgaagggcgtagtcggaaagcatccggacttcggcgcgaagaaccatgacatccaggtcaacaactacacggaactcgcccgcaacctcatgggatgggtatacgcgaaggacaataggaggaaggaaaaagcaaacgccgaagccttgcaccaggacgccaacctgaacacctatctcaatgtcctcctgcggcgcctgcaccagtacaccaaggcggtccagcacgacaggatgatggacgacagggacgtcgctgcaatgaagcaagagctggagaccgggctttctcatatccgggctcaggaacccggagaccctaagcgccaggcaaggaagcccgtcggtgcctatatggcccacttcgacgggacgatgaacccgaaattcgcgggcactcatctcgacgctcggatcgtggcacgaggcgggctggccgcggtgatgaaggagcctgagaatttcgcgctgcgtgagaaaatgatcgccttgcacgacctctccgagtacttcgggcattctcatcacacgcccccgacaatggggaaagaggctgtcgaggaaatcagcgaagcggagagcttcagtactgctgggtttgatcaccgtggcaggcgggtcgttacacccgaccgcgggcagaaccctctcttcaaccccgatggcacccgtaaactgaacaagcgtggcgagccggagactcatccttcgacacggaacgagaacgacctgacgaccaagctcgcacggtcgagggacatgcccgtctgggcaggacagtccttcacggcggcccgaatgttcaaaatggcacaggccagtggagccagcccggaagagatcgcggcagtcggctggggaatcttcgccttctggcgtacggacttcgaccacaccactgcttacgcctatcacacgctgcatgaagtgatggacatcgcccagaacttcggcgttccgtatgacatagaccagccctacgcttcccatgggatgctcaatatcaagcggggagccgaaaccatagcgacccttgcggacgaaatagcggatctcggtgtgcgggccgagcagggcgtcgcgggaatggaaatgcggaggcgggacaggtctcgcatgtggacggaccgcgacgaggatctcctggagcatttcgaacaagtccgcgacagcgcaaagcaggtttattccgacgtgcagcggcgcgcaagtgccatgcaccaatgggatcgactgtccgaggtggagaggtcaaagctcctcaagaaggtcgtcgatgaactgccggactggaaagcgaagaccaggaagatcagcaacgtgcttgcgcgctcgggccactgaccgcacctgcacggcgacgcccgagcgggccccggttcactgcgaaccggggcatgccacgccgcggggcgggtcggctggatcagccgtcacaacttcttcggctcggcggtggctgtttctccctccagtcgtaggacacacctccaggcagcaaccgtgccccggcgtgaccgaccacccccgaaccatcggcactgacatagaccttggggcgcaacccgataccctgcacgtagaaagtgccctccgccgggaccgacagaacccctcagcaaggttcatcgtcccaggtcaggaaggcctttcgcgtttccgccgcgacagccgccaaacccaagcgaaacggcgaggctagaggcggcggaagaactccgggactccggaactccccgggcggaagcctcatttggctcacccacccatgcgaacgggccgctccccggagggaacggcccgctcggacaccgccaggcggggcggtgtggccggatcagaacaggatgcggaaggtgttccagccgctgttgccgatcttcaccttggccgcgtacggggcggaggccttgccggtgcccttgtacagccacagcgcgccggtcttgtcccgggcgatgaggtcggtgatgccgtcgtagttgatgtcaccgacggagatcagggtgttgtacgcgttccagccgctgccgatgcgggtgcgcgccgcgaacggggccttggagttgccggtgcccttgtagagccacagcacacccgaggagtccttggcgacgaggtcgtccttgccgtcgccggtcaggtcgcccttgcccgccaggtcggtgtacgcgttccagccgccgccgaccttgtaacgcgaggtcagcttgccgttgccgtagcccaggtagagccacagcacaccggagctgtcccgggccagcaggtcctcgtaggcggcgccgcccaggttgccggccgacaggacgcggttgtagatgttccagccgccgccgaccagcacgtcggacgagctgtcccacggcgtgtagtggagctggctgccggtgacgtcccagatgccgtccgactcgccgtcgttgttctggtcgacctgcgtgatgaagcgggcgtcctgccagcctgaaccggtcgactggcgggaaccgagcccaccgttgccgtcgggcgcgtaaccgctcaggttgcccttgctgtccacgccgtacagcgcgttgatctgggccttccgcagcgcggtgacgctgtacttcgatgcgcccgacgccttggcgtcggtggagacctgcgatgcagaccgtccgggtgcgtcggcggcgaaagcggcggtggtgccggtcgccaccagcgcggcggtgaccgccgcaaccgtgacacgcgccgccgcgcgacgcgtgttcaggcccgagctcttggccacgtgggtcctccagttgatcacgggggccggatcgcgggccgcggtacggcccggaaagatccggagatactccgcgatctttccacagctccctcacgcatcaaccgggttttcccgctgtggatgaagtggtacagaagcgggacagaagcgcaacatcggccgtacaaccatttgcgcaaccatggttgacgccgggctgcgggcgtttgcggacggcggtcgcgggccggcgtttgcggggctcaaccgcagtccagcaggcccgccttgtgcttggcgtcgagtatccggtgcacggaggcgtcgaccttgccgcggaacgaggcgtcctgccgcatcctgctctgcacggcctgcgtcatctccggcacgatggacggccgtatcgtcaggaccatgtcgccgccggccgcgatgaagtccaccgcgcgctgcgccggggtgaaggagcgcagcgccaccgcgtcaccgaggtcgtcggagatgacgacgcccttgaagttcatgtcgtggcgcagcagttgctcgatcaccgccggtgagaaggccgccaggtgcttggcgtcgatcttcgtgtaggtggccgaggagatcatcacgaagggcgaaccggccttgatcccggcccggaagggttccagggaggcggacttcgtggtcgtgaccgagtccaccacgttcgcggtcgtgtccgtgttgcccagtacctggcccaggcccgggaagtgtttgagcgtggtcatcacaccggactgcgcgaacccggcggcgaaggcgccgctgtgcgaggtcacggtggccggggtgtgaccgtactcgcggtggaagtagccgatggggcggttgcgggtgcccaggctcgtggggaccacgtcggcgatcggagcgaggttcaggtcgaccccggcggacttgagctgcttggcccagtcggcggcccgggtcttcagggccgtggtgctccagctgccctgggtcagtccgtcgggcatggccgagaagccggggccgctcaacacctgcacctgaccgccctcctggtcggtggcgaccaccatgccggcccgccggccgccgacctggtcggactgcgtgcggatggcgtcgaccactttccgggtcgccgccgtaccggcggtgctgcggcccgtcagcatgacggagcccacgtgctggtcgcgcagggtgcgcaactgggacgcgtcggggtgggcggcggagaccccgccc

SEQ ID NO: 514 - DNA, 4766 bp, Unknown
  Kingdom: Bacteria, Phylum: Actinobacteria, Class: Actinobacteria, Order: Streptomycetales, Family: Streptomycetaceae, Genus: Streptomyces
cgacggccgctgggccggtcgccgtggcgaacggcccgatgttcggggcagcccccgcggggacgacctggctgcggttgtacgtccggcacgacgtcgttcacgacgagtacgacgtgcgcatggcgtcgagcaccgacggcgaacgctgggagtggggcggtacgtggtcgctgtccgaccagggcgacctgcgcatcggcctcgtgtccatgaacaccgcaggagccaccgccacgttcgactacgtccacacctacgacatggcgcaggccacggcgagcgtggacagtacgtgtggctccttctgggctcgacgccgcgctcgtcgtctcgctcgccggaggcgacggggcagcggccgtggcccaacacgacggccaggtcgcgcctctgcccgcgctgggggtgctgggggcgaacttcaacgagaacctcgaccagctcagctaccaggaactgcgcacggtgcgcgccgactgggtcagggggttctacgccctgcccgaagccgaccgggtgccgcccgcgcagagcggcacgatccgggcgctccacgacgcccacgcgcgggggttccacaccgtgctgagcctgaagttcccgctggccgaccgctcgttcccgcagccgggcacggcagccatggacgcggagctggcccgtctggaccgggtgctgccgctggtgctcggcaccgccgacatcgtcaccatcggcaacgaacccttcatcgagagcatccccgccgagcgcgacgagcgactcgaccggttctacgagaccgtcgcacggcacgtgatcgaggcgcgcgagagcctgtgcgggtccggatgccccacccacctgtacatgggcgccctgaaccggctggacctgccggccaaccgcactccggcggtggagcgctacctcgcattcgtgcgcgagacgcccgagctcgagggcgtcgacctgcacccccatgtgcccgacgaggacgcgatccagccgttcctcgactacaccctgccccgtctgcgttccgaccagacgttcctggtgacggagttctccctggtctggcgctggcagcggcacatgaccgacccggtcccggcgacgttcgcaaagcggtacggctatgccgccgacacccaggtgtggcaggtgatcggtgacgcgatcgcacacccgttcccgtcgcgcgagtgggacgacctgctcgcccagagcccgtggttcgagtccgagaagcacttgttgcgcgacgagatggcgcggttgcggagcacgggccggctcgccgccgccatgtacgggttccggcaggtgccgtcgatgacggcgggctggaacgcgaacaagccgccgtggctgctcaacagcgtgttcgccaccctcacggtgcagccccgcggagccgggatgtcggcgccgggctacacctggctcgacgacttccggagcctgcagtagcgggagcccctccggccgccgcgggttcgccgaccgcagtggacaccggtcggcgccgatttctgaccggcatgcaacctgggaccccccgccctcgtggcagggggtgtccacgtggcgaggccgggcacatctggtggcggaatatctggaccgcgcccgcccggcgggacggccaagagccgggaaccggcggcagctgcggtccttcgggccgagtccgggaaaggtcggcgaagccccctgcgagggcggccgccggggcccagtagagtgcgccccggcccccgaagtgcgccgcacgcagaagggccgcacgtcgaggggccgcacgtcggagtgccggcgcacgccgaggtacctggcgcacgccgacatgtgcctgtacgccgaggtacctcgcgcacgccgatgtgtgcctgtacgtcgaagtgccggcgcacgccgaggtgtgccagtacgccgaggtaccggcgcacgccgatgtgtgccagtacgccgaggtaccggcgcacgccgatgtgtgccagtacgtcgaagtaccggcgcacgccgatgtgtctccgtccgccgtccccgatcccgaggtaccgagcacgtgaagcccgaccgaccaggaccgccccctgttgctgctgccgacgccgggacgggagccgccggtggtgaaggaaccccgggcgccccgcgcctcggcctcgtaccggggctgccggacgaggcgtacgagcacgacgggcaactgaccaaacggcacgtccgggccgccacgctcgcggcgctcgccccggtccccggcgaactgctgtgggacatcggcggcggttcgggctcgatcgccgtcgagtggatgcgcgcccaccccacctgccgcgcggtcaccgtcgaacgggacccggtgcgggccgcgcgcatcacgcgcaacgccgaacgactcggcgtgcccgacctgcgtgtcgtcaccgcgtccgcaccccgggcactggccgaactcccgccgccggacgccgtgttcgtcggcggcggactcaccgcacccggtctcctcgacgcctgctgggcggcgctgcccgccggcggacggctggtcgccaacacggtgaccctggagtccgaggcgctgctcgcggacgcccaccggcgccacggcggcgaactggtgcggctcgcggtggcgcacgccgtgccggtgggcggcttcaccgggtggaggcaggcgatgccggtgacccagtgggccgtgcgcaagaccgtcgaagaaccctcaggagcagacagatgaccgtgtacttcatcggcgcgggccccggcgccgcggacctcatcaccgtgcgcggcgcccgcaccctcgccgcctgccgggtctgcctgtacgcgggcagcctggttccccgcgaactcctcgccgaatgcccgccgggagcccgcctggtcgacaccgcgcagctcgacctggaccagatcaccgccgaactcgtgcgcgcccacgaggaggggcacgacgtggcccggctgcactccggcgacccgtccgtcttcagcgccgtcgccgagcagatgcggcggctggacgcggcgggcgtgccctacgagatcgtccccggggtgcccgccttcgccgccgccgcggccgccctgaagcgggaactgaccgtgccgaccgtcggccagacggtcatcctgacccggatcgcccagcaggccacggccatgccgccgggcgaggacctggcgacgctgggccgcagcggcgccctcatcgtgctgcacctggccacccgttacgtcgaccgcgtcgtgagcgaactcctcccgcactacggcgccgactgccccgccgcggtcgtcgcctacgcctcccggcccgacgaactggtcatccgcggcaccctggaggagatcgcgggaaaggtgaaggcggcgggagtgctgcgtaccgccgtgatcatcgtcggccggacactgggcgcggaacagttcggcgacagccacctgtactcaccggagcgggaccggcacgtgtgctgacaccgtgccgtccggcagcggcggacccaccggccggtcggggcgacaacagctctgctgacgcgatccggcggtgggccgtctgctcatcgggtccggacgtctgccggccgggccggcgcggcggtgtgcccggcggccgggtccgcaagcggggcccaagagctgtttgttaggctccccttgcctcccgtgggggaagtccggtgagagtccggcgctgacccgcaacggtgtgcgcggcgacctgacggccgtcgcgcgagcccgatcgcccgtgggtggtgcgacccgttgactgctcgccgcggactgcgagaggggaccgcgcggcccggcgggccgtacgggctgacctcctgctcacgtccggcaggcggcccagccgaaggacggcccctcgtgcgccgaaggacgacccccagccggataccagtgccgccgctcgccgccggcctcgggctgctgctcctggtctcgctcgtgtgcggggtcggtctcggagccgcctcggtggcctggccggacgtcttccgccacctgtgggcagggctcaccgggggcactgtgcccgcccgcgacgcggcctcgtacaccatcgtctgggagatccgtctgccgcgggtcgtgctcggcgccgtcgtcggagccgggctcgcgacggtcggggtcgccgtccaggccatggtgcgcaacgcgctcgccgacccgttcgtgctgggcatctcctcgggcgcggcggtcggcgccaacgccgtcatcctgatgggggcgttcgcgggtctcggcgtgtgggcgctgtcggtgtccgcgttcgcctccggcctggcggccatggtcctggtctacgccgtcgcccgctcgccgcgcggcctgtccccgctgcggctcatcctgaccggcaccgccctggcgtacggcttcgaggcgctcaccacggtcatggtgttcggcgcggcccgcggcgaggcggcccggtcggcgatgatgtggctgctgggcagcctgggcggcgcgacctgggcccaggtgccgctcgccgtgaccgccgtgacggccggctgggcatggctgcggtggcgcgccgaggcgctcaacgccctggccatgggggacgagaccgccgccgcgctcggcgtgccgcccgcccggctgcgccgcgaggtgttcgtcgtcaccgcggccgtcaccgggaccgtggtcgccgtcagcggcgccatcggcttcgtcggcctgatggtgccgcacgtcgtccgcatggtggtcggcgccgaccaccg

SEQ ID NO: 515 - DNA, 3952 bp, Unknown
  Kingdom: Bacteria, Phylum: Actinobacteria, Class: Actinobacteria, Order: Streptomycetales, Family: Streptomycetaceae, Genus: Streptomyces
tcacggcaccgcgggccatgccgacgcgcttgccggcgtccgccttggcgtgcgggggcagggcgccgatctcgcggttggcgagcgccagcggggaggccgggccggtgtgggcgaccttggcctcgtgcagcgtgtcgagggagtccgcggcggcgaaggcggcgagcgcctcgtcccgcatgcgctcgatctcttccggtttcaacgcctcgacctcgacagggtcgtacgacttattgggtgcggacatctcttcccgtgcttccgatcggctggctgacggtccccgtcaccgactcgtggacattccgtctccagtggtgggacacaaaggtgccaatggccgagtctaacggggtgggggaaagcggatgcgcccgtgggtcctgggccggtcctcagaggaggtgcgccggggtgcccacgggcagcgtaaatcggaaccgtgcgccgccgccgacggcgcgtccgaccgtgatggtgccgccgtgggcctcgacgatgcctttgacgatgtagagcccgaggccggtgccgccgcgcttgctgccccgccagaagcgggtgaagacgcggttcatggactcctccgggatgccgggcccctcgtcgctcaccgtgaccgacgtgccggcgtcctccccttcacggggggacaccgcgggcatgacgtcaatggtgacggttccctcgccgtggcgcaccgcgttttcgatgaggttgctcagcacctggtcgatcttgtccgggtcggcccacagatcgggcagcggctgttccatgcggaccaggaaccggtcggcgggctggccggcggcgacgtaggcctggacgtgccggccgaccgcggccgctatgtcgacgagctggcggcgcacctcgaggcggccggagtcgatgcgggagatgtcgagcagttcggcgatgagccgggtgacgcggtcggcgtcggcgtcgacggtctccagcatcagccgtttctggtcgtcggtgaaccgctcccacttggcgagcagggtcgcggtgaagcccttgacggacgtcagcggcgagcgcagttcgtgggcgacggtggcgatcagctcggcgtggctgcgttcggtgcgacggcgggcctcggtgtcgcgcaggcagacgatcacgcggcggacgggtccggcgggacggtcgcggacgtagcgggccgacaccaggacctcccggccgccgggcagcagcaggttgcgttcgggctgggccacgcggatggccaggccgccgtaggggtcggtgagctgccaccagcggcggccctccaggtcctccagcggcagtgccttctccaggtgctgcccgagggcccggtcggcggggacggcggtgatacgggcggcggcggagttgaaacaggtgacccggccgtgctcgtcggcgatcaccagcccgtcgggcaggtcgtcggggtcgacagccggtggcaccgtcgaccggcgcgcaccgcgtgcccccggtaccgccccgctcgtgccgacactcatcccttaccccaccttcccgacggtgcagcaggcccccgagctggtcaccctactagctggaggtgccggagcggcatcctccgctcgcgcgctgggcgcgggccgacgcgtagaggcatacggcggcggcggtggcgaggttcaggctctcggcctttccgtggatggggacgcggacgacggcgtcggccaggtcccgggtctcctccggcagcccccaggcctcgttgccgaacacccaggcggtggggccgcccatggtgcccttgtccagctcgtcgtcgaggtcgtcggtgcccgcgccgtcggcggcgaggatgcgcaccccggcgtctttgagtgcgacgacggcctgttcgacgggcacgccgacggcgaccggcaggtggaacagcgagcccacggaggcgcgtacggccttggggttgtacaggtcgacggaggcgtcggtgaggatcacggcgtcggccccggcggcgtcggcgcagcgcagcacggtaccggcgttgccggggtcgcgtacgtgcgcgaggaccgcgacgaggcgggggcgggcggcgatgatctcctcgaacggcgtgtcgaggaaccggcagatcccgacgaggccctgcggggtgacggtggtggagatgtcggcgatgacctcgtcggaggcgaggtgcacccgggcgccggcggctcgggcctcgccgatgatgtcggcgtagcgctcggcggcctcgacggtggcgaacagctccacgagcgtggccgtcccgtccgcgtcctggtgcccggcggcctcccgcacggcctgcggcccctcggcgaggaacagccggtccttcccccggaagttccgcttggccagccgccgagccgcgacgacgcgggcggaacggggagagatcagctcgggagtggcggggggcatcctcttaccttcggataactacgcgcccctcaaggggcgcggggctgtctcgatatgcggctccgccgcgtgggcgcgagcaaccacgacggacccgcagccggaagccggccgcaggcccaacagcaggacccgcaagcccgaaagcttgcgggtcctacgacaccggctcgagccagcgcagcgtcacgcggccttcggcgcgttgacgtcgctcggcagagccttctgcgcgacctcgacgagcgcggcgaacgcgttcgcgtcgttcacggccagctcggccaggatcttgcggtcgacctcgacgttcgcggccttcagaccctggatgaagcggttgtacgtgatgccgttggcgcgggccgccgcgttgatgcgctggatccacagctggcggaagtcacccttgcgcttcttgcggtcgttgtagttgtagaccagcgagtgggtgacctgctccttggccttgcggtacaggcgcgagcgctgaccgcggtagccggaagcctgctcgaggatcgcccggcgcttcttgtgggcgttgactgcccgcttgacgcgtgccacttgtttgactccttgtagcggggccgtggttgtgctcacacggcccggaaacgattgggtcccggtcctgacgtacggcgcgccgtgatcgtgtgatcacgcgccgccgcgtcacttgccgagaagcttcttgatcttcttggcgtcgcccggggccatctcggcgttgccggtgaggcgacgcgtcagacgggacgacttgtgctcgagcaggtggcgcttgccggcgcgctcacggagcaccttgccggagccggtgaccttgaagcgcttgctggcaccgctgtgcgacttgttcttcggcatagcgccgttatctcctcgtcggtggcgctccggtgcccggtcgcgagaaccgggcacggttggagcgtcgctcttgtttcggttacatcctgggacgcggggtcccgggggtcacgcctcggcgtgctcctcggcgggctcttcgtcaggcgcatcgatgtccgccgcgttctgcgagcggccggggttggccttcgcgtccgccttgcgggcttcctgcgcctggcgggcctcggccatcgcctcggtcttcttcttgtgcggaccgagaaccatgatcatgttgcggccgtcctgcttcgggttcgactcgacgaaaccgaggtcctggacgtcctccgcgagacgctgcagcagtcggtagcccagctcggggcgggactgctcgcggccacggaacatgatcgtgatcttgaccttgtcgccctgcttgaggaaccggacgacgtgacccttcttggtgtcatagtcgtgcgggtcgatcttcggccggagcttcatctccttgatgaccgtgtgcgcctggttcttgcgcgcctcacgggccttcatggccgactcgtacttgaacttcccgtagtccatgagcttgcacacgggcggacgggcgttcgccgcgacctcgaccaggtccaggtcg

SEQ ID NO: 516 - DNA, 3199 bp, Unknown
  Kingdom: Bacteria, Phylum: Actinobacteria, Class: Actinobacteria, Order: Streptomycetales, Family: Streptomycetaceae, Genus: Streptomyces
ggtttcgcggtggccgtcgccctcgggcacgcctcgatcgccctgctcatcgcgctggccttcgtgctcaccacgctccagaccctcttcgacaacgcggcgacggccaccgcgaaaccaccgaccagcaggccgcgtaccgcgtccaccgtccacatcgcacgccgctggtccacccggtcggcgacggctccgcccagcagtccgaatacgatccagggcagatacccgcaggccgcgaccgaggcgatgagcagggggtcgtcggtcagtgaggcggcgagcaggggcagcgcggccgtccgcagcgcgtcgccgaagctggacagcacggcggcgctccacagccgcccgaaagccccgcgccacgcgggccgtgtcacggcctctgccgcgtccagcgtcgtcatcgccgccccctcacgattcgccgatgcacaaaccgtagagggcaccactgacaatcgcctcggcggcggccggccgcccggggaggcacacccttgtcccgagtgccgggacggcaccggacgggacgtcaactactagatctcgccccgcagtttggcgagcgcctcggcgaggatggcctcgccgtccgcgtcgctgcgccgctcgcgcacgtaggcgaggtgcgtcttgtacggctcggtgcgcggcgggtccggcgggttgtcccggtcctggccggccgggaagccgcagcgcgggcagtcccaggtgtcgggcacctgtgcgtcgctggcgaaactgggctgcgtctcgtgcccgttggagcaccagaaggagatgcgcagacgcggcgcggactcgccgcgctcggcctcgcccatcggccccgccccgacccggcttccccggatcgcgttgccacttgccacggtcgtaactccctgcgtgatggtgccgcgaaacgagtcggcgtaccgcttcgctgcgagcgcctcagtctacgtaaggcccaacgcgcgtccagtgatgggagttaccgtcccccgcacacagacgcaagccccatgataggccgcgctcgtgagcgcgtaccgaccatggggccttacgtgcggaatgtgcggtgttcgcccgctcgtcagctggtggacttcatcaggatgccgaggacgatgatgcaggcgagccacagcagagcgaccaccacggtgatgcggtcgaggttgcgctcggcgacggaggagccgccgacggacgactgcatgccgccgccgaacatgtcggagaggccgccgcccttccccttgtgcatcagcaccagcagcatcagcagcaggctgaagacgatcagggcgatcgagaaccccaaaaccacggctggaccaacttcctcggattcggatggacgacgggggcacagcacctcggctgtgcccccgccagggtacgacgtatcgccgctaccgcctactcacgtccggctcactgctcgcggaacctgatgatcttgacgaactcgtcggcgtccagcgaggcgccgccgaccagggcgccgtcgatgtcggcctggcccatgatctcggcgacgttgcccgacttgaccgagccgccgtactggatgcggatcttgtcggccacgtcctgcgtgtacagctcggcgagcttggcgcggatcgcggcgcagacctcctgggcgtcctcggcgccgcagaccttgccggtgccgatggcccagacgggctcgtaggcgatcacgacggactcggcctgctcggccgggaggtccttcagaccgccctcgacctgggcgagggtgtgcgcgacgtgattgccggcctcgcggacgtccagttcctcgccgacgcacaggatcggggtcaggccgtgcttgtaggcggccttgaccttggcgttcaccagctcgtcggtctcgttgtggtactggcgccgctcggagtgcccgatggccacgtaggtgcacttgagcttggcgagcatcgggccggagatctcgccggtgtaggcgccggagtcgtgctgcgagatgtcctgggcgccgtacttgatcttgagcttgtcgccgtcgaccagggtctgcacggagcgcaggtcggtgaagggcggcaggacggcgacctcgacggcgtcgtagtccttgtcggccagggcgaaggcgagcttctggacgtgcgcgatggcctcgaggtggttgaggttcatcttccagttgcccgccatcagcggcgtgcgggtggtcattgaggtcagtcctccagtgcggcgagaccggggagcgtcttgccctcgaggtattcgagggaggcgccgccgccggtcgagatgtggccgaatgcgttctcgtcgaaaccgagcgtacggacggcggcggcggagtcgccgccaccgaccacggtgaagccgtcggaggcgacgagggcctgggcgaccgccttggtgccctcggcgaagtcggggtgctcgaagacgcccatcgggccgttccagaagacggtcgcggcgtcggcgagcttcgaggcgtacagctcgcgggtgcgcgggccgatgtccaggccctcctggtcggccgggatggcgtccgcggccaccgcggtggggtgggccggggccttggtcttcaggtccgggaagtcgggcgagaccagcgcgtccacgggcagcaccagctcgacgccctgcttctcggcgcgctccatgtactcggtgacggccgcgagctggtcctcctggaggagggacttgccgacctcgtagcccttggccttgaggaaggtgtaggccatgccgccgccgatgagcagccggtcggccttgccgaggagctggtcgatgacggcgagcttgtcggagaccttggcgccgccgagggcgacgacgtagggccgcttgacgtcctcggtgagcttcttcaggacgccgacctcggtggcgatgaggtagccggcgtagtgcggcagacgggccggcaggtcgtagacggaggcgtgcccccggtgcacggcgccgaagccgtcgccgacgtagacgtccgcgagggcggcgagggcgtcggcgaactcaccgcgctcggtgtcgtccttggacgtctcgccggggttgaagcgcaggttctcgatgaccgcgacctggccgggctcgaggccgtccacggcgtcgtgcgcggcggggccgacggtgtcctgggcgaaggccacgggcgcgccgagcagttcaccgagccgctcggcgg

SEQ ID NO: 517 - DNA, 4602 bp, Unknown
  Kingdom: Bacteria, Phylum: Actinobacteria, Class: Actinobacteria, Order: Streptomycetales, Family: Streptomycetaceae, Genus: Streptomyces
tcccggtcgcaggcgtgggcgcccagggagacctggcgggcgacgatcgcgcgctccgcgcgcatcagccgccagccgcggcgcagcaggaacggcaccgacttgcggccctccttcagatcccgcaggaaacgccgtcggaaggtggtgaccggcccccgggtcagacacaaggcgtcggccagcacgccccgttcacggcagcgctccacgatctccgccgcgaagaccccctccgcgacgaacagcggcgtgcgcccgatgtgcagcgtctcctcgccggtgcgggcgctgcgcccgaggtcgtacaccggaacgcccgtggagcccgtcgcgcacagtcgcgtgatcgcctcgacggcgacgtccgcgtcccacgacccgggatggtcccagtcgatgtccgaactccccgccaccagcggcagcgtcgggtcgtcgccctccttgtagaagtcgtcgaggcgcagcacgggcagcccggaacgggcggcgaccaaggacttgccggagcccgaggggccgcagagcagcacgacacgggcgggtgacgggggatgaaggctcacggaacaccagtttgacgcatggtggccgtcctgccgagcccgcgggtcggctttggtgcgtggcgcacctctcaactaccctgtgcgctgttccggttactctgcgcatcagaaggcggcatcagaaatggcccgacagacccgccacgcccgacacgcggccgtgcccgtgtccgctccccgtcccactgtccggcgcgtcctgatcgccgtggcgaccgccggtgccgccctgggtgcgggtgcggcgaccgcggcggcggacagcctcccggtgctgggcggcgagtaccacaccggttccctcggcaaggtcgacccgcaggcggggctgcaggcgctgacgggcacggtcggttacgccaccgggccggtggcgggcctcaagccgaacccgctggccggcaccggcgtcgacccgctcgacaacggggtgggcacccagctcgccgacttcaagccgctgacctcacggacgctcacccacccggtggcgcaggcgccgtcggtcgggagcatcccggtggtggggcaggcgctcggcgcggtgcgctgaccgccccgcggccccgcccgcgcaagagagccgcggcttccccggacggagggaagccgcggctctcgtccgtgtgggcggagtcccgggtgcgggcgaccgtcagtacgacgagcccgaggcgccgagcgaacccgtcgggtgccagaccgtcttcgtctccaggaacgccgtcatgcggtccgtgcccggcgtcgccgaccagtcgtccacaggctgtggacgcaggacgcgcttgaggttgtccgccgccgcgatctccagctccttcgccagcgcctcgtcggcgcccgccaggtcgatcgcgttgacgtcctggtgcgcggcgaggggcgccgcgatctccgccgtacggccggagaggacgttgaccactccgccgggcaggtcggaggtggccaggacctctcccagggagagggccggcagcggggacttctcgctggcgatcaccactgccgtgttgccggtcgcgatcaccggggcgatcaccgagaccaggcccaggaacgacgactcctgcggggccaggacggccacgacaccggtcggctcgggggaggacaggttgaagtacgggcccgccaccgggttcgcgccgccgatcacctgcgcgatcttgtcggtccagcccgcgtaccagacccagcggtcgatcgtggcgtccacgaccaccgccgcccgggacttcgacaggccctccgcgtcggcgacctcgcgcacgaactgctcgcggcggccctccagcatctccgcgacgcggtagaggatctggccccggttgtacgcggtcgcgcccgaccagccgccgaacgccttgcgggcggcgaccaccgcgtcgcgggcgtccttgcgggaggcctggggtgcgttcgccagccagttgtccttagcgtcgctcacctcgtacacccggccgctctcggaacgcgggaacttcccgccgacgtacagcttgtaggtcttgaagacggagagtcgctcagtcttgtcggtcttctcagacatcgaggtacgcctccaggccgtggcggccgccctcgcggccgaagcccgactccttgtagccgccgaacggcgacgtggggtcgaacttgttgaacgtgttggaccagatcacgcccgcgcggagcttgttcgcgacggcgaggatcctcgaccccttctcggtccagatgcccgcgctcaggccgtactgggtgttgttcgccttggcgaccgcctcgtccggcgtgcggaaggtgagcacggagagcaccgggccgaagatctcgtcacgggcgatggtgtgcgcctgggtgacgttcgtgaacagcgtcggggcgaaccagtagccggaggagggcagttcgcaggccggggaccagcgctcggcgccctccgcctcgccgcggtcggccagcgcggtgatccgggccagctgctcggcggagttgatcgcgccgatgtccgtgttcttgtccagcgggtcgcccaggcgcagggtgctcaggcggcgcttgagggcgtccagcacctcgtcgtggaccgactcctggacgaggaggcgggagcccgcgcagcagacctgcccctggttgaagaagatgccggtgacgatgccctcgacggcctggtcgatgggggcgtcgtcgaagacgatgttggcgcccttgccgcccagttccagggtgagcttcttgcccgtgcccgcgaccgtgcgcgcgatctccttgccgacggccgtggagccggtgaaggcgaccttgttgacgtccgggtgcgcgacgagcgcggcgcccgcgtcgccgtagcccggcaggatgttgacgacgcccttgggcagacccgcctggcggcagatgtccgcgaagaagagggccgacaggggggtggtctcggccggcttcagcacgaccgtgttgcccgtcgcgagcgccggggcgatcttccacgccagcatcaggagcgggaagttccaggggatgacctggccggccacgccgaggggcttcggggccgcaccgaaccctgcgtggtcgagcttgtcggcccagcccgcgtagtagaagaagtgcgccgcgaccagcgggaggtccgcgtcgcgggtctccttgatcggcttgccgttgtccagtgtctccaggaccgccagctcgcggctgcgctcctggatgatccgggcgatacggaacaggtacttcgcgcgctcggagcccggcagcgccgaccacttcgcgaacgccttgcgggcggccttcaccgcgcggtccacgtccgcctcgccggcctgggcgacctcggagaggacctcctcggtggacgggctgaccgtcttgaagaccctgccgtcggccgcgtccgtgaactcgccgtcgatgaacaggccgtaggaaggggcgatgtcgacgaccgagcgggactcgggcgccggtgcgtactcgaacgcggagttcttttccagaggcatggggatcagtccaccgtcacgtagtcggggccggagtagcggccggtggccagcttctgacgctgcatcagcaggtcgttcagcagcgaggaggcgccgaagcggaaccagtggttgtccagccagtcctcgcccgcggtctcgttgaccaggaccaggaacttgatggcgtccttggaggtgcggatgccgccggccggcttcacgccgacctggacaccggtctgggcgcggaagtcccgtacggcctccagcatgaggagcgtgttggcgggggtcgcgttgaccgcgacctttccggtggacgtcttgatgaagtccgccccggcgagcatgccgagccagctcgcgcggcggatgttgtcgtacgtcgacagctcgccggtctcgaagatgaccttcagccgggcggcggacccgcaggcctccttcacggcggtgatctcttcgaacaccttcaggtacctgcccgcgaggaacgccccgcggtcgatgaccatgtcgatctcgtccgcgcccgccgcgacggcctcccgtacgtcggccagcttcacgtcgagggcggcgcggcccgcggggaacgcggtcgccaccgaggcgaccttcacgcccgagccggccaccgcctccttggcggtcgccaccatgtcggggtagacgcagaccgcggccgtggtgggagccgtgcggtccgtcgggtccgggtggaccgccttggcgccgagcgcccggaccttgcccggggtgtccgcgccttccagcgtcgtcaggtcgaccatcgagatggcgaggtcgatggcgtacgccttcgcggtggtcttgatggaacgggtgccgagcgaggcggcgcgcgcctccaggccgaccgcgtcgacgccgggcagcccgtgcaggaaacggcgcagcgagctgtcggacgccgtgacgtcggagagcggcggcgcggagggtgcagtggtgggcatggtcaccagatgagcatatctacgcgcgtagcggctgtacagccctgggggatgggctggggg

SEQ ID NO: 518 - DNA, 5114 bp, Unknown
  Kingdom: Bacteria, Phylum: Actinobacteria, Class: Actinobacteria, Order: Streptomycetales, Family: Streptomycetaceae, Genus: Streptomyces
cacgcgggccgttcggccggtcggtcgggcgccagcagcggctcggtgcccgtcgccacgaggaacagcacggcgcccagcgagtacagatcggccgacgggtccggcagggtgcggcggcccggaccgggattcagctgttccggtgcgccgtagcccagggtgccgccgccgggcgcggggatgccgtggcacgcggcgagttccaggtcgatgagacggagccggccgtccggggcgacgaaaacgttgtcaggcgtcagatcgcgcagcaccacaccgctcgcgtggacgcgggagagcaggtccgtcagccgccgggccagatccagcacctcctgccgcgccggtgcgccaccgcgcgcccgcgcccgcaggttccacagcctgagcgggacgccgtccaactgctcctgcacgaggaagacatgaccctcctcggtgaggaaggagaccttccggggagtcagtccgagcggcgcgagccggtcgagcatctccccttcgttgcgcagcagatcgcgtacgtcggtgcccagtgcggtggcgtcgatgtgggccctgccctgcttgacgatcacgcgcccgcccgtgtgccggtccgtcgcccggaagactccgcccttggtgctgagccggagagccgcgtgcacgacgaagcggtcgccgatgacgacgggccgggcgggccgtctctcctccgccgtcggggcagccggctgttccggagcagcggggggcgcctcgaaggggtcggtcacgccggccggcggggtgtaccagggctcgcggacgtcggggacccgcctgccctcggcgtccacgagggtcggccggtagacaccgttgtcaccgaggaccagcaccggcaggaatcctccgtaccggtagtgcaccaggctgcccgggcggtaggggcggtccgagaggatccgcggccccggcagtccggccgtcacctcgtgcaactcggccgctatggcgggaagaggctccgcgttccgcggatagaccgtgatgaatttccccgccgaagcccggtcgtattgccgggacaccaattcccggacgcgatccgcggaagcggccaccttgaaatccaggccatggcggagaagaatcggggcgattttctccaggatttccgcggccgacaccggagtggccgaaaggtggagtttccagccctgtccgggaaggtggccgcccacgggcgacccgtcggcgggcgacacccggcaccacaggccatcgctgctgatccgccacggctgaccagcggaatcacactcccgcaggagaggcctgaggatggcttcggggtcgaaggggcgagccgctcggtctgcctgtgccaagcctcccgggacctggtccacgcttcccgacgtcaccctgcggcctccgagatcatcgtttccggcatcccatgcgctgctgcgatcatcgccgttcaccggtgtgcggaaaccatatgaccatgtaaagaaacagcaaatccggaacctgggatctgccttgtcttggaaacggccgatgccatcgcaattgcccaatttgggtggagcggctgccgtattgccgcatcgcggcggggcgggatgtcgaacctcgccgcgaacggggaaggatggccgggacgtccgatacaccccccgacccctggaggacaccgagatggcactgacccgggaagaacgcgagaggttcctcgccgagccgcacgtggccgcgctggcggtcgacggggaggcgggcaggggtccgctgaccgtgcccatctggtaccagtacgagccgggcggcctcgtgtggatcatgaccgggctcgactcccgcaagaacaggctgatcggcgcggccggccggttctcgctcatggtcgaccggctggagccgacgatccggtacgtgtcggtggagggcccggtcaccggcacggagcccgccaccgtcgagcagctcagggagatgtcggcgaggtacctgccgaccgggaaggtcgacgcctatgtcgatttcgcctggaagaaccacggcgagcaggtcgtcgtccgcatgcggcccgaacactgggtctcgtccgacctgggaacggtctgaccgtcgaaggaccggcgtaagatcgtgcggccgtggcggggtactacgctgacggcatgacgcactttgatgtcctcgtcctcggcgcaggccccggtggctacgtcgccgccatccgcgcggcccagctcggcaagtcggtggcggtgatcgaagagaagtactggggcggtgtctgcctgaacgtggggtgcatcccctccaaggccctgctcaggaacgccgagatcgcccacatcctcacgcaggagaagaagaccttcggcatcagcggtgacgccaccatggacttcggcgtcacccatcggcgcagccgctccgtggccgaggccagcgccaagggcgtgcactacctgatgaagaagaacaagatcaccgagatcgacgggtggggcacgctcaccggcccgaagtcggtggacgtcagggccgccgacggctccacggcctcctacagctgcgacaacctcatcatcgccaccggcgcgcaggtcaggatgctgcccggcatgagccgcagcgccaacgtggtcacctacgaggagcagatcctggacgaggatctgccgcgctccgtcatcatcggcggctccggtgcgatcggcgtcgaattcgcctacgtcctgcggaacttcggggtcgaggtgaccatcgtcgagttcctcgaccgcatggtgcccaccgaggacgccgacgtctccaaggaactcctcaagcagtaccgcaagctgggcgtcgacgtcctgctctccacgaaggtcgactccgtcgaggacaccggttcgggcgtccgggtcaccgtcagccccgccgccggcggtgagtcgcgcgtgctggaggccgaccggatgctcgccgcgttcggcttcgcgccccgcgtcgagggctacgggctcgaggcggccggcgtccagctcaccgagcgcggcgccatcgcggtcgacgcccgcggacgcaccaacgtcgagggcgtctacgccatcggtgacgtgaccggcaagctgatgctcgcccacaccgccgaagccatgggcgtcgtggccgccgagaccatcgccgatgccgagacgcaggagatcgacttcgcgatgatcccgcgggcgaccttctgccagccccagatcgcgtcgttcggctactccgaggcgcaggcccgggagctgggctacgacgtcaaggtcgcgcagttcccgttctccgccaacggcaaggcccgcggcatggccgagggcgtcggcttcgtcaagatcgtggcggacgcgcggcacaacgagatcgtgggcgcccacatgatcggtcccgaagtgaccgaactgctgcccgcgctgacgctcgcccagatgtgggacctcaccgccgacgaggtcgcccgcaacgtcttcgcccacccgacgctgtcggaggcgatgaaggaggccgtcgagggcatcgcggggcacatgatcaacctctgagtccccggctggaccgcatgcctccgcccgccccccggcaccgcgcgcacgcgggcgccgggggagcgggcgggggcgggagcgcccgcgctcagcggctgccgagcagttcgagcgtgtcgatcacgcggttcgagaagccccactcgttgtcgtaccaggcgaccaccttgacgtgccggccgtcgacgcgggtcagggccgagtcgaacaccgacgaggccgggttgcccgtgatgtcggacgacacgagcggatcctccgagtactccaggatcccggcgagcggcccctgcgcggcgacccggtaggccgccagcacgtcgtcacggctcacgtcgcgggcgacggtcgtgttgagttcgacgatcgagcccactgggaccggcacgcggatcgagtcgcccgacagcttgccgtccaggcccggcagcacaagaccgatcgccttcgcggcgcccgtcgtggtcggcacgatgttgacggcggcggcgcgggcccggcgggcgtcgcggtgcgggccgtcctgcaggttctgctcctgggtgtaggcgtgcaccgtcgtcatgaaaccgtgctcgataccggcgagttcgtcgagcaccgcggccagcggagccagcgcgttggtcgtgcaggaggcgttcgagacgacggtgtgccgaccggggtcgtacgcgcccgtgttgaccccgtacgcgagcgtgacgtcggcaccgtccgagggcgcgctgacgagcaccttgcgcgctccggcgtcgaggtgggcgcgggcggccccggccgaggtgaaccggccggtcccctccagcgccacgtcgacgcccagctccgcccacggcagccgcgccggttcccgctcggccagcaccctgatgcggcgcccgtcgacgaccagcgcgtccccgtccaccgtcaccgggcggccgagccggccggccgtcgtgtcgtaggcgagcagccgcgccagcgtggcgggctccgtgaggtcgttgacggcgacgacctccagggcgctgtcgcgttcgagcagcgcgcgcagcacattgcgtccgatgcggccgaatccgttgatggcgatacgagtcatgagtggcgttccttccgttcgccgaccagcttcgccagtggcgtacggccgcgacagcggcgtgagcgccacggtccgcaaggatcgtgccaggcgcaggcgcaggcgcaggctggagcgcagacgcaggcgtaggcgcgggctggagcgcagacgcaggcgcggacgccttcgctactcgccccgcgcgaacgtgcgccggtactcgctcggtgtggtgccgaggacccgctggaagtgcagccgcagattcgcgccggtgcccaggccgacgtcggcggcgatctgctcgacgctcagttccgaacgctccagcagctcacgggccacgtcgatgcgggcgcgcatgacccactgcatcggtgtgtacccggtgtcctcggcgaaccgctgaccctggaggtgctcgcccggcacgcggcggtgtcggcgcgcacgttctcccggcggttcgccgaggacaccgg

SEQ ID NO: 519 - DNA, 10282 bp, Unknown
  Kingdom: Bacteria, Phylum: Actinobacteria, Class: Actinobacteria, Order: Streptomycetales, Family: Streptomycetaceae, Genus: Streptomyces
  misc_feature (6053)..(6054): n is a, c, g, or t
gcgccgggaccgcgaccacggcgcagcgccccgcgcccaccgcgggcgcccaccgggacacgcccgacgcctccgccgcagcctggcacaagtggggcctcaagcccctgcccaccgccccgaaaccgccggccgacaagcccgtcaagctcaccgcgcacggcaccgtcccggtcctcacccacataccgacccggcagaagatcgtcttcgtcaccctcgacgacggacaggagaaggacccgaagttcatccggatgatgcgggacctgaaggtcccggtcacgatgttcctgatgaacgacgcggtgaaatccgactacgcgtacttcgggccgctgcaggagatgggcaaccacatccagaaccacaccctgcaccaccccgtcatgaacaccctcccgctcgcccgccagaagcaggagatctgcggcgaccaggagatcctcacccggcagtacggcaccgcgccgctgctgttccggccgccctacggcgcgtacaacgccgacaccaaggccgcggtcggcgcctgcgggccccgggcgatcgtgtggtggcgggagtccatgcagatccgcaacatgcagtaccagaccgcggacaagaagctccgccccggcgacatcatcctggcccacttccgcggccccagcgaactcaagggcaccagcatgacgacgatgttcgccaacctgctcaagcgcatccaggagcagggcttcgccgtggcccgtctggaggactacatccagccgcccgcccagtaaggctctgttcgatttttctatgccctcgcgcgccccgtccgtcccgcccgcaacgcccctgacgcgccaccaatatcctttcccacctgggcatttacgcggctctgcggccctccgattgtcagtgcccggcagtagaatggaggcagtgttcgagggcgtcaccggagtctcggtctccggccggcgcccccctcgcgacaggaggatgcctgtgcccgctgccgccctgaagccgaagccgtcgccgacccagtccaccgcgaagcgtcccgtcctgctcgaccagccctacgcacccgtgcacaagcgcccgctgccgcccgggcgtccgcgcgagtggtacatcacgcacaaccggcgtctgaaggcgatgcggctcgccatcgcgctgctcgactccggtgtccaccagccgggccaggcccgcgacgagacgatacggagcaccgccgaactcatcggcgtgcatccgccgtcggacaccacctgccacatggtccgcgccctgatgcgctacgcacgctgatgcgcggtgggcggtgggcgacccgttcgcgcgggtcacccaccgcccaccgggccccgcacgctcacggccggggcgcccgccccgcccggcaggaacgtcaaagccccggcgctccccacacggggaaccagcggctgaggtcctgctccatgcgcaggtcgtcggcgagggcggacctgacccggatctccagggcgttgtcgcggcgctggtgcccgtcgggcagcggggcgaacggatagaaggtgccgcgcttgtacaggtacaccagggcgagccggcggccggtgccgtcgtcgaagccggccagggagcacaggagctgcgggccgaagccgttgacctccatggcgctgttcacggcgtgcaggtcgttgacgaggtcgggcagctggtccggggtgcggcgggagaccagccaggagtagccgtaggagtcccgggtcagctccaccggcgggcccggacggtcggtgtccgcgtccaggagggcccggacctcgcggtgtgtctgctcgaaggccgcgccctccaccgtggcgaaacacaccgcgccccgcccggtcggcgtgaacccggccgccgcctgcagcgtcaccgccgccgagggcagcgcgaacagctggtccaggtcgggcggggcgggtttggtacggccgagcaggatgtcccagaagcccatcctcagcccgccttccccggtgtggcggcctcgcccagctcggcggagatccgcgccagctgttcgagccgctgctccaggctcgggtgggtggagaagaaccgggagatgccggggtcggagcccagcgccggcgtgaagtagaacgcgttgaacgcctgcgcggtgcgcaggtcctccgacgggatccgggcgatggtgcccgtgaccttggtgagcgcggaggccagctcggagggccgcccggtcagcagcgccgccgcccggtccgcggccagctcccggtacctcgacagggcccggatcagcaggaaactgatcgcgtacacggccgccgacacacccatcaccatggcgaacagggccagggtgttctggtccttgcggccccggccgccgaagatctccgagtagaaggcgaaccggaccaccagtcccgcgagcacgccgaggaaggacgcgaccgtgatcacggcgacgtccttgtgggccacgtgcgacagctcgtgcgcgaggacgccctccagttcggcgggctccagccggcgcagcaggcccgtcgtcacgcacaccacggcgttgtccgggttgcgcccggtcgcgaacgcgttcggcatgtccatgttggagacggcgaccaccggtttgggcatgtccgcgatcgcgcacagccggtcgatcacggcgtgcagctcggggaactcctcgcgctccaccacccggccgtgcatcgcgaacagcgcgatccggtcggagaaccagtactgggcgatgagcacaccggccgcgatcaccacgaccagcacccacgacttcagcaacacgatcaacgcggccacgaacgccacgtacagcaacccgagcaggaacagcgtgagacccatgcgcacggtcagccgccggtcgctccggaagcggctctgcatcttgcatcaccccgcagtcaggcactcgtcccgccatccagtgtgcacctgcgggggcgcccgtgaccggctcgcggcggctcagtacagggcgcgggtctgggcgtaaccgatgaggaggatcagggcggccacgcagccgaggacgacggccgtggatatccacgaggaccggcgggggccggcctggccggggtcgccgcggaagggcaccgggcccggcgggtcgtccttccagcgggcggcgagcatccgggcccgcgcggagggttccttgtgctcggccgcgctcgcccaccggtgatcgaattcccgctcgaactctctatcgaactcacgctcgaattcttccggttcggacatccccggcatccccctcacctctcctgccctccctgggctcagcgggtccctcgggcgcgggccaggggcccgctcccgtcagtaggagacgcgcgaggcgccggaaggttgtgcgcacgggtcgctcattcggctcaggatgctgagtcgtcggggggcggctagcctcattgagtgtgatcgcgctgcggccgcggccttccgtcacgttccccgagaagctgcacgagtgggtggaaggaaggtattccatgaaagcaccacgcgcgaggcgtctcttcgccctcaccaccgccggcgtcctgctggcgggcggcgcggcgatcggcacggcgggcaccgcctcggcggccacgccgcggaccccctccgtcacgacgaaccacggctgcggctggtggagcagcaactgctacggccaccgcggcgaccgcggagccctctacggccccgggtacggctacggttacggcttcggcaaccagagcgccgtcgtcgtgatcgtgctgtgacgcgccggcgacgggcccgaagcccccgcccggcaccaccagcgccaccggctccaccagcgccggcaagcgagaaccgccccccgtgcgaggaatgcacggggggcggttccacggtgacaggcaccgcggcggcaccggcggcaccggcgccggggcggatcacacgtcgaagtacagctcgaactcgtgcgggtgcggacgcagctgcagcggggcgatctcgttggcgcgcttgtagtcgatccacgtctcgatcaggtccggcgtgaacacgtcgccctggaggaggaactcgtggtcggcctccaggcggtcgaggaccgcgcccagcgaggtcgggacctgcgccacgttcgcgtgctcctcgggagccagctcgtagaggtccttgtcgatcggctcggccggctcgatcttgttcttgatgccgtccaggcccgccatcagcagggcggagaacgccaggtacgggttgccggaggcgtccggggcgcggaactctacgcgcttggccttcgggttcgaacccgtgatcgggatacgcatcgcggcggagcggttgcgctgcgagtacaccaggttcaccggcgcctcgaagcccggcaccagacggtggtaggagttcaccgtcgggttggtgaaggccagcagcgacggcgcgtgcttgaggatgccgccgatgtagtaacgggcggtgtccgacaggcccgcgtacccggcctcgtcgtagaacagcgggtcgccgttgctccacagcgactggtgcacgtgcatgcccgagccgttgtcaccgaagatcggcttcggcatgaaggtcgccgtcttgccgttcttccaggccacgttcttcacgatgtacttgaagagctggaggtcgtcggccgcggccagcagcgtgttgaacttgtagttgatctccgcctgcccggcggtgcccacctcgtggtgctggcgctcgaccttcaggccggaccgctccagctccagggagatctcggcgcgcaggtcggcgaagtggtcgaccggcgggaccgggaagtaaccgcccttgtaacggaccttgtagccgcggttgtcctccagcgcaccggtgttccaggcgcccgcctcggagtcgatgtggtagaaggcctcgttctccgcggtacggaagcggacggagtcgaagacgtagaactcggcctcggggccgaagaacgcggtgtcggcgatcccggtggaggtcaggtacgcctcggccttcttcgccacgttgcgcgggtcacgggagtactgctcgcccgtgatcgggtcgtggatgaagaagttgatgttgagcgtcttgtcccggcggaacgggtccacgcgcgcggtcgacaggtcgggacgcagggccatgtccgactcgtggatggcctggaaaccacggatcgaggacccgtcgaaggcctgctcgtcgtcggggtcgaacgcctcggcgggcaacgtgaagtgctgcatgacgcccggcaggtcgcagaagcggacgtcgacgaacttgacgtcctcgtccgcgatgaacttcttggcctcgtcggcgttctggaacatccagctcctcctactcccgaccgtcccgccggggtggtagatcgttcgtgcggccagtgcggtggcacacggtgcctcgaccctagggacgggtgatttcccgggcgtgacccatttgtttcgcagaagttaaccggcccgggtggggtcacgtcgcggacaccccggccgccttcctccatacagcctcgcagtaccgtggacgggtggacaacaggcaagcagttggatcgtggctctccgggccgcgcgcggccatcgaagacgcgggcgccgacctcggttaccggggcgaacggctgggactgcccgaggaaggaccgggttccatcgcccgcccgggcaggcggctcggcgccatcgccgtcgactgggccctgtgcatgctgatcgcctacggcctgatcacgcacggctaccagcaggcgaccggcaactgggccctgctcatcttcttcgtgctcggcgtcctcaccgtcggcaccatcggctgcaccccgggcaagcgcctgctcggcctgcgcgtggtcaccctgcgcaccggcaccgtccagccgctgcgcgccctgctgcgcaccctcctgctgtgcgtcgcgatcccggccctcatctgggaccgcgacggccgcggcctgcacgaccggcttgcggggacggtcgaagtgcggatgtaggacggtgtacgaggagggggcnngccccctcctcgtacaccgtcacaggcgggaggtcagcgggccttcgggccgccccgcggcatccgcatgcccttgggcatcggccccttcggcacgggcatgttgctcatcaggtcgcccagggcgcgcagccggtcgttggtggcggtcacctgcgggccggtcagcacgcgggggaacttcagcatggtcgtgcgcagcttcttcagctcgacctggccctcgccggtgccgacgatcacgtcgtgcacggggacgtccgccacgatgcggttcatcttcttcttctcggcggcgagcagggtcttcacccggttcgggttgccctcggcgaccagcacgatgccggccttgccgaccgcgcggtgcaccacgtcctggctgcggttcatggcgacggccggggtggtggtccagccgcggccgacgttgtccagcaccgcggccgcggcgccgggctggccctccatctgtccgaaggcggcacgctcggcccgccgtccgaagacgatcgccatcgcgaggatcgcgagcaggaagcccaggatgcccaggtagacggggtggccgatcaagaagccgatcccgagaaggacaccgaagacgacgatgccgacagccgcgagtacaagaccgatcttcgggtcggccttgcgggtcatcttgtacgtcagagcgatctgcttcagtcgccccgggttggcagcctcggctgcggtttccttcctcgccatgccacgaagtctacgtggccccgcgagtgaccgacgacgcagtctccacgggacgccaggggcactggggaccgggggcgggcgcccgggatgtacggcgggaccggggccctacggccctacggcggggaagcggtcgagggcgcgctcggcctccacccggtccttggcgcgacggcggtcctccaggacggaggtccaggcgttgcggcgggcggtgcgctggccgccgctcatcagcagcgactcgaccgcacgaagtgcgttcgtgaaggacggaatggctgtggcgcgaacaggcgctgcctgcatggtggaggtcccccctcgttacggctccgggtgcgcatggcgtgagtccagggtcactgactggtgttaccagggcgtgaccgaccggtcaaacaccgatgaacccctgacatcgcgggccaaacgggcgacgcggccccggccggcgccctcatctgcggcgacggccgggaccgcgtcgtgtcggccgctaccggtcggtaagttcttgtgcgcgaattcacagaacgtccgcccggtctcgcgggcccggaacgacggtgcggcggagtgtcagacggcctgcgtggcgacgagtgcgccgtcctgctgcgaagcggccgagccccgctgctcgatcgccatccggtacagccgcccggcacggtaggaggaccgtaccagcgggccggacatcacgcccgagaagccgatctcctcggcctcctccttcagctccacgaactcctgcggcttgacccagcgctccaccgggtggtggcgcacgctcgggcgcaggtactgcgtgatggtgatcagctcgcagcccgcctcgtgcagctgcttcagcgcctcgctgatctcctcgcgactctcgcccatgccgaggatcaggttggacttggtgaccaggccgaagtcgcgcgcctccgtgatgaccttcagggagcgctcgtagcggaagccggggcggatccgcttgaagatccgcgggaccgtctcgacgttgtgcgcgaagacctcggggcgggacgagaagacctcggccagctgctccggcaccgcgttgaagtcgggggcgagcagctcgaccttggtgcggccctcggcccggtcggcggtctgcgcgtggatctggcgcacggtctcggcgtacagccaggcgccgccgtcctccaggtcgtcgcgggcgacgccggtgatggtggcgtagttcaggtccatggtgaccacggactcgcccacgcggcgcggctcgtcacggtccagcgcctcgggcttgccggtgtcgatctggcagaagtcacagcgccgggtgcactggtcgccgccgatgaggaaggtcgcctcgcggtcctcccagcactcgtagatgttgggacagccggcttcctggcagaccgtgtgcaggccctcgctcttcacgaggttctgcatcttcgtgtactcgggacccattttcgcccgggtcttgatccactcgggcttgcgctcgatgggggtctggctgttgcggacctccaggcgcagcatcttgcgtccgtcgggtgcgactgcggacacgtcggctccctgtagcttcgattcttcggcgtacaccagggtacgcccgtgatgattgcgcccagtcggtgaggccaaccccggaccttcggcgatcattcccgccgccggggccgccggggccgccgggcggccccgaagtcgccgtggccgtcaggcggtcgccttctcgatcacacggggctggaggtcggcgttctccaggacgtcccgcaggtggcgctccacgaccggcagcacctcgtcgatggtgacgtcacggcccagctcggccgcgagcgaggcgacgccggcgtcccggatgccgcacgggatgatgcggtcgaaccacttcatgtcggggctcacgttgaacgagaagccgtgcatggtgacgcccttggccacccggatgccgatctgggcgatcttgcggtcctcgcggcgctggccggcgttggagggggcgtactccggaccgttgaggcgcgggtcgaactcctcgtcggtcaggcgcgggtcgaagtccagggccagaccgccgagcgcgggccgctgctcgaccgggtcgccgagcacccacaccccgctgcggccctcgacccgggtggtctccaggccgaagtcggcgcacgtgcggatcagcgcctcctccaggcggcgcacgtgcgcgaccacgtccaccgggcggggcagcttctggatcgggtagccgaccagctggccggggccgtgccaggtgatcttgccgccgcggtccacgtcgatgacgggcgtgccgtcgagcgggcgctcgttgtccgccgtgcgccggccggccgtgtagaccggagggtgttcgagcagcagcacggtgtcgggcacctcgtccgcgaaccgggccgcgtgcacccggcgctgctcgtcccaggcctcctggtagtccacggcctcggcaccgaatcccatgcggacgaaccgcaactcactcacggcaagcgcctccctggaaggtcgtcaggcacgtaacgtgcccacgccactgtacgtccggccgtcgagcgtcagccgcgcgggcaatcctcacacgatcggatgaatgcgtgccgaactctgcggtcggctgctcactctccgctacattcacgccgttcatgaggccataagggctgctcacaggcaatccgggcaccacgcggccgcgtgcaggcccgaaaggcaggagaccgcaccgcagatgacggaacgacccgcgcagcgcactcccaaccgccagctcgccgcgctcatcgcagaagcggggttctccaatgcaggtctggcccgtcgcgtggaccagctcgggctcgaacacggcttggacctgagatacgacaagacgtcggtcacccgctggctgcgcggccagcagccgagaggcaccacgcccgccctcatcgcggaggtcttcacccggcgcctcggccgccgtctgaccgcgcaggacctcggcctcgacgcctgcgcgccggtgtacgccgggctggagttcgccgccgccccggaggaggccgtcgacatcgtcagcgggctgtggcgcaaggactccggcagccacgccgaactgcgcaagatcgccttcaccccggccggtctggtggtgcccagccgcgactggctgatcggacgggccgacgaccgggtcgcgcgcaccgcgccgcccgccgccgcccgggtcccggcccagggccggaccgccgccgcgccggtgctccccgcgtccccgctctccgtgcccccgctcaccgtgtccggtcaaccggtgtccggtcagtccggctccggccggcccgtgtccggtgtgccccgccagcgcggcgatgtcgcccgcggtgacccgctggcccgtctcgcgctcgctctgcgggccctcggcccggccgcgctggcggggcacaccggacacgggccggccggagcc

SEQ ID NO: 520 - DNA, 4460 bp, Unknown
  Kingdom: Bacteria, Phylum: Actinobacteria, Class: Actinobacteria, Order: Streptomycetales, Family: Streptomycetaceae, Genus: Streptomyces
ctggcgcgagacggagttccacctggacgacggcgaggacggccgcgcgcacggcgcagcgggcgagggggtgggcgcacatggcggctgagcgcgagagcacccgcgagcggcacccggccggcgccaccgccgcgggcaggccccggaccgcccgcctcgaccagccgcgcccgctgcggcgcaggctgctgcccgagtgggacccggaggccttcggccggctctccgagcgcatcgcgcgcttcctgggcaccgggcggttcatcgtctggatgacggtggtgatcatcgtctggatcatctggaacgtggccgcgccgcaccagctgcgcttcgaccagtacccgttcatcttcctgaccctggcgctctccctgcaggcctcctacgccgccccgctgatcctgctggcgcagaaccggcaggacgaccgggaccgggtcaacctggagcaggaccgcaagcagaacgagcggtcgatcgccgacaccgagtacctgacccgggagatcgccgcgctgcgcatgggcctgggcgaggtggcgacccgcgactggatccgctccgagctgcaggacatgatgaaggaactggcggagcggcacgacggccatcacgaacatgcggtattcccggcagaacgaccgccccggcgtgacatggacgaccgctgacgggggtcccggtgccggcgccgcgcgccgtaccatcgtctttatggctacggaagacgcggtgcgcgcagcgctggcgacggttgacgaccccgagatccaccgacccatcaccgagctgggcatggtcaaatcggtggagatcggcgcggacggaacggtcgcggtcaccgtgtacctgacggtctccggctgccccatgcgcgagacgatcacccagcgtgtcaccgacgcggtctcccgtgtcgagggcgtcacccgcgtcgacgtgtcgctggacgtgatgagcgacgagcagcgcaaggagctggcgagcgccctgcgcggcggccaggccgagcgcgaggtccccttcgccaggccgggcaacctgacccgcgtctacgcggtcgcctccggcaagggcggtgtcggcaagtcctccgtgacggtgaacctggcggcggcgatggcggccgacggtctgaaggtcggcgtggtcgacgccgacatctacggtcacagcgtgccccgcatgctgggcgcggacggccgtcccacccaggtcgagaacatgatcatgccgccgtcggcgaacggcgtgaaggtcatctccatcggcatgttcaccccgggcaacgcgccggtggtctggcgcggcccgatgctgcaccgcgcgctccagcagttcctggcggacgtgtactggggcgacctggacgtcctgctcctcgacctgccgcccggcaccggtgacatcgcgatctccgtcgcccagctggtgccgaacgcggagatcctggtcgtgacgacgcctcagcaggccgccgccgaggtggccgagcgggcgggctccatcgccgtgcagacccaccagaagatcgtcggcgtcgtcgagaacatgtccggcctgccctgcccgcactgcggcgagatggtcgacgtgttcggcacgggcggcggccagctggtcgccgacggactgacccgcaccacgggcacgtccgtcccggtcctcggctccatcccgatcgacgtgcggctgcgcgagggcggcgacgagggcaagccggtcgtcctgaccgaccccgactcgccggccggctcggcgctgcgcgggatcgcgggcaagctcggcgggcggcagcggggcctgtcggggctctcgctgggcctcacgccgaagaacaagttctagcggccggtcgccgggctgcggcagccgtacgacgaggaagggcgccgtccgcgcggacggcgcccttcgccgtcatggcccgcgtgcggatcacgcgtaggcggtgatgtccccgaccacggcgaagcccagcccgtacgcgctcatcccccgcccgtacgcgcccacgtgcaccccttgcggggtcgacccggcgagcacccagccgaactcggactcccggtagtggaagggggtcggctcgccgtccacgggcagggagagcgtcgaccagtccgggccggacaggtcgtcggccagcacccacgccgtctcggtctgctgctccagccagtcgtcgcgcagggcgtggtccatctgcatgggccaggtgacggagagcagaccgactccggccagccacgccgccgaggagacggaggtggcctccaggcggcccgtgccgtcggcgagctgccgtaccgggttggcggcgacggtgacgacgaccgcgaacttctccctggggtcgtcgggtgaaccggacacgaactcgttgcgcaccgagggctcgtcgccgtgcccgagggaaccgtgctccacacagccgtcggccgaggtgccgacctgcatcagccggcgcggccccgtgaaggcctcgtccaggccgtaccacgggaagggcgccagcaggtagccgtcggccgtacgccgggcggaggggagctgttgtccgccctcctcggccggtgcctgcgcgaccgccctacttgtcgtctccatgaacccggacgcctcctcgctctcgtcggaccggcgcggcccgccccccatcgggcgtactcgccggtccgcacaacaactcggcagcatatccaccccgtcccgagccgccgggaacgcgcccggggcgtggcccgcacaggcggcgggttccggccgtgtggctcaggtggcgtcggcgtcgaacggcggacgctcgtccgggtcggggctctcgggcttcttggtcatgtcgatgcggccgctcccggaacccggggtgcccgtggaggaggaggcggcggacgaggaggaggacgaggcctgcgaggagtcggagtcgtagctgcgcacggcgtccgtgacctcggccatctccttcttcaggtcgaagccgttgcggatctccttcagccccaaatcgtcgttgtccagctgcttgcggatgaacgtcttggggttgaggtcctcgaactcgaagtccttgaactccgggcccagctcctggcggatgtcctgcttggccgactccgagaactcacggatcttccggatcgtgcgcaccacgtcctggatgaccttcgggagcttgtccggaccgaacacgagcacgcccaggacgatgagcgtcgccagctcgggcagtcctatgtcgttgaacacctgaagctccttgcgatgtccgtggtcctcggccctcgggtggtccggtctgtgcgggtctatccgtggtccgggccggatccacggtacccgccccaggtgtccgaccggtaccgtcccgcgctgtcggagtccatgtacacgaccagtttcccgggttgtccgccttgtggaaggccggcgtcggccgttgtcccgcggaaggtccgcgtcagccgctgtccgaggagccgagcaccagggtgacccgccgtttcccgccgtcgcgttcgacggtcaggtccaggtggtcgccggggcggtgggcgcgtgtcctgacgatcagctcctcgcccgagtggacgggcacgccgtccacctcggtgatgacatcgccggccttgatgcccgccttggcgccggggccgcccggcgtgaccggcgatccgccgtccttcgcgctggcgccgaccttggctccgtcgccctggtaggccatgtcgagggtcacaccgatcaccgggtgactggcccggccggtgttgatcagctcctccgccacccgcttggcctggttgaccggtatggcgaagccgaggccgatggagcccgcctgacccgtctgcacgtccgaaccggtgtcggcggagcggatggccgagttgatcccgacgacccggccgcgggagtcgagcaggggcccaccggagttgccggggttgatcggcgcgtcggtctgcagcgcgtcgacgtacgacaggtcgctgccgtcgcccttctcgccgccggccgtgatggggcgccccttggcgctgatgatgccggaggtgacggtgttggccaggtcgaacggggcgccgatggcgacgaccgggtcgcccacccgcacgttgtcggagttgcccagcggcatcggggtcagcccgcgcacaccgcggacctgcacgacggcgaggtcgtagccggtgtcgcggccgacgatcgtgccgcgggcggtctggccgccgctgaaggtcaccgatatggccccgccggaggcggcggcgccgacgacgtggttgttggtgaggatgtggccgaggcggtcgagtacgaagccggtgccggtgtcctgctcgccggagccggacacgtgcagggtcacgacgctgggcagggcgcgggccgcgatcccggccacgctgtccggggcgcgtcccgcaggctccttgccggcctgcggc

SEQ ID NO: 521 - DNA, 10662 bp, Unknown
  Kingdom: Bacteria, Phylum: Actinobacteria, Class: Actinobacteria, Order: Streptomycetales, Family: Streptomycetaceae, Genus: Streptomyces
ctgcacgaggcgccgttgccgccctggcccggccgggcgggccgggaccgcgacgagttggcggcggatctcgacggcgagtgcgagtggctcgtgacgaacggcgtcctgcccgcggacctggtcacccgcaaccgtcaggtcgccgaggccgcgctccggccgtggactgaggtcttcacgcacggcgacctgcagatcacgcacgtgttcgtcgacggcgacgagatcacgggcatcatcgactggtccgaggcgggccagggcgacgccctctacgacctcgccacgttcacgctcggacacgaggagcacctcggcgacgtcctcgccggctatggcaacggcgtcgatctcgacgtgatccgcgcgtggtggtcgttgcggagcctgctgggggttcgctggctggtcgagcacggcttcgacccgttcgcgccgggctgtgaagtcgacgtcctgagagccagcatgtgaggccgcgcgggcccgactgctgcgagcgcgtcctgacgcatcgagcaggccgtctcctggcgcgtcgcccgcccttgctccggaccaggtgcggtgcggagtctccggacgaagtgcggtgcaaagtcgtcgccggcagacgacggcgcagccgagggtgacggacgcacggtggacgtcgtcgcggatctcccggcggatgcgcaggtggcggaaccagggcggcagcgcgatcgctcctcccaccacccagcggtaccctcccgggccggagccgtgcccggtgccgcgccacgggaactgacacggcgtcaccctggaggcccggatgcctccgggcagggcgcttgtcagtcctcctcggtgaccggctcgggaagggtccagcgctcgtcgcggcgggggcgcagatagccgtagtagtagaggtatccggccgcgaacatggccagcgagatggccaccggcacccagtcggtgaccaccgtctcgtagctgacgcagacgatgacggcgaggatcaccaggggcgcggtgatgcccccgggcatctggtaggccgcggctgtcgtccggccggtgagttttccgcgcagggcggagagcgccaccacggcatagaggacgagcagattggcgccggtggccagcagcaaggtgtccgccgggatcagccaggcgatcagcgcggagaccacgcccaccgcgagagtggccgtcaccggggtcttcagccgggcgtgcacgcgcgccagcggccggccgaccacgtccggccaggcgcggtcccgggctgccgagtacagcagacggccctgctgcagcatgatcgcgatgaccgcgttgatcaccgccagggctatcccgaggctgaccgcggtgttgaccgcgctgccgccgcgggccagcaggaagtagttcatcggcgtggcggagccgaccagttcggacaggctgggtgtgccgaggagcaccgcgaccagcggtaccacctcggcggccaccgtgatcgccagcgaccacagaatggcacggccgatggtccggccggcgttgcgggtctcctcggcgaagtagaccgcggcgccgtagccgttgtaggcgaagagcgcggtggccaccgcggcggcgaccagcccccaggagacaccggtgagcaccccgtgcgccccgccggcggtctgcgcggtccacaggacggagaccggctggcccacatggacgaagccgagcaccacgagtacggccagcgcggcgagttcgaccgccaggaagacaccggtgacccatgcgttggtgcggatgttgaagaccgccaccaccgccgcgagcagcaccacggcgatcccggcacccggtccgccgagtgagtgccagacctcgccgaggtagtcgcccgtgccgagcgcgaccacggccaggacgaagatcccgccggcgaagttgagcaggaagagcgcgaacccggtggccggccccagggtacgggccgcgaaggcgtattcgccgccggtcacggggtagcggctggagagttcggcgtagcagaaggccatgaagatcccggctaccgcggccagcaggaaggccaccacagaggcaccgccgacctgctggatcacgggcgggacgatgatgaagacgctggaggccggggtcaccgcggagagcgtgatcagcacgttctccttgaaggtgagggagcgggacagctcctgctcgtaccgcggctcgttccttctcggggccgcggctctggtgcgttcttccctactcatgatgacgctccattctttggcgccccagccaagtattaccggcagtgtcccgtcaaggcccgcggcttcctgctcttgattaatttggctgacgcgacaaagattcactcatggcccgatccaggaaccagaccgcacgccgtgcccagctgatcgccgccgccggtcgggcggtgagcacccacggcccggcccgggtgcgggtggcggacatcgccgacgcagccggagtggcccgcggctcggtgcactactacttccgcgacctcggcgagctgctggagcaggtctacaaggatgctgtggacaggttcttcacccagcgcctggacgcggtgaccgggctgcgcgacgcccgggacaaggtggtggcctgcgcccgacgcggcctgcccaccggagcggacgacgaactcgcccggctgctgtactggttcggcccggaaacgaccgacaacccggtcttcgccgcacactgccagggcctcttcgaccgccaggtcgcggtctactccggagtgctggaggtcggcgaggcacagggccacttcgtgctcaccgaacgggccatggacatcgccgccaacctggtcaccctggaggacggctacggcctgcacatcgtcaccggcaaccgctcggtcacacccgaccgcgccctctccctcgtcctcggctacgcccgcaccgcgacgggctgcgccggcctcaccccggatcgacccgtacaggagcccccacgcccatgagcagcaccgaccaccaccgcagcaccccctccggacgcctcagggcccgagcgctcggcatcccgctggacggcactcccggcgcgtacaacgccatcaccgacgtgtcgggggtggccgtcgggcacaccaccctgatcgagggcgaacaggtcaggaccggcgtcaccgcccttctcccgcgcggccgctcggacgtcgggctgccctgcgcggcgggctggtactcgctcaacgggaacggggagatgaccggcacgacctggatcgaggagtcaggggcgctctccctcccggtcgccgtcaccaacacccacgcagtgggcgcggtgcacgagggcgtggtccagtgggtcgcggagaaccgcccggacctggccgcgaaatggctgctgcccgtggtggccgagacctgggacggctacctcaacgacatcaacggacggcacgtccgccccgagcacgccatcgcggcgatcgacgccgcggtctgcggccccgtcgaggaaggctcggtcggcggtggcaccggaatgaactgctacggcttcaagggcggttgcggcacctcgtcgcgtctcgtcgactacggcccggaccgctggacggtcggcgcgctggtccaggcgaacttcggcgatcggcgcgaactgaccgtgaccggcgttcccgtcggccgcgaactgctggacgacaacccgatggaagacaccgactggcacgagagcgcccggccgctccccggtggctccggctcggtcatcgtcgtcctgggcaccgacgcgccgctcctgcccggccagtgcaaggcactcgcgcgtcgcgcggcgatcggcctcggccgcaccggcaccaccggcgggcacttctccggcgacatcttcctggccttctccaccgccaacgccggagcgctgaacagcgagttcccccggggcgagccgtccgccgacgagtacgagacgctgcgcttcatcccgtggggccggatggaccgcttctacacggcggccgtgcaggcgatcgaggaagccgtgctcaacgccctcatcgcgaacgagaccatggtcggccgagacggccaccgctcccccgcccttccccacgaccgcctgcgcgaactgctcaagcgctcctgaagaacagcggtgcgtaccagcgcgggtgcgtacgatcgcgggcgtacgtaccagcgcgggggtgcgtaccagcgcacccgcacccggctgcgcgtccggcgaatgccgtgtagctgagcggggcgtccggcgcttgccggtgccgcagcgcctggggcgggcctgacgtgagaggtgtggcggaccacctcggcgtttcggggcgtggcagcgggccggattgagcagtcgagccgcggcgacgccgaagaccgacgccgcctcggtccggcgggtcaggccgaaacccaccggctgttcgacgaggtgagcacgcgccggatcggcgccgagttcgcgatccgccggcacgtacagctcctggtgctggagatggtgcgcgcctgcgcctcccaggccgaactgccccccgggccggctgcgcgtgctgaccggcgagcggttgcgcccggcgatcgggctcaggcacgccgatcccaaaaagccctggggcctggacgagccggcccgcgccgcggcgatgtcacgcacctcgttcgccgagcgcttccggaccgtggcgggcgtcccggccttggcctacctcggtcgctggcggatgctgctcgcgcagcaggcactgcgcgacgacgacgtccgggccggagcccttgcctcgaagctgggacacacgtccgagaatgcgttcagcaccgcgttcaaacgtcaggtcggactgtcgcccccgcgctgtcggcagcgcgtacgcacgcacgagcccgggggtccgcgacgcaccggatcgtaggtgggtgtcctgtccggtgcacggcggcgctcggcgtcttcgcgcgtccgcgccccggggcgctcagtgcgggcggcggtcggagcggccggcgaaggagcgggccccaggggcggtagacgccgtcccccgggccaggacgcgccctggtcagtcgtggctggggacggaccgatcggcgtcgccgccgtagccggaggcggcggctgcgcaggttgccggagcgccctggtcccccgccgcgtccgtcccgatggaggccgcccggtcgcctcgcggcgtggcagtccgtacgacgcgggaccggccgtgcagccgcagcgagacggtcaccagggcgatcgccaccgcggtcatggccgcgcccgcccaggcggtggaggcgaagccgaaacctgcgtcgatcaccgtgccgccgagccaggggccgccggtgttacccaggttgaaggcggccgtcgtcgtcgcgccggcgagcgtgggcgcggcgcccgccacgttgaacatgcgcgcgttcagcgccggggccgtgtagaacgccgagaagccgagcaggaaggacaggaccaccgcggtcaccgggctcgacgcgaacagcgcgagggcggccagcagcacggtggaggtggcgattccggagagcagcacgccgaacaggtgggcgtctgcgacccggccgcccaccgtggttccgaccagcgcgccgacgccgaagagtgccagcaccgtcggcacccagccgtccgccagcccggccacgtcggtgagcagcggcgcgaggtaggagaaggcgcagaacacaccgccggccgccagcgcggtcacgccgatggacagccacacctgccggtcccggtagatcgccagctcgcccttcagcgccgagtgacgctcgggcagcgggatgcgcgggatccgggtcagcacaccggccagggcgatcgcggacgccacggccaccgcccagaacgccgaccgccagcccaggtgctcaccgaggaaggcaccggccggcacacccagcacgttcgcgatcgacagcccgccgatcatcaccgccatcgcacgggcccgcgaggtcaccggcaccatcgcgatggccacggccgcgccgaccgcccagaaaccggcacaggcaagggcgctcaccacccgcgaaacgaacaggatgtcgtacgtgggcgccagcgcgccggcgacctggccgagaccgaacaccgagatcagggcgaccagcgtggtcttgcgtggcagccgcagcgtcgccgcggcgagcagcggcgcgccgaccaccatgccgatcgcgaacgcggatatcagcaggccggcttgcggaatggacacgtccatgtcctcggcgatgggcggcagcagcccggagagcatgaactcgctcgtgccgagcgcgaacacggacagaccgaggatgtagacggcgagcggcatacggggcgccgggggccgtgcggaagtggcgtgcatgacagacgccaacgacgctcgcgctcctgtcattccccgcgcacccggccgagtcggcgccggctgttcccgtcacgcccggccggcgccactcgcccctgtcccgccggtccggtccagcggtcgggcagccgccaccgcacgccctgcccgccgggtgcaggacgaggccgcactgtccttgccgggaatcgacgaagccgcggggcagctgatcccaggcgatcgctgcggcacgatcgccgcggcagtcgccggcgtgcggccgtaggacccgccgccgtctggagcggcggacacggcgggggcgtgctgcggcggtcggtgcgccacggcgacgcctggcaccccacctccgtcaccgccgactggctggtgctccgcggcccgttcgcgccgggcgacaccgtcgagcggctgaacctgctggtgcccgtgctcgcgccgcggatcaagctgcgcaccctggcagtgatcaggccctgaggcggcactgcggctgcttcacctcgctcggcgtctcctcagcccagcgagccatgtccgggcatcgcccctggtgttcgcgccgaaggcggccggaagatcacccttgtcctcaaccgcagttgaggtcatagcgtctgtgcgtgccctgcaggggtgcaggcacgcgccgatgggccaggaggggactttccatgacgatccagcagatgtccgacgccgaactcgccgggcagcccgccgcgtactggaccggggtcgcctacgaggcgctcatcgcgtacacccgggcccggcaggcggagaagggctgcacccagccccagttctggctgctgcgcaacctgtcggagaacgacatctcgcccgacggcgagggaatgaccctttccgagctgcaggcggccatggcctcctacctacgcgccgaggacgacctggcggcagaggcccgtgtgctggtggagcgcgggtggctgacccgggacgccgaggaccggctgtggctcaccgaggagggggagcgggcccgcgtcgacctcgcgcgcaacgcccccgcgatccgcgccgccctccaccagggcatcgacgacgcggactacgtcaccacggtgaaggtgctccagcggttgatccgcaatgcgggcgggacagtcggctgagaggccggggggaagcagttgcgcgggctcgcaccgccgctgtccccccgttctgcgatgcgacgccaccgggtgcgtttgacttttctgttgcattccctttgcgtacaggagagttgactgtgactgccggccgccgagccggctggagcggaaggggtaggcaggcatggagatcgcgcaaacactcgcgctcgtcgcggccacagtgacggccgggctggtcagcgggttgttctacgggttcgccatctcggtgatgccggcgctgcgcggcgcggacgaccggacgttcatcgacgtgatgcagcggatcaacgtggcgatcctcaacggatggttcgttctcgggtacatcggcgcgctgctgttcggtgcgctctcggtggggctgcagttcggcggcggggaccgggacgcgctgtggcccgctgtcgccgcgctggtctgttacgtggcctcgatggcgctcaccaaccgggtgaacattccgctcaacaacatgctggacgcggccggcgcacccgaccggatcgaccggccccgctccgtacgcaccgagttcgaggggccgtgggtgcggtggaacgtggtgcgggcgctgctgtgcaccgcctccaccgggctgctgtgctgggcgctcgtgctgcagggcgggagctgaccgggacgtcacgacggggtgggcgcggcctttcgccgcgcccaccccgtgtggtggctggtgggtccgcccggttcagcggccccccgcgcccagcagtgcctccgcgcggccgtgcagcttggccgcgtaggccgcgcagccgagggccgccgtgttgaggagcgtgcggaagatgttcacggactcccaggtgcccttgaacttgtcgacgagggagaagtcgtggatcttggcggggttgccgaggtcggcgagctggttgttgagcgggatctcgacgcctgccgtgagcatcagcacgatcaggtagagggcggcggcgaggcccgcccacagagcgatcgtcttgcggccccggcggaactcgaggaacgcggcgagtgccgcggcgatgatcgcaccgcagaagatcagggcgaacagcccgttgccgtcgatctccgcgttgaactgctgcatcgcggtcacgtacgtgcggtcgtcggtcttggccaggccgggcatgacggagatgtcgtaggcgaagaacaggccggccatgaggccgagcgtgacgaccgagacgatgtgcagccagccggcggccttgttcggacgtgcgggcggctgagggagcggcggctgcgggtggggcgcgtagccgccggggtggccgtactgctgctggtacgggttggctgtcatcgggacgtcctcgctttggtctggagtcggtaagtacgatgccgaggcgcgctgttgtagaggttaggcggattcccccgggcggacacggcgcactgggcggtcctggacagcctttcgacgcggtctcgaccggtcctcgagcgctcgtcgagcggtgctggagcgcggcggccggatcagcggatccgcatctgcgccatcatccccatcgcggagtggtcgagcaggtggcagtggtagacgtacgtgccgcggtaggtgtcgaaggtggcctggagtgtgacggtctcgccgggcagcaggcacacggtgtccttcagcccggcctcccctgcctgcggtgccttcccgttgcgttccaggacccggaactgcacgaggtgcatgtggaagttgtgggggacgtcggtattggtgttggtgacggtccacacctcgctggcgccgtacgggatctcggtgtcgatgcgtgcggggtcgtactggcggccgttgatggagccctgcggctcgccgccgaccgtggagacgttcagttcgaaggtgcgccggccggtcaccggcggcagcgggggcagggtgcgcaggacggacggcacccggctcgggtcggcggcggtgcgcaccacgtcgaaccgcatcaccttgccggtgcggtcggggtcgccggggccgagcgtgttctccaggaccaggcgggtgccgaccgggtagcgggcgaagtcgatcacgacgtcggcgcgttcggcgggtgacaggagcagcgtgtcggtggtgtacggccggggcagcagcccgccgtcggagccgatctgcgtgaacggcgagccgtcggccagacgcagcctgaagaaacggaggttggacgagttcagcagccggaagcggtacttgcgggccgcgacctggaggtaggggtagggcttgccgttggcgaggatcgtggcgcggcccaccgcgtcgtccatgacgtacagcagttgtccggcgtcgtcgaagtgggcgtcgcgcagcgcgatcgggatgtcgtagcggcccgcgggcagcgggagcgactcctccacgtcgtcggtgagcaggtaggaggcggacagtccccggtagcagttctcggactcggcgtggtgggcgtggtcgtggaaccagagggaggcgtgcggctgccggttggggtacgtgtaggtgcggctggtgcccggagcgaaggtggccatgggcgcgccgtcgctgtcgacggggacggcggcgccgtggagatggaccgaggtgtcccggtccagctcgttgtgctggcgcatcacgaccgggcgcccggagcgggcccggacgacgggtccggggaagtgcccgtcgtaggtgaggacgtcggtgcgcaggcccggcaggatctcggcccgggccgtacgcatcgtgatgtcgtagacatcggctgcgccgctcgtcgaggtgggggtcagcacgggcagcgaaggcaggggcacctggaacggttcgacggcgggtcccgcgggcacgccgtcgcccgccgccgcggctcccgctcgctgcggggcggcgcccgccctcctgaggggggtgagcgccgcggcggtgaacagcccggcgccggcggtgctgagggcggtcatcacggtgcgtctggtcaccatcacagaactcctggcggaagggcggaagggcggtcgggactgcgccgagtgcagcaggccgcgctcgcgtgcagatcgagaacgactcggtgacgtgtc

SEQ ID NO: 522 - DNA, 5699 bp, Unknown
  Kingdom: Bacteria, Phylum: Actinobacteria, Class: Actinobacteria, Order: Streptomycetales, Family: Streptomycetaceae, Genus: Streptomyces
gtgccgtacggcacacccgcggccagttcgcgcagcgcctgtccgttgagaccggtgttcccggagagcatggaccagtccagcggcagttcgaagtcccgccgctcgcccgcgaagtaggcgtccagctggcgtatcgcctccgcgagcagcggggagccgggcgcctcgacgggctcggtgcccagccgcgatgcgagccgggccagcgcccggtcgcgtaccgcgtcggtggcgtggaacacgacgttgaccaggccggtgcgggtcgccgccagcagcagggggccgatgccgctgccgaccacggcccacacgacccgctgtccgctgtgctcgtcctgctcgtggttgtccatgccgaccaccgtacgacccgccactgacaacgccgccgacctgcgcgttcgccgcggtccgcccagtccgctccggtcggctcagggggcgtccagtgcggtgcggaccacgtccggcttgtcggagatgatgccgtcgacgccgtaacccgagacggtccgggcgcgaggggcgtcgtcgacggtccaggtgaagaccttcagcggtctgccgtgcgggccgacgaccgcgtggacgccggcgacgtactgcgcggtcagtgtggcccaggacggattgatcaggtcggcgaacccggcgtagcggcgcaggtcccccgtcgccggccggccgaggaaggcggtcctgaccgccggttccaggcggtgcacggtgcgtacgctgtccgcgctgaaactctgcacgatcagccggtccgccaggtgccggcggtcgagccagcccacggtgcgcagcaggttcagggtctggcgttcgatgccggggtacagctccgggttcttgacctccaggagcagtttctcgtggttgcgctccacccggcgcatgtactgcttcagcgtcggcacgcgcgtgcccgcgtacgccggggagaaccagctgcccgcgtccaggcgggcgatctcggcggcggtgaagtccttcaccttccacggcgcacggccgggaaagacctgctcgacgtcggtggtgcgccgcaggctgtcgtcatggaggacgacgagttcgccgtccttcgtgcgctgcacgtcgttctccacccagcggaagccgagggcggccgccttgtcgacggaccggagcgtgttctccggggcgtaggcggcggcaccccggtggccgacgaccaggggccgctcatggccgccggccgcccggacgtcggccgtgggcgacagcaccatggctcccaggagcgcggtggtcgtggcggcgatcgcgcgcgcgtgcatgcgggctcctcacatgatgtgatcacttacagtgcaagagtgacagcattaggtcaccatctggggatgtcgtgggatcgccacgcgatcgagggagtcaccgggctcgctcaccggtgccgcacattgcggaagggtcgtgcttctttgccggaaaatcgttcggccattccggcgggagtcatactctctgcgtcaaccctgaccgcggggcccgtcacgagacgggggcgacttcaccacattccgggactcaacagggcggaagggcaaccgcgcatgcacggcacggtcgacggattcagctacgggctcgtcaccccgctggtggcctatctcatggcctgcctcggcggagcgctcggcctgcgctgcaccacccgggccctgctcgtcgcccactcctggcgccccggctggctcgccctcggctcggctgccatcggctcgggcatctggaccatgcacttcgtggcgatgatgggattcaccgtccacggggcgccgatccactacgacaggccgacgacgtacgcgagcctggccctcgccatcgtcatggtgggcatcgggatcttcatcgtcggctacaagggcgcgaccgggtcggcgctgttcaccggaggcacgatcaccggtctgggcgtcgcctccatgcactacctgggcatggccgggatgcggttcaacggcaccttcgagtacaacaccctcaccgtcgccgcctcggtcgtcatagcggtcgtcgcggcgaccgcggccctgtgggcggccgggcaggtcagggggttcctgtggagcgtcggcgcgagcctcatcatgggtctcgccgtcagcggcatgcactacacgggcatggcggcgctcagcgtccacctccacggcacggacagcggcccggtcccgggcgagtcaccggcggcgctgctcgcccccatgctcatcggcccgctcgccttcctgctgctggccggggtcgtcgtgatgcgcgatcccctgatgatcatgggcaggacggactgggtgcccgtcgagtacaagccgggcgtaccggcccgcgaactcgtcagccactccgcccggcgccccgccgccgacgcccgccgcagcccggccggacgccgaccgcggaccccgcagaatcactgatccgctcccgttgtcagtggcgggtcgtacggtggatgacatgcggcccgtttcccagatcgaacgcacggtggcgcccttcgaggtcgtcagcccctatcagcccagcggcgaccagccgcaggccatcgccgagctggcccggcgcgtcgaggcaggcgagaaggacgtcgtcctgctcggcgccaccggcaccggcaagtccgccaccaccgcgtggatgatcgagaagctccagcgcccgacgctcgtgatggcccccaacaagaccctggccgcgcagctggcgaacgagttccgcgagctgctccccaacaacgccgtcgaatacttcgtctcgtactacgactactaccagcccgaggcctacgtcccgcagtcggacacgtacatcgagaaggactcctcgatcaacgaggaggtggagcggctgcggcactccgcgaccaactcgctcctcacccgccgcgacgtcgtcgtggtcgcctccgtctcctgcatctacggcctcggcacaccgcaggagtacgtcgaccgcatggtcccgctcagggtcggcgaggagatggaccgcgacgagatgctgcgccgtttcgtcgacatccagtacacccgcaacgacatggccttcacccgcggcaccttccgggtccgcggcgacaccatcgagatcttcccggtctacgaggagctggccgtccgcatcgagatgttcggcgacgagatcgaggcgctgtccaccctgcacccgctcaccggcgagatcatcagcgacgaccagcagctctacgtcttccccgcctcgcactacgtcgccggccccgagcgcatggagcgcgccgtccgcggcatcgaggaggagctgaaggagcgcctggccgaactggagaagcagggcaagctgctggaggcccagcggctgcggatgcgcaccacctacgacatcgagatgctccgccagatcggcagctgctccggcgtggagaactactcgatgcacttcgacgaccgcgcgcccggcaccccgcccaacaccctgctggactacttccccgacgacttcctcctcgtcatcgacgagtcgcacgtgaccgtgccccagatcggcgcgatgtacgagggcgacgcctcccgcaagcgcaccctggtcgagcacggcttccggctgccctccgccctggacaaccgcccgctgaagtgggaggagttccaggagcgcatcggccagacggtgtacctgtcggcgaccccggggcagtacgagctgtcccgctcggacggccaggtcgaacagatcatccgccccaccggactcgtcgacccggaggtcgtcgtcaagcccaccgaggggcagatcgacgacctggtgcacgagatccgcaagcgcaccgagaaggacgagcgcgtcctggtgaccacgctcaccaagaagatggccgaggacctcacggactacttcctggagctgggcatccaggtgcgctacctgcacagcgacgtcgacaccctgcgccgcatcgagctgctgcgcgagctgcgctccggcgagtacgacgtcctggtcggcatcaacctcctgcgcgagggcctcgacctgcccgaggtctccctggtggcgatcctcgacgccgacaaggagggcttcctgcgctcgggcacctcgctcatccagaccatcggccgcgcggcgcgcaacgtctccggacaggtccacatgtacgccgacaagatcaccccggcgatggagaaggccatcgacgagaccaaccgccgccgggagaagcaggtcgcgtacaacaaggcgaacggcatcgacccgcagccgctgcggaagaagatcaacgacatcgtggcgcagatcgcccgcgaggaggtcgacaccgaacagctgctcggcaccggctaccgcaagggcaaggacggcaagggcgccaaggcccccgtcccggctctcggcgaccaggccgccaagggcgccaagcccggcaagtccgccaagggcaaggcgaaggagacggtgcccaccgatcgccccgcggcccagctcgccgagcagatcgagcagatgaccgagcggatgcgtgccgccgcggccgagctgcagttcgaggtggcggcccggctgcgggacgaggtctccgagatgaagaaggaactgcgccagatgcgcgaggccggcctcgcctgacccacggggcggccggatgcccgagcgggcaaaggggacggcggatgcctggagtgagcgcctccgggcgtccgcgtgcgcgctgtgttgcaagaccgacacaaagtgcgcagcggagtgcggcgatgtcagtccctctgcgtagggttctgatcaaccgcgcgaatccgcggcaacaggggagtagtccgagaggggaatcagccgtgaccgtcaacttgaccaagggtcaggccatcagtctgcagaagaacgacggaggcagcctgagcgcggtccgtatgggtctcggctggcaggcggccccgcgccgcggcctgttcggctcacgcacgcgcgagatcgacctcgacgcctcggccgtgctgttcgccgacaagaacccggtcgacgtcgtcttcttccgccacctggtgagcgacgacggctcggtgcgccacaccggagacaacctcgtcggcggggtcggccagggcggcgacgacgaggcgatcctcgtcgacctgcagcgcgtcccggtccacatcgaccagatcgtcttcaccgtgaactccttcacgggccagaccttccaggaagtgcagaacgccttctgccgtctggtggacgagaccaacggccaggagctggcccgctacaccctcgcgggaggcggcaactacacggcccagatcatggcgaaggtgcaccgcgcgggcaccggctggacgatgacggccctcggcgtcccggccaacggccgcacgttccaggacctgatgcccacgatcctgccgcacctgtaggaccgtagggcgagcagcggcacgggcggggcacggcacagggggagaaggcgatgacggccgagctggtgcgggggcagaaccacccgctctccgagacccgcctggaagtccgggtctcggccggaacaccggtggtggccctggccacgaccggcgacgagaacggcacgatcgcgggcagtgccggggtggcccaccccggtgcccccgtgctgcccggcctggaggtccctcgccaggcggccgccgaccaccggatcg

SEQ ID NO: 523 - DNA, 3264 bp, Unknown
  Kingdom: Bacteria, Phylum: Actinobacteria, Class: Actinobacteria, Order: Streptomycetales, Family: Streptomycetaceae, Genus: Streptomyces
cggccgcggggcccctgctcccatggtcggacctccccgccgtgccgccgtccagccctctccaggccctgccctgacctcgacggtaggcgcggaacgatcagcgggaaagatcgcgaggcgaacgcgcccccttgcgctccctcggttcactccgagcgcctgcacggtcgggtgaataaccgagggtcgttggatagaccctaggggtgggggaaagaggggggaccgtggagcggcggccggggaacaccccgtgtccgcagtcgccgctccacgggcggcccgcccggcgaggtcagccgaagacggccaggctcttggccttgccccgctgttcctccacgagcgcgaggaagcgtccctcggggccgaagacggcgacggcgccggcgcccgcgtactcctcgggcatctcaagccgtacgccgttggtgagcagccgggcgcgccgggtgtcgacgtcccagcgcgggaaggcggcggtggccgcgtcggcgatgggcatgacggtcagctcctgctggagctggtcgagcgtcttcgcggcgtccagcttgtacgggccgacgcgggtgcgccgcagcgccgtgaggtggccgccgacaccgaggtcggcgcccaggtcgcgggcgagggcccggatgtaggtgccggaggagcagaccaccgagacgaccaggtcgagcacgggagtgccgtcctcggcggcggcctcacggacgtcgtacacctggaaggacgagatggtcaccggccgggccgggatctcgaagtcctcgccctcgcgggcccgcttgtacgaccgtacgccgtcgatcttgatggcgctgaccttggacggcacctgcatgatgtcgccggtcagcttggcgacggcggtgtcgacggcctcgcgggtgatccgggaggcgtcggcggaggaggtggtctccccctcggcgtcgtcggtgagcgtgttctggccgagccggacggtgccgacgtactccttctcggtcagggcgaggtggccgaggagcttggtggccttctccacgccgaggacgaggacgccggtcgccatcgggtcgagcgtgccggcgtggccgacgcggcgggtcttcgcgatcccccgcatcttggccacgacgtcgtgcgaggtgaagcccgacggcttgtcgacgatgacgaggccgtcgggcggggtgggcttgctggtcattcggtgctgtcgtccgtctcgtcggcgtcgtcctcggagcccggcttgcggtacgggtccgcgccgccggcgaaggcggcgcccgcggacgcctcccgcaccttggcgtcggactggcgtgccttgtcgagcaggtcctcgatggtccgggcggtgtccgggagggcgtccgcgacgaaggtgagcgtgggggtgaacttcaccccggccgcgcggccgacctcggagcgcaggatgcccttggcgctctccagtccggccgccgcggccgtgcgctcctcctcgtcgccgtagaccgtgtagaagacggtcgcctcccgcaggtcgcccgtgaccctggtgtccgtgatggtgacgtgcgagccgagccgcgggtccttgatcccgcgctgcagcttctgggccaccacctctcggatgaggtccgccagccttttcgcccgcgcgttgtcggccactggtccgtctcccgttcttgtctcttctgcgttctgaagcgttctgaaatgtggtgcgtgtgtgcggtccggtccggaccgccgtgcgctagtcgtcgtcctcgccgtggaagcgccgtctgacggacagcagctccacttcggggcgggcagcgaccagccgctcgcaccggtccagtacgtcggtcaggtgcgccgcgtcgccggagaccgcggcgaggccgatgacggcccgccggtggaggttcgcgtggtccacctcggccgcgctcaccgcgtacttgcgctggagctcggcgacgatcgggcggacgacggagcgcttctccttcagcgaatggacgtcgccgaggaggaggtcgaaggacagagtccccacgtacatgtgtgtccgggttgcccgccggtacggggtcgatggtcctgccttcgatacgggcagggacatcaagaacggtaccgcgaacccggcggcggctcgacggggtttctctcccgcacacgtgtctcccgcccggccggaccgggcccggacacggcgcaccggccgacgggaagcagtcccgtcggccggtgcccgcgaggcgtcggggtgttacacccgcggcttctcgcgcatctcgtacgtcgcgatgacgtcgtcgaccttgatgtcgttgaagtttccgaggttgataccgccctcgaagccttcgcggatctcggtgacgtcgtccttgaagcgacgcagaccctcgatgttgaggttctccgcgacgaccttgccgtcgcgcagcaggcgcgccttggtgttgcgcttgacctcgccggagcggatgaggacacccgcgatgttgcccagcttggacgacttgaagacctcgcggatctccgccgtgcccagctcgacctcttcgtactccggcttgagcatgcccttgagggccgcctcgatctcctcgatcgcctggtagatgaccgagtagtaccggacgtccacgccttcgcgctcggccatctgctgcgcacggccgaccgcgcgcacgttgaagccgatcacgatggcgtcggagcccatcgccaggtcgatgtcggactccgtgaccgcaccgacgccgcggtgcaggacgcggatgtcgacctcttcgccgacgtccagctggagcagcgaggactccagtgcctcgacggatccggaagcgtcgcccttgatgatcaggttcagctgctggacctcgccggccttgagcaccttgtccaggtcctccagggacacgcggcgcgtgcgcttggcgaacgcggcgttgcgctcgcgggcggcgcgcttctccgcgatctggcgggccgtacggtcctcctcgaccacgatgaagttgtcacccgcacccgggacgttggtcaggcccaggacctggaccggcgtcgacgggccggcctcggcgacgttgttgccgttgtcgtcgagcatggcgcgcacgcggccgtaggcgtcgcccaccaccatcgtgtcgccgacccgcagggtgcctcgctggacgaggaccgtcgccacggcaccgcggccgcggtcgagacgggactcgatcgagatgccctgcgcgtcctggttcgggttggcccgca

SEQ ID NO: 524 - DNA, 1804 bp, Unknown
  Kingdom: Bacteria, Phylum: Actinobacteria, Class: Actinobacteria, Order: Streptomycetales, Family: Streptomycetaceae, Genus: Streptomyces
cgcgccgagggcggccgtaccttcaccgccgtacggaacgcggcccggcaggcctgggagaggcggcttgcggacgtacgggtcaccggcggcgacaccacccgccgccgcaccttctactcgtccctgtaccggtccttcgtcgcgcccgacatcggggaggacgccgacggccgctacaccggctgggaccagcgcgtccaccgcagcgacggcttcacctactaccagaactggtcgctgtgggacacctaccgcacccaggcccagctcctcgcgctgctcgcaccccgcgaatcccgtgacatggcgatctccgtcatccacatcgacgaggagagcggctggctgcccaagtggggctacggcacggtcgagacgaacatcatgaccggcgacccggtcacccccttcctgaccaacgcctaccagcagggcctgctcaagggctacgaggaccgcgcctaccgcgccctgaagaagaacgccgacggcgtcccgcccgccgactccccggccgtgggccgtgacgccaaccaggactacctcagccgcggctacgccccctacatcaagggccacgagcccgccaaggccggtcactccgactacgccttcggcgcctcggcgaccctggagtacgccctgtcggacgccatgctcgcccagatggcccgcgcgctgggccaccgcgaggacgccgaccgctacgcggcccgctcccgcaactaccggcacctgttcgacccctcgacgcgcttcttccgggcccgcgacacctccggcgccttcgccgggccgtggagccccgcgcagagcgtcggcttccacgagggcacggcctggcagtaccagtggctcgtgccgcaggacctgcccggcgtggtcgacctgatcggcggcaagcggctcaccgatgaccggctcgacgagttcttcgcctacgagcagctcctcggggatccggcgcgcaccgcgcgcgaggtgtgggtcaaggggccgtacgcgtactacgacaccgaccgctacaacccgctcaacgagcccgatctgctcgccccgtacacctacctgtcgaccggtcagccgtggaagacgaccgacgtggtgcacgccgccctgaccctgttcaccgacgagccgaccgggctcaccggcaacgacgacctgggcaccatgtccgcctgggacgtgctgtcgtccatcgggctctacccggtgcagcccggctacggcacctggggcctgtccacgcccgtgttcgaccgcgtcgacctgcgcctcgacccccgctaccacccccgcggcgccctcacgatcaccgcgcccggcacctcccgcgaggaccgctacacccagacggtcagcgccgacggggtgacccacgaccggacctacctgaccaccgccgaactgcgccggaccaggacgctccgctacaccgtgggcccgcagccctcgtcgtggggcacatccgcgcaggcggcgccgcccgccctgagctgacccccgcggccgcgccccacgtggccgccgcgtcccgccccgcacaccggggcgggacttcatctgtcgttaactttgcgtaactggatcgtacttgaccgtaatcatcagcaggctgttgactgcaggttcacccaccgtcgacggaggcaagccttgacccctgacctgctcgctcccctcgacctggcgttctggaacatcgagtccgccgaccatccgatgcacctcggcgcactcggggtcttctccaccacctcgcccagcgccgcggcgcacgcggccgacctgctcgccg

SEQ ID NO: 525 - DNA, 2654 bp, Unknown
  Kingdom: Bacteria, Phylum: Actinobacteria, Class: Actinobacteria, Order: Streptomycetales, Family: Streptomycetaceae, Genus: Streptomyces
cggcggcgcccggcggagtgcggtggtgaacgcgactccgaagcccgggcgatgacggtccgttacttcgagtgggcttcgggaagcgcgccgagaagatcgaccggacgcggcacggctccattgccgccttcgcgaagaagtatccgaagatcggcgaagacggactttcgggaccacctttctttccgggagaagtcccggacgcgggtctcccgcggaaatcccccgacggccccgggaggttttccaaaaccccgtcacatttcatcgcgcacttcgcgtacgacgggaacggccgacgcggtgcgacctcgccgccgggcagactgagggccatggactggacccactaccgcttccgcagcctgtggcccctgcccgcgccgcccgccgccgtgtacacggcactggagcgggtcgaggactatccgcggtggtggcgccaggtacgcgaggtccggcggaccgacgcgaccaccggcgtcatccggatccgctcgctcctgccgtacgacatgaccttcaccgcccgcgaagtgcgccacgatccggcggccggggtcctggaggtggcgatgagcggggacatcgacggctgggcgcgctggactctgaccgcgcggggcaccggcaccctggtccgctacgaccaggtcgtcgacgtgaacaagccgctgctgaggcggttcgccgtgccgggcaggccggtcttccggctcaaccaccgcctcatgatgcgctgcggacggcgcggactggcagcgcacctcggagcggtttgaaggaaggccacggggccctgtattgttcagtgcgttcccgggcgattagctcagtgggagagcgcttcgttcacaccgaagaggtcactggttcgaacccagtatcgcccaccgggaaaggccggtccgcatcgtcggaccggccttcttcatgccgccgcgggcagctccggccgcagcggccaggacggatccaccgtctcctcggtgccgctgcgcgcgaaccacgcctgcagtccgcgcgcctgggccgcgtgccagccggtctgcagggtgtgcagttcggtgggggacaggcgttccagacgcgtcgcgaagcggcggccgagcgcccggacgacctccagcgcggccagcgcgtccgccgcggcgtcgtgcgcgtccgccagcgtgacctcgtagtgcgcgcacagatcggtcagggtgcgccggcccttgcggtaccggtcgaggtgcttgtccagcacccgcggatcgagcacgcacagcggcgacgcctccagccggcggcccagcgaggacgcacggtggcgccgcaactcccggtccagcagcgtcagatcgaacggcgcgttcatcaccacgagcgggcggccgagcgctgcctgttccgccagctcctcggctatctcgtgcatcaccggggccggccagcgcccgttgcggtgcagatggtcctccgtcagcccgtgcaccgccgtcgcggcctcgggcaccggcacccccgggttcaccagccagcgcatcatgcgcggccgggcgcccggggcgtcctggacgacgacggcggccgacacgatgcggtcggtctcgacgtcgacgcccgtggtctccgtgtcgaaggcggccagcggcccctcgtaccagcagcacgtcatgtcgaccacaactcctcgctcaaccaaggcggctgacgtgccgtccgccgcccgaaccggtgatacccgggccgtttgcgccgtacgcgggaaggagacaacaggagtacgggtctttgcagttcacggacccgctcggggaccggggcgtgcgccccgacgactcacccggcatctcattcggcacgcactcggcacgtcactcccggcactctgcacagcaatgcactcggcaatcactccggttcggaaggctgttggtcatggtgatggcgcagcccgagcggggcgggctgctgcccgaccgcgcgggcacccggcgcggcacactcgccaccaccgcctgcatggagaccctgcaggtgggctatctgcacgcggtcgccgccgcggccggctgctcgctgtcccagcccttcccggacaacggcatcgactggcacgtcagccacagcgcccccggccacaccgtcgacgacgaggtgaccatcaaggtgcagctcaagtgcacgtaccagatcccgccccacccgccgggcccgtacttctccttcaccctggacaacgctcacctggcgaagctcgcccgcaccccggtctcggtccacaagatcctcgtcgtgatgatcgtgccgcgctcccaggaccagtggctgcgcgccggacacgaccggctcgacctcaggcactgctgctactgggtcaacctggccgggcaccccatcaccggccggcaccgcaccaccgtgcgcataccgacctcgcgcatcttcgacgaccgggccctgtgcgagatcatgacgcgggtcgggacgggaggcagaccatgacgcaccgccccctcgacgagccgctgcgcccggtgcgaccgcaccccgtggacgcgcccctgggccgcgccctgcgtcccgccgacgtcgacccggccgtgctcggcgccctgctgcaccggcacggctggcagcgccgcggcggagccgccggacactac

SEQ ID NO: 526 - DNA, 1447 bp, Unknown
  Kingdom: Bacteria, Phylum: Actinobacteria, Class: Actinobacteria, Order: Streptomycetales, Family: Streptomycetaceae, Genus: Streptomyces
ctccagcgcggcgacctggcggctgacggtggacttgtcgagggcgtagtgcgcggccaggtcggtggcgcggcagccgccacgctcctccaggtgcccgagcagcgtgtacgagaccagggacagctccggatgcatgcggcccgccgaggccctggcgcggcgggcgaagaccgtcatctcgcgctggatggtctcgacggccgtctccccagcgggaccgcccgcgggcacgccccgggggacgggaccgttcgcgggcgtctcccccgcgggaccgttcgcgttcgcgccctcggggacgttttgaccgctcacgtccgtggcctgggtgacggcgcgctcgtccggcgcctcggctgctgtcacggaatacctccccggctgcttctggttgtatagtacaactgaaacaagagttgtatatgccaacctttggaggtcgtgagcgatgaggtcgcctgcgctgcgccatgtgctcacccacctgatcaccccgctgctgatgtgcctgggcatggggctcgcgtacatgggcgcgttcgtgaccccggagccgcaccacctgcccgtcgcggtcgtgggctccggaccgcaggccaaggtgttcgcccagaccgtcaaggacaccgcgggcgaccagctcgacgtccgcaccgtcggcacccgcgaccgcgccgtcgagctgctcaagtcccgtgacatcgacggcgcctacgtgcccggcaccaaggccccggagctgatcgtggccagcgccgggtccgacatgggcgccaccgccgccgagaaggtcttcacacccgtcgccgcgcgccagggcctcccgctgaaggtgaccgacgtggtccggcccgcctccggcgaccccacggggcagggcctgttcttcctgctggtcgcgctgagcatcggctcgtacgcctccgtcgccgccatcggtgccgcgggtgccgccctgccgatgcggatccgcgccctgctcaccctcggtgtgtccgccgtggtcggcggcatcggcgcgctgctcgccggccccgtcttccacctggccccgcacagcctcgcgggcatctggggcatggcctggctctactccgccggcatcctcttcatcggcgtcggtctgcacaccttcctcaagcggtggaccacgctcaccatgatggtgctgttcgtgatgctcaacttcaccacctccggcgggctgttccggccggagctgcagaacggcttcttcggcaccctgcacgccttctggaacggcgccgggttcgtcgagggcgcccgcagcctgctgtacttcggcagcgacggcctgggccgcaacctgtggaccctggtggtgtggctgctggccggcctggcggtcaccgcgatcgcggcggcctacgagggcgtccggaggtccgccccccacggcgccgttccagaaggcgtgcagggt

SEQ ID NO: 527 - DNA, 1824 bp, Unknown
  Kingdom: Bacteria, Phylum: Actinobacteria, Class: Actinobacteria, Order: Streptomycetales, Family: Streptomycetaceae, Genus: Streptomyces
ggcctggcgcgacgcgtgcgacctgatcgccgacgtgatcgtggcgctcgcccggcggggcatcgccccggaccacgtcaacctcggtggcggcctgcccgcgctcggctacctggaccggcacggccgcgcgctcgaccctccgctggacaaggtgttcgccgtcatccgggacggcatggaccggttgcggcaggtcagctcccggcccctggcgttcgtcatggagccgggccgtcacctggtggccgaccacggcgccgtccgcgcgcacgtctaccgcctcaccacacgccggcagcccggcggcgacctcgcgcgctggctgtacctgagctgcggcaagttcaacgggctctacgagatggaccagctctgccaccggctggtcttccccgggcacaccggcgccgcacacgtaccggccgtcgtcgcgggcccgacctgcgacagcgacgacgcctacggcgcggacggccaccgcacaccggtgcccgaggacctggcctccggcgatccggtctggatcctgtccgcgggcgcctacgccaccagttacatgacccagggtttcaacgggttcagcccgctgccccacgccgtcaccggcccggcaccggacgccgccgccgaccctgcggaagggacgggctgacgtgatacacccaccgcgcatacgcgccgtcaccgacgccgactggcccggcatcgcggtcctggaggcggcggcgtacgccgggaccgccctcaccgaggggcaggccgcgctggagtcccggggccgggtctcccccgagacgtgtttcgtgctcgacgcgggcgaccggatcgcgggctacgtcctcgccctgccctatccggatgccgctttcccggacctgagcacgccggagcggtccgcccaccgcacccgcaacctccatctgcacgacctggtcgtcggcgaacgcgtccgcggccggggcctgggcggccggctcgtgcgccacctcacggccgtcgcggccgggtggggctacgagcggatgtcgctggtcgcggtcgcgggcctggagggcttctggcgccgacacggctaccggccccaccacgacgtcgaggtcccgcccggctacggccccgacgcgctgtacatgtccaccagggtgcctgcgggcagaccctcgaacagagagatggcgggccgatgacggtgcatcccgtccgtgacgagtccgagcgcgcccgccgcgccaagtgggccgtcgcggcattgttctgcttcctcggcttccagtacgccacctggacctcccggctcccggctctcaagagccgtctcgacctgtccgaacaggagctgggactgctgctgatggcctgcggtgtgggagccgcggtctccttcccgctcgtctcgcacctcatgcggaggctgggatcgcggcggctgtccctgctctcgggcctgtgcctggcggtgctcctcgccgccctgtcgaaggcgcccgactacccggtcgccctgctgatcatctgctgcgacggtgtggccgtcggcgcgctgaacgtggccatgaacgcgcaaggagccgcgctggagaagcggttccgacgcaccgtgatgtcccagttgcacgccacgttcagcgcgggcctgctcggcgccgcgctgctggcctccggcgtcaacctcgtgaccagcgccgtcacggcgcacttcgccgtggccgtggtcctcctgctgctgttgctggccttcgcccggcgcggtctgctcgacgaggccgcgcggaccccgcccggtgagccggagacggcgcccgaggacaaggaccccgggcg

SEQ ID NO: 528 - DNA, 891 bp, Unknown
  Kingdom: Bacteria, Phylum: Actinobacteria, Class: Actinobacteria, Order: Streptomycetales, Family: Streptomycetaceae, Genus: Streptomyces
gtgcggcggtcgcgggtgcggtcaagctggtggcgcccagggtggcggcgagaacggcggtgacggcgaaggcgagccgtcgcgcagcaggacgggggtgaggcaagttctgctcctcctcaggggcaacgggcgcgccatgcgcctccgctctcagaccacggggcaagggcattggttggagggatggctgcagggatgactggcacctttttttgaacggagcgctccgctccgataaggtccgcacgagacacacccgctcaccggcacggaggacacacacatggcggcgacgaccaagccgaccgcgctggtcaccggcggcagccggggcatcggcgcggccacctcgtgggagctggcggcccgcggttaccgcgtggccgtgaactaccactcgaaccgggaggcggccgaccaggtggtcaagcggatcgaggccgacggcggcgaagccctggccgtgcaggccgatgtgcacgacccccggcaggcagcggaactgctggagcgcgccacggtcgacgggcgtctggacgtcctcgtctgcaatgccggtgcacgcttcacaccgaccccgatctccgggctcgcctgggaggacttcaacgcgaaggtgacggacgagctggcgtccgcctacaccctcacccagcgggcgctgccgatcatggaggcgcagggcgggggccggatcgtgtacgtgtccagtgccgtggccgacgggccgcccaccgtgggcatggcagcgcacggcaccgccaaggcggcgctgaacaccttcgcccgcttcgtcgcgtacgaggccggtcccctcggcgtcaacgtcaacgtcgtggcgcccggcttcgtccgcaccgaggccagcgccggcatgccgctccagtt

SEQ ID NO: 529 - DNA, 782 bp, Unknown
  Kingdom: Bacteria, Phylum: Actinobacteria, Class: Actinobacteria, Order: Streptomycetales, Family: Streptomycetaceae, Genus: Streptomyces
ccgggaggccgtgtcgggtgtcccgccgaccctgcctgccgccgctcccgggcctccccggccgccagggccgtccgggccgtccgggatctccgccaggcggaccggtcggtgctcgcggcgggacagttcgcaggcctcggcgatgcgcagggcctgcagggcctcctgaccgtcgcaggggttgggacgtgccccgaggacgacgtcgacgaaagcggtcagttcggcctcgtaggcgggtccgaagcgctccaggaacccggtccagggcttgtccgcggcaggcgggccggtcggctcggtggacgcgatcggcgtacggtcgccgaggccgacgacgatctggtcccgttccccggccagctccatgcggacgtcgtagccggcgccgttcagccgggtcgccgtcaccgtggccagggtgccgtcggcgagggtcagcaccgccgcgccggtgtcgacgtcaccggcctcgcggaacatgtccggaccggcgtcggacccgcgggcgtacacctcggcgacctcctgcccggtcacccagcgcagcatgtcgaagtcatggatcagcgcgtcccggaacagccccccggacacggccaggcggcccgccggcggcggcgcctgctccgaggtcagcgcgcggacggtgtgcagccgcccgagccgccccgagcgcaccgcctcccgcgcaccggcgtagccggagtcgaagcggcgctggaaacccatctgcagcaccgtcccggcggccgccacctcggcgagcgcgcgcagcg

SEQ ID NO: 530 - DNA, 8949 bp, Unknown
  Kingdom: Bacteria, Phylum: Actinobacteria, Class: Actinobacteria, Order: Streptomycetales, Family: Streptomycetaceae, Genus: Streptomyces
gtcctttccgggctgccgggctcgcgaccgcttccgcccggcagcccggaaaggacggggcccacggtgtcctggtaggcatccagggtcccggcaggccgcagcgccgcggcgccggcgaagccggtacggaacgcgccgggctcgacgatcagcacccggatgccgtgcggggcgacctcggcggccagggcctcggagagcccctccagggcgaacttggtggcgcagtaggcgccgactccggcgaaggcgaaccgtccgcccatgctggtcagctgcacgatggcgcccgagccgcggcggcgcatgtgcggcagcgcggcccgggtgagcgcggccgggccgaagaagtgcaggtccatcaggtcccgcagctccgcgtcggtggtctcctcgaccgcccccaccatgccccgtccggcgttgttgacaaggacgtcgatccggccgtgccgggctgccacgccgtcgaccgcggctcggacgcccgcgatgtcggtgacgtccagcggcagcgcctcgacctggtcggggtgcgcggcgaccaggtcgtcgagcggtgcggtacggcgggcggcggcgaccacgatgtcgcccgccgccaccgccgcttcggtgatcgcccggccgaacccgctgctcgccccggtgaccagccataccctgttcatgttcttctccttcttcaccgtgtgcttctccgcgtgcttcaccgcgtgcttctccgtgtacttcgccgcgtgcttctccgtgtacttcgccgcgtgcttctccgtgtacttcgccgcgtacttcgccgtgtaacggtgatccgccgttctccgcggcccgcgtgaaccaccttgcggggcgccccggttgcccgtccaagacctgctgtgatagccgatggttatggacgttcacgcacgggacctgaggtacttcgccgccgtggccgaggaactgcacttcacgcgcgcagccgagcggctgtacgtctcgcagcccgcgctgagcaagcagatcaggatgctggagagacaggtgggggccgcgttgttcgaacgcgaccggcgggaggtgcgcctgagcgcggccggtgcggcgctgctgccgcatgttcagcgcattctcgccgagtgggaggcggcccaggaggcggtggcccgggtcgtggccgaccaggcggccctcctcgtcgtggggatgagtaccagcccggggcgcgggggcgtgctgccggcgatccgctcccgcttcaccgccgcgcgccccgacgcccgcctcagacttcaccaggtcccctggcacgactcgaccgccgggctcgcggacggcacgtgcgacgcggcgttcgtctggcttccgctgcccggtccggagcgctaccggtgggtggtggtcgccgaggaacctcgccatgtcgccatgcccgatactcacccgctcgccgaccgggagatcatcgacttcaccgacctgctggacgagccgttcctcgctctgcccgagaccgccgggccgctgcgggactactggctcgccaccgacgcccgcggcgggaaaccggctgtcatcggcgcggaggtggcgagcaccgaggagacgtacgaggcgctcgtcgcgggtctcggcgtggtcctgctggcggccgggaacactccgctgatcaccctcggcggagtcgtcacccgtgtggtgaggggtgtctcgcccagccgcttcgccctggcctggcgcgccgacgaccgccgcccgctggtgcgggagtacgtacgcgcgtgtgaactggcgaccgggacgacgcactgaggcggagtgcagccccgcggttgaacgcacatgatcacatcaaacccccggcaccgtcgtaccggccttcggcagccattggtgccgaccgtgccgggggttccgcggcttccgcggcttccgcggcgctcagggccgagaacggcttggaccatcctcatgtccaagggaacgggcagggaacgggcccatcaccgccttggacggatcgtgcgtcgtccccgagcacctggcagctccgctcgacgccggaaccggcccggtcgccggagatgaaggcctggcactccccctcgccggcgccggagagctcacggccgttgatccggtcggccgcggcgggccacgccctccaggagtctgcggcgttgggccggggttgtggccagttccacgcccacgtgggcgagtgccgtcgctccgtcgatgacggcctggtcggcggccggcgtcgtgccgtgggcggtgaactccgcggtgtggtgtttggcgccttcggtgtcgtagccgatggtgggatggatcgtcggcaggacgtgcgagatgttgcccatgtcggtggaggccatgagttcaccgtgcagggcgacggggtcacggcccagcccccggaccgcccgctcgtaggcatcggtcatgaaggcgtcttgcctcaggtcggcgaagtcgtggccgtgtgtggtcagttcgaggtcggcgccggtggcgagagcgcccgcggcgaagcacgactcgacccggcggcgcgcctgtgccagctgctcgaaggtgggggcccgcagctcgtagcgggcccgggtgaggtccgggatcacgttggcggcctgtccgccctccgtgacgactccgtggacgagtgtgccgggcggaagctgctggcgcagcaacccgacggcggtgtgggccagagtcatcgcgtcgagcgcgttgacgccctcccagggggcgagggccgcgtgcgagggctttccccggtaggtgatgtcccaggcgctgatggccagcgaggaggcgccgacggtgtcctgcgccgccgcgtgcaccatcatggccgccgccacgtcgtcgaacgtgccggcttgcaggagggtcaccttgccgccgaggtcctcctcggccggcgtccccaccagcttcacggtgagcccggccgcgtccgcgacggcggcgaggccgagggcggcgccgaccgccgacgccccgttcacgttgtggccacaggcgtgtccgatgccgggcagcgcgtcgtactcggcgcacacggccacgaccaggtcacccgatccgtaggtggccaccaacgcggtgggcaggtccgcgacgccacgggtgacggtgaagtccgcgtcggtgaggagatcggcgatcttggcggcagaccggtgctcgttgagggccgtctccggttcggcgtgcaggctgtggctcagcgcgacgaggcggtccctccaggcgtgcacgctccgggtcgctgcggcggtcagggtctgttcccgcacgggggtcctcctggttccatggcggggtgtggtcgcctggctgggtgcggtcatgccggctctccgctgtgggcgaggggctgcgcgtcctgtcccgtcctcgtgccgggaagggttcggaaggccagggccgccgccgcgcccagcagggcgaccgccgcgcacacgctccaggcccacgcgtagcccgccagggcgatccggccgtcggccgactggtgcgcggcgaacagcgcgccgatgacggccgcgccgatggccgcgcccagggagagggccagctcgttgaggccgacggacagcgccgtctcgctctcggacacgatctccgctgacagggtgcgcgtgatcgattcgaagacaccggtggccagcccgatgacgagcgcaccgacgaggtactggggaagggagccgtggaagagcacgagggagaggaagccggccgcaccgatgacaccgtcggcgcagagcaccgcacggtccccgatgcgccgggccaggtgaggtgtcgccgtggagccgaggcagcctgccacgaccatggcgagggagacgactgcgatggcctgtgatcccaggcccatgccgtaacccgctcggcccgggtcggagcccaggaacacggcgttggcgcccaggaatccgatggtgccgaaggccgcgcagaaggtgtgcgcgctcacgacggcgagtcgcgcgttgctcagcagccgtacgtcgaccagcggatgcttcgagcgccgttcgagcgtcacccacagcgccagcaggagcaccgcggccgcggcggtggccagggagtcgaacgacgcccagccccacgtgccgccctgggccaggacgaggaccagagccaccagcccgagggtgagcagcgtcgcggccgcggagttgaactctccgcggcgtggtgcggcgctgtccggcaggaccaggctggccgccaccgcgagagcaccgaccggcaccgccgtccacaggccggcgacggcatgcccttcgctgagcgcgcccgcgaccagaccgccgacgccgatcgagatgaggagcgcgccgacgagcaccgacatgccgagacggccgtgtccgggtgcgcgcgagcgcaggattccggccagcagcgggaagaacccgacgacagctccctgacaggtcatgccgaccgccagggtgaccgtggcgggccgtacggctatcagcagtgcgccgccgaagaccacggcgacacagatccgcagcagcctgcggtgcccgtacaggtcgcccagtcgggacagcagcggggtcatcacggcgaaggcgagctgcgacaggaggtagaggttgttctgaccgacgctgccgagcccgacgtgggttccgacttccggcaggagcggggtcaggtacccctgtgacacgccactgcacaccacgatcactgtcatggtcgcgagcagtgcgcgacccgaaccgatgcttctggccactggtctcccatccttgtggtggctcgaacgagacgtaggggctactctgcgggcaccattgcggcctggccggattttgacgggaatcgtgcatgagaggcgtgcctgatgcgggaaacaggcgctgtgagcgaactggacctggctctcgctcacgcactgcagttgcagccccgggcgacgtggtcggagttggctccggcgctgggcgtcacggcggacacgctcgcacgccggtgggagcggctgacctcgcaggggctcgcctggatctacgcggcgccgggccgggcgttctcccgtacccgtgccaccgcgttcgtcctgctgcgctgccgtcccgacgcgcgacagctgctcgccgagcaggtctgcgaactcgatgaggtggtcaccgtcgaactcaccgcgcccggaagcgccgatctgctgctggacgtgctggcacccgacatgggatcactcacgcgactcatcaccgagcgtctgagcgcactgcccggtgtgagcggcatggagtgcctcttcgccacctcgctctacaccgagggcagccgttggcggctgcactccctcgacccggcccagctcaccgcgctcgggccgcccggcaccgggacccggccggccttcgactcccccgggctggacgcggtcgaccgctccctgctggacgccctcgtccgcgacggacgcatgggccttgccgcgctggccgaacacaccggcaccagtcctgcgaccgtccggcgccggctgcgccgactcaccgactccgccgtgatgaccttccggtgcgatgtggcacctcaactgacggggcttcccgtggccgtgagtttccgcggccacctaccggtccgcgatgtcaacagtctgcaccgcaccctggcgacacttcccgagtgccggctcgtcgccgccgtcacgggcaccgcgaacctcttcgccacgttctggctccgcagcctcgccgacatccagcagcgggagaccgcgatctgcgcacgtctgccctccctcaccatcaccgaccggatcgtgggcctgcatacggtgaagcgcatgggacacctgctcgaccaggccggacggcacacgggcacgaggccgatccacccctggtagcggtcatcgcgcaacgggaggccgggataccggtcatgccggctcgacgtggtggtcattcccagtactccggcccgtcgaccggcgcgaggcgggcggccaccggtcgaaccggtggccgccctcagtgccgtactcgtcggagctaggcgcaggtgcccgcgaacgtcgagcgggtcacgacgtccgtcgcggcggcggtggtgtccagccacaccacgcgccggccgtcaccgagggacggggccagctgcgagccggaggagcaggagacgcggctgaagtcgttcacgccggccagcacgtcggaggtcttggcgaccttcaccttggtgggaccgtcccaggcgccgagggcgccccagatgctgtacgtcgagtacgccaggtagtcgtcggtcacggagaactgggcggcgtagaggctcgacgggtagcgcaggttcgccatctggttcacgtcgttggccggcgtcgagcccagcgtggtgctcgggatcaggaagccgttcgtcacgcggtagaagatgcggtccgaggtgagctggatgtccgagatgtagttgaacaggaagccgccgatccgcttgttctgcgtcctgccggtggcgatgtcgtagatgtagaggtacgtgccgtcaccgccggcccaggcgatggtgccgttcttcatggcgaggtgggaggccttggtgccgggctcgggcgtcacatcgacggtggtgccgtcggccttgcggagcatgacgtcctgctcgccgcccggggtggtgcggatgtaggcgagggcgccgttctcggtgaccggctcggtctcgtccacgcccggctcgtcgaccagcttcttgaccgcgccctggcccttgtcgccggcctggtagatgccgacgccgtcggcggcgatccgggtgaagacgatccggtcgctgtcgagggacgggtcgagcaggtaggcgtccttctgggccagttcgtgccgcggcttcttgtcgaagcggcccacggtgatgccgaacgcggcgctgccctggtcccaggcgatggcatcgccgtgactgatggcgtagacgtcgtcgtggacttgggcggcctgctcgtcgacgccgccgtagacctcgtaggcgggcaggatgtcgccggcgatggtggtgccgtcgtgcgtgccgcccttgtgctcccagccctgctcgatgccgtgcgcgtcgaaggccttgccgatcgcggcgaggtcggccgtggagaccttcatggaccgcgcggcgagggtcaccgcgttgcgcatgtcggtgaagccggacagcggggtgaggtagttctccgcggcccggtagatgatctggtccgcgagcttggtgtcgatgctcttgcggaggtcccacagcgcgccgccgacgatggtggagttggagtgcactccgccgttgtcgatgtcgagcgtgatgggcaggtagtccttctgcgcgttgcggccgtcgttcaggtcgcgcagggcgcagtcctcgagcggcttggtgccgttgcagaggtactcgccgaccaggccggaggtggggtcgctcatggcgacgcccttgtcggcggtctccatggcgttgccgaagtagtcggagatcgcctcgttgagggcgccggactggttgaggtagacgagcccggcggcgtgctcggtgacgccgtgcgtcatctcgtggccgaccacgtccaggcccaccgacagcggtacgccgttcatgtggccgtacaccatcttggagccgtcccagaaggcgttggcgtagtccttgccgttgccggcgacgttgacgacggagtagacgctgccgcctttgccgtcgatgccgtcgcggccgatctggttcttgtagtactcgtagaccttggcggcgttgatgtgggcgtcgaccgcgccggaggtggtgttcgcgccgtcgaagcgggtggtcggtgacttcgccggcgggacgtcgtcggtgaccgggccgcccgcgacgagggtgtagtccttgcgctgcgcatcgtaggtgcgtatctggccgccggtccgcccgaacatgtcgcgggtggagtcgaccagggtgtacgagccgtccgcctcctggctggcgtccagcttcgcctcggtgccgtccatgcgcacgcccgtcgccgtcacgggcgcggcgtcggcggcgtcgatgttgttgtacgagagggcgatgcctccgacgttcgcgtcgacgtacacctcctggcgcaccggggtgccgtcagcgtgcgcaccggtcacggtgaagtgccaggtcagcgtgccgccacgggagttgggcaggacgacgaggccgtgctcggcggtgctggcgccccggacggtgcgcaggcgcgcgtccagcgagaacatccgctgcttcgcggtggcctcggtgacctccggggtggtggagacggtgaggtcggtgtacagggtgccggtggcggagaggaccttctggccgccgtcggccggctcggtctgcaccgcgtactcggcgccgaagaccggtaccccgttgtgcttctgcccgaagcggaccgaggactgcttgccgaccttggtggtccgcagcgtcttcaggtcggagaccgggaccttgtacttgtcctgatgggcctcgatgtgtgcgcgggccgcctcggcgggagttcccttgcggccgtccttgtccaggccctcggtcatggccggtgcgaccggcacctggtcggcggtgacgttcgggggctgcggtgcctcgtcctcggcccaggccggtgcggccagcagcgacgctccggtggccgcgacgaccactgcggtggccagaaccctgcggagccctcttgttctcatggggaacacgcgaagcctctcccttgtgcacggatacgtgaaagcgcacctgtacgcgcggtgcacggccccacgcgttcggtgacctcgatggttcggtacggtccggtccgctacaagggatcagccccgacgcaaatatgccttggcgtaaatgcgcctcaactccgtgggggagccggtgtgttcgcggtgtctcgtccagccg

SEQ ID NO: 531 - DNA, 1445 bp, Unknown
  Kingdom: Bacteria, Phylum: Actinobacteria, Class: Actinobacteria, Order: Streptomycetales, Family: Streptomycetaceae, Genus: Streptomyces
tggtggcgagtgtgctgcgcgtggtggtccggcgggcgatcaccaagctgatcgagcggatgaaccgcaccgcgcagcaggcgagcggcacggcgctgggcggtctgctggtgaacgccgagcggcgcaggcagcggtccgcggccatcggctcggtactgcgttcggtggcgagcttcctgatcatgggcacggccgcgctgatggtgctgtccgcgttccagatcaacctggccccgctgctggcgtccgccggtgtggcgggtgtcgcggtcggtttcggcgcccggaacctggtcacggacttcctctccggcgtcttcatgatcctggaggaccagtacggcgtcggggacacgatcgacgcgggcgtcgcctccggtgaggtgatcgaggtcgggctgcgcgtgaccaagctgcgcggcgacaacggcgagatctggtacgtccgcaacggcgaggtcaagcgcatcggcaacctctcccagggctgggcgacggcgggcgtggacgtgaccgtcaaggcgagcgaggacctggaccggctcaaggagacgctgagcgaggtcgcggagaagatgggcaaggaagagccctggaacgagctgctgtggagcccgatcgaggtgctgggcctggacagcgtgctgatcgactccatggtggtgcgggtctcggccaagacgatgccgggcaagtcgacgtccgtcgagcgcgaactgcgctggcgcatcaagcgcgccttcgacgaagccgacatccgcatcgtgggcggcgcgacggcccccgcggacgaggactcggccccggacccgatggcagcggtcgccgccccgtcggcgtactccaacccggcctccccgcagaccaaggcggcgacgcccataccgccgcagcagccgaccgggaagtagggcatggggggcagcggatcacccgcctgataacgactccgttgcctcccgtccgttcacccttgacgtccccttcatctcgggcttacgttcctggcactcgaacaggaaactttcctaacagtgatcttcggtaatctccggtgatcaacggtgatcaccgctgatcttccagggcagggggcgagaagcatggcagggacgaccggcacgccgggtacgccgggcaccccgcgtgtgctgcgtgccatgaacgaccgggccgccctcgacctgctcctggagcacgggccgctgtcgcgcacccggatcggcaagctcaccgggctgtccaagccgaccgcctcccagctcctggcccgcctggaagcggccgggctggtccgtgccaccgggaccagcgagggccggccgggcccgaacgcgcagctgtactcggtcaacccggccgccgcccacgccgccgggctcgacgtcaacccgcaccgcatccgcgccgcggtcgccgacgtcaccggccgcacggtcggc

SEQ ID NO: 532 - DNA, 2775 bp, Unknown
  Kingdom: Bacteria, Phylum: Actinobacteria, Class: Actinobacteria, Order: Streptomycetales, Family: Streptomycetaceae, Genus: Streptomyces
gtgcggcccgacccgcactgcctcggcgcggccggccgcctgcgcagcgcgggcgtccgggtcctcggccgcatcgacgcagtccagggcacccggagccgggtcgaactgatcgccgacgcgcaccggtacctcgagtggtaccaggtcgacggcttcctcctggaccactgccccgccacgcgcgaagggctgcccgagacccgccgcacgatcacctcgctgcgcgcgctgcacgccgacgcccacgtcgtcctcggccacggcacccatccgtacccgggctacgccgagaacgccgaccagctggtcaccttcagcgggccgtggagcgactaccgtttctcgcaggccgccgagtggaccgccgactacccgcccgagcgtttctgccacttcgtgcacggggtgccgcgcggtcatctcgacgaggcgctgcgcgtggcccgctggcagggcgcggcgacgatctggttcaccgaccgcaccggccgcggcggacgcagggacccctgggagtcactgcccggctactgggacgacatcgtctcgcaggtcggaacgggagtctcggaatgaagaaggccgtggcagtgttacggggagaacaaccgtagtgattgaccgaccaacggagtccccgtgtcgctgccacccctggtcgagccggctgatgagctcaccgtagacgaggtccgcaggtactcccgccacctgatcatccccgatgtcgggatggacgggcagaagcggctgaagaacgccaaggtgctcgccgtgggcgcgggcggcctcggctcgccgaccctgatgtacctggcggcagccggtgtcggcacgctcggcatcatcgagttcgacgaggtcgacgagtcgaacctgcagcggcagatcatccacagccaggccgacatcggccggcccaaggccgagtccgcccgtgacaccatcaagggcatcaacccgctggtggacgtggtccttcaccaggagcggctcgaggccgacaacgtgatggacatcttcagccagtacgacctgatcgtcgacggcacggacaacttcgcgacccgctacctggtcaacgacgcgtgcgtgctgctgaacaagccgtacgtgtggggttcgatctaccgcttcgacggccaggcctccgtgttctggtccgagcacggcccctgctaccgctgcctctacccggagcccccgccccccggcatggtcccctcctgcgccgagggcggcgtgctgggcgtgctgtgcgcgtccatcggttccatccagaccaacgaggccatcaagctcctcgcgggcatcggcgagccgctggtcggccgcctgatgatctacgacgccctggagatgacgtaccgccaggtcaaggtccgcaaggacccgaactgcgcggtctgcggcgagaacccgaccgtcacggaactcatcgactacgaggccttctgcggcgtcgtctccgaggaggcccaggcggcggcggccgactccacgatcactcccaagcagctcaaggagtggatcgacgacggcgagaacatcgagatcatcgacgtccgcgagccgaacgagttcgagatcgtctccatcccgggcgcccgcctgatcccgaagaacgagttcctgatgggcaccgccctggagagcctcccgcaggacaagaagatcgtcctgaactgcaagacgggtgtccgcagtgcggaagtcctcgccgtgctgaagtccgcgggcttcgcggacgccgtgcacgtcggcggcggcgtgatcggctgggtcaaccagatcgaaccgcacaagccggtctactgagccgaacgcgacgagcccatggcgcccccgcagcgggcgccgtgggctcgtgccgttcccggcgtgcggccggctaggtgcacacggttccggccgccggcgccttcccgtcgagcaggtagccgttcaccgcgttctgcacgcacttgttcccgctgttgtaggcgccgtgcccctgccccttgtaggtcagctccacggcgacgcccttgcccagcgcgcccaccatcttcctcgcgcccccgtacggcgtggccgggtcgccggtgttgcccacgacgaggatcggcgccgagccgtgcgcgctcacgtcggggtggtcggccgcgccgggcaccgcccagtcgctgcaactgagcatgccccaggccaggaagtccccgaacaacggggaggcggcccggaactcgggcagcttgcgccgcacgtacgccgtgtcgtagcgctccttctcgtcggcgcagttgatggccacgttcgcggcggtgatgttgctgtactcgccgttctggctgcggccgttcatcgcgtcggacagcagcatgaggatccggccgtcgcccgcgtaggcctgttccagcccctcggtgagcggtgcccacagatccttggagtacagggcctgcgcgatgccgttggtcgcggccgtctgcgtcagctgacgggggaagatgccggggatcggtgccccgtcgagcttcctgagcagtgcggcgacgcggttctcgacgtccttggccgtactgccgatggggcacttggtgctcttcgagacacagtcgtgcgcgaagttgtccatggccagctggaagcccttggcctgccccagcgaactctgctcggggttctgcgtggggtcgacgaccgcgtcgagcacggcgcggcccacgtggcgcgggaagaggtgggcgtagacgccgccgagttcggtgccgtaggagatgccgaagtagt

SEQ ID NO: 533 - DNA, 9371 bp, Unknown
  Kingdom: Bacteria, Phylum: Actinobacteria, Class: Actinobacteria, Order: Streptomycetales, Family: Streptomycetaceae, Genus: Streptomyces
gaatccggagcccatgcccgacgccccgcagccggcgcccgccccgcaggcaccgcagaagaagagcgcgggacgggacctgggcgctgccataggcgtcggtctcgggctcggcgtggtgatcatcgcgtcgctgttcgtcgtcaaggccgtgttcgtgggcgtcatcgcggtcgcggtcgtggtcggcctgtgggagctgacgtcgcggctgcaggagcgcaaggacatcaaggcgcccctcgtgccgctcgcggtcggcggtgccgcgatggtggtcgccggctacgtccgggacgccgagggcgcctgggtggcgatggcgctgacgacgctcgcggtcctcgtctggcggatgacccagccgccggagggctacctcaaggacgtcacggcgggcgtcttcgccgcgttctacgtgccgttcctggcgacgttcgtggcgatgatgctcaccgcgcccgacgggccgtaccgcgtcctgacgttcctgatcctcaccgtggtcagcgacaccggcgcctacgccgtcggctggcgcttcggcaagcacaagctcgccccgcgcatcagccccggcaagacccgcgagggcctggtgggcgcggtcgcgttcgccatggtggccggggccctgtgcatgcagttcctgatcgacgacggagcctggtggcagggcctgctgctcggcctcgcggtcgccgccagcgccaccctcggcgacctcggcgaatccatgatcaaacgcgacctgggcatcaaggacatgggcaccctgctcccgggccacggcggcatcatggaccgcctcgactccctcctgccgaccgccccggtggtctggctcctgatggtcctgttcgtcggatcctcctgaccggcgcggccgggcccgcgaggcccgcgaggatcttcctgacggccgggcccctctcgcaggggtccggccgttagagttctgccccatggggcggggacgactggagaaggacggcacctaccacggcgatctgccgtgccggtggtgcgaggcactcatcgatcagggcgggcgccgcagaccgcgccgctactgcggcggctggcaccgcacgaagacctacgtctcctgggtcttcaccggcatcttcgccatcttctcctgaccacggatcccgcccgcctccaccgcgcccccgcgcgttcggcgcggacagggcgcccgcgccaggtcactgggccgtcttcgggccgtcatgccggcgtgggtccggccgtcgggctcgcagcggggccaggccgtcaggatcgcccaggtccggccgtcaggctcgcagcggggccaagccgtcgggctcgcagtggatccgggccgtcaggatcgcccgggtccggccgtcaggctcgcagtggatccgggccggcaggatcgcccggggcggaggaagcaccctcgtgacagactccggcgcatgaaactcgaccagacgctcgtggacgcggccgtggaactcatggaccgccgctggcccgtcggtgaacccggcggggcagccgctgtgcggctcgccgacggcggcatcctgaccagcgtcggcctcgacaacatgaacgggtcggtcgcgctgtgccaggagaccggggcgttcatccaggcctacacccaggaccggaccgtcacggcctccgtctgcgtctgccgtgacccggagcgcggcaggatcctgatcctgccgccctgcggcgtctgccaggaacggctcgcgctctgggggccgtccgtcgaagtcgccgtcccgcggggagacgacccgaccggctgggaggcgcgcaccctcgccgaagtgaacccctactactggggcctgcagttcgccgaggggcagtggccttcccgggcacagcactccgagtgaccggcggcggcgttccacccggccggcggccctgcgctacaggggaaccgccgtcaccgccaaccggtgacggtcaccgacggcagccggagccagccgctgcccgaggtcacccgattggatctgcgacactggtaccaccatgcccaagcccggagaactcactttcgtcgccccccgcggagccaagaagccgccgcggcaccttgccgatctctcgcctgccgagcgcaaggaggccgtcgccgcgatcggcgagaagccgttccgtgccaagcagctctcgcagcactacttcgcgcggtacgcgcacgaccccgagcagtggacggacatcccggccggctcgcgcgccaagctgcgcgaagcgctgcttcctgacctgatgacggtcgtccggcatctggcgaccgacgagggcgccacgcgcaagacgctgtggcggctgttcgacgggacgctcgtcgagtcggtgctgatgcgctacccggaccgggtcacgatgtgcatcagctcccaggccggctgcggcatgaactgcccgttctgcgccaccggccaggccggtctcgaccggaacctgtcgaccgccgagatcgtgcaccagatcgtcgacggcatgcgcgccctgagggacggggaagtgcccgggggacctgctcggctgtcgaacatcgtgttcatgggcatgggcgagccgctggccaactacaaccgtgtggtcggcgccatccgcgcgctgaccgacccggagcccgacgggctcggcctgtcccagcgcgggatcaccgtctccacggtgggcctggtcccggcgatccaccggttcgccgacgagggcttcaagtgccgcctcgcgatctccctgcacgcccccgacgacgaactgcgcgacacgctcgtgcccgtcaacacgcggtggaaggtgcgggaggtgctggacgccgggttcgagtacaccgcccgctccggacgccggctgtccatcgagtacgcgctgatccgggacatcaacgaccaggcgtggcgcggcgaccggctcggccgcctgctcaagggcaagccggtgcacgtcaacctcatcccgctcaacccgacgccgggctcgaagtggaccgcctcgcggcccgaggacgagaaggcgttcgtcgaggcgatcgcggcgcacggcgtgccggtcaccgtccgggacacccgcggccaggagatcgacggggcgtgcggacagctggctgccaccgagcgctgagctgacggtacgctgagccagtccacaacttcatagtccggcatcttcatattccgacaggggagcgccacagcgctgagagtgcggcaccggccgcagaccctctgaacctcgcccaggtcattctgggtaggaagttcggtcaccactcgagctgttgcgccctgcccgggtatcccgcgcggatcccgggcggggccgcgtctcttcctggccaccacccaggaggaaaatccagtgcaccacaagacgttcgtcgccgcggccgtcggactcggcctggtcacgctctccgcgtgcgggtcgtccggtgacaaggcggcggactccaagaccgtgaccgtggtcagccacgactcgtgggccgcgtccaagagcgtcatcgccgacttcgagaagacgtccgggtacaaggtcagggtcctcaaggacggcgacgccggacaggccgtcaacaaggccatcctcacgaaggacaacccgcagggcgacgtcttcttcggcgtcgacaacacgctgctgtcccgcgcgctcgacaacggcctcttccagtcgtacgagccgaaggactccgacaaggtcgaccagcggtaccgggtcgaccaggccgagcaccgcgtgacgcccgtcgacaccggcgacatctgcgtcaactacgacaagaagtacttcgccgaccacaagctggccccgccggcctccttcgacgacctgctgaagccgcagtacaagaacctcctcgtcaccgaggacgcggcgacctcctcgcccggcctcggcttcctgctcggcaccgccgcccagtacggggacacgggctggcaggcgtactggaagaagctcaaggacaacggcgtcaaggtcgtcgacggctgggagcaggcctacgaccaggagttctccggctccgccggcgggaagaaggccaagggcgaccggccgctcgtcgtctcctacgcctcctcgccgcccgccgaggtcgtctacgccgacccgcagccgaagaccgcgccgaccggtgtcgtcgacggcacctgcttccgccaggtcgagtacgccggcctgctcagcaacgccaagaacaccaagggcggcaaggcgttcctcgacttcctgatcagcgagaagttccagcaggacatgccgctgaacatgttcgtctacccggtgcgcgagaaggccgcggtgccggccgtgttcacgaagtacggtccgcaggccaagaacccccagaccatggcgcccggcaagatcgccgccaaccgcgaccagtgggtcaagacgtggtcctcgctcgtagtgaagtaggcggccgggcgggggaccgggcacgccgccggtcggcgaacgcggcgcggttcggcctgatggccgtgcccgtcgcgttcttcgcgctgttcttcgcctacccggtggccgcgatcgtccggcgcgggctgcacgccggcggcgcctggcagtgggggcagttcgccgacgtgctgggccggtccgacatccggcacgtgctgtggttcaccacctggcaggcgctcgcctccaccgcgctcaccctgctcatcgcgctgcccggcgcctacgtcttcgcccgctacgacttccccggccgccatgtcctgcgggccgtggtcaccgtgccgttcgtgctgcccaccgtcgtcgtcggcaccgccttcctcgccctcctcgggcgcggcggactgctcgacgacctgtggggggtgcggctggacaccaccgtgtgggcgatcctcctcgcgcacgtcttcttcaactacgccgtcgtcgtacggaccgtgggcggtctgtgggcacagctcgacccgcggcaggaggaggccgcgcggatgctcggcgcctcgccgctgaccgcctggcgcaaggtcaccctgccggccctggctcccgcggtggccgccgccgcgctcatggtcttcctgttcaccttcacctccttcggcgtggtgcagatcctcggcggccccggcttctccaccctcgaagtggagatctaccggcagacctcgcagatgttcgacctcaccacggccgccgtcctcaccctcgtgcagttcgtcgcggtgggcgcgatcctcgccgtgcacgcgtggacggtacggcaccgggagaccgcgctgaaactggtggacgcctcccgcaccgcccgccgcccgcgcggcgccgggcagtggacgctgctggccggtgtcatcgcctgcatcgcgctgctcctgctgctgccgctggccgtgctggtgcagcgctcgctcaccgcccccggcttcggctactaccgtgcgctgaccgacgccgacggcggcaccttcctcgtcgcgccgatccacgccgtcggcgcatccctgtcctacgccgccgccgcgaccgccatcgccgtcgtcatcggctccctcgccgccgccgcgctcacccgccgggacgccggccggctcgtccgtggcttcgacgcgctgctgatgctgccgctcggggtgtcggcggtgaccgtcggtttcggtttcctgatcgccctggacaagccgccgctggacctgcggcagtcctggatcctcgtcccgctggcgcaggccctggtcggcgtgcccttcgtcgtacggaccatgctgcccgtgctgcgcgcggtggacgtacggctgcgggaggcggcggccgtgctcggggcgtcgccgtggcgggtgtggcgggaggtggacctgccgctggtgcggcgggcgctgctgatcgccgccgggttcgccttcgcggtgtccctcggtgagttcggggcgaccgtgttcatcgcgcgtcccgacaacccgaccctgccggtggccgtggcccgcctgctcgcccggcccggcgacctcaactacggccaggccatggccctttcgacgatactcatggtggtgtgcgcggtggcgctgctggtactggagagactgcgcggcgccgaccggacgggggagttctgatgctgctgagcctcgacgccgccaccgtccgcttcggcgggcgtgccgtgctcgacgccgtggacctcgcggtcgcggagcacgagatcgtctgcgtgctcggacccagcggcagcggcaagtcgacgctgctgcggacggtggcgggcctccagccgctcgactccggccgggtgctgctcgacgggcgcgaccaggcggcggtgccggtgcaccgccgtgaggtcggactgatgttccaggaccaccagctcttcccgcagcgggacgtggccgggaacgtcggcttcgggctgcgcatgcacggcacggcccggcaggaacggacggagcgggtggccgaactgctcgacctggtcgggctcccgggcgcgggagggcgatccgtcgccgccctctccggcggcgagcagcagcgcgtcgccctcgcccgtgccctcgcgccccggccccggctgctcatgctggacgagccgctcggccagctcgaccggtccctgcgcgaacgcctcgtcgtcgaactgcgggagctgttcgggaggctcggcaccaccgtcctcgccgtcacccacgaccagggcgaggcgttcgcactggccgaccgggtcgtggtgatgcgcgagggccgcatcgcccagtccggtacgccgctggaggtgtggcagcgtccggccgacgccttcgtggcgcgcttcctgggcttcgagaacgtcgtcgaggcgaaggtcgacggcgaggtggcgctcacgccgtggggcaaggtgccggtgcccgcgaacgccccgcagggaacccgtgacgtgctcgtacggcccgccggtgtccgtctcgtcccggccggcgagggcctgcgctgcacggtggtcgcccgtaccttccggggcacccatgtcaccgtccgcctccagccgccggacgcgccgcggctggaggcggcctgcgcgctgcggtcggcccccgaggtcggggaggagacgggcgtggagttcgacccggacgacacggtggtgctgggctgacggcgacggcggccgtcccgggcggggccgccgtcgcggcgcgggcggaacaggcctgccagacacggccgttggcggctggcaggccctgggttctgcgcctgtcagccctggctgttcgcgccccggcggcgcagcccgtagaagaccgctccgccgcctacgacgaccagggcggccgcgatgccgacgatcagaccggtgtgggagttcgccccggtctcggccaggttggactcaccggcggcgggcgagggcgcgttgccctgcgtgcccgcgggagcggtgctgccgctctgcgaggcggacggggccggcgtcgccggaggtgccggcgtggcgggctgggacgccgtggccgtcggagtcgggggcggagtcgggacggccgactgcgacggggtcgcgggggtgctcggcgtcgccggggcgcaggccgccttcggggcggtcacgttcggcgtgatgtccgaatcgacccgcgtccccgcggccttgacgtgaacgcggtagacggcgccgggctgccagtcctcggcgaacgtcaccgtggtgccctgggcggagccggtgacggtctgctcgccgaccttcctggcgtcggcgccgttgctctccaggaacacggagacgaccgccggggtgcgggaggtgtccttgtcggtgacgacgatggcgcccttgccgccgtcgcacgtggtgacggcggagaactcactgatgtcgcaggcgagtgcggtgtcggcgacgccgagcgcgagcgcggcggagacggcggcgacacccaggatgcgcgtggaacgtgcgatacggcgggatatggacaagatggccactttgcccttcacggatgcgcaagtgcggggggtggaaggggtgttggacgcaccggcgtcagacgggcgcgccccggcaccccaggaggctccggttctacaagcgctccggagcgagtgtcaacgcgtgtgacccgcacgggcgttggctttgcccgttcattaaccgccgagatgcttcagcgcctgcggggcctcctcgatccggtcgaccagagcgatgcggtgctccatcggacggccttgcgcgagcgagcgcagcaacggccaggccggcagccgctccgtccagtgcacgcggtccacgagcaccatcggggcgggctcgccccgcgactcgtagtagttcggggtggcgttgtcgaagatctcctgcacggtgcccgcggctcccggcaggaagaccacgcccgcgttggaacgggccagcaggccgtcctcgcgggtggcgttggcgaagtacttggcgatgtgcgccgcgaacgggctgggcggctcgtggccgtagaaccaggtgggtatgccgaccgacgtgccgccgcccggccagcggtcgcgcacctcgaaggcggcgcgcgcccagtcggtgaccgacggcctgaacgacggcgccttgccgagcagacgcagcgcctcgtgcagcatcgcgtcgtcgaagggggcggagtacgcgccgaggttcgccgcctccagcgcgccgggtccgccgccggtggccacggtgaagccgtcgcgggccagcgcgcggcccaggcgcgccgccccggcgtactcctgcgtgccgcgctccatggcgtgtccgcccataacgcccaccacccgggcgctgacgaggagttcgtcgagggcgtcggagacggcgtcgtcgtggatcgcgcgcagcatggaggcgtggatgtccccgtcggccttcgtctgctggaaccaggcgtaggcgcgggcgtcgggagtggcctcgtagcccgcgccctcgagcccgtcgaacagttcgccgggcgaatacacgaagccccggtacggggcgaagggcaggtgcggtacgggcgggaagaccagggccccggcggcgcgcaccttggcggcggcctcggggtccatggcgcagccgaggaagatggcgccggtggcgtcgacggagacgaggacgtccgtacggcccgtcagatcgacggactggacgcggatgggggtcccccctgctcattgagagcttgggggagggccagggagccgtgtgcggagacgacgtcgtcgaactcggcgagggactcgatctcacggtcgcgggaaccgccggccggcggcgcgggtatcggatgcacccgcccacgctaggcagcaccacgacccgcgacgccgccgggcagcaccacggcccgcgacacctctgggcggtgccg

SEQ ID NO: 534 - DNA, 5823 bp, Unknown
  Kingdom: Bacteria, Phylum: Actinobacteria, Class: Actinobacteria, Order: Streptomycetales, Family: Streptomycetaceae, Genus: Streptomyces
agtccaggtagatccggctcagcgcggtgagccggtcgcgcgggtccgccacgccgtcctcggtcgcctcccgtacccggacggccaggtcctcgaagccgcggcgtgcgatggcggacagcaggtgcaggtgggtggggaagtggcggcgcggcgcgccgtgcgagacgcccgcccggcgggcgatctcccgcagcgtgagcgtctgcgctccctgagcggccaccagctccaccccgacgtcgaccagccgctcccgcagcccgccgggactcttctcggattcatgcatggacagtgtctaccaacagtgcgtagacactgtctacccccaagggtgaccgtccaggacagcggcacacgcagggccccggtgctcaaccggggccctgcgtatgacatttcggaccgggctacggcctggtgttccactccgcgatcaccgggcggtcgtgttccgtcgagaggcggctgaccgtgccggtggcgagctggaagaggcggccctccgcgggaggcaggcccagtctgcgggccgtgaggacgcgcaggaagtggccgtgcgcgaccaggaccacgtcgccgtcgtccgcggcgagtgccggggcgaggcgggcgaggacgcggtcggcgcgccggccgacgtcctcgggggactcgcccggtgtgccgtccgcgcgcggcggggcgccgtcggtccacaggtcccagccgggccgggtgcggtgtatctcggcggtggtcacgccctcgtagccgccgtagtcccactcgtgcaggtcggcgtccggctcggcgccggtcaggcccgccagttcggcggtgcgtacggcccggcgaagcgggctggtcagcacgcgtgcacaggtccgtccggtgaggagtggagcgagcaacttggcctgttcctcgccgttgtgggtgaggggcaggtcggtacggctggtgtgctgtcccgacacgctccactccgtctcaccgtggcggaccaggagaaggtcccccacgacggatcagtccttcttcgccgactcgacggcgtggccgccgaactggttgcgcagcgcggcgatcatcttcatctgcggggagtcctcctggcgggaggcgaaccgggcgaagagggacgccgtgatcgcgggcagcggcaccgcgttgtcgatggcggcctccacggtccagcggccctcgccggagtcctccgcgaaaccgcgcagcttctgcaggtgctcgtcgtcgtccagggcgttgaccgcgaggtcgagcagccaggagcggatgacggtgccctcctgccaggagcggaagacctcgcggacgttgtccacggagtcgaccttctccaggagttcccagccctctgcgtacgcctgcatcatcgcgtactcgatgccgttgtggaccatcttcgcgaagtgtccggcgccgaccttgccggcgtggacgtagccgtaggggccctccggcttgagcgcgtcgaagaccggcttcaggcggtcgacgtgctccttgtcgccgccgaccatgagcgcgtagccgttcttgagaccccacacgccgccggagacgcccgcgtcgacgaagccgatgccccgcgcgtggagctgcttggcgtgcctctcgtcgtccgtccagcgggagttgccgccgtcgacgaccaggtcgccgggcttgagcagggtcgccagctggtcgatgacgtgctgggtggcgccgccggccgggaccatcacccagatcgcgcgcggcccgtcgagccggtcgacgaggtcgaccatgctggggacgtcggagacctcggggttgcggtcgtacccgatcaccgtgaggccggcgttgcggaggcgttcccgcatgttgccgcccatcttgccgagaccgatcaggcccaactgcatcgatgccatgtcagttcacttccttcagttcgcggtaggcggccacgagggcggcggtggacgggtcgaggccgggcacgtcggcgccctcggtgagggcgggctcgacgcgcttggccagcaccttgccgagttccacgccccactggtcgaaggagtcgatgttccacacggcaccctggacgaacaccttgtgctcgtagagggcgatgagctggccgaggaccgacggggtcagctcggcggccaggacggtcgtggtcgggtggttgccgtggaaggtgcggtgcgacacctgctcctcgggcactccctcggcgcgtacctcgtcggcggtcttgccgaaggccagcgcctggccctgggcgaacaggttggccatgagcaggtcgtgctgggccttgagttcaccgctcagctcggccaccgggttggcgaagccgatcaggtcggccgggatcagcttggtgccctggtggatgagctggtagtaggcgtgctgaccgttggtgcccggggtgccccagacgaccgggccggtctgccactcgaccggctcgccgtcgcgctggaccgacttgccgttggactccatgtccagctgctggaggtaggcggtgaacttcgacaggtagtgcgagtacggcaggaccgcgtgggtctgcgcgtcgaagaagttgccgtaccagatgcccagcaggcccaggatgagcggggcgttggcctcggcgggcgcgttgcggaagtggtcgtcgacgatgcggaagccgtccagcatctcgcggaaccggtccgggccgatcgcgatcatcagggacaggccgatcgccgagtcgtacgagtaccggccgccgacccagtcccagaactcgaacatgttgtcggcgtcgatgccgaacccggtgaccttctccgtgttcgtcgacagcgccacgaagtgcttggcgaccgccttgtcgtcgccgcccagcccgcgcagcagccagtcgcgcgccgaggtggcgttggtgatcgtctcgatcgtcgtgaacgtcttggacgccacgatgaacagcgtctcggccgggtccaggtcgcgggtcgcctcgtgcaggtcggcgccgtcgacgttggagacgaaccgcaccgtcaggtcgcggtcgctgtacgcccgcagcacctcgtacgccatcgccgggcccaggtccgagccgccgatgccgatgttgacgatggtgcggatgcgcttgccggtgtgcccggtccactcaccggagcggacccgctcggcgaagccggccatcttgtcgaggaccgcgtgcaccttcgggacgacgttctcgccgtcgacctcgatcaccgcgtcgcgcggggcgcgcagcgcggtgtgcagcacggcacgcttctcggtgacgttgatcttctcgccgcggaacatggcgtcacgcagcccgaacacgtccgtcgccgcggccagttcgcgcagcagccgcagggtctcgtcggtgaccaggtgcttggagtagtcgaggcgcagatcaccgacgcgcacggtgtagcgctcggcgcgggaggggtcctcggcgaacagctcccgcaggtgcggctgccacgaggcgcggtggtcctccagggcggtccactcgggacgccgggtcagctcggtggtgtcggacatgtcagacggtctccttgatcccgtcgccctgcagggccacggcgtacatctcgtcggcgtcgaggcggcgcagctcctcggcgatgagttcggaggtgggacggaccttgagggcgagggtgcgcgagggctggccgggcagggtcagcgtggccagcgggccctcgggccggtcgatgacgatctcgccgtcggcggtgcccaggcgtacggccgtcacgaacgggccttcgctgcccacccggtccaccgtgacgcccaggcgcgcctccagccagcgggccagcagctccgcgctcgggttctccgcctcggcctccacggccgccgacgtcacccgcacccgcgcctggtccagggccgcggcgagcatcgaacgccacagcgtgagccgggtccaggcgaggtcggtgtcgccgggtgcgtagttgcgcgcccgggtctgcaggacctccagcggcttctcgaaggcgtacaggtcggtgatccggcgctgggccagcgcgcccagcgggtccgcggaggggttgtcgggcgcctccaccggccaccacaccaccaccggcgcgtccggcagcagcagcggcaggaccaccgagtcggcgtggtcggagacctcgccgtaggtgcgcagcaccaccgtctcgccggtgccggcctccgagccgacccggacctcggcgtccaggcgcgagtgggtgcggtcgcgcagggtgcgcgcgtgccgcttgatcacgaccagggtgcgcgaggggtgctcgcgcgaggcgtcctcggccgccttgatcgagtcgtaggcgttctcctcgtccgcgacgatcaccatcgtcaggaccatgcccacggccggggtgccgatggcacggcggccctgcaccaacgccttgttgatcttgcttgccgtggtgtcggtcaggtcgatcttcatggcctgcgccagctccgtccgtctcgtgcgagcatctcgtcggcttcccgcggaccccaggtgcccgacgggtactgggccggcctgccgtgctcgtcccagtagccctcgatcgggtcgaggatcttccaggactcttccacttcctggtggcgcgggaacaggttcgcgtcaccgagcagcacgtccaggatgaggcgttcgtacgcctccgggctggactcggtgaaggactcgccgtaggcgaagtccatcgtcacgtcccggatctccatggaggtgcccggcaccttcgagccgaaccggaccgtcatgccctcgtccggctggacgcggatcacgatggcgttctcgcccagctcctcggtggccgtggagtcgaacggcgagtgcggggcccgcttgaagaccaccgcgatctcggtgacccggcggccgagccgcttgccggtgcgcaggtagaacgggacgcccgcccagcgccggttgtcgatccccagcttgaccgccgcgtacgtgtcggtcttcgactgcgggtcgatgccctcctcctggaggtagccgggcaccttggcgccgccctgccagccctccgcgtactgcgcgcgcaccgtgtgggcgcccaggtcctccggcagccgcaccgacttgagcaccttcagcttctcggtgagcagcgcctccgcgtcgaacgcgatgggttcctccatcgcggtgagcgccatcagctgcagcaggtggttctggatgacgtcacgggcggcgccgatgccgtcgtagtagccggcccggccgccgatgccgatgtcctcggccatggtgatctgcacgtggtcgacgtaggaccggttccagatcggctcgtacatctggttggcgaagcgcagcgccaggatgttctggacggtctccttgcccaggtagtggtcgatgcggaagacctggtccgggtcgaacacctcgtgcacgatccggttcagctcgcgggcgctggccaggtcgtggccgaacggcttctcgatgaccgcgcgccgccaggagcccttcggtccctccgccagaccgtgcttcttcagctgctgcacgaccttggggaagaacttcggcggtacggagaggtagaaggcgaagttgccgccggtgccccgggaggcgtccagctcctccaccgcaccgcgcagctgcttgaacgccgtgtcgtcgtcgaagtcgccggggatgaaccgcatgccctcggcgagctgctgccagacctcctcgcggaacggcgtgcgcgcgtgctccttgacggcgtcgtgcacgacctgcgcgaagtcctggttctcccagtcgcgccgggc

SEQ ID NO: 535 - DNA, 2177 bp, Unknown
  Kingdom: Bacteria, Phylum: Actinobacteria, Class: Actinobacteria, Order: Streptomycetales, Family: Streptomycetaceae, Genus: Streptomyces
agaagccgttgccggtgttgacgctccagttgccgctcgactcgcaggcggccaccttgttccaggtggccgcgtcggccgcgtacgccgtaccggcgccgatcagcgggatggccatgcccgcgccgcccaccgtgaccgtcagtgaggcgcggttgatcctgttcggctggtaccggcggtgccggccgcgtgcggccatgtccgttccccctcgccatgcgtcaggaggggcaaaagtagatgccgcgaacgagccatgacaagacggcaatcagccgcttccggcgaccaagtgacgtgtaccgtacatgtgttgaccggatcaaggacgacgggggacgggagacggacggtgacgtccgggagagaggccggggcggcagggagcaacggcagggaacagcagacggtacggatgtgcggccgacgtaccggcgggccaggatggtcacagggcggcgaagccccccggccggccccacggacgggacggcaggccccacggacggacggcagaccccacggacggacggcagaccccacggacggacggcagaccccacggacggacggcagaccccacggacggacggcagacccatggacggacggcaggccccggcgatccaccggatctttgaggagcaggcggtatgagcactacagcccagatcggcgtcacgggactcgcggtcatgggccgcaacctcgcccggaacttcgcgcgcaacggctacacggtcgcgctgcacaaccgcacggtgtcacggacgaggtcactggtggaggagttcggcgacgagggcgacttcgtcccggccgagaccgccgaggagttcgtggcggcgctggagcgcccgcgccggctggtcgtcatggtgaaggcgggcgagccgaccgacgcggtgatccgtgagttcgcgccgctcctcgaacccggcgacatgatcatcgacggcggcaacgcgcacttcgcggacacccggcgccgcgagcgggagctgcgcgagcagggcatccacttcgtcgggacgggcatctccggcggtgaggagggcgcgctgcacggtccgagcatcatgccgggcggttcggccgagtcgtacgactcgctcggcccgatgctggagaagatcgcggcgaaggcggcggacggcgcgccgtgcgtgacgcacgtcggtccggacggcgcgggccacttcgtgaagatggtccacaacggcatcgagtacgccgacatgcagctgatcggcgaggcgtaccagctgctgcgcgacgtggccgggtactcccccgcgcagatcgcggagatcttccgcacctggaacaccgggcgtctggactcgtacctgatcgagatcaccgcggaggtcctggcgcacgtggacgcggccacgggcaagccgttcgtggacgtggtggtggaccaggcggagcagaagggcaccgggcgctggacggtgcagatcgcgctcgacctgggcgttccggtgtcgggcatcgcggaggcggtcttcacgcggtccctgtcgggacacgcggcgctgcgcgaggcctcccgccacctcacgggcccgaaggcgtcgccgctgtcggagtccgaggccgcggcgttcgccgaccgcgtcgagcaggcgctgtacgcgtcgaagatcgtgtcgtacacgcagggcttccacgagatcgcggcgggcagcgaggagtacggctgggacatcgacctgggcgcggtctcctcgatctggcggggcggctgcatcatccgcgcggcgttccttgaccgcatccgggccgcgtacgacgcccggccggacctgccgagcctgctgtccgacgacacgttcgcgcaggagatcgcggcggcccaggacgactggcgcgaggtcctggtcgccgcgacccgccagggcgtggccacccccggtttcgccgcggcgctggcctactacgacgccctgcgcgccgaacgcctgccggccgcgctcacccaggggcagcgcgacttcttcggcgcgcacacctaccgccgcgtggaccgggacggttccttccacacgctgtggggcggggaccggtcggaggtgacggcgtaggcggcgcgccgacaggcgacgcgggccgctcgccctgacggcggtggccgcccctgacggcagcggcccgccgccgtcagg

SEQ ID NO: 536 - DNA, 14034 bp, Unknown
  Kingdom: Bacteria, Phylum: Actinobacteria, Class: Actinobacteria, Order: Streptomycetales, Family: Streptomycetaceae, Genus: Streptomyces
ccgcggccgcggccgcggcaggccctccggcaagcgcaggtgaccgcggtgaccgacatcaaggagctgctgctcagccgcatccgcgacgtggccgactatcccgagcccggggtgatgttcaaggacatcaccccgctcctcgccgacccggcggccttcgccgcgctcaccgaggcgctggcggagatcggcacccggcacggcgccaccaaggtcgtcggcctggaggcccgcggcttcatcctcggcgccccggtcgccctgcgggcgggcctcggcttcatccccgtgcgcaaggcgggcaagctgcccggcgcgaccctccgccaggcctatgacctggagtacggctcggcggagatcgaggtgcacgccgaggacctgaccgccggcgaccgcgtgctcgtcgtcgacgacgtcctcgccaccggcggcaccgccgaggcctccgtccagctcatccgcagcgcgggcgccgaggtcgccggtgtggcggtcctgatggaactgggcttcctcggtggccgcgcccgcctggaggacgttctggccggagccccgctggaggcgctgctgcgggtctgagcaccccgcgcaccaggccgcgcacacccgcggcacagcacgcgagacgggcccggaggaatccggcgcccgtctcgtgcgttcctccagtgaacggcccccgcgtcgggctggaggcgatccgggagcgcgggatcgctaccatgggatctccggagcctgaccgggggacccggatcgcgcacgaggagtcctcttgccagacgaggcccagccactgaccgccgccaagcccgagtccgcctcggcagccgcggcgaagcccgcgccgaacgcgacgagtgcgaagaacgacacccgcgggccggtcgagcgcgccccgtccgcgcccgtcgagaagtccgccgagtccgtgcgtcccaaaccggctccgcccgtgcgcccggccaccggccagagcgcccgttccggctcctccaaccgcgtccgcgcccgcctcgcccgcctcggtgtccagcgcgccaacccgtacaacccggtcctggagccgctgctgcggatagtgcgcagcaacgacccgaagatcgagacggccacgctgcgccagatcgagcgcgcctaccaggtcgccgagcgctggcaccgcggccagaagcgcaagagcggcgacccgtacatcacgcacccgctggccgtcaccaccatcctcgccgagctgggcatggacccggccacgctgatggccggcctgctgcacgacaccgtcgaggacaccgagtacggcctggaggacctgcgacgcgacttcggcgacgtcgtcaccctgctcgtcgacggcgtcaccaagctggacaaggtcaagttcggcgaggccgcgcaggccgagaccgtgcgcaagatggtcgtcgccatggccaaggacccccgggtcctggtcatcaaactcgccgaccgcctgcacaacatgcgcaccatgcgctacctcaagcgcgagaagcaggagaagaaggcgcgcgagaccctggagatctatgcgccgctcgcccaccgcctgggcatgaacaccatcaagtgggagctggaggacctcgccttcgcgatcctctaccccaagatgtacgacgagatcgtccgcctcgtcgccgagcgcgcccccaagcgcgacgagtacctcgccatcgtcaccgacgaggtccagtccgacctgcgcgccgcccgcatcaaggcgaccgtcaccggccgcccgaagcactactacagcgtctaccagaagatgatcgtccgaggccgtgacttcgcggagatctacgacctggtcggtatccgtgtcctggtcgacacggtccgcgactgctacgccgccctcggcaccgtgcacgcgcgatggaacccggtccccggccggttcaaggactacatcgcgatgcccaagttcaacatgtaccagtcgctgcacaccacggtcatcggccccaacggcaagcccgtcgaactgcagatccgcaccttcgacatgcaccgccgcgccgagtacggcatcgccgcgcactggaagtacaagcaggaggccgtggccggcgcctccaaggtccgcaccgacgcgcccaagtccacaggcaaggccggcaaggacgccgccatcaacgacatggcgtggctgcgccagctcctggactggcagaaggagaccgaggaccccagcgagttcctggagtcgctgcgcttcgacctctcccgcaacgaggtcttcgtcttcacgcccaagggcgacgtcatagcgctcccggccggcgccacccccgtcgacttcgcctacgccgtccacaccgaggtcggccaccgcaccataggagcccgggtcaacggccgcctcgtcccgctggagtccaccctggacaacggcgacctggtggaggtcttcacctccaaggcggcgggcgcggggccctcccgtgactggctcggcttcgtcaagtcgccgcgcgcccgcaacaagatccggggctggttctccaaggagcgccgcgacgaggcgatcgaacagggcaaggacgccatcgtccgcgccatgcgcaagcagaacctgccgatccagcgcatcctgaccggcgactcgctcgtcacgctcgcgcacgagatgcgctactcggacatctccgcgctgtacgcggcgatcggcgaggggcacgtctcggcgcagaacatcgtgcagaaactcgtccaggccctcggcggcgaggaggccgccaccgaggagatcgacgagagcatgccgcccgcgcgcgggcggggccgcaagcgccgctccagcgccgacccgggtgtcgtcgtcaagggcgtcgacgacgtgtgggtcaaactggcccgctgctgcacgcccgtacccggcgacccgatcatcggcttcgtcacgcgcggcagcggcgtgtcggttcaccgcagcgactgcgtcaacgtggagtcgctgtcgcgtgaacccgagcggatcctggacgtcgagtgggcgcccacgcagtcctcggtcttcctggtcgccatccaggtcgaggccctcgaccgctcccggctgctctcggacgtcacccgcgtgctgtccgaccagcacgtcaacatcctctccgcggccgtccagacctcccgcgaccgcgtcgccacctcccgcttcaccttcgagatgggcgaccccaagcacctgggacacgtgctgcgcgccgtgcgcggtgtggagggcgtctacgacgtgtaccgggtcacgtcggcccgcagccgcgcctgagcaccagaggcaccaggaagcaccagaagacgccgaactcctgcaggcccttcagtgcctggtccaggagcgcctggcggccctccagctcgcgcgccagcttgtcggcccgggcggagttgccctgggcgcgcgcctgctcgatctggccgcgcagcttgtccacggcggcctggagctgaccggtcaggccctcggcacgcgcgcgtgcctccgggttcgtccggcgccactcggtctcctcggcctcctgcagagcccgctcgaccgtgtgcatccggccctcgacccggggacgggcgtcccgcggcacgtggccgatggcctcccagcgctcgttgatcgagcggaaggcggcccgggcggccttcagatcgccgaccggcaggagcttctcggcctcctcggccagctcctccttcagcttcaggttctccgcctgctcggcgtcgcgctcggcgaacaccgaaccgcgcgcggcgaagaagacgtcctgggcgccacggaaacggttccacaggtcgtcctcgtgctcgcgctgcgcgcggcccgcggccttccactcggccatcagctcgcggtagcgcgccgccgtcgcaccccagtccgtggagtccgacagcgcctcggcctcggcgaccagccgctccttggtcttgcgggcctcctcgcgctgcgcgtcgagctgcgcgaagtgcgccttgcgccgcttggagaacgccgaccgggcgtgcgagaagcggtgccacagctcgtcgtcggacttgcggtccaggcgcggcaggcccttccaggtgtccaccagggcgcgcagccgctcaccggccgcccgccactggtcggaaccggccagctcctccgcctcggtgaccagggcctccttggcgtgccgggcctcgtccgcctgccgggcgcgctgcgccttgcgctcctcgcgccgcgactcgacggtctccaccagcttgtccaggcgggcgctcagggcggccaggtcgccgaccgcgtggtgcgcgtcgacctgctcccggaggtggtcgatcgcggcctgggcgtccttcgccgacaggtcggtggtccgcacgcgcttctcgaggagaccgatctcgaccaccaggccctcgtacttgcgctcgaagtaggccagcgcctcctcgggggagccggcctgccaggagccgacgacctgctcgccgtcggccgtacgcacgtacacggtccccgtctcgtcgacgcggccccacgggtcgctgctcacagcgcctcctccacatgatgcctgcgaggggcttcgaaggctcccccgggcatcgtccacagtttcgtcacggccaacataggcgaccagcgggtttcctgtccgcatccagcgcgaccgaaatcaggcagtcgacgctcaggacttcgtgaccgtcgccttgttgatcacgaccgtcgcgttcggcgctccgtcgccggcgccggtgctctcgcccgcggcggcgatcttcttcagcaccgacatcccggatgcggaaatcgtaccgaacggtgtgtagttgggcggcagctgactgttctggtagacgaggaagaactggctgcccccggtgtgcttctgcccggtgttcgccatcgccaccgtgcccgccgggtagacgttgcccttgaggctcttgtccgacaggttctcgtcggggatcgtgtaccccggtccgccggtgcccgtcccggtcgggtcgccgcactgcagcacgtagatgccgttggtggtgagccggtggcacttggtgtggtcgaagaagcccttcccggccaggtagtcgaacgagttcacggtgtgcggggcggcggacgccttcagcgacacgtctatgtcaccgcacgtggtcgcgagcttcatcgtgtacttcgccgacgtgtcgatggacatcgccggctccttcttccagctcagcttcttcaccgaacccgcggcgggcttcgcgcacgggtcgggcgtcttcttcggcgccgacgcgctgggggagacgtccgcgctcgcgttggccttgttgtccttcttgtcgctcttcagcgccccggtcgtgtacagcgccacaccgccgatgacgaccacgccgagcaccgacgcgatcaccgagttgcgtgtgcgcgccttgcgccgtgcggcggtgcgccgctgctgctgccgcaagaacttctcccgggcgagctgacgccgccgctgctcctggctgaccaccgggttctctcctcatgcgtctcgtgtgccgaccggcacccgcgcgcccggtgaaccgggcgcccgtgtgtgccccgtaccgtatatgggttcgctgaggatccggcagcgccggtagtctctgaccacaggcgcagccacccgatgcctcccgtatcgacacaaacgaaggacgatcgtgctcattgccgggttccccgccggggcctgggggacgaactgctacctcgtcgcccccgccgccggtgaggagtgcgtgatcatcgaccccggccaccaggccgcccagggcgtcgaggaagcgctgaagaagcaccgcctcaagcccgtcgccgtcgtcctcacccacggccacatcgaccacgtggcctcggtcgtcccggtctgcggcgcgcacggcgtccccgcctggatccacccggccgaccggtacatgatgagcgaccccgagaaggccctcggccgttccgtcggggcccagctgatgggcgagctgaccgtgggcgagcccgacgacgtcgaggaactgaccgacggcgcgacgctgcggctggccggcctggagttctccgtcgcgcacgcccccggccataccaaggggtcggtgacgttccggatgcccgagaccgcggacatcccgcaggtcttcttctccggggatctgctgttcgccggctccatcggacgcaccgacctgcccggcggtgacatggacgagatgctcggatcgctggcccgcgtgtgcctgccgctcgacgactcgaccgtggtgctgtcgggccacggcccccagacgaccatcggccaggagcgcgccaccaacccgtacctgcggcaactggccgcgggcagcgccgcacacggcgccggtgaggctccccgacgaggaatgtgacgagagacttcgtgagcaccttcaaggcccccaagggcacgtacgacctgatcccgccggactccgcgacctacctcgcggtccgcgaggccatcgccgccccgctgcgcaactccggctacggctacgtcgagacccccggcttcgagaacgtcgagctgttcgcccgcggtgtcggcgagtccacggacatcgtgaccaaggagatgtacgccttcgagaccaagggcggtgacaagctcgcgctgcgcccggagggcaccgcgtccgtgctgcgcgccgccctggaggccaacctccacaaggcgggcaacctccccgtcaagctctggtactccggctcctactaccgctacgagcgcccgcagaagggccgttaccgccacttctcccaggtcggcgcggaggccatcggcgccgaggacccggcgctggacgccgagctgatcatcctggccgaccaggcgtaccgctcgctcggcctgagcggcttccgcatcctgctcaacagcctcggcgacaaggagtgccgccccgcctaccgggcagccctgcaggacttcctgcgcggcctggacctggacgaggacaccagccgccgcgtcgacatcaacccgctgcgggtcctcgacgacaagcgcgagtcggtgcagaagcagctcaccggtgccccgctgctgcgcgactacctgtgcgacgcctgcaaggcgtaccacgaggaggtccgcgaactcatcagcgcggcgggcgtctccttcgaggacgaccccaagctggtgcgcggcctggactactacacgcgcaccaccttcgagttcgtccacgacggcctcggctcgcagtccgcggtcggcggcggcggacgctacgacggcctgtccgagatgatcggcggccccgcgctgccctcggtcggctgggcgctcggcgtggaccgcaccgtcctggccctccaggcggagggcgtcgaactccgactccccgcggccaccagcgtgttcgccgtcccgctcggcgaggaggcgcgccgggtgctgttcgcgaaggtcaccgagctgcgcaaggtcggcatcgcggcggacttctcgtacggccacaagggcctcaagggcgcgatgaagagcgccaaccgcagcggcgcccgctacaccctggtggccggcgagcgcgacctcgccgacggcgtcgtccagctcaaggacatggagtccggcgagcagtcggcgatcggcgtcaacgagatcgtcgcggaactggagtcacggctcggctgagccgggccggggtgtgcgccgggcgccggcgcacacccgccaggatcaccccgtacgccggtccctccagcggaacgtcagcaggcacagcaccaggccgccgacgcaccaggccgccaggaccagcgccgtccgcccggactcccggctgcccgcctgttccagcacccgtgcggagtccggcaggaacaccccgcgcaggcactggcagagccacttgagcgggaagacggcaccgatgtccagcatccaaccggggatggtgctcacggagatgtacaccccggagacgaactgcagcaccaggaacggcaggacgaccacggaactggcgctcctcgccgaccggggcaccgaactgatcgcgatgcccagcagcgcgcagccggtcagcccgagcacgaagatccaggcggagtcgaaccagcgggccgcgtccgagggcaggtccacgtcgtggagcgtcgtccccccgagcagcgggacggccgtctccaggaccccggtgaccagcaccagccagatcttccccaggaagtacgccgacggcggcatcggcgtgccgcgcagccggcgcagcaccttctcgtcccgctccaccgcgatggagatgcccagcgactggaaaccgtcacagcggggacgtacagctgcgaggcggtgacgccggcgccctggacgtcgtcgtggaagatcgacgcgaacaggaacaggaagacgaccgggaaggcgaaggtgaacaccacctgctcgcgctgccggaagaactgcctgagttccagcgcgccccggctcagcctgatcccccgcgcacccggcaggcgaccttccgcggcccgggccccggtccgcgcggcggtcgtcgtcatcggacgtcctcctgcccggtcagccgcaggtggacgtcctccagcgtggggctgctcaccgtgaggccgggtatctcgccgtcgaagcggcgcatcagcgcggcgacggccctggtgggggcccggtgtgctcggcgcgcggggtgccgtcgctctgcgtccaccgcacggtggcgccggtgccgtggcgctcgcgcagctcgtccggggtgccctcggcgacggtccgtccggcggcgaccaccgccggccggccggccggcgcctcggcctcctccaggtggtgcgtggtcagcaggatcgtcgtgccctcgtcggcgagcagccggatcaggtccgggaccggcgccgcgccgccggatcgaaaccggtcgtcggctcgtccaggagcagcagcccgggtccgccgatgacaccgagggccacgtcgaggcggcgccgccggccgcccgagagcgacttgatccggccgcccgccttcgcctccgggccgaccagcgcgatgacctcgtcggggtcgcgggggcgggggtagcagcgggcgaaatgacgtacggtctcgcggaccgtcaactcggcgggcgcggattcgtcctgccagacgatcccgatgcgcgagcgccacccgcgcgtgccgctcgccgggtccgagccgaggaccgagacctctcccgcgtcccgcccgcggttgccctggaggatctccacggtggtgctcttgcccgccccgttgggcccgagcaggccgaagacctcgcctttctcgatgcggagaccgatcccgtcgacggcggtgacgtccccgtagcgcttgcgcagcccccgtacggtcaccgcgagttcgttcgatgtcatgggcagagcgtggcccggaaccgtccgttcagggacccgtgcgcagctctccttatgtcgatcgaacggtgcgcacgcgcgcgcgtgcggcacaatggcccctgcccgaagaaggtccgactctcaagtgacggaatcggcgtgatgagcaagacgacagtcaaggacgtctccacggagcccggtccggaacccgcggccaccggcgcacggacagcgggcggcagccgcgccttcgccctgctgctggtgatcgccggcgcggccgggctgctcgccgcatgggtcatcacgatcgacaagcagaagatcctcgaaggcaagctgaccggcaagaccttcacgccgagctgcagcctcaacccgatcgtgtcctgcggcagcgtcatggagagcaagcaggccgccgccttcgggttccccaacccgatgctcggcctggtctgctacggcctcgtcatctgcgtcgggatgagcctgctcgccggcgcccgcttcccccgctggtactggctgaccttcaacttcggcacgctcttcggcgtctgcttcgtcacctggctgcagttcgagtcgctgtaccggatcaacgcgctgtgcctgtggtgctcgctggcctgggtcgccacgctcaccgccttctggcacacgacgtccttcaacatccgcaacggcttcctgcccgccccgcgcccggtgaagaacttcctcgccgagttcacctgggtcatcccggtcacgcacagcggcatcatcgccatgctgatcctgacccgctggggcagcagcctctgggcctgagccggcctcggcgcgccccccgggccccggccaccgggcccgagcccggcccggcgccatgggccccggccgcgttgtcagtggtgtgccatagggtttcagcgtggagcccgacctgttcaccgccgcagcagaagaacgccaggagaaggacccggccgccagccccctcgcggtccggatgcgcccgcgcaccctcgacgaggtggtgggccagcagcacctgctcaagcccggctcgccgctgcgccgtctcgtgggggagggcgcgggaggaccggcggggccctcgtcggtgatcctctggggcccgcccggcaccggcaagaccaccctcgcctacgtcgtctccaaggccaccaacaagcggttcgtggagctgtcggcgatcaccgcgggcgtcaaggaggtccgcgcggtcatcgacggcgcccgccgcgcctccggcggctacggccaggagaccgtcctcttcctcgacgagatccaccgcttcagcaaggcccagcaggactccctgctcccggcggtggagaaccgctgggtgacgctgatcgccgccaccacggagaacccgtacttctcggtgatctccccgctgctctcccgctccctgctgctcaccctggaacccctcaccgacgacgacgtgcgcggcctgctgcgccgcgccctcaccgacgagcgcggcctgaagtccgccgtcgccctgcccgaggacaccgaggaccacctgctgcgcatcgcaggcggcgacgcccgccgggccctgaccgccctggaggccgccgccggggccgccctggacaagggcgagagcgaggtcgccctgaccacgctggaggagaccgtcgaccgggccgcggtgaagtacgaccgcgacggcgaccagcactacgacgtggccagcgctctgatcaagtccatccgcggctccgacgtcgacgcggccctgcactacctggcccggatgatcgaggccggcgaggacccccggttcatcgcccgccgcctgatgatctccgccagcgaggacatcggcctcgccgatccgaccgcgctgccgacagccgtcgccgccgcccaggccgtcgccatgatcggcttccccgaggccgccctcaccctcagccacgccaccatcgcgctcgccctcgcccccaagtccaactccgcgacgacggcgatcggcgccgcgctggaggacgtacgcaagggactggccggctccgtgccgccccacctgcgggacgggcactacaagggcgccgccaagctcggccacgcgcagggctacgtctacccgcacgacctgcccgagggcatcgccgcgcagcagtacgcgccggacgccctcaaggaccgcgagtactacagcccgagcagacacggcgccgaggcgcggtacgcggacgccgtggagtggacccgcaggcacctcggtcggaagcggtcctgagcaccctgtagactgcccggagcgctgagtcccgtgccgtcagagcgggacagtcagccggagccctggtcctcacgggccggctccaggagcgtcgcgcaccgtcgaacggtgtcgcgggcagcccaccaccacccggggcccgggacggtcggtgggccactcgcgtgctgcacgtatgtgcccagaccagggaagcggctgcccgaccggtccctcgcggaccgacgggttctcccggctgcggatgcgacctccgtaaccctgacaagccgagaactacgaaatgagagacagtggcgaaccagtcccgccccaaggtcaagaagtcgcgtgccctcggcatcgcgctgaccccgaaggccgtcaagtacttcgaggcccgcccctacccgccgggcgagcacggccgcggccgcaagcagaactcggactacaaggtccgtctgctggagaagcagcgtctgcgcgcgcagtacgacgtgtccgagcgccagctcgtccgcgcctacgagcgtgcctccaaggtccagggcaagaccggtgaggccctgatcatcgagctggagcgccgccttgacgcgctggtcctgcgttcgggcatcgcccgcacgatctaccaggcccgccagatggtcgtccacggccacatccaggtcaacggccagaaggtcgacaagccgtccttccgcgtccgccccgacgacgtcgtgcaggtccgcgaccgctccaaggagaagacgctcttcacgatcgcccgtgagggtggcttcgcccccgagggcgagaccccgcgctacctccaggtgaacctcaaggccctggcgttccgcctggaccgtgagccgaaccgcaaggagatcccggtgatctgcgacgagcagctcgtcgtcgagtactacgcccgctgatcaccagcaggccgtagcacaagcacctcagcccgccgtctccccgcccttccgggtgggcgaggcggcgggctcgcgcatgcccgccgccttgctccgcgcctgcccgcgcggccccggcagcgcccgcagcgcccgccttcccgcccgccccagggcccgcgccacggccgcctccctgctgagaccggccccctcgcgcacacactcctcgtaccgcgcatcgcccagctgtttcctggcccgcgccgcgcacagctcgtgcggcgcgttgtagtgcgccgacccgaacagccgcagccccaccgacgtccacatcacgcccgcggcgccctgcagcaccgccgcctccgccgcgtcgccctcgctcaccgtcaccagcgccagcagttccaccgccagcaccgaaccgagcaggtcgtggaagccgtgcgcgtcggcgagacagtcggcgagcaggtcacgggcgtaccgcgcgtccccctcctgccaggccgcgtacgccagcacgtacagcgcgtacgcccgcgaccagcgctccccgtggtcgtcgcagacacggcggacgtcctcgcacagccggaccgcgtccggcagatcgccctggaaggcccgtgtcatcgccagctcgacctggcccatcagcaccgtgctgttcagctcgccgatctcccggtagcgctccagcgccgagcgcagcagcgtctccgcgcgctccatgtcgtcggtgaccagggccaggcagcccgcgcggtgctcggtgtaggcgagcgccgtcgcgcacgccgaggaccgcgcggcgcgccggcactcctccagcgcggccagcgcgggcaccgtgtcgccctgcaggatcgccacgtacgccagcacccacagcgccttcagccgtgagggctcgtggccgccgtccagcgcgacggcgcgctccagccagagccggccctccgacagccggccgcacccggcccagcagaaccacaggcagcccgccaggtactggcccagatgcgcgtcttgcggaccggtcatgcagtactcgagggcgctgcgcagattcggcagctccgtctcgatccgcgccgcgacctgagcctgccgcggcgagaaccactccagctcgcaccaggtggccagtccgacgtaccagtcgcggtggcgccgccgcagccggtcggcgtccccggtcgcggccagccagtcggcgccgtaggcacggaccgtctccagcatccggaagcgcacacccgacggcgtctcctcgcgcgccagcacggactgcgccagcaactcgcccagcacgtccaggacatcctcggcggcgagcccgccgccgctgcacacgtactcgacggcctccaggtcgaacggcccggtgaagaccgagagccgcgcccacagcaggcgctccgcgggcgtgcacagttcgtggctccagccgatcg

SEQ ID NO: 537 - DNA, 4530 bp, Unknown
  Kingdom: Bacteria, Phylum: Actinobacteria, Class: Actinobacteria, Order: Streptomycetales, Family: Streptomycetaceae, Genus: Streptomyces
gacgcgacgagcggcgtcgaccgctgacaccggccgccgggacaccggccgccgggacaccggccgggcgggggacgggcgctcagcgcgagggaaccgcgctcagcgccggggatccgcgctcagcgctccccgcccggcacccacagcacgtcgccggtctccttgttcgccgtgcgcgccaggatgaagagcaggtcggagaggcggttgaggtaggtcgcggtgagcgggttcatcacctcgccgtgcacctccagcgcggcccaggtggaccgctcggcccggcgcacgaccgtgcacgcctggtggagcagggccgcgccgggcgtgccgcccggcaggatgaaggagcgcagcttctccagctcggcgttgaagcggtcgcagtccgcctccagccggtcgatgtagaactgctcgacccgcagcggcgggaactcggggttctcggccaccggcgtggacaggtccgcgcccacgtcgaacaggtcgttctgcacgcgggtgaggaccttcacgacctccgcgtccaggccgcccagcgcgatggcggtgccgatcacggcgttcgcctcgttggcgtcggcgtacgccgagatccgcaggtcggtcttggcgacccggctcatgtcgccgagggcggtggtgcccttgtccccggttctggtgtagatgcgtgtcagattgaccatggcaccagcgtagttacgccccggccgtgcggaagacccgtgtgcccacggtcacggccagcgcggcgaaggcgacggcgaccagggcaccgtagagcatgtgcgcgctggtgtacgagccgacgtacgcgtcgcgcaccgcgtccaccagatagcggaacgggacgaagtgcgagagcacgtccagccagcccggtgccagggtcatcgggagcatcaggccggacagcagcatggacggcatcgacacggcgttgatcatcgggccgaactgctgcggggtggcgaccttcatcgccatcgcgtaggacagcgaggcgagcgcgagcgtgagcagggcgacgaacgcgaagccgatgaggacgccggccagcggcgcgcgcagccccatcaccacggcggccagcaccagcagcacggcctggaagacgaagacggtggcgtcgcgcagcacccggcccagcagcagcgcgagccggctgacgggggtcacccgcatccgctccagcacgccctgccccttctcgatgatgatcgtgaagcccgcgaacagggcgccgaacaagccgagttggagcagcaggccgggcacgagcatctgccaggagctgccgccgccgcccagcggcagaccggtgagcagcggtccgaagaagagcaggtagagcaggggcgtcagcaccccgaagagcagcgcgaagcgcgagcgcagggactggcgcaggtagcggccgtagatgagggccgtgtcgtggaggagcatcggtgtccttgagggtgcgctagacggcgacgggagcggtgtccgcggcgggggcggggccgcggccggtgatggcgaggaaggtgtcctggagggaggcgtcgagcgagccgccgtaccgcagcttgagcgcgctcggcgtgccctccgccacgaccacgccctggtcgacgacgaccagccggtcggagagggcgtcggcctcgtcgaggtagtgggtggtcaggaagacggtcgtgccctgttcgtcgcgcagccggcgcaccaggtcccacaggtcggcgcggctgccggggtccaggcccgtggtcggctcgtcgaggaagagcacgcgcgggcggtgggtgagggccatcgcgatgtccagccggcggcgctggcctccggagagcgcggacgtcttgcggtcgagcaggccggtgaggtccaggtcgcgggccagctcctcggcgcgttcgacggcccgcgccttgggcaggcggtacatccggccctgggtgaccagttcctcgcgcacggtgatctggccgtcgacgccgccggactgcgccacgtatccgcaggcgcgccgcaccccggccgggtcgccggccaggtcgcggcccgcgacggtggcggtgccgccggtcggggccagcagggtggtgagcattcgcagggtggtcgtcttgccggcgccgttggggccgaggaagcccaggatctcgccctcgcggacggtcaggtcgatgccgcgcaccgcctcgaccgggccgcgcttcgtctggaaggtgcgggccagtccggccgcgctgatgactgctgctgtcatgccgacagaaaaacagagactctgaaattttgcaatgtctctaaattttaagagggtgcagaaatgggtgcaggctaggattcccccatggcagaggggctcagggagcggaagaagcggcagaccaggcagtacatctcggacgtcgccaccggcctgttcgtcgagcgcggcttcgacgccgtcacggtcgcggagatcgccgacgcggcgaacgtctccgtcaacaccgtctacaactacttccccgccaaggaggacctcttcctcgaccgctccagcggggtcgtcgaccggctcgcccgctgggtgcgcggccgggacgcgggggagtccgccgcccgggccgtgctgcgcgaactgcgcgcggaggtcgaggccgtctcgccgcgcatcgggctgttcgacgggtacgcccccttcatgcgcgtgatcgaggccgcgcccgcgctgcgctcccggctctgggccgtcggccaggaggtgcaggccaacctggagcagaccctgcgggaggagaccggcgcggcggacgacgacccgctgccgggcctgatggccggtcagatcagctggctccacggcaccgtcatggccgtcgtcggacgcgagatgctcaaggagcgcgccccggacgaggtgtcccgcgaggtgctcggcctcctcgacgacatggaggacctgttgagcgagaaggtgctcaactacgccgtccgaggcgcgcagtgacccctgccggtgtgatgtccgtcaattgagacgtgacgcgcgttacttaccggtcacacagcgccgcgcgggcgctagtgtccgccgagaggcatacgcaaacagcgtgaaagccgtccttcagccgcgcgcacagcgcgcaggcgcctgcgcagtcgttcaccagcagtcgttcacaaggggtgtctcagtggcacggaagctcgccgtcatcggagccggtctcatggggtccggcatcgcccaggtctccgcgcaggcgggctgggacgtcgtcctgcgagacgtcacggacgaggcactcaggcgtggcaccgacggcatcaaggcctcctacgacaagttcgtgagcaagggcaagctggcggccgaggacgccgaggccgcgctcgcccgcatcaccaccaccaccgacctggacgccgccgccgaggcggacgtcgtcgtggaagccgtcttcgagaagctcgacgtcaagcacgagatcttccgcacgctcgacaagctggtccgcgaggacaccgtgctggcgtccaacacctccgccatcccgatcaccaagatcgcggcggtgaccgagcgccccgagcgcgtcgtcggcgtgcacttcttctcgccggtgccgatgatgcagctcgtcgaactcgtccgcggctacaagaccagcgacgaagccctcgccaccgcacgggagttcgccgagtccgtcggcaagacctgcatcgtcgtcaaccgcgacgtggccggcttcgtcaccacccggctcatcaccgccctcgtcgtcgaggcgaccaagctgtacgagtcgggcgtcgccaccgccgaggacatcgacctcgcctgcaagctgggcttcggccacgccatgggcccgctcgccaccgccgacctcaccggcgtcgacatcctgctgcacgccgccggcaacatctacaccgagacccaggacgagaagttcgccccgccggagctgatgcgccggatggttgacgccggtgacatcgggcgcaagagcgggcagggcttctacaagcactgagaccgcttcggggaccccggcatcacccttcggggtgaattcggtatcggttcgcacacagacagcaaccggaccgccgcacaagcagtcagacgttgcacagccaaccgtcacacggagcacgccaccgcattcacggggagcgcatatgtacatcaggggcgaccacgccgaggtggtcgtcgggggccgcctcgacgtccgcaccgcggcggacgcccgtacggtcctgcactcggccgtggacgacggcgcgggcgacctggtcctcgacctgtccgggctcgactcctgggacgccaccggcctcggcgtgatcatgggcgcccaccggcgcgccggccgctgcggccggcggctggtgctgcgcggcgtgcccacgcagatgcagcgcctgctggtggccacccggctgcaccgcatcctcgccatcgagggcggcatcggcgtggagtccctgccccgcgtgtgagagcccgcccgggtacggcac

SEQ ID NO: 538 - DNA, 1580 bp, Unknown
  Kingdom: Bacteria, Phylum: Actinobacteria, Class: Actinobacteria, Order: Streptomycetales, Family: Streptomycetaceae, Genus: Streptomyces
tgcacgtacggctccaggccctcggcgggggcctggagccgtacgtgcacaaggcgtccgaggcggccccggtcgcgaccacgctgcgcgcgcctgcgggtgtcgccgcctccgacctggtggcccgcgccctggagtcggacccggccctcccgctggccgcgggcggcggtccgctggccaaggagatgatccgggtcaaccactacggcccggacgcaaccccggaaaccgtcgaggcgaccctgacggccctggccgccgcactgaccaccgagcggaacacggaagtcgacctccaggccgcccaccgggccgccgcccgggcctggaactagccgccgccccccggacctgaaggctcggggcgctggaccggggggccgaaaaggcaccgttgccccggccccctggggtgccatgctgcccgcatggctcttgaagcaccccagacgctgcccgacggccggcccgtgcccctcatgacgggtgccgaacgccccatgctggagagctggctcgacttccatcgcgccaccctggaggcgaagtgcgccgggctggacgacgagcggttgcggaccgcgtcggccgagccgtcggcgttgacgctgctggggctcctccagcacctcgccgaggtcgaacggaactggttccagcgggtggtcggcgggctggacctgccgcccgtcttcgaggaggagaccgggtacgtcctgcggtccgcgcgcgggttcggtgaggtgctcggcatctggcggcgcgaggtcgcccgcgggcgggagatctgtgccgggcgggcgctggacgacacggggctgatcggcggcgggccgatggcggggtgcgtggtcagcgtgcggtgggttctcatccacctgatcgaggagtacgcccggcacaacgggcacgccgacattctgcgggagcggatcgacggggtcaccggggcgtgagaacaaatcaagcaactccaagtaattcctggaattaaattccgggcagcttcccgccttcttctgccccgttttccaattcctaaacgcaacgatttcacgaacactcggcgactcaattacaagcctcgcacgggcgcgtccgtagagttacgccatcgtgatgcactccacaaagccgtcccttttgtgccggtaatttcggaacaaagcgcgcatctcaaccagctctcgcgcgaccgcacgcccgcgcgataacacacatggccgttgcacgtaagagcaatgggcgatgcatttttcaattcagctcggtaagttcaattcacatgactgccgcacaagcagacctgcgaaccgaccgggcggaaatagcggacaccgtgtccatcgagccccccgccgtcgccgacggcgccgcgctctggaggctcgccaaggactccgggacgctggatgtgaactcctcctacagctacctgctgtggtgccgcgacttcgccgccacgtccgccgtggcgcgcgacgccgacggcgagcccgtcggtttcgtgaccgggtacgtgcggcccgaccgtcccggcacgctcctcgtgtggcaggtcgccgtcgacgccggcc

SEQ ID NO: 539 - DNA, 4217 bp, Unknown
  Kingdom: Bacteria, Phylum: Actinobacteria, Class: Actinobacteria, Order: Streptomycetales, Family: Streptomycetaceae, Genus: Streptomyces
ccgaccgttccgtcggcccggccgccttggtgccgacccggcggctcgtgctgttcacgtgcggccgggccgacggaacggtcgggaccacacccgaagaggagccggaccaagcggccggggccgcactcgaacactcctggccgcgggccgtaccgaggccgtcgtaccgagagaagtgagatccatggccgatgacacgggccgcagtgccctgcctctgccggactacgaccatctgcccctcggtgccctggagagccgtgtgcgctccctgcccgccgaggaggtcgaggagctgctcgcctacgaacgcacccacgccgaccggatgcccgcgaccgaggtgctcaccgcgcgcctgctgcaactgcggtcgggcgccgggacctcccccggcgaccccgccgcgccgcgccccgagcggcgggagggacacacgggctcccgggtgaccccggcgacctcgcccgagccgtccagcccgcctccgcacggcacgccggaccagcccggcgagccgaagggcgaccgcacgtagagcgaacgtcacgcctggtttccggaagcggtgcacgggcacccgtgcgccgtgctgatgcggaggaggagggcccgggccgcggccgggctccgtgatgcggccgagcgagccaccgaccacgtggacgggcgggcgcccgtgtacgaagcgggtggccttctgcggaaggccttcccggagcactggtcgttcctgctgggcgagatcgcgctgtacagcttcgtggtgctgctcgtgaccggcgtctggctgacgctgttcttccatccggacatgaccgaggtcgtctaccacggcacctacaccccgctggacggcatccggatgtcggccgcctaccgctcgacgctgcacatcagcttcgacgtgcgcggcgggctgctgatccggcagttgcaccactgggcggcgctggtcttcgtcgcggcgatcggcgtgcacatgctgcgcgtcttcttcaccggcgcgttccgccgtccccgcgagatcaactggatgatcggcgtgaccctgttcctgctggcgctggccgagggcttcgcgggctactcgctgccggacgacctgctgtccgggacgggactgaggatcgcgcagggcgtcatgctgtcggtcccggtcgtcgggacgtacatcggattcctcgtcttcggcggccagttccccgggcacgagctgatctcgcggctgtactcgctgcacatcctgctgatccccggcctgttgctcgccctcgtcaccgcccatctgatcctggtgttccacctgaagcacacccagtgggccggccggggccgcaccgaggccaacgtggtgggcaagccgctcttcccccagttcgccgccagttcactcggactgctctgcacggtggccggcgtcctgaccgtgctcgccggagtggcgcaggtcaaccccatctggaagtacggcccttaccgtcccgacatggtgtcgagcggctcgcagcccgactggtacgtcgggttcctggagggctcgctgcgcctcgtaccgccgtgggagacgtccgtcgccgggcacaccgtcatgtggaacgtcttcctgcccgccgtcgtcctgccgctcgccctgttcgccgtgctgtacgcgtacccgttcttcgaggcgtgggtcaccggcgaccggcaggaacaccacctggccgaccggccccgcgacaggcccgtacgcaccgggttcggtgtcgccgcgctctgcttctacggcgtgctgctcgcggcgggcggcaacgacgtactcgcccacaccttcaaggtctcgctgaacacgctgacctggaccttccgcgtctgtcttgtgctcctgccgccgctggccttcatggtcaccaaacgggtctgcctcgccctgcgggaggccgagctggagcggctggcgaagggcgaggagaccggcgaggtacggcagacggtgagcggcggctacagcgcccggcacgtgccggtcgacgaggagacccggtacgtcgtccgggcccggcgagtgcccaggccgctcgtctcaccggaggactccggcggggacgcgacgcgggtgcggcggctgcgggccgccctcaactcctggtactccgacgaccgtgtggcggggctgccggactctcaggacggggagccggaacggccggagcgcggcctggagcgctgagcggcgatacggacggcgacgtccgggccgctcggcgcgctcaccgggtcgccccggccggcgtgctggaacaccatgccgaacactccgcagccgagcaccccgaagcccatcagggccagccacagaccgaagacgacgcccagggccagcagcacggcaccgagggctacgacgatcggccaggggctgtgcggggagaagaagtccagcgggcccgcggtgtcgatcacctcggcgtcggagcggtcctgcgcccgcgggccgcgcctgcggtgctgcacccggaggaagaacgcgacgagcgcggccatcaggccggtgacggccagggccgcggtgccggcgggctcggcggaccaccagccgtaaccggcggcggcgagagcgaagaaaacggccacgccggtgaagagtcgcgcctcggttttcacgtgagtacctctcaggtgtctgctctcaggtgtctatcggtgtcactcggccttcatgagcactcggccctcagccttcgtgggctcggccctcatgagccggtgcgggtgacgtcggggtggtgcaggtcgaacgccggggactcggagcggatgcggggcagcgcggtgaagttgtggcgcggcggcgggcaggaggtcgcccactccagcgaacggccgtacccccaggggtcgtcggcctccgccctgcgtccgtgccgggcggacttccagacgttgtagaggaacggcagcgtggacagccccagcaggaaggcgccgatggagctgacggtgttgagggcggtgaagccgtcggcggccagatagtcggcgtagcggcgcggcatgcccatctcgccgagccagtgctggacgaggaacgtggtctggaaaccgacgaagagcgtccagaagtggatcttcccgagccgttcgtcgaggaaccggccggtgagcttgggccaccagaagtagaagccggcgaacatcgcgaacaccacggtgccgaagagcacgtagtgcaggtgggccacgatgaagtagctgtcggtgaggtgcaggtcgagcggcggggaggcgatcagcacgccgctcatcccgccgagcaggaacgtcaccatgaagccgagcgaccacagcatgggtgtctcgaacgacagggagcccttgtgcatggtgccgatccagttgaagaacttcacgccggtgggcaccgcgatgaggaacgacatcagggagaagaagggcagcaacacggcgccggtggcgaacatgtgatgggcccacaccaccgcggagagcatggtgatggcgatggtggcgccgacgagtgtgacgtagccgaagatcggcttgcggctgaagaccgggatgatctccgagacaatgccgaagaacggcagcgcgacgatgtagacctcggggtggccgaagaaccagaacaggtgctgccacagcagcgcgccgccgtcgccggcctcgaagatccgcgcgccgaacttgcggtccgcctcgagggcgagcagggcggcggtcaggacggggaacgcgggcagtacgaggatcgaggtgaacagcgcgttccaggtgaagatcggcatccggaacatggtcatgccgggggcgcgcaggcacaggatcgtggtgatgaagttgaccgcgccgagcgtcgtggacaccccggtgaccaccaggcccatcacccacaggtcaccgcccgcgccgggactgcggatcgcgctgttgagcggcgcgtaggcgaaccagccgaaccccgccgctcccccgggcaccaggaacccggacaccaccatcaggccgccgaacagatacagccagtacgacagcgcgttgagccgcgggaacgcgacgtcgggcgcgccgatctgcaacggcatgatcgcgttggtgaacccggcgaacatcggggtcgcgaacagcagcatcatcaccgtgccatggatggtgaagagctggttgtactgctccgaactgaccaactgcagtcccggccgggccagttc

SEQ ID NO: 540 - DNA, 6866 bp, Unknown
  Kingdom: Bacteria, Phylum: Actinobacteria, Class: Actinobacteria, Order: Streptomycetales, Family: Streptomycetaceae, Genus: Streptomyces
cccgaggtcccgcagggtctcggcggggcacagggcctgcaggcgcgggaacagcagctgctcctcctcgacgatgtgctccgtcgtcctggtgaccaccgcgagcagcagccgtccgaactcctcgccgcccgggtccgcggcctccagggacaccagcagctcctcggtctcctggtgcgcgcgcagctcgcgctccgcccaccggtcaccgtccggcaggtaccggcggacggcggggtagagatgggccttctccacgaccgtatggctgaccagttccgcacaggcctgctccaccagggacgtcctctcctcgctgtccgggcgggcggaccggatgcggtcgaaaagcccctggatccgctggtggtcctgcgtcagctcgtcgacgatgccgctgcgactgtccactcctgctcctcgctgaggcgccgggccgcgcggcgctccgcggggaccggcccgtcgcgaccgggcccgcgggtgtccgccgtgcggcaatgggggtgcttccggcacgcctgcgcgatgcgcccggaccgcacacccaagattgaagcacctggcagacgggcgcccccggcccgccgcgccaccggggccgcccggcggacgcctaggacgagacgtgacacgcggggacgcgtgaggacacgtgccaggcagtgacgcgtaaggagcgtgatgcgggcgtgctgatgcggcggcgcagggaacggatcgaggcgagggcgcggcaggccgcgttccaggcgtatgtcgtcgccgaccgcagggcaccggtctccgaactggccggacaggtgctgcgcaaggccttccccgaccactggagcttcctgctgggcgagatcgccctgtacagcttcgtcgtgctggtgctcacgggaagcttcctgacgctgttcttcgaccccagcctcgccgaggtgacgtaccaggggccgtacgggccgctgcggggcgtgctggtctcgaaggcgtaccagaccaccctcgacctgagtttcggcgtgcgcggcgggctcctgatgcgccagacgcaccactgggccgcgctggtcttcgtatcggccatcggggtgcacatgctcaggatcttcttcacgggcgccttccgcagaccgcgggagatcaactggttggtgggcgtgaccctgttcctgctgtccctcctggagggcttctgcggctactccctgcccgacgacctgctgtccggcacggggctgcgcaccgccaactccatcgtgcagtcgatcccggtggtcgggacgtacctcgccttcttcgcctggggcggcccctttccggggcaggcgatcagccggcggctctacatcgtgcacgtcctgttcgtgccgggcctgctgatcgccctgatcgccctgcacctgttcatggtggtgtacctgaagcacacccagtggtcggagcagggcaagaccaaccgcaacgtcgtcgggcagcccatgttcccctccttcatcggcaagtcggccgggctgtcgctgatcgtcttcggggtgctcgccgtcatgggcgccatcgcacagatcaacccgatctggaacttcggcccgtacgtgcccgaccaggtctccaccgacgcccagccggactggtacgtcgggttcctggagggcgcgctgcggctgatgcccggagtggagtggaacgtcgccggacacaccttcatgtggaacgtcctgctgcccgcggtggtggtgccgatcctgctgttcctggtgctctacagctacccgttcttcgaacgctggatcaccggcgacctggtggagcaccacctgtgcgaccgcccgcgggaccggccggtgcgcaccgcgctcggcgtcgcggccgtcgtctggtacgccgtcctgctgctcgccggaggcaacgacgtgctcgcgctcaccttcagggtctccgtcaacggcctcacctggatcttccgggtggcgttcttcgtggcccccgtcctcgcgtacctgatcaccagacgtgtctgcctggcgctgcaacgccacgagcggcagttgctgcaggagggggacgagacgggcgtggtctaccaggacctgcccggcggcatgtcggagagtcatgagggcatcgaccggcacctgcgctacaagctcctggtcagggatatcccgctgccgctgaagcacccggggcccggggcaccgctgcggcgccgcctgcaggcctcgctcagcacctggtactacggcgagcgcgtggacatgcccaccacggcggaggaacgcctgcagatcagcgggcgtacggccgacccggtggcgggcggcgccggatcgtccgaggagtgacacatgccgtgcccgcacgggggcgtgcgggcacggcatgttcctttgtgtcagcgatggggtgtgccgctgtgtcagcggtggacggggtcagcggtgggcgcggcgtccgcgtgtgacgccgatggtcagacccatcgcggccaggccgagggcggcggtcaccccacccacccagcagttgttccagatgatgcccgcccgcgcgccgtgtgtgagggtgaccacccacggggagatgaacagccacacgccgagcggcacgagcgcccacgccagccggaacatgcgttctggggccagcgccaagccgagcccgatcaggccgacggtgatgccgacgatcaggttgttgacggtgatggcgggctggatcgcgaagtgcacgacccatggtgagatcgccgcgtagaggccggccaggacgaccaggccttctatggcgatcgccgggccgctcgatgcggtgcgctcgagccgttcccgcatctccgccatctcgggatgcgagcccatcatctccggatgggcgcccacgtcactggagcgatgtggatacgacatttctgtcgtctcctctccaaaagggggttcctttgccttatgcaagggttcccccgtacgagtgacttatgcgccttttaccccggaatctcacggaaaatgacggggccgcatcgcgggctcagccgtcctgccggccgacgaaggcgagcaccatgccgatcagcccgatgccgacgacacccagaccgatcatgaagagccagaacccgtagatgatgccgatggcgcagatggtcacccccgcggcggtgatcaccgggtgcccgctgtacggcgggaagaagtcgacgcgaccgctgcgctcccggatctccccggtcggccggtcctccgggcgctggcccttgcgccggtggttgaccaggcagaagaaggcgatcacggacgacatgaagcaggacaccgtcagggcggcgatgcccgccggctcccgcgcgaaccagatgtacgccacgtcggtgagcaggaagaacaccgccacaccggcgaagaggtaggcctcggatttcattcgctctgtgtccccagggtgtcgggtgtgggctcctcggttccgtgcgcgcgggacggcaactcccgcaggacatcgggatggtgcaggtcgaaggcgggggagtcggaccggatgcggggcagcgcggtgaagttgtgccggggcggcgggcaggacgtcgcccattccagggagcggccgaacccccacggatcgtccatcccgacatcggtcccgtactggctggtcttccacacgttgtagaggaacggcagcgtggacaggccgatcaggaaggccccgatcgacgagacggtgttcagcgccgtgaacccgtcggacgggaggtagtcggcgtagcggcggggcatgccggtctcgccgagccagtgctggaccaggaaggtcgtctggaaaccgacgaagagcgtccagaagtggatcttgccgagccgctcgtcgagcagcttgcccgtgatcttgggccaccagaagtagagcccgccgaacgtcgcgaagacgatcgtaccgaacaggacgtagtgcaggtgggccacgatgaagtagctgtcggtcaggtggaagtccagcggcggggaggcgatcaggacgccactgaggccgccgagcaggaaggtgaccatgaaccccatcgaccacagcatcggcgtctcgaaggagagactgcccttccacatcgtgccgatccagttgaagaacttcaccccggtgggaacggcgatcaggaacgacagcagggagaagaacggcagcagcacaccgcccgtggcgaacatgtggtgggcccacaccgtggccgacagcatggtgatcgcgatcgtcgcccccaccatgccgacgtacccgaagaccggtttgcggctgaacaccgggatgatctccgtgaccacgccgaagaacggcagcgccacgatgtagacctccggatggccgaagaaccagaacaggtgctgccacagcagggcaccgccgttggccggatcgtagatgtgcgcgccgaacttgcggtcggcctccagcgccagcagcaacgcggtgaacaccgggaacgccagcagcgccaggatcgaggtgaacagcacgttccaggtgaagatcggcatccggaacatcgtcatgcccggcgcgcgcaggctcaggatcgtggcgatgaagttgaccgcgccgagcgtggtgctcagacccgcgatcgccagacccagcgcccacaggtcaccgccgtgtcccgggctgtgttcggcgctgttgagcggggcgtaggcgaaccagccgaacgccgccgcgccctcgtcgaccatgaacccggacagcacggtgagcccgccgaacaggaagaaccagtaggtgagcgcgttcagccgcgggaaggcgacgtcgggggcgccgatctgcagcggcatgatcgcgttggagaacccggcgaacgtgggcgtggcgaacagcagcatcatgatcgtgccgtgcatggtgaacagctggttgtactggttctcgtccaggaactgcagtcccggccgggccagttccgcccgcatcagcatcgccatgatgccggcggccaggaagaagccgaacgcggtgaccaggtacaggttgccgatcttcttgtggtccgtcgtggtcaggtagtcccggatccgttcaccggtgccgggccgggcaggacgcggggcccgccgcgacccgtccaggccgggatgtgtctgtgacatgaacgccctccacgcgcctcacggggtccggtcggccggaccgtcgaagggacgggcggcccccggtcccgaacgcggcaccggcctggtgtggatgtacagctcccggcggttgccgaccggcaccccgggcgggagcggcagctggtagtggacgggacggcggtggtcggcgagctggcgctgcgggttgtacacgcggttgaacttccacagcatccgggcgaagttggtctggccgtgcgccagccggtcggcgaggacacgggccgcgccgaacgcggtgcgcagtcccaggtgcttgcggttgatgacggactgggtgcgcaccagctcctcgtagaagcggggcagcggcagggtggtggggacgacggcgtgctggatgtcgaacaggcggtagtcgcgggtggtgagccgccgggactcggtgtgccagatctccgttcccgggtagggggtcatcacggtcaggtgcacgatctccgggacggacagggcgaactcgcgtaccagacggaaacgctcctcgtcccaggccgggtcgacgatgaggttgatggccacgttgatccccagccgccgcgcggtctccagcgcacggaagttgtcgtccgggttgacgcgtttgcggaactggtccaggccgtcggcgtccagggcctccatgcccaggaacatgtagcgcaggcccagccgggtccagcgctcgaacacctcggtgttgcgcagcagcacgtcggcacgtgtctccaggtagtactgcttgcggacccggcgccgttccagttcggcggcgatgtcgtcaccgtgctcgggccggatgaaggcgacgtcgtcgacgatgaagacgttcggctcggcgatggacgccagctcgtccgcggcggcgcgcgggctcgccttgcggtaactgcggccgtagaacgtccacgcggagcagaaggagcagtcccaggggcagccgcgggtgaactcgatcgaggcgcaggggtccagctcgccgatgaagtaacggcggcggtggcgcatcaggtcgcgggccgggcgcggttcgtcgatgccgtgcatcatgagcggcgccggaccgtgccccgcggtggtgacgatgcccgggacctcctgcaggccgccgtcgcgcaccgcccgcagcagcggcgccatggccggttccccctcgccgcgcaccacggcgtcgacggcgccgccggcctggcgcagcacgtcgtcggcgacgaaggagacgctgtgcccgccgaagaagacgaagcagtccggcaccacctgtttgatggagtgtgacaggccgatcgcctccgggatgttcgccaggtagttcagtccgaatccgaccgcctcgggccggaacgagagcacgacgcggcgcaggtcccggtggcgcagcacctggaggtcgaccacccgcacctcgtgcccggcgtcacgggccgcggcggccacccgctccagaccgagcggctccagcctgaggaagatctccgagtacatcagggcactgggatggacgagcaggacacgcatggatcacctcgggttccgcggcgggaagcgggggagtaaccacccgccgatggacgaaaacacgcatcatccgtgtggcgcagcgcccccggaacgccggcgccgcggcccgcccctcggggcacgcgcggctcgggtccggcgccggcgttccgggggcgctgcgccacacggatgatgcgtgttttcgtc

SEQ ID NO: 541 - DNA, 8823 bp, Unknown
  Kingdom: Bacteria, Phylum: Actinobacteria, Class: Actinobacteria, Order: Streptomycetales, Family: Streptomycetaceae, Genus: Streptomyces
cgcacgccggacagccgtccttcccgggcggcgcgctcgaccccgaggacggcgacccgcacggcgacggcccgctgcgggccgcgctgcgcgaggccgaggaggagaccggactcgacccgggcggcgtccagttgttcggcgtgctgccccggctctacatccccgtcagcggtttcgtcgtgacgcccgtgctcggctggtggcgcgagcccagcccggtgggcgtcgtcgacccggccgagaccgcccgcgtcttcacggtccccgtggcggatctcaccaaccccggcaaccgggccacgaccgtgcatcccagcggccacagaggcccggcattcctggtcgaatcggccctcgtgtggggcttcacggccggaatcatcgaccgtctgctccactacgcgggctgggagaggccgtgggaccgcgacaagcaggtcccgctcgactggcggtcatgacagggtggggcgtgccgttcgggccggaaccttccgggacgccgtgtcctgggtccgccgcgcggccggccggacctcggccgacctgtgacctgtgacctgacccgagacctgtggtgaccggaagacgatgaggcgaggctcgacgcggtgaacgtgctggacatcctgctgctggtcgccgccgtgtggttcgcggtcgtcgggtaccgccagggattcgtcgtcggcatcctgtcggtgatcggcttcctgggcggcggcctggtcgccgtgtacacgctcccggtcatctgggacgccgtgacggacaactcgcccatcagcaccaccacggccgtcgtcgcggtcatcgtcgtcatcgtctgcgcctcggtcgggcaggccctgaccacgcacctcggcaacaaactgcgcgtgcacatcacctggtcgccggcccgcgcgctggacgcgaccggcggtgccctggtcaacgtcgtcgcgatgctgctcgtcgcctggctgatcggctcggccctgggtggcacgacgataccgaccctcggcaaggaggtgcgcacctccagggtgctgctcggggtctcccaggcgatgccgcagcaggcggacacctggttcgcggacttcacctcggtcctcgcgcagaacggcttcccgcaggtcttcagcccgttcaccgacgaacccatcaccgacgtacggcccccggacccggccctgcgccacagcgcggtcgcccacagcgccaagcggtccgtcgtcaaggtcgtcggcaccgcgaccagctgcggcaaggtgctggagggcagcggcttcgtcttcgccgaccgccgtgtcatgaccaacgcgcacgtggtcggcggcgtcgacgaacccaccgtccagataggcggcgagggccgcaagtacgacgcgaaggtggtgctctacgactggcaccgcgacatcgccgtcctcgacgtaccggacctgaaggcgcccgtgctgcagttctccgacaccgaggcgcacaacaaggacagcgcgatcgtcgccggcttcccggagaacgggtcgtacgacgtccgtgccgcgcgtgtgcgcgggcgcatcaccgccaacggaccggacatctaccaccgcggcaccgtccgccgcgacgtctactcgctctacgcgacggtccgccagggcaactccggcggcccgctgctcaccaccgacggcagggtctacggggtggtgttcgcgaagtccctcgacgaccccgacaccggctacgcgctcaccgccggcgagatccagcaggacatcaccaaggggcgcacggcgaaccagcaggtggacagcgaccgctgcgcgatgtgaggcggcctgtgccgggcggagcccggtgacgggtcagccgcggggatgccgtaggcgtaccgagacccagcgggcccggcggcgcaggatgcgcggaatgccgacccgggggtccgtgcccgtcagttgcggggcgtccccgtgaagggagcccggaccgctcgccgatcggcgggtgcgtgctacgtcactgtagtcgtgcgtccagcccataccccgacgtctgcccccgtccgaaggtcgataaccgcccgcgggcgcctcaattggcctatgcgccgggcaaatggccgttcgttggacaggtgttcacgttcggataccgggcgcatcggaaccgtcacggaacggccccggaccgcctcaggcaccgatcagccaccgagggaccggtgaggcaccgaaggaccggtgaggcaccggccgtgttcgttcaccggtcgggctcggggtccttcagccagttgatcagttcggtcgagaaggccatcggatcctcctcgtgcgggaagtgccccaggccgtcgaacaggcgccagcggtacggggcctcgacgtactcgccggaaccggccgcgctgcgggtgcgctgcaccgggtcgagggagccgtgcaggtgcagggtcgggacgagcaccggacgcttcatccggcggtagaactggaggccgtccggccgggccagggaacgcaccagccagcggtacggctcgacggagcagtgcgccgtcgacgggatgcacatggccctgcggtacgtctcgaccgcgtcgtcgtccggcagccgcggccccgaccagtcccgtaccaggcgggccaccagcgcgccgtcgtcggcggtgagctgccgctcggggatccacggccgctggaagccccagatgtaggaactcgccgcggtctgccgggcgtcggacagcatcgccgaacgccagcgccgcgggtggggcatcgaggcgacggcgaggcgccggacgagcttgggccgcatcgccgccgccgtccaggccaggtagccgcccaggtcgtgtccgaccagcgccgcgtcgggctcgccgagggagcggatcacaccggtgatgtcgagggcgaggttggcggggtcgtagccgcgcggcgtgcggtcgctgccgcccacgccgcgcaggtccatcgccacggccctgaagcccgcgtcggcgagcgcggtgagctggtgccgccaggcccaccagaactgcgggaagccgtgcagcaggagcaccagtggtccgtcgcccacttcggcgatgtggaatcgggcgccgttcgcggcgacgtcccggtgcgtcaccttccggtcgcccgggatgccgattcgtacgaccgaggtcgattgcgccgaaggagtggcggggtccgtcatgaggacgagcgtgccacagcctcgatggccggcgggttcaggtcctccagagccggggtctccgggcgcgggtgcggcttggcgttctggagcacgccggcggtctgcttcatggaggcggccaccttctgggggcccttgctcttcttggccttcttggcgaagacggcgccgaccaacatcaggacgatgaagaccaggacgttggccgcgaaggagagcaggaagcacagggcgaggttccaggcggtccaggtccgaatgccgtaggcgagcgcgaagttgagcatcggcagtgagaacagcaggatcaggccgccgatcgagaacgcgccgccgctcaccgcgccccgcttgacgtcctgcttcagctgcgccttcgccaacgcgatctcgtcgtgcaccagcgccgacatctcggccgtcgccgaggcgaacagctggccgatgctgcgttcggcgccgaccgggctgccgtcgggtgcgctcatcgcggtctccctcttctgcctgactctgcgttccggaacggtccgggcttttgtaccgtcccgtcagatcatgccggactgtcgttctgctcgcctgccccgccctccacttccgcaagccgtcctgaccgttcggcctcttttcgggcggcgatccggcggtgttcgacggccttgtgttcgaagatggccgccatgcgcaggtggtaggcggggtcgtcctcctcgtacacgtccggaatgccgtcgaggtcgtcgtcgcgttcctcgtcctcgcacatcctgcggtatctggcgttccgtatcttcagcaggaccgtcgccagtgccgccgcgatgacggagccggtgaggacggccgccttgacctcgtccgtcaaggacgcgtcgccggtgaaggccagttcgccgatgagcagggagacggtgaagccgatcccggcgagggtggcgagggcgaagacgtcggcccaggccaggtcgtcgctgagcgaggcccttgtgaagcggacggtgagccaggtcccgccgaagatgcccaccgtcttgccgacgaccagaccgagcacgacaccgagtgtctcgggccgcgtgaacacgtcggccagcgcaccgccggagacggagacgcccgcgctgaacagtgcgaacagcgggacggccaggccggccgacacggggcgtacgagatgttcgatgtgttcgccgggagagtgctcctcgccctcgcgggtggtgcagcgcagcatcaggcccatcgcgacacccgcgatggtggcgtgcacgccgctgttgtacatcagcccccagatgaccagcgcgagcggcacgtacacgtaccagccgcgtacgcccttgcgcagcagcagccagaagacggccaggcccacgaccgctccggcgagggcggcgaagttcaggctgtcggtgaagaagatcgcgatgatcaggatggcgaacaggtcgtcgacgacggcgagggtgagcaggaaggcgcgcagcgcgctgggcagggaggtgccgatgaccgcgagcacggccagcgcgaaggcgatgtcggtggcggtcggcaccgcccagccgccgagcgaaccgccgccggtgagattggtgagggcgtagaccacggcgggggccgccatgccgcacagcgcggcgaccaccggcaaggcggcggctttggggtctttgaggtcgcccgcgaccagttctcgtttgagttcgatgccggcgacgaagaagaagatcgcgaggagcccgtcggcggcccagtgctcgacggagaggtcgagcccgagggcggagggcccgaagtggaagtggctgacactttcgtagccggcgtgcagcgtggggatgttcgcccagacgatcgcggcgatcgcggccagcagcagcaggacaccgccgacggtctcggtgcgcagggcgtccgcgacgaagttccgctccggcagggacaggcgtccgaagaccttgtgggcggcactggagcggggggtgaccacgggaacctccggtcggtgggcagagctgagcacatgccgaccagacttcccggcgcacctgaggatcttgttgcgtgttctttgctttgcttagtttacctaacgtgcggcgggaaggtgtacgaggtgtacgccctggggcgacctgggcgtccgcgcgggtgacgcggaacgcgggagggcgcctggcgtcgctcacgccgggtgccctcccgcgtccctctcagtcctggagccggcccggggccggtcctggcctcagtcctcgctgggtgccgcggggagcttggcctggatgaggtccatgaccgtggagtccgtcagagtcgtgacgtctccgagctgccggttctccgccacgtcgcgcagcagacggcgcatgatcttgccggagcgcgtcttcggcagctccgccaccggcaggatccgcttcggcttcgcgatcgggccgagcgtgccgccgacgtggttgcgcagctcgttgaccaggtcgtcggtctcggcggccgtaccgcgcaggatgacgaaggccacgatcgcctgcccggtcgtctcgtccgcagcgccgaccaccgccgcctcggcgaccgacgggtgggagacgagcgcggactcgacctcggtggtggagatgttgtgaccggacaccagcatcacgtcgtccacgcggccgagcagccagatgtcgccgtcgtcgtcctttttggcaccgtcaccggcgaagtagcggccctcgaagcgggaccagtaggtgtcgatgaagcgctggtcgtcgccccagatggtgcgcagcatcgacggccacggctcggtgagcaccaggtagccaccgccgccgttgggcacctcgttcgcctcgtcgtcgacgaccgtcgcgctgatgccgggcagcgcgcgctgcgccgagccgggcttggcatcggtgacgcccggcagcggggagatcatgatgccgccggtctccgtctgccaccaggtgtcgacgaccggggtccggtcggacccgatgttcttgcggtaccagatccacgcctccgggttgatcggctcgccgaccgagccgagcacccgcagggaggacaggtcgaacttcgcggggatgtcctcgccccacttcatgaacgtgcggatcgcggtcggcgccgtgtacaggatcgtgaccccgtacttctgcacgatctcccagaaccggccctggtgcggggtgtcgggcgtgccctcgtacatgacctgcgtcgcaccgttggccagcgggccgtacacgatgtacgagtggccggtgacccagccgacgtcggcggtgcaccagaagacgtcggtctccggcttcaggtcgaagaccgcccagtgcgtgtacgcgacctgcgtgaggtagccgccggacgtgtgcaggatgcccttcggcttacccgtggtgcccgaggtgtagaggatgaacagcgggtgctcggcctcgaacgcctccggggtgtgctcggccgactgccggccgaccgcctcgtgccaccacaggtcgcggctgtcgtcccaggcgacctcctggccggtgcggcggaccacgagcacgttgcggacgttctccacgcgtccgaccgcctcgtcgacggccggcttgagcgcggacggcttgccgcggcggtagccgccgtcggccgtgatcacgaccttggcgtcggcgtcctggatccgggtggcgagcgcgtccgaggagaaaccgccgaagacgacggagtgcgccgcaccgatgcgggcgcaggccagcatcgcgacggcggcctccgggatcatcggcatgtagatcgcgacccggtcgcccttctggacgcccagctcggtgagggcgttcgccgccctcgacacctcgtccttcagctcggcgtaggtgatggcacggctgtcgccgggctcgccctcgaagtggatcgcgacgcggtccccgtgcccggcctcgacatgccggtccacgcagttgtacgccacgttgagcgtgccgtccttgaaccacttggcgaacggcgggttcgaccagtccagggtctcggtcggctccttggcccaggtcagccggcgggcctgctcggcccagaagccgagcctgtcagccttggcctgttcgtacgcctctgccgtgacgttggcgtcggctgccaggtcagcgggcggcgcgaagcgtcgctcctccttaagaaggttggccaggctttcgttgctcacgacatctccctttcccagggtgtccgttgtgtcccaggccacagctcatcagacccgggggccggatgacaagggccgacgggtaattggtttagacctgttgtggaacgcttgcgcagttccggcgtcgggtggcgggtgtcacccacgttcagcatggcccccggaagcgaagggggccacggctggggtgtgcgtgtcgccgaggcacccgtcacaccgtgctgaacccgtctttcgtcggttctgtcactcctgccccttacgtccctgctgtcactgaggttcctgctgtctctgctgctgccaccgctgccaccgccggagcggcgtaccgctgcccccggagccggagccggagccggagccggagccggagccggagccggagcccggcccggactccactcccggcgggccggagtcgaggagtgcctgcacggtcccggacccggcggcgcggaccgaggtatggcgaccggtgagccggacggatccgccctgcatggtgtgcgtgcgctgccagtcccgcagggactcgtaggccgcgtggtccatgaaggagccgtccaactcgacggtcacgtccgccccgtgcgggatcagatgcagggtgcggctgagacggggcaccgccaggaacgtcaactgccctcgtacgcgtacgtgatggactcccttctgctcgtcatgggtgatacgggtgcgggcgaggcggtgcagggcgagggcgacggccgcggcgactccgagggccaccccctggaggacgccgagagtcaccacgccgagggtggtcacggcgtacaccggcacttcccggtggcgggtcaccgtacggatgtggtgcggggagaccatctggatgccgacggccatcaccagggcggcgagcgaggcgagcgggatgaactccaggagcgggaccatcaggagtgcggcaaccactacgagaacgccgtgcagcatcgtggagttccggctcacggcccccgcccggacattcgccgaactccgcacggcgacccccgccaccggcaggccgccgagcgccccggagacgacgttcgcggcgccctggccgagcagttcccggtcgagatcgcagcgggcggggcggacgaccggtcctgggcggcccgccaccagtttgtccacggcgacggcgccgagcagcgactgcacactgcacaccagcgtcgtgctcaggaccgcggcgacaagtccgaggacgggcccctcgggcagcccggccagggcgtggctgcgccaggacggcaggtcgaccctgggcagcaccagtccggtgacgcacacgatcacggtggccccggcttcccggccgggcgggccgcctcctgcgcgtgatgcccgccgcgctcgtcgccgtcgccggggccaccgtgatcgtg

SEQ ID NO: 542 - DNA, 4259 bp, Unknown
  Kingdom: Bacteria, Phylum: Actinobacteria, Class: Actinobacteria, Order: Streptomycetales, Family: Streptomycetaceae, Genus: Streptomyces
ccgacggccgggtcaccgcggcgatctcgccgccggccacgggcctgctcctcctcactcgccgcaagaacgaacccggcctggcgctggaggcctggcggcaggtgtgaacggcagctccggctccagccccaccggaggacacggtcgcgcctcaccggagggtcacggccgggccccgcagccaaaccccttggccgccaggcacggtcatccggccgccatacgaggttcaccgcacgctcgcctatgatgggccagctcggccgcccgtacacaggttcgggacaggcggatcagccgcgccgaggtcacgtcagggaaggggccaggtcacctcatgcggaccagatccgggcgcggtgccgcccgcggcagagccgacggagccgtggagcgcgcgagcgcacagcgccacaccgctcggcataccgtcggcggacgctggctgacgctgggcaaggacggcaggctgacggcgtacgcccgcaccgatgacgggctgttgcgctggaccgaggtgcggccgggcggaccggagtggacgggcccggagttcttcccggtggcggatctcaccgatctgacggtcattcagggagccgacacctacgtgcacttcgtggggcggcgcgcggcgcgccgggcggaggggccgccggccgtcgacatcgtccacgcgatccagtaccagaccggccgtccggtcaccgagtggcggtcgctgggcaacgcgcaccaggaccgtgagaaggcggcccgtttcggcgtgcccgcgggcgcggtcagcggttcgggccgggtgtacgtcttcgcgcgcaacgccggcggaggcgtcatgctgcgccgcgaaggtcccaccggcaagtgggaggcctggcaggacctcaaaggcagtcaggtccgcgacgggatggcggcggtcgtccacgcctccggccgtatcgaactcttcgcgaccggcgagggcatcgccatgcgctggcagcaggacggtgtcgacaaggagttccggcgtgaggcgaacgtcccgctgcgggtggcccccggcacagtggcggcgttgccgaccggtccggaacgcacgacgtactactgggccgaccccgaccagggcgggctggtcgcgcaccggccgggccagtgggtgatcccgctcggcggcgccccggacggggagccgccgagcgtgctgcgcacggaactggacggctacgactgcacggtgctggcccaccgcgacctcgactggcaggtctcgttcgccgtgtgcggcacggagaacgagcaggccggcgcgtggtggatgccgaccggtgaacgcgcactgggcgccccggcgctggcgctggacggacgcgggcgcgtggtggtcgcggtgatcgacccggacggcaggctcgcagtggctcgccaggccgacgccccgggactgtcgctgggcgcctgggtccgcgtctgacgacggccgcaggggcgcttcacgacggccgggcggccggcaggccgcggcatgcgccgcacccctgccggccgcccggccggtgtccgtcaggtccgcacgacagtcaggtccgcacgacagtcacgtccgcaggacggtcaggccgccaggacagtcacgtcctcgggtccgtcagggcgtcttgccgcccttggcgggggattccttggccgactccgggatggtccggtccgtgcgcagggccttccacagctgcgtggactgcggctcggccgccacgacgcggttggggtcctgggtgtcgtactgcaccggcagcatgatcgtctccatcgtcgccgggtccacgcccttcatgctgcggctgaactcggcgagtttggtgagcgaggcgaggtcggagtcggtcgtcagcgactgggtgagtccgtcggcgatccggtaggtcttggtggggctgcccagcaggtcctgcttcttcacctcggacagcagcgcgatcatgaatttctgctgcaggccgatgcggccgaggtcgctgccgtcaccgatgccgtgccgggtgcggacgaactgcagggactgggtgccgtccaggcggtgggtgcccgcgggcaggtccaggccgctggacttgtcgtggatgtcctggtcgacggtgaccgtgacaccgcctatcgcgtcgaccaggcccttgaagcccgcgaagtcgatctccatgaagtggtccatccgcacgccggacatcttctcgaccgtcttgaccacgcaggccggaccagccagcgagtacacggagttgaacatcacgcggttcgccgagggcagcgtggatccgtccgacttggtgcactccgggcgggtcacgagggtgtcgcgcgggatgctgacggcgacggccttcttgcggccctccggtatgtggatgaccagcgcggtgtcggagcgtgccccggccaccttgcccgtgtccagggcggcgttggcgccggcccgcgagtcggagccgagcaccagcacgttctgtccggatgtgggcagcttctccggccggtcgtcaccgagcgcccggtcgatgtcgacaccgttgatgttggagttcaggttgctgtacagccagtagccggtgccgccggcggccagcaccagtacgacgaagcccagtgcgatccagcgccagacgcgtcgccggcggcgcggcggtttggtggcgcggcggcccgagggggcgcgcctcgatctgctggggcccgtctccgtgggcgcctgcgtcatgcctcagtcctctcgctcaggtggctcgatgccttggtccgttgtgtggggcagggcacgagtggggggagggaccgggcccgcgcggcgtcggagcgccgtggtgtgcccgaactatagaccgaatgccggaccgttcgcggattgctcttacctgtctcacgaccgcgggtgttcaacgccccgtcacgttgacgtgtggtttctgtcattcgcgcacgaagttgacagaacaacgacagctagtgatgatgtggttcacgtgtgaaggttaaattattgtgtgaaaagcgtggcgacatcagtcggcgcgtggtgtgtgcggtcgcggttcgagcccgggggggcacgagggcgggcgaccgcgagggcccaccggcgggatttggtgggagacgagggaggatggctgtgatgctgcgtgcgtctgcccgggaagggcggcggcgtgacggccgtatctgatcacgtcacgggccggatcgacggccccgtccggcgtgttccccagggacgacccgcgccgcggggccccgtggaccaggccgcgacgacgctcaccgcggagcacggcgacgtctacgtcgagcccggactcacaccgctggcggcccgcgaggccaaccgctccgcgctgtccgcgctgctccacgccgccggaatcgcgcacttcgccgtccgcggcaccgtcgatcacggcacggtgatcgccgtcgccgaggaggaccgtgagcgggtgctgtccgtggtgttccgcggactggggcagttcccgggccacctgagcgtggtggacccggacgcgccgcgcccggccaagcccgtctcctcgcgcgatccccgggcctggcgcgaggtccccggcgcgcgcgtgctgcagatcagctggtaccgcaccgaccccggccggcacctgctgctcggccacgagtacggctgcgccatcgagttctggcggcgacaggacggctacctggtggcaccgcgggccaaccgcgccacctgggcggtcgccaccgagggcgccaacctgctcggcgcggcccgcctgttcagccgcttcgtctccgactggacgccggcccggctggctccgccgctggccacccggcccgagttcctggtcgactgcgccgacgacatcagcttccccgtcgacgccgtctacacctgggtcgacggcaacgaccccgcctggcagcagcgcaaggcgcaggccaagggcgaggtctaccacgccgagtcggcgagcgacgcccgcttcatcagccgggacgaactgcgctactcgatccgctcgctgcacctgttcgcgccctggatccgtaacgtctacgtcgtcaccgacgaccaggtgcccgactggctgcgcgaggacctgcccggtctgcgcatcgccacgcaccgcgagatcttccgcaaccaggcggacctgccggtgttcaactcgcacgccatcgagagccagctccaccgcatcgagggcctcgccgagcacttcctgtacttcaacgacgac

SEQ ID NO: 543 - DNA, 2296 bp, Unknown
  Kingdom: Bacteria, Phylum: Actinobacteria, Class: Actinobacteria, Order: Streptomycetales, Family: Streptomycetaceae, Genus: Streptomyces
  misc_feature (1933)..(1934): n is a, c, g, or t
gcggccgggccacgctgaggtcgagcaccttcgcccggccgcagtccacgacgacgttggccggcttgagatcgaggtgcagcaggccgcggccgtgcagatagtggaccgcggagcacaactgcaccccgagcagcgccacgtctgcggcggccgggcgccgccgcaggcggtgcaggagacgggacagtgtctccccgctcagcgtctccagcaccaccagcggctgcggtgccgtgcggacctcgtacccgcggaccaggtacggatgggtgaagtcgcacagccaccggccctcccgcagcagtcgctcggccgcctcctcctcagtgcggcggtccgggcgcagcaccttgacgacgcaccggcaggcgcgttcctcgctccaggagtcgtacaggtcgagccagcccgtgcgcgccagatgccccagaacccggtagccgggcgccggacgggcgcccgcggtcagtaccgggcccggaggggtgccgttcatgacggcaccggctgcgcggggtcggccagggcgcccagctggtgcagcccgtacagccgggcgtacgcgccgccgtgccggagcagctcgtcgtgggtgccgcactcggtgatccggccgcggtcgagcaccacgatccgggaggcgtcgcggacggtgagcaggttgtgcgagatgacgacggtcgtccggccggacatgaggcggcgcagcggtgccatgatccggcgcccggatccggcgtcgaggccggtggtgggctcgtccagcagcagtacgggcgcgtccctgaccatcgcgcgggcgatcgccagccgctggcgctgtccgccggagagcgtccggccgcgctggcccaccatcgtgtcgtacccctgcgggaggcaccggatgaacccgtcggcgtccgccgcccgtgccgccgccacgatctcggcgtcggtggcgtccgggcggccgtaggcgatgttctcccggaccgtgccgtgcaggacgagggtctcctggaggaccaccgcgacgctctcgcgcaggtcgtcgagggccagctcccgcagatcggtcccgtcgaggcgtacggcgccgaggtcggggtcgtagaagcgcagttgcagcttggccacggtggacttgccggctccgctgggtcccaccagtgccagggtctcgccgggggacacgtggaaggacacgtcgctgagcgcccagggcgcggagcccgcgggggcgccgagcggaatgcccgcagagtcggccgcgtcggccgcgtcggccccggcgacctcgtctgtcccatctgtcccctctgtcccgtccgggccggtcgccggatagcggaagcagactccgtcgaactcgatctcgccgcgggcgcggccgaggcgccgggcgtggggtgcctgggtgacctggggccgctggtcgagcagttcgacgatgcgttcggcggaggcggaggcggagtagaaggtggtgccgaggcgggacaggtcacggaccgggccgtagagcttgccgatcagggccaggaagaccaggagtccgccgagggtgagctggccctgggtcagtttccaggtgccgaggccgatgacggccagcgccccgcacatctcgatcatctcgacgagcggccggtacagggcccggatccgcgtcgacgtcatgacggcgcggaacgtgccgaggctctcgcgctcgaagcggcgcgcctcccaggcctgccggttgtacgcctggacgagggccacgttgcccagcgactcctcggcgaccgccgtgagcgagccgccgcggcgcctgcgctcccgggacgcagccttgaccagcctggagaagtgccgcgcggcgccccagaacagcggcacgatgacgagtgcgagcagcgtgaggtcccagcgcaggtagaagagcagccccaggaagacgcccagnncagcaggaacgtctcgacggcgtccacgtcaccggtgatccgtgacagcacgtccccgagccgccgccgttcgaagaacccgagcgacagcccctggacgtgccggaagacgtcggagcgcagcgccagcaggaagctctcgctggtgtacgcggacatcacgtcgtcggtgaaacccagcacccctgagacgacgacgagccccagacaggccggggcgatccagaggaacggcgccaggttccgggggacgagcacgtcgtccaccaggagcttgaagagccacagctcgcccgcgtcgacgagcggccaggccaggctgaacagcgccagcgggacgagccggccccgtcgcccgcgcg

SEQ ID NO: 544 - DNA, 2710 bp, Unknown
  Kingdom: Bacteria, Phylum: Actinobacteria, Class: Actinobacteria, Order: Streptomycetales, Family: Streptomycetaceae, Genus: Streptomyces
  misc_feature (477)..(576): n is a, c, g, or t
  misc_feature (1350)..(1351): n is a, c, g, or t
  misc_feature (1496)..(1497): n is a, c, g, or t
ccgcacgccgcagaacacgatcggaagggacaaccatgagccgctacgcacgcttctccaacctgcgcgtggacgggccggacaagaccggtgtgatcgagctggtgctcgacgcgcccaagctgaacgccgtgagcgaggccgcgcacgcggatctggccgagatctggcgggagttcgacgccgaccccgaggtgaaggcggtgctgctgcggggcgagggcaagggattctccgccggaggctccttcgacctggtcgagaagctgaccaacgactacgacacccgtacccgcacgatgcgtgaggcgcgggacctggtctacaacgtcatcgactgttccaagccgatcgtctcggcgatgcacgggcccgccgtcggggcggggctggtggcgggcgtgctcgcggatgtgtccgtggtgagcaggaccgcgaagatcatcgacgggcacacccggctcggcgtcgccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgacctgctgcccaccgcccgggagatcgccgaggaactcgcgcagggcgccccgtcggccatccgctggaccaagcagtcgctgaacaactggtaccggcaggtcgccggcgccatcttcgacgcttcgctcgccctggagttctacggcttcggcgggcccgaggtgcgcgaggggctcgcctcgcaccgcgagcaccgcaagccgaacttctagccgaacttccgagccgcatccggttcttgctcgtcctcagtcaaggagatcaccgatgaagccgtaccgttccatgctgttcgtgccgggacacaagcccacgtgggccgacaaggcgatcgcctccggcaccgatgccgtcatcctcgacctggaggactcggtgccggccgcggacaaggccgacgcgcgcaagacggtccgcgcgacggtcgaaaggctccactcggagggtgtccgggccgatgtctgggtccgccccaacagcgtcgacagcggtctgttcggcgccgacgtggaggaggtcgccacccaggggctggccgggctcttcctgcccaaggtgttcagcgcggaggagatcgtgcggatcgacgcggtcgtctcgcacatcgaggagcgggacggactcgaacgcggctcgatcggcctgatcgtcagcttcgagaccgccgtctcgatggcgcactgcgaggagatcgcggcggcctgcccccgggtggcgagcctgctcggcgcgaccggcccgaacgccgacgtcggccgggagctcnngaggacaaccgccgcctcggctaccgcggcatggtcgtcatccacccctcgcacgtggccccggcgaacgaggtgttcaccccctctccggagaaggtggacttctaccggcggatgatagcggcgttccgggaggccgaggcgnncggccgggatcctcaccagtgccacggcgaacaggctgatgaccgaggacgctgccatgtagaccgacaccgacaccgtggtgtgcgtcgcggccagcagcgagaccatgatgaacggggccagcccggcgccgatgatgttcgcgatctggttgccgagcgacgatccggagtagcgcatgccgggcgggaacgcctcggccagcagcgcggttcccggcccgaacatcgcacccacggccaactgcccgacggacgcgccgagaaggatcagcgggaagctgcgggtgtccaccagcgggaagagggcgaagatccacatgcccgagaagcaggcacccgcggcgaagaccttgcggcggtccaccaggtccgacagccacgccgaaccgatcgtgcccaccgcgaacgcgatcatcgacagcatcgtcactgtgagcatcgtgtccttggagatcttcaggtcgccggtcgcgtactccagcaggcccgtgacgatgccgtagaacatgatcgtggccggcaggaaggtgaacgcgacgagcaggacctgcttcgggcggcgcagcacctgcaccacggacgacttgggcgcggagcccctccgggcggacagtttcgcctcggtccgctggaactccggggtgtcctcgatgtagcggtgcacgaagtaggcgaccgggaacatcacgatgctgaggaggaaggggatacgccatccccacgacgtgaactgcgcggccgtggtgaggtggctgacgagcaggaacacgagcgtgccgacgatcatgccgacaaccactccgagctgcggcagcgcgccgaacagaccgcggcgcccgggcggtgcgctctccagcgcgagcagggtggcgcctccgaactggccgcccaccgcgacgccctgggcgatgcggaggaccaccaggacgaccggtgccgccacgccgacgctgccgtaggtgggcagcatgccgatgagcgtggaggagacggccatcagcaacatcgccgccaacagcgccggcttgcggccgaacttgtcaccgaagtgcccgaagaccgcggcgccgatcggccggccggcgaacccgacggcgaacgtggcgagcgaggccagagtgccggcgagcctggatcccgaagggaagaagagggtgttgaggaccagtgaggcggcggtgccgtagatcaggaagtcgtagtactcgat

SEQ ID NO: 545 - DNA, 5710 bp, Unknown
  Kingdom: Bacteria, Phylum: Actinobacteria, Class: Actinobacteria, Order: Streptomycetales, Family: Streptomycetaceae, Genus: Streptomyces
tcggcggcgaccgcgacgccatgcatcagcttcccgcacccgacctggccgcactccagctcgcggcgctgcgcctgcgcttcgccgaactggtggaccggctgccggtggtcagcgcgctcgcccacgagcagcacctggacggcatcagcgcgctcgacgacgcagccccgctgctccttccccacaccgtctacaagtcctaccccccgtcgctgctggcccagggccggttcgaccagctcacccgctggatctcacagctcaccaccgtcgacctgagcggcctggacacggccggctgcgacagcgtcgacgcctggctggccctgatcgacgaccgcacccggctgcgcctggcccattcctccggcacctcgggcaccatgtccttcgtcccgcacacggcgcagcagtacgcgctgctgtacgagatcgtgcggcaggacaccgtgccgccgggcacgtcgccggacgaaccggtccacgtcgtatggccctcctaccgcagcgggcgcagcggcatcgcccggcacgccacagcgatgttcgagcaactcgcccgccacagccccgagcacttccacaccctcgacccgggccacttcagcgccgacctgatgctgctcgccgcccgcgtcaaagcagccggcggccgcccggggcaggtggagatccccgcggccctgcgtgaacagcgcgaccactacctggcccgccgccgctcggcgccccaggccatgcgccgcttcaccgccgatctcgccgggcggctgcgaggcgaacgcgtcgtctcgctcagtctgtgggagacgtactaccaatgggcccgcgcgggcctggaccagggcctcgacggcgtcttcgcctccgactccgtcctcatgcccggcgggggcaccaagggctcggtgctgccgcaggactgggcagcccaggtggcccggttcgccggagtgccgtccgtgcggctgtgctacgccatggtggaactgatcatgctcagcctggtctgtccggcgggcgcctaccacgtcgaaccgtggatcgtcccctacgtgctggacccgggcaccggcacgcccctcccccggcagggcaccgtgcgcggcagggcggccttcttcgacctcaccgcggacgtctactggggcggcttcgtcaccggcgaccacgtcgcggtgtcctacgatccctgtccctgcgggcgccgcacgccccgtgtggaacccggcatctcccggttcgaggacgacgacaagatcacgtgcgcggccactccggaggctctggacgacgccctggagtacctcgccgacgccgccctgtgaccctgccgaccgcaagggaaatcgccccatgaccgcgcccgttgacaccgccgccggatccctgaccgtaccggcgtatgtgcgggggacgaccgtcaccgaccggctcgtccctttcggaggccgtcccggccgccctgcgttccacgcccccgacccgaccgctctgctgccccgtctgatcctgcgcgacccgggcagcctgcgggaactgcaccgcctgagtacctccgagatcatcgaccagctcaccgtgctcggccccctgctggcgctggaggccaatccactcctgcgcgaggcgctgcgcaccgctgccgcctggtccgacatgacggaaccggtcctgcgcgccgcctacgagggcctgcccgagctcttcacccgtcaggcactgcacgacgtcgcggagcacaccgtcggcacgcggttcctcgacggctggacccccgtgcccggccgcggcggacgccgcgcagcggtccgcgccgtcggggcgcgaacggttcacgtcatcgccggcaaccatccgatgatcgctgcactcaccgtcatccgcaacgcgctcacccgctccgacgccatcatcaagacaccgtccaacgacccgctcacagcggtcgcgatcgcccgcacactggctgacgccgcgcccggccaccccctcgcccggcacctggcggtggcctactggaagggcggtgccgaagggttcgagcaggccctctaccggccccgcaacctggacaagatcatcgcctggggcggcatggccgcgatgcggcacatcacccgctacatccgtcccggcctcgaaatcgtcgccctcgacccgaagtccagcggcacggtgatcggcccggaaggtttcacccacgccgcggccatggtccgtaccgccgagctggccgccgccgacgtcggcgagctgaaccaactggcctgcttcaacgcccgcgtggtgcatgtggtgaccggaactgacccggccgggctgaggcgggccgaggagtgggcggaactgctgcacgcgcggatccaggcactgcccgcccaccgcagcaccccggcccggcacttcgaccccgccctgcgtgaacatctgcgcgctctgcgagccaccgggggcgactggtaccgagtgatcggcggcaagaacgacgaaggcgccgtagtcctttcccgcaccgcggacaccgtccccttccacaccgcgctgtccgggcgcgtcgccaacgtcgtcccggtggacgatgccgagcaggcgctctccaccatggacgcttccacgcagaccctcggcgtctacccggacaccctcaaggagcggctgcgcgacctggcgcccttccacggcgtgcagcgcttggtgccgctcggccgggcgaccgactaccgccccgaccttccgcaggacgcgaccgaaccactgcggcgcatggtccgctggatcaccgacgagacctacgaccccaccgcggcgtccggagggcaacgatgacgcacaccgcaccggccacccaccacaccgcctcctccggcaccgcaccccgctgcccccacctcgcccgcctcaccgccgacttcgacgcccacgacccgcacctgagtccggacctcgccgtggacgtgcaccgggcgatccgcaccgccacaccagtcgcctactcgcgagcgcacggcggcacctggatcgtctcccgctaccacgatgtccgcgccgcactggccgaccacgcaacgttcagctccgcctccggcgtcttcttcccccgcgccgcgggcacgccgcgattcgcccctctggaatacgacccgcccgagcagacccgcttccgcaccgcgatgaagccgccgttcctgctgtcccaggtccgcgatcttcacgatgcgctggcggagctggtccgcgcgcacgtcaccccgatcgctgaacgcggccagggagacctggtcgccgagctggctgtgccgctgccgctgagcgtcgtagggctcgcggtcggcttcaccgagcacgcccagcgcagcatccgggaattgacgagcaacacctgggcccgcatgcccaaagacgacgggcccggaggcttctggccggcgttcgccgagctgttcgacagcgaaatccgtcgggcacgggaacagcccggcgacgactacctcagcaccctcgtccgcgcaccgttggacgggcggcccgtcagggacgaggaactgcacgtcatgctcgtcgcctacgccatcgcgggccacgagacgtcgatgaacaccttggcacacctgctgtggcagctcggctcacagcccgaactccagtcagcgctcagaaaggaccctggcctggtcccggccgccgtcgaggagacgctgcgactgtggacacccgtcgaccacggcactcgcgtcaccacccggccggccgtcctgagcggcgtcgagattcccgccggcgcccgggtggtactgctgaccggtgcggccaaccgcgacccggaggtgttccccgacccggacaccttccgtctcgaccgcggtgtcaaccggcacctcactttcggcaacggcatccacttctgcctgggcgctcacctcgcccgggcagaattcgcccaagtactccacgaactcctccggcacccggtgttcaccctcaccgaacaaccgactcgctacttcgagaacggacggcacatctgcctcgaccggctaccggtacgattcgcctctcgcgacgagggccagcggtaacacctcgcgcaggacgtgatcgaatcagctgcggggggcatggcaacctcacggaactgacgcggcacggccgcccgcgccacctggtcagcgccgtagccggcctgatgggctatgccatgtgttagtgttgcgcgtttgcgtggtcgtcgcggtgggcggttccgcctgttcggttccgcttctgcgtgggctggtcactcccgccgggccttcctcggtacgttcccctgcggaaggctgttcatgaagcatcccgatgactgcggcatcgctcacggcggtcccgcccagcccggggccacgaccccggtggtgcccccggccgtctccttcgccggtctggcactgccggccgaggtgctgcggacactgagtgaactcggggtgcgcgaactctttccgatccaggccgccacactgcccgatgccctgaaggggcgcgacgtcctgggacgcgggcgcaccggatcgggcaagacgctcgccttcggcctgccgctgctgacccgtacggccgggcggcgcgccgaaccgaagcagcccctcgctctgatcctggtgcccacccgggagctggcccaacaggtcacccaggcgctggcgccgtacgccgaggcactgcggctgcggatcgccacggtcgtcggcggaacgtcgatcggccggcaggtcgccgcgctgcgccagggagccgaggtggtcgtcgccacccccggacgcctgcacgacctgatcgagcgcaacgcctgccgcctgggacgggtgagaatcaccgtgctggacgaggccgaccagatgtgcgacctgggattcttgccgcaggttgccgacgtgctcgaccaggtgcaccccgacggtcagcggatgctcttctcggccactctggatcgcgacgtcgatcagctggtccgcagccacctccacgaccccgtcgtccactcggtcgacccgtccgggggcacggtcacgacgatggagcaccaccttctggtcgtccacggccctgaccgctacgccgtcaccacggagatcgccgcccgcgacggccgcgtactgctgttcctcgacaccaagcacgccgtcgaccagctcacccggcatctgcgggccagcggggtgcacgccggggccctgcacagcggcaagtcccagccacagcgcacacggactttggcgcagttcaaggacggtcagatcaccgttctggtggcgaccaatgtcgcggcccgcggcctgcacgtcgacgacctcgatctcgtggtcaacgtcgacccacccaccgaccccaaggactacgtgcaccgggcgggccgcaccgcccgcgccggtgggtccggcagcgtggtcacgctcgtgccggcggcccagcgccgcgagacgagccgcatgatggccggggccggcatcgagccgaccgtcaccaaggtgcgctcgggcgaggcggagctgagccggatcaccggcgccaggactccctccgggatcccgctcgacggcgggcccgccgtccctcggcccaagaacaccaacgctcccttccgcggcctcggcaccagcaaggacgcctcccgcggcaagtcccgaaaggccggcgagcccgcaagctcgccggcctttcgggactt

SEQ ID NO: 546 - DNA, 4916 bp, Unknown
  Kingdom: Bacteria, Phylum: Actinobacteria, Class: Actinobacteria, Order: Streptomycetales, Family: Streptomycetaceae, Genus: Streptomyces
ccgccgccgagcggcggcggatcgcgctgctgggcggcgccgtggtccgccagaccggcgtggaccgggaggtcgcggtcgtcgtggagcggcaggccgacccgtgcgcggagcagccgctgcccgcgcggatcgtgcgggccgtcaacgcctacgacgagaaggtccacggcgcggggcccgacggctcgctgcgggcgctggaggagctgcgcctggccaccgcgggcgagtacgccgccgaagtggtggaatcactggcccgcgtcctggcgcggggggattgtctgactccctccactgtggggtaacccatgggtaatgagcgcccctcaagccgtacgtggttggatgcgaaggaaagggtgtccgggggcagagccagcccatacgacggaactggcaggcgggaatcgtgaggatcttcggcaagggacggcaccggccctccgcctcctggcggcaggccaccgaccgcgcgttcaccctgatcggcgacggccggtacgaggacgcgggcgcgctgctgacgcgcgccgccgatctggagccctggctgtcggagtcctggttcaacctcgccctgctgcacaagttccggcacgactgggagcaggcgagggcggcgggcctgcgggccgtcgccctgctggagaaggagaccggggcgccggactggtggaacgtcggcatcgcggccaccgcgctgcaggactggtcgctggcccgccgggcctggcaggcctacgggctgaaggtgcccgggggcacggccgccgccggtgagccggtcggcatggagctgggcagtgccgcggtgcggctgtcgccggagggcgaggccgaggtggtctggggccggcgcctggacccggcccggatcgaggtgctgtccattccgctgccgtcctccgggcggcgctggggcgaggtcgtgctgcacgacggcgtgccccacggcgagcggaccaccgcggccgggcacagtttccccgtcttcgacgagatcgaactgtgggcgccctcgccggtgcccacctgggtggtcctcctggaggccgccaccgaggccgaccgggacgcgctggagcagctcgccgcggacgccgggttcgccgccgaggactggtcgtcctcggtgcggctgctgtgccggacgtgctcggagtcgcggatgccctccgacgagggcgacggcgtgcacctggacccgcacgaccacagcgagccgggccacccagggccgctcggccaccgcaccgacgggcagctgtgggtgccggagcgggagtgcggggtggccgcgccggcctccctggtgcgcgggctgctggacggctgggtggcggacagtcccgattcccgtgactggcgggacctcgaagaggtctgctgaagcggggcgcgcgccggtccccgtaggctgtacgggcagaacttctccaggcttgcaggaaggcgtacgtcggtcatggcgcagcaggacaccgatcagcagcaggcgggcgtgctcccggtcgacgacgagggctatgtcgtcgacacggaggactgcgaggcgcgcgagacggcgtggtgcgagcggggcacctcgcggccgatcacggtcgtcggcaacccggtgctgcacaaggagtgcaaggacgtcaccgagttcggtgacgacctgcagcagctggtcgcggacatgttcgccagccagcgcaccgccgagggcgtgggcctggccgccaaccagatcggcgtcgacctgaaggtcttcgtctacgactgccccgacgacgagggtgtccggcacaccggtgtcgtctgcaacccgcgcctcgtcgagctgcccgccgaccgccgccgcctggacgacagcaacgagggctgcttgtccgtgccgaccgcctacgcgccgctcgcccgccccgactacgccgaggtgaccggccaggacgagcagggcaacccggtcaaggtgcgcggcaccggttacttcgctcgctgtttgcagcacgagaccgaccacctctacggctccctctacatcgaccggctctccaagcgggagcgcaaggacgcgctgcggcagatggccgagaacgagccgcgctacccggtcgtcgccaacgactgagcaccccaggcaccccagggcgcgactgcccccgtgcgcacggcgcccgaccgcatcccggtcgggcgccgtctttttgtccgtggcacggccactcactcaccgatgcggccatggcacggccactcactcgttcgatcctttgggcgcatctgctgaatcagaatcagtcacacaaggggatattctcggcacccgaggtggcgagtgggccaaatccgttcccagaacggtcagttgtggtgctgaatgggagtgcggggatgcgcgacggcgtgcgccgggcacagcggaagaggcggacgccaccggcggctgagaggggttgttcgtgccggctttcccatacagcaccacaacgacatccacatccacaccgacagcggtcgcggtgccaccgtcactcgctctcccggtgatcgaggcggcgtttcccaggaagttgcacgcctattggcccgaactgcaggagaacacccgcggctggctgctcgaaaagcggctcatgccggcggacaaggtggagcagcacgccgacggcctgcgctacaccgacctgatggcggggtactacctcggcgcaccggacgaggtcctgcaggcgatcgcggactacagtgcctggttcttcctctgggacgaccggcacgaccgcgacatcgtccacgggcgccccgtcgcctggcgcaggctgcggcgcgcgctgcacacggcgctcgacgccccgcaggaacacctgcaccaccaggacaccctggtggcggggttcgcggacagcgtgctgcggctgtactcgttcctgccgggcacctggaacgcccgcttcgcccggcacttccacgcggtgatcgacgcgtacgaccgggagttccacaaccgcagcgagggcgtcgtgccgacggtcgaggagtacctggccctgcgccggctcaccttcgcccactggatctggacggatcttctggagccgagcgccggatgcgaactcccggacgccgtacggaagaatcccgccttccggcgtccggccctgctgagccaggaattcgccgcctggtacaacgacctgtgttccctgcccaaggaaatcgcgggtgacgaggtgcacaacctcgggataagccttgtcaaacacgatgggctcagccttgaggcagcaatcgcggaaatccgccgcagaatcgaggagtgcatagctgaattccttgccgcagagcaggaggcattgcgcttcgccgacggtctcgcggacgggacggtgcggggaagggaactgagttccgcagtgcggtcctgcctcggcaatatgcgcaactggttcagctccgtctactggttccaccacgagtccggccggtacatggtcgacagctgggacgaccggtccacgcccccttacgtcaacaacgaagcggcaggtgagaaatgaccgtcgagtcggtgaagcccgaggacaggtccgaggcggccccgcagcggcgcgaacccccgctggccgcaggcgccgtcccgctcctcggccacggcctgaaactggcccgcgacccgctggccttcctgagccggctgcgcgaccacggcgacgtcgtccgcatcaggctcggcccgaagacggtgtacgccgtcaccgcgcccgccctcaccggggcgctggcgctcagccccgactacatcatcgcgggccccctgtgggagtccctggagagcctgctcggcaaggagggcgtggccaccgccaacggcccgctccaccgccgccagcggcgcaccatccagccggccttccggctcgacgtgatccccgagtacgggccgatcatgaccgaggaggcgcacgccctggtggagcgctggcgctcgggcgaggtgctcgacgtgaccgcggagtccttccgcgtcgccgtccgcgtcgccgcacggtgcctcatgcgcggcagctacatggacgcccgcgccgaacgcatctgcgccgcgctggccaccctgttcgccggcatgtaccagcgcatggtcgtgcccctcggaccgctttacaaggtcccgctcggcgggaaccgggaattcaaccgcgcattggccgatttgcatctcctggtcgacgagatcgtcgccgaccgccgggcaagcggtcaaaaaccggacgatttgctgacggctttgctggaggcgaaggacgagaatggcgagcctattggggagcaggagatccacgatcaggtcatcgcgatactcaccccgggcagcgaaaccgtcggatccatgatcatgtcgctgcttctcgtcctcaccgagcacccggatctcggcgacaagatccgcgacgaggtgaaaacggtggtgggcgaccgccccgtcgcattcgacgacgtccgaaaactgaggtacacagcgaatgtcgtcgtggagacaatgcggctctatcccgccgtctggattctgacccgccgcacggtcgccgacaccgagctgggcggcttcaccattccggcgggcgcggacgtcatctacagcccgtacgccatccagcgcgaccaccgctcctacgaccggcacgaggagttcgaccccgaccgctggctcccggagcgggccgccgaggtcccgaagcacgcgatgagcccgttcagcgtgggcaaccgcaagtgcccgagcgaccacttctccatggccgaactcacgctgctcaccgccgcgatcgccggcgcctaccgcttcgagcaggcgcccggctccgatccgaggccgcgcatcgggatcacgctccgcccgcgccgcctgctgctgcgggccctgc

SEQ ID NO: 547 - DNA, 6909 bp, Unknown
  Kingdom: Bacteria, Phylum: Actinobacteria, Class: Actinobacteria, Order: Streptomycetales, Family: Streptomycetaceae, Genus: Streptomyces
ccatgtagcacctgcgcaggagcgaccagaccagacgccttcgaccgggttgaggtctggtgcacagctgcgggccatgcgctccttgagcgtggcgtccttgggggtgcgtccccggggtgcggcgggacctgctcggcgtgggcgaggcggccgtcgttgctgccggcgtgctgccgacggcagcgttccttgtcctcggcgtggcggcggggcttgtcggcggcttcagcctcgatctgcgcgcgggcgccctgcaaccgcgcgaggcgtttctcgcggcggtccagcccggcgggcgggtcgggcctcctcgtcgtcgacgccaaagcgctcatcctcggcggtgtcggtggcctcggcgtcgtccagcagggcggcggctttggcctccaggcgggcgatctcggccttgagtcgttcctccttgtcgatgagccggccgtagctcatggtcttgtgcttggaggcgttggcctccggttttgcgccgtccagggcgacgcgccccatcttgaccatgccgagcttctgcgcgaggcgcaggcactggagcaacaggtcggccggtgcctccaggtggcggcggcggaagcgggagatcgagtggaagctgggggctggtgggcggtcaggaaccggagggcgaggtcgtcgacgcacgtgtgctcgatcgcccgggaagagcggacgccggtggtgtagccgtagatcagcaggcgcaccatcaggcggggctcgtagggcgggtagccgcgcttttcggtgtagtcggccaggatcgaggagaggccgagtgcctggtcgaccaggtcggcgacgaaccgggccaggtggtcctcgggcagccagtcgtccagcgacggcggcagcagcaggacctggtgcgggtcgaacgccctgaaccgcttgtccaccgccaccggacgaccctgcggctgcttcttctcgaccggccgcccgacctcgaacagaccatcacccacgcatacaggcatcattctgcacgaatggtattgaatgaaaggcgggttgccggttactgatccgcgttcgtagtcggctcggtcaggcggtcagcgccgcgagctccgcgttggcgcgctcggtgaccagggcgaggacgcgaccggcggcggccaggtcctcggtgggcatcccgccccagatgcgggcggtgatggggccggtctccgcgccgacggcggtgatcagctcgcgccctgcatccgtggggagaaggtgcgcgccgtccgcgacgagcaactgcttggccagcagctcgtcgacggtggcgcggacggcggccgggccggtcttgagggagccccggacctgggtgacgagatcgtctggcgtctgcggggcgtcggcggtgactgcggtgcgcagggcgacctgctgctggaacgtgatgccgtgccgggccagaacgtgctccaggacgccgcgggcggcgtagtgggccaggccaagggcgcgggcgtcggcgacgggtgcggtggtggtggatgcagtggcggtcatggtgttgtcccttgagtgctctcgctgttcggtacggatggagtgagtggtgcgtcgagcagagtcgtcagctcgtcggtgaacgcgcgcgtccgcggggcgtcgaggccaccgagtggctccagcaactgctgaagcagttcctggaccactgcgatggcctgccgcgtgacggcctggccctgctcggtgagggcgagctgtacggcgcggggatcgcgggggtcgcgggtgcgctcgatcaggccggccgactccagggcccgcgccagcttcgagacgtacagcgcctccatgccggtgtggtcggcgagtcggcgctgactggggcgctcgccggcgcgctgcatgccgtgcagcgacgcgaccagtgagtactgcgcgtgggtgaggcccagtggggccactgcccgatcgaccgcgacgcgccacttgttggcgagccgccataccaggaagccgggcgtggggccgggcgaaccgttgctcatgcatatagagtacttggctactatatccatggctactattttttggggctgaacttcaccgtcgtgctcgaccagtccgcccagaacaccggcacccactccaagcaggccctcgtcgacgccggatactgctccgagagacgggtccggcccaccggccctctcgggccgcttccctggcctacaggacccggccgcctgcacggcaggcaccggccgggccggacgaccgcaaccgacctcggcgaccacgatcaccaggtcagttgccggttatcccgcactgtgactgcctcgcgcgcgctcggctggggtttccccccggctggggtttccccccagcaaccgccccgccggccacaccggacgctgcggccgggcatcagcagcccgccgggtgaactgcaccgcatagcgggcacggtggcctccggcagtccgggctcctcggccgcggacaccagggcctgcagaaaacatcaggaccgtccggaccgtccggacgtcggcgccccgcccagcaggaaggtgttgcccaccgcgttcggcaggaaggcgtccggcagccgcgcggcgagcgtctgctgggccgcccagctcgtgcagtgtgcggcggccaccacctcgggcgccatctcgaccagttcgtcgaccgtccggtcgacgaccggcccgaaacggaggtgcagcccgcccagtaccgcgtacacccgctggaccccggtcaccttccgggtgtgccggatgatgttgacgatcccggcgtgcccgcaccccgtcaggatcaccagccccttgtcccgcacgtgcagaacggcggcctggtcgtcgtcgatccggtccggcacccactccccgtcggcgcacgcctgatggcccggctgtcccgtctcgaactcggtgacgcgctcgacctccccggtgatcagcaggaagtcgtcgagcagcagggacggacgccgttcctccagcaccgtgaaccccgccccctcgacggcggcccggctcggcgtcggcaggtccagcacaccgcccggaccggcgatccggcgccgccgccacgcgtcggggtggagcagcaccggcagccccgcccgcccgagccgtcccaccagcccgtgcagccccgtcacatggtcgaagtgcccgtggctcagcacgacggcttcgaacgtgtccggacggatgccgaggcggtcgaggttgccgatcagtccgtcagtggtggcaccggcgtcgaagaggacgcggcggctgccgccgtcggtgtcgatctccagcatcgccgagaagccgtgctcggcgcgcagcacgtcgagcgtggtgcccgacacggtcatcccggccggtgccacgggcagcggtcccgcggtgccggccagcccccagcgccgcacgagacggccgtccggcagcagggcgtcgctggagttgtcgatcagtgtcgtcacctgcacggcgtcgaccggacgcagggcgatgtgcatgaggggcctccttcggttccgtaccgcaccgatgccatcgcaccaccagccaccgggtccaggaccgttccgctctcgccccgagcgtttcgctatcgtggccggtcatggacctacggcagcttcgctacttcgtcgcggtggcagaggaactgcacttcggccgggccgccgcccgcctccacatgtcgcagccgccactgagccagcgcgtccgggagttggaggcggaactcggctgccgcctgctggaccggtcaccgcacggggtgcgcctcaccgacgcgggccgggtgctgctcgccgaggccacggagatcctggaacgcgccgagcgggccaaggacaaggtgcggcggagcgccgggcaccgcacggtcgtggtgggcgccgtcgccggcgccggacccgccctcgacgcacggacccgggcggacttccgccgccggcagccccatgcgagcgtccgattgcgggagtgcacgctgaccgaccccagcgcgggactgcgcaccggacagaccgatgtggcgctcacccggctgcccttcgacaccacgggtctggccacccgggtgctgtacgaggagcccctggtggcggccgtgcccgccaccgaccccctggccatggcaccccgggtcgacctcgcggagctgggcggacgcccggcgttccggctgccgccaggcaccgatccgcagtggcgcgagttctggctcccggtctccaccgacgcaccggacgcccccgtggtacgcaccatcggtgaatgcctgcacgcggtcgcctggcgctcggccgtcggcctgctcccggcctccgccgcacaccggcacccggcggagggtgtccgtttcgtcccgctggccggacaccgtcccagccgcgtggtgctcgcctggcggtccggggaggcggacggcacggtactcgacctgatcgacgccgtcaccagcggcggtggcgacaatggcgatggcgatggaggtggagcgctcgggggcgttgacgcctccgggaggtagagctaggggcgacgcacgagcgtgccttcccgaccgacggtgcaacgcatgcaggccgggcggtatggcggaagggcgggcgcgcacggagcacagcggtcggcctactcgatgaccagaagtcgatcactcgggaaggtacgcccttcgcgtccgccccgaggccgagccacaggtcatgggcattacttccaaggagacggccccgacacgctcttcgcggaccgcggctacgaccacgacaagtaccgtcggcttcttcggcaacgtgggatccggtccgcgatcgctgagcggggacaaccgcacgggaacggcttgggcgccttcccctgggtcgtcgagcggaccgtctcccggctgcacggtttccgccgcctacggatccgatgggagagacgcgacgacatacacgaagccttcctcggactcgccgtctgcctgatcactcaccggcacgtccagcggccttgttagggccagtcaggcaacgttcgccctgttgtagaaccaagccaatacggccgcgccgatgggtgtcccgacaaggaaacccgcgaggagcccgaagccgtgatcagccaccaccggaaaagcccagtctgctgttgcgccaacaagcagtgccaccgcagtcaatgcgaacagagcggcgacagcagcgagccgacgcggcggccccgcgcggtgcaactcaaccgcaggcttcgccgcaaacatgccagtcaagagagcgatgaaccccgcgtcgggtagccacccgaacggccacgcaaccaaggcgacagccgcgcagaaagcgagaccaaccagttgcagcacaacagtggaccacaccacacccgacagcccgcgccgaatcgcgtcgaccccgccgtccttctcctcagtcacaccggaagggtagccgtcacgagggcgaacggtgcctgatgcgactccagttgctggcccgctgccttctccgctccgagatccgggcccccacgatcgccgctgccgatatgagcccaggcacgaacgccgcagcccaggattcggagaccaaccagcggcccagcatcgtcatgaccgcccccccaaaccagggcaagtgccgctgtcttcgtgatccaccgtctccgctccacgctcccatcatgagtcaagcgaggacctggctgtcgccgaactgccagaccgaggtgacatggaagggcggctcgggcggctcccgccagccgaatgggctctcgtcgccgtccagatcgacgacggtctccctcaggctgacgagcgtgcgttcccaggcggcgccgggccagggcgtttgctcgccgcggggcggggacggcggccgggcttggggctgctgacgggcagccttcgcacgtccagttcgatggtggcgtgcgtctcgccggtctcgacgatgcggaggcggtcagggcctgaatcgctcgcgtgcagccgcctgctgtcgtccggtcggaggcaccgaccggacgacagcgggatatcacccgtccgggagctgtcagagggcgaggctcatcaggatctcgtcccggtcgtcgccgggggccacacccgcagcgctctgggccatcggccgacctcgacccagccgagtctgcggtaggactcctccaactcctgatgctccgttacacgctcgaccgacccggcatcaagcgcgggagggcacgcctagctgattccagcggcacgctcgcgagacgtcagtctcgcttgctggagtagggcagcagggccatctcgcgggcgttcttgatggccgcggcgagctggcgctgctgctgggcggtgacatgggtgacgcgccggctgcggatcttgccgcggtcggagatgaacttgcgcagcaggtcggtgtccttgtagtcgatgtaggcgatgccggccgcgaccaggggattggagcgggacttcaccggcttgcgggtgttgacgcgtcgggtcatgcggattcctcggatcgtcgtggtgacggtgctgttgtgcggggtggcggattacgcggcgtcgagcagggagtcgaaggccgccggcaggcgctgccagccctcgggtccggccgcgtactcggcgtcggtgagcaggcaggagtcgaggagctgctcgatgccgaagcggtcgagtccgggggaggtgaagacgaggtgctggcagcggtcgccgtgctgcggatgccagtccagggcggcggccgcccgccgtaccggggggaccagttcccacgccgcgtcgggcagggaggcgagccaggggccagcgctctcgacgcacagggcgccgccggcggcgtcccaggagagcagcgtgtcggggcggtcggcgagccagaaccgccccctgctgcgcgccgccgcgcag

SEQ ID NO: 548 - DNA, 3535 bp, Unknown
  Kingdom: Bacteria, Phylum: Actinobacteria, Class: Actinobacteria, Order: Streptomycetales, Family: Streptomycetaceae, Genus: Streptomyces
taccgcgcggggtgccgccgcggcccggcgagaacacctcggtctcgacctcgtccacgtcgtcctggagggcggaggccaccgcgatgtagccgtccacgacgtggtcggcgatggcgtgcagcaccgcggaggggcccttggccagcagctcggggtcgtcctggagccggtgccgcagcgcccgcagcgagccctgcccgccgtgccggacggtgatgaagaagtcccggccggtgaagcacatcacctcgccggtctccacgacctcgctgttggcggtgagctggtcgtggtcgacgtagtggatggtcttgaagacggtgaacagggagtcgtcgtagcgctccagcttgggccgctggtgggcctggacggcgtcctcgacggcgagcgggtgcaggccgaactccgaggcgatacccgcgaattcggactcggtcggctcgtgcagcccgatccacacgaagccgccgtcgcgccgcacctggcgcaccgcctcctgcggcgtgagcggcgcgggcgtctccaggcgggcgccgtcgcggtagacggcgcagtcgacgacggccgagggcgtcgccgggtcgcgagtggtgtcgtaggtgccgttgtccttgcgctgccccgggcgggacgggcggaccgcggcacgcaggtcacggatcatcgacatggcggggctccttcgtgacgagcgacgaagagcgccgacggcggtcggaactgcccggaatgaggacgtccggcgtgcgggatgtttcgcacgtccacaaagcggggagcaccgcaccgacgcggtgacgggcttcgtcactgattcgatcggtcagatcgggcgatcaggcaaacgaaacgaagtgctcttccgtacgacgcgcgtggaggcacgaaggcgagaggtggcgggtcagccggagccggaacagctacatcagcggcgggaagagcgggtgctactgcacggtcgacttcgatccatgacagccccacctcctccggccggtccctcgtaagggagtcccatcggtgttcggagcctgatggcgacgctctgcgtgctgccccgaaccacgggcaagagtatcagtcggccgacgtgtcaaggtgccgctttgccgcgtactgacgagttctatgctcgcggcatggcagatgttcttcctctggtcgaggcccggttgcgctccgcgctgggcgagccggacgcgcgcgcggcggtcaccttcctcggcacggaccgtatcgaggtgctgcgcttttgggcgggggacatcgtccgctacgccaccctcggcatgtccgcccgtccgatgacggaccccaccgcggtgctcgccgacccggtcgaggggccgcgcgccgagttggtgctgagtgtgcgggccgggctcgccgacaccgacaaggtgctccgcccgctcgccgtgctcgccgcgtccccgcaggtcgagggtgtggtcgtggcgcccggcgcctccctcgacgtgggcggggagctgtggccgaaggcacccttcacctcggtcctggtggccgagccgggcggcctggtggaggacctggaactcgacgcgccgctggaccccgtacggttcctgccgctgctgccgatgacgccgaacgaggccgcgtggaagcgggtgcacggcgcgcaggcactccaggagcgctggctgacctgcgggacggacctgcgggaccctgcccgccggtccgtcccgctggagtgaccgatctcactcaagagccggacggtgtgcgtcagttggcgaagacggtgacgctgtcctccgtcgcgtggcgcggctccagttcctccgcctcgtgggtgagggcccggcgccggaccagcaccaccagcgcgcccagtaccgcggtgacgccggcgaccacgaacgggatgtggatgtcggtccactcctcgatcttgggcgccaggtagggagcggcggccgcggcgaaccagcggacgaagttgtagcccgcgctcgccaccggacgcggcgcgtccgagacgcccagcgccagctcggtgtagacggtgttgttcacgccgatgaacgcgccggacaggacggtgcagacgatcgcggcggtgtggctgccgtagccgaggacgaccacgtcggcggcgagcagcaccagggaaccgccgagcaccttcagggagccgaaccgcgcctgcatgcgcggggccaccagcaccgagaagatcgcgagcagcaggccccaggcgaagaacaccgcgcccgacttgtacggcgtcatgttcagcacgaacggcgtgaaggccagcacggtgaagaacgtgtagttgtagaagaacgccgagatcgccgccgaggcgagaccgccgtggccgagcgccttgatcgggtcgagcagcgaggtcttgcgggccggcttgggctgttccttcaggaacgccgtgatgcacaggaagccgacggccatgaggcaggcggtgccgaagaacgggtagcgccagctggcgttgccgagcagggcgcccaccagcgggccgcacgccatgccgaggccgagcgcggactcgtagagcaggatggccgccgcgctgccgccggccgccgcgccgacgatgaccgcgagcgccgtggagacgaagagggcgttgcccagtccccagccggcccggaagccgaccagctggccgaccgagccggaggtgccggcgagtccggcgaagaccacgacgaaggcgaggccgagcagcagcgtcttcttgccgccgatgcggctggagacgaagccggtgaccagcatcgccacggcggtgatcaggaagtacgaggtgaagaggagggagacctggctgggcgtggcgtccaggcccttggcgatggagggcaggatcgggtcgaccagaccgatgcccatgaaggcgacgacggacgcgccggccgtcgcccagacggccttcggctgccgcaggatgctgccggcacccgcgtcgaaggggtccgcggacatgcgtgctccaatccggacggaggatgcttggctgatggttggtgtatgcacatagtaagttaggtcggctaattaatgcaaggtgcatctagttcgtccggtgtggacggtctccgtccggacgggtgatcgtccttgacgcggcgcggtccgggtaggaccgtggggccctatgaggggcgaacccagttgcccgaagtgcggtggccgggtcagggctcccggactcttcagcgacacctggcagtgcgctgtccacgggacggtgtatccggtgcagcccgtgaccccgcccagcgtcgaggggctcggcgtcgtcgtgcaccgcacccaggtgccggtgtggatgccgtggccgctgcccgtcggctggctgttcacgggcgtggccagcgcgggcgacgaccgcagcggcggccgcgcgagcgccgtggcctgctcgggacccagcccgctcggcggcatgggcgagctgatcctggtcgccgaggaactcggcgtcggactcggcgcccgctacgccggcatcgagggccccgac

SEQ ID NO: 549 - DNA, 4931 bp, Unknown
  Kingdom: Bacteria, Phylum: Actinobacteria, Class: Actinobacteria, Order: Streptomycetales, Family: Streptomycetaceae, Genus: Streptomyces
gaactgccgcgccgccgccaggttcaccgcgcgcgcagcctcgcgccgccccactggccgcgccccggcctcggtctcggtgggagcgggccctaggcccagcgtctccaggaggtactgctgcgcgggcatcagccggtcccaccccgtacgctgcgctgccgcccaggctccgaggtcttcgccctgcacgatcacctcacccgcggcctcgggcagcgtcccgccggcgcggacatgggcctggcacagccggtaggcccgctgccatcccgcgtcccacgccgggcaccatcccgcgtcgatggcttccagggcctccctgcggctctcggtgagttccccggtgctgggcacgcccgtctctcgcccgccgcgcgccgcgcggcgttcacagcggccttccgggcggcctgacgctggttcttcgcccacactccgatgggttgtccctcccacaccgccgtggtggccgggggcacgaagcgtgcgcctcggcgtaggagcgggccacggcgagcatgccctcccactccgtgtagaccgaccagaccatgcccagcttctccagctcggccacccgcgtggcctccagcgtcccggccgcgtagtacctgcgctgacccgccaaccacgcacccaatggatgggcgccgactccggaccagtcttccgggtgtcctgtctcgccgaactttgaccgttctcagtgaagatgggcccgcgagcggttcctatcactctcccgcagccagcacctctctggcgcggaccgcgaaggcttcgcaggcatgctctgcagcctcgcctcgggtaagcatgtcggtcttatctgtagccaagaagatctcccgtgtcctcacctggatctcagcagcctgctcagcgaggcgctgcgcctgcgggctgagggcgacgaggcggagccggaggacgctgctgcggacctcgacgtagagccggtacgactcggcccgggcggtgagggccgcctcggagtcgggtactgcgtgctggctcgtccaccggtcgtactgcgcccgccggtagtcctccgccagggcgatgaagtcagcactcgcatcgaggaggcgctggtggactcgctcgcggtcagcgcgggctgcggaccgggctgcgctcttctcctgatagcggtgtgcgacgacagcaccgaacagtgttccgatgacggcgatggccgccgcaatgacccccgacacatcgaccagctcaccatcaggcaagagcgccggaaagagcgtgaaccggccaccgtcctcgcatccaggtctcatctggcgttccccttcgccgtccgctgacgcaaggtccgaggacagcctcggcagggccggtgggccagtgagacgaccccacggaggaagttctccggctggatcggtgattacggcaacgtccacggtgtccgcctcaccctcatcgacgaggagaccggcgagacgttgacgacctggccgcaggaggcacaccgtctgccaagctggggatcatggctcaccgtccgtacccggtccgcggccgcgcgctgcggcagatcatgcgccggcaccgcaacgagatcccgcccggcctgctcccgccgacccgcacgcgcgcccgagcagctgccggtcggcgcctaccggctgtcaacgcgccgcccctgagatcacccgccgtccggggccgggcgccgggcggccttcttcaccccggcctccacctcggtccgcgactgcccctccgccgcggcgtactcggtgacggcggcctggacgtcgcgggcgaggtcgcgccaggcaccccacgcggtctcatacgtttcggtctgctgctcgctccactgccgggcggtcggcggcccgtactgatcgcggagctgctcgacctgcgcctgcgcctggtcggctgcgcgctgcatctccacgagttcttcgaaggtgtgtgccacgcgcggatcttaagcgggcggtcagatgtgctgaccttcggacttacacccgatcgggtagagcccctgacggtctcgggcaggtcgccggcctggcccgctacgaagatcacgacctgttcgggatctgcgaagggaccaccgttcgatgcgtttcgcccgcaccgaggccgcggtcgccgccttcgctgctctcttcctcccctccactgctcacacggctgccgcggccggcctgcagcagcacgcccccggccagacggtgaccctgcccgtccgtgacgccctcgcccagcttcccgtccgcgacgtggaccgtacggggtacgagcgcaggaagttcaagcactggatcgacgccgaccgcgacggctgcaacacccgccaggaggtcctcaaggccgaggcggttgtcgcaccggcacagggtgcgaactgcacgctgaccggcggcacgtgatattccccgtaccacccgggtaggcgctcgcggccgcgagtcgcctgaagacacggcggcgcgcccctgcaggaggagatgacgggtgctggaaggccgcgatgaggaggcggcgccgccgcgacgggtggcccaggctaccgtttccccgtgggtgcaggcgatgtagagcaagagcagatagagcagggctggagctatggctacggcttcgtctgcgccggatgtgtcgatgacgagaccctcgcagcaaagatcacagcagatgccgccgaggacgacacctgcaactactgcatgcgcacgccggcggcccccatcgacacgcttctcgaagcgttcttcgacgggctgcacactgagtattccttggccggcgacgccctcgcttacttcgggggcgaactgctgcccgccaagcgctgggaaggcgaagagctcgtcgacgagtactcggacgtcctgctcagcgagaaactgcaggagactgtccgcgaggcggcgcggcacgatgacgtctgggtggagcgcgacttcatcgaacctcgccaggacgaggcgctgctcgacggctgggagcgcttcagccatcaggtgatgtaccggacccggcacgtgttctggctggcccctcccgacaaggacgaggtctatctcggtggcggcgagatccctgccgcagccatcctccagaccctcggcgacctcatcccccgggcaggactcgtgcgggagattccggcagggcaccgcatgtggcgcgcacgtgcccacgaggccaaacagcgctggtccgcccacctgctggggaccgcgctgcccactcaggcccgacaccccaaccggatgagtccggccggcatccctctcttctacggagccgacagtcccaccactgccatccaggaagtggctcgccacgctgccggcgtcacccgctttgtcacttacgccgcattcgaaaccacccgcccctgcacggtggtcgacttcacgcgcctggaacccgtccccagtatcttcgatacaggccgctcacgcctacggcgcgcgctgatgttcctccacgagttcgtgaaacgcatcagtgccgatgccgacggccgcgagcacctcgaatacgtgcccacgcagatcgtcaccgagtacttgctgcgggtcttcgaccaaggccccctcgatgggctcctgttcacctccgctgccggtcgcaagggcgtctgcacggtgctcgacatccctcaggaccactgtctcgatcctgccgacccagagcccgacgagcgccccgccctgcggctggtccccggtacgctccacgcgaaccagcccttgcccgccgcgcgccactgcgactgagagacggcaatactgccggaacttggtccaatcggagggcctgggcgtggcatacaggctggccaggccgcacagacccgcgtcctacctgcacgagcactgatcagaagccggatgagtgggccgaaaacccgcccttccccatctcgccggggacgtcgccgtaacagccaggcggctgaccgccccagatctctatgatcgtccgatgtatgcaggcgcaagtcagggcacgcggtccggggctgcacctgccggatacgaggtggggggctgtgggacagacttggggtgcgctcgccgtggccgttgtgggtgtcgtcggcactttgggtgccgccttgctgacgcagagcagggccgaccgtctcaagcaccacgaattggaagcgatggcccgccaacagcgcgaagagcggaactacgccgaacaggtccgacaacaggaagcacgcaccacaacacatcgcgaactcattgatcttcgacgagcctgctatatctccctcaacaccacagcacgccagtaccagaccgcacagatcaatctgatgcacgcgctgcgggcccgagacgacactgagatccgggcctgtgccgagcagcttgaggaacgacgactagcccttcgcgacagctacgccgaagcgcagatgatcgtgcccgccggagtgctgacatgcgcccaaggggcgagtcgtcagctgaacaacacctacggcctgctgaaacgcgtactggcaggtgaccatgccagcgacagccaactcgatgctttggaagctgagacggagatgtcgtgggtcctgctgtccgacttgcgcggtgccatgcgcagtgaccttggcgtcgacgagccctccgcgtagctccaccccccgattgtgaatggttggtgttgtgtcggtgggttggtcggcagcgagtcgacagtggtctctgatgtggttgattgcccaggcctatgcggagggatcccgctcttcgccggcgtggtcgaaaccgcgcagcagcggcgtgagctcctgcgcgcacccgcacagagtgcacaaggtcgtcgccgggttctccgcgacgtccagggcgcgttccaggtcgagcaccggggcgtcgtgcggcgcctcggcgcagtccggtgcgtgcagcacacgccgggcc

SEQ ID NO: 550 - DNA, 3202 bp, Unknown
  Kingdom: Bacteria, Phylum: Actinobacteria, Class: Actinobacteria, Order: Streptomycetales, Family: Streptomycetaceae, Genus: Streptomyces
gcctccgggtcggcggcgatccgcgcggcaccggcgaccgcgccgagcatttcggtcgcctcctcctgggccagcacgttcagctcgatgcgccgcacgtcgtagtcgccggtgaggtggtcgatggtgtcgcggctggtgatcagtacgcggcagcggccccggcccggcagcagcgggcggatctgcgcgaacgtacgggcgttgtccagcacgatcagcatctgcttgccgtccagcatcgaccggtacagcgcggcccgctcgtgctggtcgccgggcacctgctggcccggtacgccgagggcgcgcaggaaccggtcgagcacggcggccggagcgagcggcgagtccgactcgtcgaagccgcgcagatcggcgaagagctggccgtcggggaagcggtcggcggcctggttggcccagtgcaccgccagggcgctcttgccgaccccggcgatgccggagacgacggcgacggagaccggcgacgcgtcacggtcaggggccgtcagcaggtcgaggacttcgagttcacggctgcgcccggttaacgcggccggaccggaggggagttgggcgggaaccaccgcgcgcggctgcgggacggcctgcggctcgggcggcagatgcagttcggtcgcgtcctgcaggatcagttcgtgcagttcctggagttggttgccgggttcgatgcccagctcctcgaccagcgcccggcgtccctcgcggaacacctccagggcctcggcgcggcgccccgagcggtactgcgccagcatcagatgggcccgggcctgctcgcgcagcgggtggtcgcggaccagggcggtcaggtcggggagcagggtgcggtgccggccgcggcgcagttgcagcccggcctgttcctcacgcagttcgagtcgcagctcggcgagccgggaggcctcgtggtcgatgagcccgccggtcgccccgtccagcgcgacgccgcgccacagcgcgagggcctcggcgagcaggcggctcgcctcggcgatgctgccggaccgcgccagttccctggcccgctcgacagtggtctccagttcgagcaggtcgatgcggtgcgggccgacgttcagggtgtagccggggtgggtggtgacgatcaggtcgtccaccccgccggcggtgcggaacgtcttgcgcagcgcggtgacgcagatggcgatctgattgcgtgcggtggcgggcgggtcctcgccccacacggcggcgatcagcgcatcgacggagactacccggtccggcgcgatcaggagcatggtcagcacggtgcgccgacggcccccgccgagccggacgggttctccgtccacctccacgtccagtggtccgagcagtctgaagttgatccggtgcaagacgtcccccacttcccccgagccccccggagccgccgggacattgtgggccttttctccgtgaagaatcaacgaagatccaccggacgtccacgaaacgaccacatggagggcggcgtagcggctttctcggggcgaatcggtgccttcgggtccgacatggagcgaatataggccaacccggagagtgggcgggtacgtcgatgccgagcagagcagaggaacccgacatggccacgaaccccttcgaggaccccgacggcaccttcttggtcctcgtcaactccgagggccagcactcgatctggccgtcgttcgccgagatcccggccggttgggaggtcaccctgtccggcgccggacggcaggaatgcctcgaccacgtcgaggccacctggaccgacatgcgcccggcgtccctgcgcggcgcgtaggcggaccgcggcgccccggggcggggccctgcggttcaccacggctctccgggatgaggcaccatctcgggagacgaggagcagggcgccgcgcgtcggcgtgtgcgggccgccgtcgccggacggcgtggacagaggtgagggaaaaggtggacgaagcggtggagccgaggatcgccgtcgccgtggtgaccatggggaacaggcccgccgaggtcgacgccctgctggagtccgtggccaagcaggatctcgcgccgtcccgcatcgtgatcgtcggcaacggctgcgggctgcccgagttcgcccgccgcctctccctgcccggcgaggtcaccaccctcgacgtcgacgacaacctcggctgccccggcggccgcaacgtcgccctcgcccggctgcgggagtacggcgacgtcgacgtggtcgtcgaactcgacgacgacggactgctcgtcgacgcggacgtgctgcgccgcgtacgcgatctgtacgccgccgatccgcgcctgggcatcgtcggcttccgcatcgccgacgagcacggcgagacccagcagcggcacgtgccccggctcggttccgccgacccgatgcggggcgggtacgtcaccggcttcctcggcggcgggcacgccctgagcatgcggatgctcgaacagaccggcgactggcccgcggagttcttcttcgcgcacgaggagacggacctggcctggcgcgccgccgacgccggctggaagatcctctacgctcccgagctgctcctccagcacccgaagacctcgcccgcccggcacgccatctactaccgcgtcaccgcccgaaaccgcgtctggctggtccggcgccggctgccgctcgccctcatcccggtccacctcggcgtgtggacgcttctcaccctgctgcggacccgctcggccgccgggctgcgggcgtggctcggcgggttcgcggagggactgcgccggcctgcgggggagcggcggcccatgcgctggcggaccgtgtggcagctcacccggctgggccgccccccgatcgtctgaccgccctcacttggcgtccgcgtagcactccaccaccgccatcgtgaacgggaaccgcaccggcgtcgagccgaacgtgaggcggcccgccagctccgccgcctcgcgtatcgccgccgcgaccgcgtcggcctcctcctcgggacagtgcacgatcacttcgtcgtgctggaagaagaccagctcagccgccatgtcccggcaggaacggcgcagcgcggcgagcatcagcagggcccagtcggcggcgctgccctggaccacgaagttgcgggcgaagcggccccgggcccgcgagtcgccggaggcgtaccccggcgcccagccc

SEQ ID NO: 551 - DNA, 4100 bp, Unknown
  Kingdom: Bacteria, Phylum: Actinobacteria, Class: Actinobacteria, Order: Streptomycetales, Family: Streptomycetaceae, Genus: Streptomyces
ggcgcggacggcgctgtcgccgggacccggacgccggcggccccggccgccccctccgtgctgccggaggtggcggcggggaccacggccggggcgaaggcaccggccaccagcagccctgtacacaacgtcaggcgcagtgaacccatcgtgacacctccgggtaccaggagacgtcacggggccgggatccgcatccgcaacgggcggctgctgctccgtacgggtgagcgtgggttcagggcctgccgggggccgggctcagatgcgttccaccaggtcggcgatggagtcgatgacctcggaggggcggaacgggtagcggtcgacgtccttgggctgcgtcacgccggtcaggacgaggaacgtgcgcatcccggcctccagaccggcgagcacgtcggtgtccatgcggtcgccgatcatggcggaggtctcggagtgggcgccgatcgcgttcagtccggcgcgcatcatcagcgggttgggcttgcccacgaagtacggcttcttgccggtcgccgcggtgatcagggcggcgaccgagccggtggcgggcaggtcgccctcgacggaggggccgacgttgtcggggttggtggcgatgaaccgggccccgtcgttgatcaggcgcacggccttcgtcagcgcctcgaaggagtacgtccgggtctcgccgaggatcacgaagtcggggtcgtggtcggtcaggacgtagccgatgtcgtgcagcgcggtcgtcaggccggcctcgccgatgacgtaggcgctgccgccgggccgctggtcgtcgaggaactgggcggtggccagcgcggaggtccagatgttctcctccggcacgtccaggcccatgcggcgcagccgggcgtgcaggtcgcgctgggtgtagatcgagttgttggtcaggaccaggaacgggcggcccgagtcgcgcagctgcttcaggaaggcgtcggcgccggggatcgggacaccctcgtggatcaggacaccgtccatgtcggtgagccacgactcgatgggcttgcggtctgccatgggtttcggtctcctgccgtacgcgggcctgcgtgggccccagcctaaccagtgaccggatcttgccggaacggttcagcgcggcactgttccggcaggccggagccggggccgagggcgggcgtccgggccccgccccggacgcccgcccggccggtcagctgccggtggcgcgcttccagtcctcgacgtacgtggtcaggttcgcgccgatgtcggtccagtccggctggaacacctgcacgccccgcatcagggcggccagtgcggtggcgttggcgtcggtggcgtgcacgtccgtgcgggcgctgaagccgccgccgatctcgctgacctgctgctgggcctgccgggcgagcatgaagtcgaggagctttctgccgttctcggtgtgcggggccttggtgacgagcccggcggcgtagggcagggcgaacgtggtgggcttgccgccgccctgccgggccgggaaccagatgccgaggttcggcatggtcttggactgggcgtagttcatctggacatcgccgttggcgacgagcagttcgcccttgtccaccttgggggcgagcttgccggtggaggcggacgggccgacgttgttggcctggagcttcttcaggtactgaagggccgcgtccttgccgccgaagtcgtgcacggccttgacgagcacggcggtgccgtcgccggcgacgccgggcgtggagtactggagccggttcttgtacttggcgtcgaggagctgctcccaggtggtgggggcgggcttcagctccttcttgtcgtagacgaacccgaagtagttgttgacgaccgaggtccaggtgccgtcggccgccttgtcggcggcggcgacctggtcggcgcccttcggggcgtacttctgcagcagccccttgctgtcggcctgctggatgaacgggggcagggtgaccagcacgtcggcctgcgggttggccttctcgcgcacggcgcgctgcaccatctcgccggagccgccctcgacgtacttgaccttgatgccggtctgcttctcgaagtccttgaagacgcggtcgtaccagccgtcgccgttctcgcccttgaggccgtcggcgctgtagacggtgacggacttgtcgtcggcggcggccgaggagccgccgcaggcggacagcagcggggtggcgagcagggcgagggccacggcgagggcgggcttgagggcgttcctgggcatggcgaggctgttcctgggcatggcggggcgtactccttgcggcgaggggagggagacgagggtgcgggggcggccgggtgtggtcagcggtaggaggcccgggtgcggacgcgggagacggccagcaggacgagcagcgtgacggccatcaggaccacggcgacggcggagccggtgaagagcgaaccccggtcggtggccgcgaagatcagcacgggcagcggggtccagtcgggcgggtagagcatcatcgtggcgctcagctcacccatggacagggcgaagcagaggccggcggcggccgtgagcgagggcagcagcagcggcagccgcacccgccacaggacgtacgcgggccgggcgccgagcgaggcggcggcctgttcgtaggccgggtcgaggcggacgatcgccgccgacacggactggtacgcgaaggcggtgaccagcacggtgtgcgcgacgatcacgatccagcgggtgccgttgagcagcatcggcggtgtggagaacgccaccaggaccgacagtccgaccaccaccgacggtacggcgaccggcagcacgaagagcgcgtcgagaacccgtcgctgggccttcttcagggcggccccggccagcgcggcccaggtgccggcgaccagcgcgagtaggctcgcggtgacggcggtgaccaggctggtggtcagggcctggagggcctcgccgcgggtggcggcgcggtagttgccggtggtcaggccggaaggcaggacgccggaccagtgggtggcgaaggaggcgccgaggacgacgaggaggggcagggcgaacaggggcaggaagaggacgaggaagaccgcccacaccgcccagcgggccttgcggctatgcaccagcacgacggctcaccacccggtagaggccgtagaggcccacggagatcaggacgttgacgacggcgaccacgcacgcgcccgggtagtcggactccaggatcgccttgccgtagacgagcatcggcaaggtggtgacgcccttggcgccggtgaagagcacgatgccgaactcgttgaggcacagcacgagcacgaggctcccgccggcgccgagcgcgggcagcgcctcgggcaggatcacctgccggacgatccgcggggcccgggcgcccagcgaactggccgcctccagctgggcggtgtccagttgcgtgaacgcggcgagcagcgggcgcatcacgaacggcgtgaagtaggtgatctccgcgaggagcacgccccagggcgtggtcaggaacgcgaagggtccgtcggtggcgccggtggcctgggtccacagcccgttggccaggccggtgcggccgtagacgaacagcagggcgagggtgatgaggaaggagggaaaggagaggaagacgtcgatgaaccgcgcgaccgccttcgccccggggaacggtacgaaggcgatgaccagcgccagcaggaaccccagcaccaggcagccggcggtcgaggcgagcgcgagccagacggtggtccacagcgcctcgcggaaggcggccgaggcgaacacgtcggcgtagggcttcagggaggtgccgccggtgtccggctggaaggactgctggacgacgaggaggagcggatagaggaagaagacggcgagcagcgcgaccgggggcagcgcccagagcaggcgccgggccgtccggggggcgcgcgccgcggcggagggcgccggggcggcggtgcgcgggcccggcgcccgggcgggcgccggggtggtcagcggctcagtggtcatcgccgctcacccccgcggccagcagcaccgcgtcctcggcggcgaagtgcaggct

SEQ ID NO: 552 - DNA, 2881 bp, Unknown
  Kingdom: Bacteria, Phylum: Actinobacteria, Class: Actinobacteria, Order: Streptomycetales, Family: Streptomycetaceae, Genus: Streptomyces
ccggtcgcagcgcgtgccgcccgcacggtcggcggcacgcgctgcgaccgggtgtacgcggcgcacggcaccggtgtgtgcctccagcgcaccggcccggtgccgggcacgtatgtcaccgtgctcgaccgggagttgaaccgcgtgcgccgggtgcgtaccgagggcttccccaaccgggcccgggtctcggcggacgggcggatgctgtcgtggacgatgttcgtgcgcggcgactcctacctgcgcgacgacttctcgacccgcaccggcatcctggacacccggaccggccggctgaccggcaacatcgaacgcatcccgctgacgctggacggccgcccgtaccaggccgccgacgtcaactactggggcgtgacgttcgcgcgggacgacagcaccttctacgccacggtgcgcaccgccggccgcacctatctggtgcggggcgactaccgcgagtggggtgcgcgcacgctgcgggagaacgccgagtgcccgtcactgtcgccggacgggacccgcctggtgttcaagaagcgggtgagcgcgggcagcgggcggccgtggcggctgtacgcgctggacctggccacgatgcgcgagacgccgctcgccgaggcgcgcagcgtcgacgaccaggcggcctggctggacgcccggaccgtgatgtacgggctgccccggcacggcggcggctgggacgtgtggtccgtcccggccgacggcagcggcgcgccgcgcctgctcatccgtgacgcgagttctccggcggtgctgcctcggtgacgggcgcgactactgggacgccgtcaccgttcccgccgtatcggcggcgcagttcgaccttgcgcaccttgccggacaccgtcatcgggaaggagtccaggacggcgagccggctggggatcttgtagtgggccagccggcccgcgcagaaggcgcggacctcctccagcgcgggcgggtcggccgcgtccagcgggatgacgcaggcgagcacctcctcgccgtactccgggtgcgccacgccgacgacctgcacgtcgcggatcttcgggtggccgtagaggaactcctcgatctcgcgcgggtagatgttctcgccgccccggatgatcatgtccttgatgcggccgacgatctccacgtagccgtcctcgcgcatcaccgcgaggtcgccggtgtgcatccagcggcccgggtcgacggcctcggcggtgcgctcgggttcctcccagtagccgagcatgacgctgtagccgcgggtgcacagctcgcccgcggtgccgcgcggcagggtgacgccggtggccgggtcgacgaccttcacctccaggtgcggcagcacccggccgacggtggcggtgcggtgttcgaggtcgtcgtccacgcgggtctgcagggagaccgggctggtctcggtcatgccgtagcagatggacacctcggccatgtgcatctcggcgaccacccgtttcatcacccccaccgggcacggggagcccgccatgatgccggtgcgcagggtggagaggtcgtaggcggcgaagccggggaggcccagttcggcgatgaacatggtcgggacgccgtacagcgacgtgcagcgttcctgctggacggcgtccagggtggccttcgggtcgaaggacggggcggggatgacgatgcacgcgccgtgggaggtggccgcgaggttgcccatcaccatgccgaagcagtggtagaagggcacgggcacgcagatgcggtcctgctcggtgtacgcgaccaattcccctacgaagtaaccgttgttgaggatgttgtggtgggagagggtggcgcccttggggaagccggtggtgcccgaggtgtactggatgttgatggggtcgtcgcaggacaactccgcctcgcgcgtccggagttcgtccgcacggccgggcgtgccgcgggcgacgaacgcgtcccaggtcgggtcgccgatgtagacggtgtccgtcaaccgcgagcagttggcccgcacttggccgaccatcgcacggtagtcgctgctcttgtgccgcagggaggcgaagagcagggagatcccggcctgtttcaggacgtactcgacctcgtgggtgcggtaggccgggttgatgttgaccatgatcgcgccgacgcgggcggtggcgtactggaccagcatccactcggcgcagttcacggcccagattccgacccggtcgcccttggcgacaccgctggcgagcagcgcgtacgccagccggtcgacgtcggcggcgaactcggcgtaggtccagcggcgccccgaggggacgtcgacgagtgcctcacggccgggcccggcggcgacggcccggtccaggttcgcgccgatggtgtcgccgagcagtgcggtgtggccggtgccgtgggtgtacgagagtgcgggggcgttcgtcaccggaagtcctcctcgcggtactcgtggtcggagccctgggccgtggcttcgcgcagttcgatgcggcggatcttgccggagaccgtcttgggcaggtcgccgaactccagtcggcgcagccgcttgtagggggcgaggacctggcgggagtgctcgaagaggatcttggcggtgccgggccccggctcccagccctccgccaggacgatgtacgccttcggtacggccaggcgcagttcgtcgggcgcgggcacgacggccgcctcggccaccgcctcgtgctccagcagggcgctctccagctcgaacgggctgatcttgtagtcggaggccttgaagacgtcgtcggagcgcccgatgtacgtgagatagccgtccgcgtcccgggaggcgacgtcgccggtgcggtagtagccgccggccatggcctcggcggtgcggtcggcg

SEQ ID NO: 553 - DNA, 5035 bp, Unknown
  Kingdom: Bacteria, Phylum: Actinobacteria, Class: Actinobacteria, Order: Streptomycetales, Family: Streptomycetaceae, Genus: Streptomyces
atcgagcgcgacctgcacgacggcgcacagcagcgcctcgtctcgctcgccgtcaacctgggcctggccaggtccaccctcggtgacgacctgcccgaggacgcccgcaaggtgatcgacgaggcgcaccgcgaggcgaaggaggcgatcgccgagctgaacaacctggtgcgcggcctgcatccggccgtccttgaggaccgcggcctcgacgccgcgctgtcgggggtcgccgcccgcctcccgatcccggtgcgcgtggcggtggacctgccgcggcgcccctcacccacggtcgaggccgtcgcgtacttcgtggtctccgaagccctgacgaacgtggtcaaacacgcccaggcgacccgggcggacgtgaccgtggagcggatcggggagacactgctggtggtcgtcgcggacgacggcgcgggcggcgcggatctcgcggcggccggcggtggtaccgggctcgccgggctcgccaagcgcgtcgcgtccgtcgacggcacgttctcctgccgcagccccgccgggggcccgaccgtcatcaccgtggagctgccgtgcgcgccgtgatcgccgaggattccctcttgctgcgcatcggcgtggtcaaggtgctggaggcggccggcttcgagatgtgcgcgcaagtcgccgacgcggaagggctgctggcggccgtcgaggagcaccggcccgacatcgccgtggtcgacgtgcgcatgccgcccggcttcaccgacgagggagtgcgcgccgcgctggtgatccgccgccagtacccgcgtaccgccgtgctgctgctgtcgcagtacgtggaggagcggtacgccgccgatctgctcgccgccaacacctcgggcgtcggctatctgctcaagcaacgggtcgccgatgtcgaggagttcgccgaggcggtacgccgggtggcggccggcggcaccgcgctcgaccctcaggtcgtcgcgcagctgctggtgcgccgccacagcgatccgctcgaccggctgacaccgcgcgagcgggaggtgctggagctgatggcgggcggccggtccaactccggcatcgccgccgagctggtcgtgagcgagagcgcggtcgccaagcacatcaacagcatcttcaccaagctcgaccttcccaaggccgacgccgaccaccgccgcgtcctagcggtgctgcggctcctgggcgttgcgaccgcatagtgcgcgatcacgcccgcatgcccagtcgacaacagtgctgatcagcacttggtggggaatgcggcgccttcggacaggtgctctccaccaggctttgccgcgctgagtgccgaaggcggtggccgtcgtgcgcagggccatggcatgggtggggctggtcatcactggtgtcctcgcagtcttcgggattgggtgcggtggctcggcctggccggtcggctgtcgtccggagcggacgtgatgtcagggcggccgtcgcgtcagtcccttcgtcccgggttcggcggcaccggtgcgtgggagtcggccggagccggggaggactgaccggaagcggccgagaccgcctgcgggctgcgccttcgggcggcgagaacgcgctgctcggcgaggtccgcgctcgtggcggcgctgcgcagcgtactggtggcttcggccagcgcggtgcgggcggcggtgaggtgggtggtgatccggcttcgggcgaagtcggcgttcgcacgcgggttggcgtaggccgaggtgaagtggtcgatgaagagctgatcggcctgggcgccgccgagagcgttgatcgcgcggccgacggcggcgacggtgtgggcggggtccgttgcggttcgggcgtgcgctttgcgggcggccggagcgcccgtgaccatggccgtacggatgtcctggccctgggcggtcaccagggggagcagtgtgcacctcaggcggcgcggcatccgggcggtcatccccgtgccggccgatcaacgcggccaccgtctgcgacgcggcagccggggtggcaggacagtgggcgagcgccgtcggccggctgatgaagatcaacaagatccgcaaggccgtgaagctcatgcgtaagatcggcttcaagcgcctgtacaggctgatcaaggcgatcaggaacaagccacggcgcaagtggtggaagaccgctgccgacatcgcaggcggaccctacaccgcgctcgatgtctttatgggcttctcaggggttcaggaagactgctacgacgcgttcaagtgacgaaacgtcccaggggactgacatcagtcccctggggccacacccccatctctggaatccaccatgccctcttcagtatggaagtcggccggaatcacagctcttctggtcgcagtcctccccaccctcgcgttcctggccctggctctccgggccgctcagagccgcaagcccagccgctcacacctcaggtggacgttctcccctcatgtcgccgtcgcctcggtgctcagtgtgctcatcggcgcattggcgaccgaccgaacgccggcattcagcacggacgaactcaagacgctgctgatcccgctcaccatgggcctgtccgttcacgccctcgcccgcttctggctcgccgacggtgaggaaacccggtgggtgacccgctgggtcccggccgccctgacgctgatcgtcggaacactggtcgccggcgccaccacgtacctcggcgcctgacggcgacttaactttccctgacaatcgcctcctacctcctacgtgatcggcggaccgggagcgctcagcgagggctgcggtagcacgtttcgttcgggtcaccgaacagaccagagacagatgctcccgacgtggaggccggccaggcagatggtggcggtcttctcgtaacggccggcgatgccgcgccattgcttcaggcggttgatgcaccgctcgacgatgttgctctgcttgtagttctcgcggccgaaggtcggtgccttgccgccctggcttccctgccgcagtaggtgatgtcgttggccggctggggcggggatcaccgtccgtgaaccgcgcttgcggtaagcccagccatcgtccgccgacgttgacgtcaactactggcacgatcgcagggcgtccgcgtcatcggcctgcggcgatgtcggtctcacggcctggcgaaggctcggttacagcaccagctcacggcgactgctatgagcttccaccgcctcaacgcttggtggaccgacatcctccgagccgcccgcactcgcacttcccgcctggcagccctccggcccaccgagcaagagccaggtactacgcaagtcgaggcagtgggcgagaggggactcccacctgtgttcggaccagggctcgtaactaggctcccgcaccatgaccagtgatctcggattcacctgcatgtgttgtggagcccgccaccctgagctgccgatggactacacggccgaggccccggccgtgtgggatccggccttcgccgacgccgaagactgcctgctctcgtcggaccagtgcgtggtccgcgcgcagcactacttcgtcaagggcctgatcgagataccggtcatcggccgtgatgaggtgttctcctggggcgtctgggtctcgctcagccgtgagaacttctcccgggcggcggacttgtgggatacgccgggtcgcgaagccgaggagccgtacttcggctggctcacgaccgacctgcccgtctacgcgcccacgaccctcaatctcaagacccagctccacacgcgcccggtcggtgagcgcccctgtgtcgagcttgagcccactgaccaccctctcgctgtcgaacagcgcacgggaatcactccggaccgtgtgcgggagatcgcgacagccatgatccacggcaacgagagcggtcagcgctggtgaccggcaactctgtaccgccgatcccggtcgcccctgccggtcttacccgccgagccgaaatgttcgtcgaggcgcacggcatcagcgtgcctcggcagggcatccggcgccaccgagatgcgtggatcgagcacgggatccccgccgtggaggtcgaccgggccgcagcattccaggaccgctggggtggcctcgtactgccgccgtccccgttctacgagggcggcccgcgcatcctggacgcggactgccccgagggctcgcccacggaaggctggcggatcccggccggggactgccgggcttccacggcctacggattcatgatcggccccggcgaagagttcggcatccatggctcttgctgggcaccgctgcatgccagtaccgacggatgggtggaatcgctcgcgctggcggcccacgcgggacggtgggccagaaccctcacgaagatcaccggcaaggccgtcgactcgctagacctcgacggatacgagccggtacctgaagtccagggactgaccgactcctggtggcggggcaaggattcactcatcgccctctaccggggcgaagccgtcgcccttgacgccccgcaatgccttgaagctcacatctacggcggcctcgacaagcgggtcctccacggcggctgactcgccggcgccgccgagactgagcacctacttggccgtacgggtcaaccatcgcgcccacgcacgcctctcccggggccgaggggaactctgcggacaggatcagccaacggtgtcgctgacatgccgggggtgggtgccggacgttgcccgggcacctcagtggaccgccgaccagttgggcagttcagacgggtggccagttccgcagcgccgcgtcggccacctgctggagttcggagcgggtggcgccgccgacagcctggacggcgatgccgttcgccacggtcatgacgtatcgggcgagcagttccgggtccgcgccggggggcagatcaccctcgtcgacggcctgctggaaccggtggcggaggcgagcacggccgtcgtcgcgccaggcgatcagggcgtcctgggccgcccgtcccgagtcgccggcggccagcgagccctgcacgcccaggcac

SEQ ID NO: 554 - DNA, 1942 bp, Unknown
  Kingdom: Bacteria, Phylum: Actinobacteria, Class: Actinobacteria, Order: Streptomycetales, Family: Streptomycetaceae, Genus: Streptomyces
gaagccgccgtgcgcggcggcggcgagggcggcgtccacctggtcgctcatcgcgggcagcgagcgggtgccggaccagccgtgggcgacgagcttgtccacgcgcagcttctgcccgggctccaggacggaggcgaccgtgagccgggccaggtccgggtggctctcgctgctggtggtggtccgctcggggcccgtgacgacgtggtcggcggcgacggccacgcgcagcccgctgcgccgggtgcggtgcaccagccgcagccggctgccggaggcgaagtcctcctccggctccagcggtgcctgcagggccatcgccgcgcgcgggtcgccgttggcctgcggcagttgctcgttggcgacgagttcggactggatgaccacgcggaccgagcagtcgaccggctccacctcgtaggcgatggcgccgatggagcgctggctgagggagaccatccgggtggagcgcacccggatgcgggtgccggccggggagacccactcgcaggtccgttccagcagcccgcggcgcaggtccaggacgcgctcgtgcgagacgaggcggccgtagcgcaggtcgaacggttcgtcgttgacgagcagccgcagcaccttgccgttggtgatgttgatgaccgtctggccggaatccggatatccgtagcccgcctccgcgtacggcagcgggtgcacctcgtagacgccgttgaggtaggagccgggcaggccgtgcggttcgccctcgtcgaggttgccgcgccagccgacgtggccgttggagagcgcgaagaccgactcgctctgggcgagcacgtccaggctcagctccgtctcgcgcacggtccacggttcgacggcgtacgaacggtgggtgatcacgcggcacctccctgtccggcggggccctggccggcgggtccgcctgcggtgaggagttcggcgaggtcctcgacgacgacgtcggcgccgtgcgcgtacagggcgtccttctgtccgacgcggtcgacgccgacgacgtagccgaatttcccggaacggcccgcgtccatgccggccagggcgtcctcgaagacggtggcccggtcggcctcgacgccgaggtcgcgggccgcggcgaggaaggtgtccgggtgcggtttgccgggcagtccgcgctcgcgggccaccactccgtcgacgcgtacgtcgaacaggcgctcggcgtcgatggagcgcagcacgtccagggtgttggcgctggaggacacgatcgcggtcttcaggcccctggcccggaccgccgcgatgtagcgcagggtgccgtcgtaggcttccacgccatctgtacggattttctccaggacgagttcattcttgcggttgcccaccccgttgaccgtcggagcgtccggcgggtcgtcgggggtgccctcgggcagttcgatgccgcgcgaggcgaggaaggtgcgcacgccgtcggcgcggggccgcccgtcgacgtactcgtcgtagtcggcgaccgcgtcgaaggggcggtagtccgggccctcccgctcgcgcaggaacgcgtcgaacgtctccttccaggcggccgcgtgcaccaccgccgtcttggtgacgaccccgtcgagatcgaagaggcaggccaggatttcatcgggcagaccgagctgtgtcatacaggcacccttccccacgacacggcgttgacggggtgtcgcacgccacatcggacgcgcttcgcccgtatctccggaccactttccggccatcgcggggcccgcgcccgtcggggggcgcgcccggccgggtgacacactggcgcgtgtgccgctgagcttcgacgacctcctcgaccgcgcccgcgccctgccccgcgacggacaccgggcgatcctcggcatcgcgggcagcgtggacttcccggcgccggggctgcccgcgatgccgaggatcgccc

SEQ ID NO: 555 - DNA, 2179 bp, Unknown
  Kingdom: Bacteria, Phylum: Actinobacteria, Class: Actinobacteria, Order: Streptomycetales, Family: Streptomycetaceae, Genus: Streptomyces
  misc_feature (1884)..(1894): n is a, c, g, or t
aagacgggagccgcggtgggcgagcccaccgccgcctcgcccgccccgagcgccttcctcgaagtacgcgacctcaaggtgcacttccccaccgacgacggcctggtcaagtccgtcgacgggctcagcttccagctggagaagggcaagaccctcggcatcgtcggcgagtccggctccggcaagtcggtgacctcgctgggcatcatgggtctgcacaccgccggccagtacggcaagcgcaaggcgcggatctccggcgagatctggctggacggcaccgagctgctctccgccgaccccgaccacgtgcgcaagctgcgcggccggcagatggcgatgatcttccaggacccgctgtccgcgctgcacccgtactacacgatcggccagcagatcgtggaggcgtaccgcatccaccacgacgtcgacaagaagaccgcgcgcaagcgggcggtcgagatgctcgaccgagtgggcatcccgcagcccgacaagcgcgtcgacaactacccgcacgagttctccggcgggatgcgccagcgcgcgatgatcgcgatgtcgctggtcaacaaccccgaactgctcatcgcggacgagccgaccaccgccctggacgtcaccgtccaggcgcagatcctcgacctcatccgggacctgcagacggagttcggctccgcggtcatcgtcatcacccacgacctgggcgtcgtcgccgaactcgccgacgacatcctggtgatgtacggcggccggtgcgtcgagcgcggcccggccgacgaggtgttctacgagccccgccacccctacacctggggactgctcggctcgatgccgcgcctggaccgcgagcagcaggagcggctcatccccgtcaagggatccccgccctccctgatcaacgtcccctccggctgcgccttcaacccgcgctgcccctacgccgacgtccccaaggacgacctgacccgcacggtgcgccccgaactgtccgaggtgggcagcgggcactgggccgcctgccacatgtcgcaggagcagcgggagcggatctggaccgaagagattgcgccgaagctgtgagcgagaacgccaaggacaaggcagtgggcatccctgcgcagagcgacggtgacaaggccggggcgaaggccgaggcttccggcacggccaccctcaccaaggaggccgcgcccggcgagatcctgctcaaggtgagcgggctgcagaagcacttccccatcaagaaggggctgctgcagcgccaggtcggtgccgtgcgcgccgtggacggcctcgacttcgaggtgcgttccggtgagaccctcggtgtcgtgggcgagtcgggctgcggcaagtcgacgatgggccggctgatcacgcggctgctcgaacccaccgcgggccggatcgagttcgagggcaaggacatcacgcacctcggcgtcggcgggatgcgcccgatgcgccgcgacgtgcagatgatcttccaggacccgtactcgtcgctgaacccgcgccacaccatcggcaccatcgtcggcgcccccttccggctccagggcgtcgagcccgagggcgggatcaagaaggaggtgcagcggctgctgtcggtggtcggactcaaccccgagcactacaaccgctatccgcacgagttctccggcggccagcgccagcgcatcggcatcgcccgcgcgctcgcgctcaagccgaagctggtggtggcggacgagccggtctccgcgctcgacgtgtcgatccaggcgcaggtcgtcaacctcctcgacgacctccagcaggagctgggcctgacgtacgtgatcatcgcgcacgacctgtcggtcgtccggcacgtctcggaccgcatcgcggtcatgtacnnnnnnnnnnncggtgctggaaggcgacggaggtctgccggacgaccgagccggagctgaaggagctgaagcccggtcagcgcgtggcctgccaccacccggagaacttcgcggaccaggcaccgcaggacacggtgctgctgacggccgccaaggaggccgccgagctggtgtccgaggaggtcctggccaagtcggcccagacgtcggcggcggtggcggcggaggtcacggagtcggcggagaccgcggagacggcgaaggcgccggaagctgtggaggcgccggaggccacg

SEQ ID NO: 556 - DNA, 1861 bp, Unknown
  Kingdom: Bacteria, Phylum: Actinobacteria, Class: Actinobacteria, Order: Streptomycetales, Family: Streptomycetaceae, Genus: Streptomyces
tccagcagcgccgaggcggcccgcgcgcggccgaccacgggcggccgtaccgcgcgctgggcgggcgggacgaccagcgtgacctgctcgccgtacacaccgcgcagctcggcggccagacggtgcgcgagcccgtcgtccccgcacaccaccatgtgcgcccccgtgccgcccgacgcaccaccctgatacggaacgctccccacgagggaagagactgccctacggggacaggcggttccaggagcgggctgtgctgcttcagggcggggccgggagatgcgcgggacaatcggagtgagtgatcccgaacgaggattccgaggcggtcggcaatccctgggcacggacaggccgtatgtacggatatgtcaaggttccggttccccgtaggtcggctcccggacgaggctctgctctccgggctggccaccggtgacccggaactcgcggtcactttcgtccggcggttccagcaccgggtctacggcgtcgccatcgccgtcaccggggacccgcagctcgccgaggacatcgcccagcagaccttcgaacgggcatggcaccacgcccagatctacgactcacggcgcggttcggtcaccacctggctgaccaccatcgcccacaacctcgccatcgacgccgtccgtgcccggcgcccggagccggtggcgcccgaggatctcgacgcgatcctggacgccgtcggcgagacccccgagcagcacgcgctggcggacgaggcgtcgtcccggctgcgggccgccgtggcgcaactgccgcccgcgcagggccgggccctggtgatggcgggcatctacggcatgaccgcccagcagatcgccgaccgggagcggattccgctgggcaccgccaagacacggatccgggccgcgatgggaaagctgcggaccacgctcgcgtcggaccggcgaggcgaccatgaccagtgacgtgatctgcgagaagctgcgcgagatcggcgccgagctggctcttggcgtgctgccgggccgcgagcgggccggtgccgtggcgcatctggagcagtgcgcggactgccgggagcacgtccaggagctgacccaggtcggcgaccggctgatcggactcctgccgtgctgcgagccaccggtcgggttcgagacgcgggtggcgcaggcgctgacacagggcgcgcaggggcgcgagaggcgcgcacgcccgcgtgcacttggtctgcgaggccgccggatccggccacgggccgccgccgcggccgccgcgttcgtcctcgccgtcggattcggcggctggtcggtcggcacggcggtcgagaccatcctggccgacccggcctcctccacgagcggccgggagacggacctgctgtggggcgggctgacctccgtccgcccggtggccggccgtcctgccggcgaggtctacgcccaccccggttcgcccggctgggtctacatgaccgtcgacctcaccgcgtccggtaccccgtacaacgggtacaccggccgggtctcctgcgtgctggtgcgccaggacggcaccacggtacggatcggcgccttcgacctgtacgacggcaagggcgcgtggggggcgcccgcgccgcccatggaccgctcggcgctcgccggcgcccggctgacggctgccgacggcacggtactggcgagtacgcacctcacgaccgccgcgaagggccagtcctgaccggcgccgggtcagtcccgggcggtggctggggtcagccccgggtggtggccggtcagccaggggcggcggccgggccgtccggtaccagcgagcggagaaccgccgccagctcggggaccgtcggccgtgccgccgggtcctgccg

SEQ ID NO: 557 - DNA, 4154 bp, Unknown
  Kingdom: Bacteria, Phylum: Actinobacteria, Class: Actinobacteria, Order: Streptomycetales, Family: Streptomycetaceae, Genus: Streptomyces
ccgcccgctccggccaccgctccccgcgccgcacggcatccgtcctcgcgatgctggcgggcgcggtcctcggcgcctggctggtcgtccaccgcgacctgggcacaccactgctgatcgcggcgctggcggcgggggtgggggcggcggttgcttcggggcgggagtgaggtctcggtcgcgatctaccacgtcagttgactcccgtaccacaacgggtggactccgagtcaaaccagtgctggatgtgaacgagggcggatctgcctaccttcgaagtgaaggaaccaccagaacctgactcgcacatgggggaacaatgcacttcggtcatcagcgcgtgctgggtacagccgcggtcctcgcgggagtcgctgcggctcttgccccactgagcacggcggcagccacgccgacggctgcgcgcggcacggcacacagcagtgtggccgcggcacactggcaccacctgtggggaccggcgcaggtctccgcaaactacttcaaccaccacacacgttgggtgtcggggaccttcgtcccggacacgaccaggaccggcatcaacttcaactgctacaacagcggggacggcggcaaggcccgcgtgcggctgtacaacgtcgaaagccgcaagtacatccccctcaccggcaacaccgggttccagtactgcaacaagcccggcaactcgtggttcaccatcaactccagcggcggataccgggtcggccagggtctgcgcgtcgtcatcgacgagaagggcaagcgccacaccgtcaacgtgaaggcgtacgactaccaccgttgaccgagacgggcgccctgcgcggctccccggtccagcaggtcgccccgggcggaaacgtgccgcgatgccgatcggcccggggcggccggaaccgacttcggagacctcatgatgagcctcaaatccaccctgcccgcactcgccggggccacgctgctcacgctggccggtgccgccggcgcccaaagcgcgagcgccgcgagcccgcggcagccggccaccgcgcaagccgaggggtccagcggcaagatgaccgcctccgccctgcccagctctacgtactggaagcccgagcacaccagcgggcggtgcatcaccgcgcacggcggcacccgcaaggccgcgaagatcgaccagtaccagtgcgtgggcggcgccaaccagaagtggtccttcgtcaccgtcagcgccactcccacggtctacaccatcaggccggtgagcaacgccggactctgcgtggacattcagggtggcgactacagcaagggccgccagccgatcctgtgggactgcaacggccgcatcaaccaggagttctggatcaactgctcgggcagcctcagcaagtgcaacatccacccgtaccatgccagccaacgcaacaagtgcctgtcggtgaagggcggttccaccgcgaacaacacccctgtcatcctctggtcgtgcaacggggccaaggaccagcgctacacactgcgctgacacggcgttcgtccgttcaccaccccgcgctcgtcgacagacctcggagcggggatcacgcccggggaacgctgcggtgctcgtagcgttccccgggctccggcgcgggaagcgtccgtcacggacggccgggtgcccaccgcctctgccgcccgggcaaggagatgcgttcgtctccgccccagggcgagctgtcacgcctcgcgcgcggccaccccgaagtccacgtccgccgtgtccacggtcccgcccgttcggcccggtgccgcctggtggcgccagtacaggttggtgtgagtgatcacctggtccaccggcggggcgccccagctcgtcttgtccccggcggtgtgcgcgtcgccgaccaggatcgtgtcgtacccgcgcacgaacgcaccgtgcagcgtggagcggatacaggcatcgctctccgcgcccgccacgaagagccggccgacgccgagatccgacagcacggtctccagggtggtgtcctcgaaggagtcgccgtagttcttgtggatgaggggttcttcgtcgtccggcgtcagctcggggacgatccgccagccgtcgctgcccttcaccagttcgtcgtcggagtgctgcacccacacgacgggtacgtcggccctgcgggcgcgctcgaccagggcggcgatgttcgcgacgaccgcgtcacgggcgtgcgccccctccacgacgtccacctggacgtcgacgacgagcaacgcggtggggcgtggagcggttgcggcagggcggcaagaccgtgtggttcgagtgcggtcccgccgccggtcactccgccgaactcagaagctgaaccggcgcggctactacggctggtcagcggcgccgcagtgaggcgtcgagcagggacggtggggtgtcgaacttctcgtgcggggcgaggtcggtgccgggggcgacgatctcgtcggcggcgtccaggacgtcggcggtgagcaccgtgtccgcggcggcgagctgcgtgcgcaggtggtccagggtgcgggggccgatgagggcgctggtcacggcgggatgggcggtcacgaaaccgagggcgagctggatcagcgtcaggccggcctcgtcggcgacccgggcgaggcgttcgaccgcgtcgaggcgggcccggttggcggggacggtcaggtcgaagcgggcgggcatgaagccggagcggtgggtggtgatgtcgcggcccgcccggacggcgcccgacagccagccggaggccagcgggctccacaccagcacgccgaggccgtactcctcggtgacgggcaggacgtgggtctcgatgccccgctggagcagggagtagctgggctgctcggtgacgtagcggccgaggtggtgttcgcgggcggcccactgggcctgcacgatgcggtgggcggggaaggtcgacgatccgaagtgccggatcttcccggcacgctgcaggtcggtcagggccgacagggtctcctcgtcgctggtggccgggtcccagcggtggatctggtagaggtccacgtggtcgacgccgaggcggcgcaggctgtcctccagcgcggtgaccagccatcggcgggagctgccgcggtggttgcgctcttcgctcatcggcatgcccgccttcgtggcgagtacgacgtcgtcgcggcggccggcgatcgccttgccgaccatctcctccgactccccggcgccgtacatgtcggcggtgtcgatgaggttgacgcctgcttcgagcgcggcgtccacgacggctgccgcctcgtcctgggtggtgcggccgatccggccgaagttcatcgcgccgagcgcgagggtgctgacctgtatgccggtacggcccagggtgcggtactgcatgagctggttcctccgtgggtgagggtggggtcgcgatggggcgtgggtggccggagggccgccgttctggcatgctgaagaagcggaacagcgctccgttaagcccggtggggccgaagatacggaacgtcgttccgttttggcaagcccgatggggcccggcagggaaggacacggcacggtgagcggcaaggacgagggcgcgggcggtgcggcacgggaaggcgcgcagggcgcggcgcggggcaagcgggcggatgcccggcgcaaccagcagaccctgctcgacgccgccgccgcggtcttcgtcacctcgggcgtggaggcgccggtgcgtgacatcgcggccgaggccggggtcggcatggggacgatctaccggcacttcccgacccgcgcggacctgatcgtcgccgtctaccggcaccaggtcgaggcctgcgccgaggccggtcctgccctgctggagagcagcgcgagcccgcacgccgcgctgggacagtggatcgacctcttcgtcggcttcctggtcaccaagcacggcctggccgccgcactccagtccgacgacgccgggttcgagacgctgcacgcctacttcctcgaccgcctcctccccgtctgcggcgacctgctccaggccgcggccgacgccggtgagatccagccgggtctgtcgccgtacgagctgatgcgcggcgtcggcaacctctgcatcggcgcggagaacgacgcccgctacgacgcgcgccgtctggcccagatcctg

SEQ ID NO: 558 - DNA, 5887 bp, Unknown
  Kingdom: Bacteria, Phylum: Actinobacteria, Class: Actinobacteria, Order: Streptomycetales, Family: Streptomycetaceae, Genus: Streptomyces
cctcggccgcgttcagcgggtggcagacgcggccggtggcgaagagcggtggggcgccgcactgtgccgccgcgtccgggcggctgctgtgtgccgggccggggctggtcttcgccctcgatccggccgacggcaaggtgctgtggcgccaccccgtggcggcgggaccggccagtggggccccgctggtgtcgggctccctcgtgctggcgccgaccggcggggacggtgttctgcgggcgctggaccccggctcggggcgaacgcgctggcagcgtgacgtgtcggcgtacaaggcggtgcggtgcgccggggacatgctgctgctcaccggtgcggacggcacggtgaccggggtggacagccggtcgggcaggacgcggtggcggcaccacgtgccggggccggccgagccgtacttcatgtcgttcgcgggtgacccgctggcgtatgcggcgagcccctcgggcgacgggaagggcacgcgggtgaccgctgtggacccgcgcacgggcgcggtgcgctggcaggcgcggctggacgggacgctgcggcccttcgggtcggccggcgggtccttgttcctccaggccgtggacggggtctacggcgacacgcgcgcggtggtccgctattcccccggtgccggtgtcacgcgccgggtggcactcgcggtgccgctccagcaggcgcacgccacggtccgtggcgatgtggtcgatctgctgtccgccggtggttcgctggcggccgtcgacatggcggcgggcaggcggctgtggaccctggagacctccgtcagccgtggttcggcgccggtcgccgacgcgcggcacgtgtacgtcctgtcggcggacgggcggctgctggccgtggacgcgggcaggggtgtgctggtcgggcagacgccggcgcggctgggtgcgggcgcggaccgggtcgccgcgtccgttccggatccggtggcggccgccgggcatgtctacgccggggctcccgacggcaccgtcttcgccgtggacgcgggcaacccgtccgcctggtgacgtgcgaaggggccgctcccgacgggaacggccccttgtgcaggtcggcgggtcagcccagcttggagacgtcgcggacggcgcccttgtcggcgctggtggccatcgcggcgtaggcgcgcagggcggccgagaccttgcggtcgcggtccttgggggcgtaggcgccgttcagggcctgctcgcggcgggacagctcctgctcgtccaccaggagttccacggagcggttcgggatgtcgatgcggatgcggtcgccgtcctcgacgagggcgatggtgccgccggaggccgcctcgggggaggcgtggccgatggacaggcccgaggtgccgccggagaagcggccgtcggtgatcagtgcgcagctcttgccgaggccgcggcccttcaggtacgaggtcgggtagagcatctcctgcatgccggggccgcccttggggccctcgtagcggatgacgacgacgtcgccctccttgacctgctgggtgaggatcttctggacggcctcctcctgcgactcgcagacgacggccgggccctcgaaggtccagatggactcgtcgacgccggcggtcttcaccacgcagccgtccactgcgaggttgcccttgaggaccgcgaggccgccgtccttggagtaggcgtgctcgatggagcggatgcagccgccctcggcgtcggtgtccagggcctcccagcgctcggactgggagaaggcctcggcggagcggacgcagccgggggccgcgtgccacagctcgacggcctcgggcgacggggagccgccgcggacgtcccaggacttgagccagtccgcgagggaggggctgtgcaccgcgtgcacgtcctcgttgagcaggccggcccggtgcagctcgccgagcagggcggggatgccgccggcgcggtgcacgtcctccatgtagtacgtgcggtccttggcgacgttcggggcgaccttggccaggcaggggacgcggcgggagacggcgtcgatctcctccaggccgaaggacacgccggcttcctgggcggcggccagcaggtgcaggatcgtgttggtcgagccgcccatggcgatgtcgagggccatggcgttctcgaaggccgcgaaggtggcgacgttgcgcggcaggacggtgtcgtcgtcctgctcgtagtagcggcgggtgatgtccatgaccgtgcgggccgcgttctcgtagagggcgcggcgggcggtgtgggtggcgaggacggagccgttgccgggcagggagaggccgatggcctccgtcaggcagttcatcgagttggcggtgaacatgccggagcagctgccgcaggtgggacaggcgttctcctcgatgcggagcatgtcctcgtcggagaccttgtcgttggcggcctcggacatcgcgtcgatcaggtcgagcgtgcgcacggtgccgtcgacgagggtggcgcggccggcctccatggggccgccggagacgaagaccgtcgggatgttcaggcgcagcgccgccatgagcatgcccggggtgatcttgtcgcagttggagatgcagaccagggcgtcggcgcagtgcgcctcgaccatgtactccacgctgtcggcgatcaggtcgcgcgagggcagcgagtagagcatgccaccgtggcccatcgcgatgccgtcgtcgacggcgatggtgttgaactcgcgcgggatgccgcccgcctcacggaccgcctcgctgacgatccggccgaccggcgccaggtgggtgtggccgggcacgaactcggtgaagctgttggcgatcgcgatgacgggcttgcggccgatgtccgcgccgggtacaccggaggcgcgcataagggcgcgggcgcccgccatgttgcggccgtgggtgactgtgcgggacctcagctggggcatcgtcgctcgctccttcggagagttctgactgagtcgagcgtacgccggtcatccagagggcgggacgcggtgtccgcaatgcgggacgggtgtctcgggtgaaggctcaccgcggggcgccgcacggtccgcgcctgggcgtccccgccgtcgatgcccccggtcagcgccggggcacgcccgccgtcgatgtcaggtggagccgggtgaaggcgagggcctcggcgaggtcggcctcgcgctccgcgccggacatggcacgccgggtgttgacctcgatgacgacatggccgtcgaacccggagcccgcgagccgttccagcagcgcggcgcagggctgtccgccgcgccccggcaccaggtgctcgtccttcgcggagcccttgccgtcggcgaggtggacgtggccgaggcggtcgcccatgcggtcgaccatctggagggcgtcggtacgggccgtcgccgcgtggctgaggtcgatcgtgaagtggcggtagtcgtccttcgtgacgtcccagtcgggggcgtaggcgagcatctcgcggtcgcggtagcgccaggggtacatgttctccacggcgaaccgcacatcggtctcgtcggccatccgccagattccgctgacgaagtcacgggcgtactggcgctgccagcggaacggcgggtgcacgacgaccgtgctcgcgccgagccgctccgccgccgcccgggcgcgctggagcttgacccaggggtcggtggaccacacccgctgcgtgatcagcagacagggggcgtgcacggccaggatcggtatcccgtggtagtcgctgaggcggcgcaggccgtcgatgtcctggctgacggggtcggtccagaccatgacctcgacgccgtcgtaaccgaggcgcgcggcgatctcgaaggccgtcgccgtcgactccggatacacggaggccgtcgacagggcgaccttcacatccgggatgcgtacgacgggttccaccacgaatgacaggttacggggtgcgcacgcgctcacggcgtgagcccgctcaccgtggccggttccccgcccgtgatccgcgtctcgcccggctgggtccctcatgacccgcgtaggagctacgcagagcccatgtggtcaaggcgtcgcaggatcacgccctcgcgcagggcccagggacagatctccaggcgttccacaccgaggaggtccatcgcgccctcggcgaccagcgcaccggccaggagctggcccgcgcggccgtcggagacgccgggcagttcagcgcgctcggcggccgtcatcgcggccaggcgcggcacccacgcctccagcgactcgcgtttcagctcgcgctgcacgtacaggccctcggcggagcgcgcggcaccggcgatgcgtgccagctgccggaacgtcttcgaggtggcgaccacgtgatcgggggcgccgaagcggctgaactcgccgaccgtccgcgcgatctccgcacggacgtgccggcgcagtgccctgacgtcgtccgggtccggcgggtcgccgggcagccagccggcggtgagccggccggcgccgagcggcagggacacggcggcgtcgggttcctcgtcgatgccgtaggcgacctcgagggagccgccgccgatgtccaggaccagcagtttcccggcggaccagccgaaccagcggcgggcggcgaggaaggtcaggcgggcctcctccgccccgctgagcacctggagccggacgccggtcccggcctgcacgcgcgcgaggacgtcgtccgcgttgccggcctcgcgcacggcggaggtcgcgaacgggagcaggtcctccacgcccttgtcctcggcggcctggatcgcgtcctggatcaccgtgatcagccggtcgaccccctcggagccgatcgcgccgtcctcgtcgaggagctgggcgaggcgcagctccaccttgtgcgagtgcgcgggcagcgggcgggcaccggggtgcgcgtcgaccaccagcagatgcaccgtgttcgaacccacgtcgaggacaccgagtctcatgtacggaacgctactgccccgtgggcgggcacggcacgggcccacggcccgctcggtacccggcggagcgacttaccctggacgcgtgccaaagacgaagaaggcgaagaccggcaaaccgacgaccggtgcatcggcaggctcggagccggacgagaaggggctcgacttcgcgcgcgcgtgggtggagttcccggacccggcggacgacgagcaggtcttccgctgcgacctgacctggctgacctcccgctggacctgcatcttcggcagcggctgccagggcatccaggcgggccgcgccgacgacgggtgctgcacgctgggcgcgcacttctccgacgaggacgacgagcagcgggtcgccgcccacgtggccaggctcaccccggacatctggcagaaccacgccgagggcatggagaacggctgggtgtccgaggacgaggagggctcccgtcagacccgccccttccagggctcgtgcatcttccagaaccggcccgggttcgccggtggcatgggctgctcgctgcacatcctggcgctcaaggagggccgcgagccgctggagacgaagccggacgtgtgctggcagctgccgatccggcggaccttcgagtggatcgaccgtcccgacgacacccgtgtgctccaggtgtcgatcggtgagtacgaccgccggggctggggtccgggcggtcacgacctgcactggtggtgcacctcggccacgtcggcgcacggcgcgggcgagccggtgtacgtctcctaccgggcggagctgaccgagctgatgggcaaggcgggctacgaccggctggtcgagctgtgcgaggaacgcctcgcctccggcctgccgctgctcgccgcgcatccggcggacccggcggacccg

SEQ ID NO: 559 - DNA, 11817 bp, Unknown
  Kingdom: Bacteria, Phylum: Actinobacteria, Class: Actinobacteria, Order: Streptomycetales, Family: Streptomycetaceae, Genus: Streptomyces
cgccgtcctggtggccgcactggtcgccggcggtctgggcggcggcctcggctacaccctggccaagaacgacgacggcggttccaccacggtcgccgcctcggactccggtgcctcccaggtcaagcgcgacccgaactcgatcgcgggagtggccgcgaaggcgctgccgagcaccgtcaccatcgaagcggagagcacgaacggccagggcggcaccggcaccggtttcgtcttcgacacccagggtcacatcgtcaccaacaaccacgtcgtggccgacgccgtcgacggcggcaagctcaccgccaccttccccgacggcaggaagtacgacgcggagatcatcggtcacgcgcaggggtacgacgtcgcggtcatcaagctcaagaacgccccctccgacctcaagccgctcgcgctcggcgactccgacaaggtggccgtgggcgacgagacgatcgccatcggcgctcccttcggcctgtcgaacacggtgacgacgggcatcatcagcgcgaagaaccgcccggtcgcctccagcgacggcagcagcgacagcaaggcgtcctacatgagcgccctgcagacggacgcctccatcaacccgggcaattccggtggtccgctgctcgacgcgcgcggcgcggtgatcggcatcaactccgcgatccagtcctccggcagcggcggcggactgggcggttccggccagtccggttcgatcggcctgggcttcgccatcccgatcaaccaggccaagtacgtcgcccagcagctgatcaagaccggcaagccggtctacgcgaggatcggcgcctccgtcgccaccgtccaggagggctccgacggtgcgaagatcaccgaccagggcgcgggcggcgccgccgcggtggaaccgggcagcccggcggacaaggccggtctcaagtccggcgacgtcatcaccaggctcgacgacaccgtgatcgactccggccccaccctcatcggcgagatctggacgcacaagcccggcgacaaggtgaagatcacctacaagcgcgacggcaaggagcacacggtcgacctcgtcctcggctcccgcgtcggcgacagctcgagctgacgccgccgagccatcgcccgcactcccgccccacgacacccgggaaacgcgcgaggccggtacgctgtacccgctccgcccctggtgggcgggcgcgaaggtgggttgcccgagcggcctaagggaacggtcttgaaaaccgtcgtggcgcgagtcaccgtgggttcaaatcccacacccaccgcgtgagagaacggcccctgaccaggagatacggtcaggggccgttgtgctgcgcactgaccgcccgtcaccccttctccccgtggtttcccgctcgatcgggcacggatggggcacgcgcgaggcacgggctgagcgcggcgctcgaagatccaaccggcggcggggcgggcgctgctatcggttgatcgggatctcgtagacgatctcgcagtgagcggcgggcacgacgatgtccgccgtctcgacgggacgcccttcgtcgctgtagtacgtccggcggatgtgggtgacgagtgcggctttctggatgccgagtagggatgcctcctcggcggtggcctgccggggctcgggctgctccacggcgtggctgacggtgacgccgatagcggccatccggttcacgacgcccgccccggcgtgcggccctccctcgggaaggacgacgagagtgccggcggtgaggtcgtacggctcccaactcgtcgacaactgcaccggcctgccatcggccaggaactcgtacgcagtgcggacgcacagatcaccctcggcgataccgagccgggccgcgatgtcagctggcgccgggaccttggcgtcggtccggctctcccaatccccctgcttgcccgcggccttcatgtccgagcggaacggcgagccggtgggctgctcgcgtgccgaggaacgcacgacccgcacccgctgccggggctcggcgacataggtgcccgaacctgcgcggccctccagcacgccctgcgagatcagcaactcctgcgcccggcgcaccacgttctcgccgacgccgcactcctggccgatctgcgcgcgggagggcagacggtcccccggctcccacacgtggtccgcgatccgccgccgtagttcgtcggcgaggcggagatagggcggctgctcaggcatatggaaaatctagtccactagctctaatctagttaactagcttcactcaaagtgatcgccggtgacggaggctgccctgtgcctgcttgggaagtgagcgcggaagccatcgcggcccggttatcggccgtcgggctcaccacccgtgtggaggagcacgaacgatgcacgtcgatcgaggcggaggtaccggaatcgctctccgccgactcgtggcgggaggtcttggacgcggtggccgaggctgaccgattcgggctcctcgccaccagcttgaacggccgcaccctctgggcggtcgtacgcaaagcggtccccgcggcgggtgatgccgggggaccgagccatcagcgataggagctgagcagcgtgctcaaccgtatccgccgtgccgtcttactcaccagagagcggcacttccgcaagggcaggcaccgccgcccgtcgacgtcctccaggccgccgaccgcccacgcgctgtccacgtccatggaggggtccgtgatcgccgccacggggcaggcgaaagacgccgcgaaccgtttgggcttccttgcgggtgaggacaacgcgctcgtccggccgtacatggcggcctgggagaggcgcgtacaacagcgctcggtggtagtggcccggcatctgccagctgaggcctggtcagctctcgcgggggcccactgatgccctaccgcccccaacatcgcctcacgaacgctgaggctgctccgtaccggtcggcctcatgccggatcggcacgcaccaggcatgcgcggagtccgcaccggccatggccccggtcgacgttccggtggtctacgaggcgtgcgactgcccgtgccactcggcacccaaccgacccgcgttggtgaaggtggagaggtgagggaacgcatgcccactggggcgatggtctccccgatcgagatcacttcggcgagcgtgcagcgcggtgacctcatccagatcggcggccgtcagtgcctggtgatcgacctcatccaactgcgccagggcgcgaagcagctcgtcttcgagtcgggcgaactgctgaccatgcactcacggtcccggatgatcgccatgcgaatgctgagaaggtggtgactgggcccgtgtcctctcgccgagacgccatcgccggtgacctccgcagccagatcgtcaccggccgcatcaaggccggcgaacgtctgccgtctgaacccgtcctcgcatcgcgctactcggtcagcctgcccacgctgcggagtgctctggcggtcctccagggagagggcctgattgagaaggtgcacggcagggggaacttcgtccggcgtcccctccggcgaatcacgtacgtcgggggagcgcggtgtaccgacgcggatacgccgcctgctgacccggctctgcgtgtcaccatccgcacggccaatacccgagcacggggcccactggccaccctgatgaacgtaccggtcagaagcccgctgactgagttcatctgtctcgctcaggaaggggaggcgcctcacagcttggctcgtatctacgtgccccgcgacctcgcgccggccgccgtgcccgaagagtcgacctcgcgattcgggatgccggtggacctgggcaatctgcgcccgccgctggcggaggtccaggagaaggtcagggttcgcctgccgacgcaggaggaagcctcgatccttcggctcggcccggcctgggccgtactcgccatcacgcgggttatgagcgacatcgccggacgcgtggtcgaggccgcgttcctggtgttccccggcgaccacgccgacgcagtcttcaccacacgtcaccagatcgacgacagggggatggaagagtgaccatgcgagagggattgcggttactgccgtggtcgggccctgatggcaaggcctgctacctcagcaccgacaacggcgacagctacctgtcgcgcttggcggacaacaccgaatcggcccaactcggcttcgctgccgagatgctggagcaggcgcgagacgtactcggcgactcggactcagatccggaagaactgcgacttctggcggccggactgaccggcgcactgcgggacacactccgagtggcaaccagccgcggcgaacgcttgcgatgaccgcacgcgggccgccgcgtcagctcggcctgcgttgccggtctactgatcaccggttccgctgaccagcgggactgacgaagcccacggctctgagctgatcagagccgtgggcttctgtcgttgttggtcggcgtcgggtggcctcgcacggcccagggacggcccggagccgatcgcgctggctggctgggctacggcaccgcccgcacaatctggcacgcacctgggcacacgacatcctggctggcgaccaagcgcttcacccgcaccaagtccgcagccggcagttcagggcgtgtgggtcaggcatacggatcagtcgtagatcatgacgcgccggggccggtgcagtgctgaggggctcagtgcaagacatagctgcaaggctgtcagagggggcggagccagcctcactgggaagttgccccaatcttgctccgtacaactcaaggcatccgtaagatcgaaccgaagttggtgttgctcagcaatgggctgagtagggcatgggtgacagggcggagcgatggtggagtcaggcatcactaccccgggctcgatgaccacggatgtgttaatccagcatcgtcgtgaaattgcagacctcaagcaacgcatcaagaatcgccgactccaagttaccggtctgtatggggctccggtcctagccctcatcgttctcctggcgtgggccgcctttaaggtgctcctatggctgcattcgagcatgccaagtgcactcaacggaattcttgggggtactgcagctctattgggggtgtcctttgtcgcgcaggcgctagttgaattcaatagtgacttcgtcggcgtgtggagagatcggcggacctcagtccgagagctgaagctcgaactttcgttggccgaagagcgtcacattcttgaagccaggcgccgcacccctccaccgatggatcggcagtcttcctataaggaaagactgccgggggaaatatctcgattgcgcgaagagtcgcgacactatcgccgcatgcatctcctcatgcaatggcttctcttcattagctcatcggctgtttcagctgtgactgcctggtatgacccgccccaacccgcaaagggtgcactcatcggcctcggctttatagtgactttgatcacggctgcgactggttacttcaaaccccgggagcgtgctttcaatcttcagcagactgctgacgctatcgagcagcatgctaacgcgcttgagcttggcattgctccgtataacttgagcgaggatgaaaggaacttggagctattcgcaaccaccgtagagggattgcgtgctgagcagcgaatgcgtgagcagcagcttgaccagccacaacaaggtcagcagcaagtcatttaacggtgagagctgccacctgagcagtgaaacgtcgtcttggaacagccccaactgatcgctggcggccgtggcctgtggccgtccaatcgatcgcatcccgacctggtgccgagctgtcggccacctgtcgacgttggtcagcttgagcccccttctgcggcccgaggtcggcccgacaaggcgctcgtgcctgctcgtcagtgcacgaccccgagaagagtgccggccgcgagaagacaaagcgctgcacccgaaaaaaacatgccgatgcggatcttcttgtatttacgggtcacggaacgcgccaacactgaaaactgctggacattcctcttcgcatgatcgctcatttcaatgaggtgcagtatctcggagtctgtcagttctccgttcgctttcacgtcaccgaaatagtacatgcgcccctgcacaccggtaccgggataggggtataccgccatacccagaaacacaagcgccaggcctgccattccgcaaccgaaccaaaagagccattgagtcgcgcagtcaaaatcggctggattaatcttggcgctagcaaaagcaccgattagtgccgcagcggctacgccaagcgccgcaagcaggaggttcgctttctggtcggctttggccagttcctctcgagtctccgacaagagggattcggtcagcggcaggcaattcgtcctgcgcgaatttccactagccactgatgcctcgccggatctggcgactgttctggtcgcggaacttgatgacttcctgatacttgccgtatgccaggcggttacgcttcgaatccaggtctggcctgcgccaggaacctgagcagaccttgtcacagtaagagtctccacaggtttggcaccagctactcgtgagcagcaaaccttcagagtctttcccggagaccttttctacatgctgctccgaccacaggggggcaggcgctgcaccacactcgcaggaataccagaggtactcgttacggcgaatgatgtcagcaatgggcttcgtggcgatcatttcgtgcgccttggcctgctgtgagcacttggctgcatagttgacggcacggcctgcccataccggagcatggtgatcagtgcgcgaaattccaaccttcttactcaagaggtcactgatagcgcatccgaccttgaaccctgtctgcggcggattcattggccactttttttcaagggcaggcataagaatgcgttggccgaaagtcttgatggtaattccggcacaaattgctcgtcgctgggaatattcgccggtaaagagaccgaacgccgcgtcaccttgcacatcgatgaactcggcaccgaaatctgaaagaatacgtacggcgggcttgacggcggcatcatagattgaagctgtcgacgcctcccatcgcccattccgcagtgttgtcgagcctgccaggtcggcgaagacgcaggagacctgcgggtacttgcgccacttggaggcgtcgatgaagaggtccgctgtgtcaattggaccgtcgctttcaatcacctccggggtttggcgcaactgcgaggtgacgtggtcatcgaactcgtccatcatctcggatacctgcggtctcgcggccatgcgttccccaatcgctcgatttgccagtatgccgacaccacgggtttcgagctacccactttcaacaactgggggtgtcccagatctgccgcgtccgtgaggtcggcggagcggctttgggctggagctgctttggggcgagtgatcatggccccgtaagcttgcggcgcgtcgggcagtctgtggacctgcccggtaaagcacgacgttggggccatgatcttagaggctcgccccaaagtggctgcctaaagccttggagccgaccgccccagccacggagggtttctccccacgacgtgcccgcagccgcgagcgcgccgccgggcgcggccagccggggcggagacaggaggcaggccgcgccgcagaggcggcgcgcgcccgcgccgtgcgcgggccttgatgaagtagggaaactcttaccgcatccgccacttgtggctctggggcgcctcagaggtgccaggtgctgagcttcgtcaatgcttcggcgcggtcctcgatgaccttcatacgggcaagccgctcggcttcgtggtggtgggcgtcctgggctgtggtttggccgggccacttgcggtagaggagtccgcactcctcgatgaaccatccggtgctgacggcgttcagggccatcaagaggccggtgtcctccgaagacggcaacgccatccaacctcccaacgccgtcacaaggttccgccgtgcgcacaacgtcgccggatgaacctgcgctctgtagttgtgcgttcgccaccgttcgaggacggcgccctgtccgatcgggccagctggtgggtcgccctcgaaaccgacggttgatccgtctgggagtaggtcgaggacacgtgacgtcgtccaggcaatgccgctctgctcggtcaggatcgtgatgtcccggagtagtgccccgggtgtgagcttgtcgtcggcgtccaggaccttgagcaggtcgccgcgggctcgggcgagggccatggtgcgggccatgccggcgcggccgttcctgccttggtcgaagctgatgcgggagtcctcggggacgtgcgggcgtacgtcgtccgtctcgccgtcctcctggatgagccattcccagtcccaacctggcggcatctcctgctgggtgagcgaggagtaggcgtcggcgagatacggtgcggccggtccgtgtacgggcgtgatcaccgagacaaggcgcgtcatgcggccgttcaccacctttccaggggggtcacgcacttcacggcgtagcggtcgccgggcagtacgacgtctgccacctccacgatccggccgttggtgtcgtagagggtctttcggacgtccatgaccgcgacacctggcatgaggccgagttcttcgacctcgtcggaggtcgggggacgggcggtcacgacctcctcgacccggtcgacctcgatgcccacggtgtgcagctggttcatggtgccgccgggccacggctcctgggcctcgtcgaggaggtccgggttcttctcggcgagcgcgtaggggatgtaggagcgggccacgttcagcggctcgtcctcgttgacgctgcgggtgcggtaggtccgcctgagtacggcggcgcccggctcgacgtccagggccgcggccagggcctccggggcttcgatccgctcgtactgggcgttgaacgccagctgggtgatggtgaggccggtgtcccgctcggtggcgccggtggtgctgcgctccttcaggtcggcgcgggcgcggtccttctcccactgatgacggaggttgctccgttcggcgcgctggcgctgcttgcgtacgaagttgccgagaccgtgcctcttctcgatcagcccttcggtctggagcgcgctcagtgcctgtcgcagcgtgggcaggctgaccttgtactccgtgacaagggtcgtctcggccggcagccggtctccgggtgcgtactcgccggactcgatccggcggcgcaaatcctcagaaaccttctcgtatcgcttcgccatctgcggcctccttgcgtcgacacacagtctaagtcctcttgaggacttgacgagtggtcggggactctgcatagtcatagcaactcctaaagaggagttgaggacaacagctctgtaagtgctggctgagtcagccctgtgaaagcgagttcccagatgcgtcagatccccgtcgacacctccgacgccaccgcgatggtcgcgcaggccccggaacggaagatccgcgaccggcgtaccggtgaggtcgccaccgacgccgagaccggcgcgacgctcatgaccgtgagcgtgatgttcgctctccacggtgacgtcgagatcctgaacgtcaccgtcccggagaccggcatttccggtgacctgccgatgggcaccccggtcgcgctcacgggcctggtcgcccggccgtgggagaacgagttcaacggccagaagcgccacgggatcgctttccgcgcggtcgccgtgacctcgctgaccgctgcggcgtcgcaggcggcctgatcatggcccgcttcgcggtcgctctcgtgctggtcgtcgccaccgccggtctcctgcggtggcggcgtcccgcctggtactggctgaccttcgggatcacgttcgccgtcgtccgggtgctggtccgctacggctcggtcatggatgcctgcggcctgacggtcccgccctcgcgctggcgcttagccctggcccgcatggccaaccggcccgttcccggcccccaggctccccgcatcctccgggtgcggccgacccggaccggcctggtgctgcggctcaagctcagggccggacaggatgccttcgacgtcgccgcctcctgcgaccggctccggcactcgttcgccatgtacggcgtcacctcgcgtgagctgcgctcgggcgtggtcgagatccgtatgaccggctacgacgtgctcaagcgggtgcagatgccggccaagaccgacacccgaccgatgcgggttccggtcgccctgcgggaagacggctcggtccactaccgcgactaccggtcgataccccacgccctcaccctcggcgccacggagtccggcaagtccgtctaccagcgcaacctggtggccgcactcgcctcgcaacgcgtcgccctggtcggcatcgactgcaagcaaggggtggaactgttcccgctggcccgccgcttctccgcgctcgccgacaaccccgacagcgccgccgaactcctcgatgccctcgtggcccggatggaaggcgtctatcagctcatccgcgccgagcagcggatcaccgctgacgtgccggatgcggagatcgccgccgacatctggagcctctcggaagaactgcggccggtcccgatcgtcgtcctggtcgacgaggtcgccgaactcgcgttgttcgcgaacaaggaacaggaaaggcgccgggaccgggtcatcaccgccctggtccgcctcgcccagctcggccgcgcggccggcatctacctggagatctgcgggcagcggttcggctccgaactcggcaagggcatcaccatgctccgcgcccagctcaccggccgcaccgcccaccgcgtcaacgacgagaccagcgcgaacatggccttcggcgacatcgccccggatgccgtgctggccgcgatccagatccccaccgacctgcccggtattgccgtcaccggcgattcgaccggcggatgggctcgcatccgcgccccgcacacctcgctccgccaggccgtgaacacctgcaaccggcacgccgccctgaccccggacctgcccgaactcgctccgttccggcccgtcctgcccagcgcccctgcggcggtcccggtgccgctgtccaagacggctcccgccacagcctgaccacgtctgtagacccgtagaagggagatcccaccgtgtgccccgactgcgacgacttcgcccggaccgtgctcctcctcgggcaactcgccctgtacgccgacatgaccggcgctgacctcgacttcgtggaagccgtcagcccgtctctggccgcctcgctgcccgagccgccgcccggcacctcctcgcccggctacgagccgagcgatggcccggactaccccggcgggaacgtttgatggcccgctccgctctgcgcgtcgacgcggtcctggtccaggcggtcattgctggtgccctgtccttcgcccacctgcacgacctcgcctccgcggccggacaggacggctggaaagcctgggcctacccggtcagtgtggacctgctcctggtcgccgcctggcgtcggctccgctccgacggaccgtcccggctggcctggtgctggttcgtggtcgcgctgttcgcctcgctcggcgccaacgtcgccaccgccgggttcctcgacctggccgacccgcccgcgctgctccgcctcggcgtcgccggatggcctgccctcgccttcctcggcggcaccctcctcgcccactcc

SEQ ID NO: 560 - DNA, 18929 bp, Unknown
  Kingdom: Bacteria, Phylum: Actinobacteria, Class: Actinobacteria, Order: Streptomycetales, Family: Streptomycetaceae, Genus: Streptomyces
gcccaggccgccgcgtccacgcaggccgcgacgccgaccgtcatcggcgcggtcacgggcttctcccactccggcgccacgtacaccttcacggcgggcgcggccaaggcccgggtcgcgttcgtctcggccgacaccttccgcatcgaggtggcccccgacggcacgttcaccgaccccgtcggcaccgacatcgtgctgccgcagggcaaggcgccggccacccgctggcgcgacctcggcgaccgctacgagctgtccaccgacaaggtgaccctgcgcgcgtacaaggcgccgctgcggttcggcctgtaccgcgccgacggcacccgcctgtgggaggagagccagggcatcagctggaacggcaccgccaccacccagacgctggcgcgcggcgccgacgagcagttctacggcaccggcgagcagaacggcagcggcaacacctcgcagcgcggcaagacgctcaaggtcggcgtcgactacaactggaacgagggcggccaccccaactcggtgccgttctacctctcctcggcgggctacggcgtctaccgcaacacctacgcgcccggcacctacgccttcaccgacccggtcaccaccaccgagcaggagaaccggttcgacgcgtactacttcgccggtgactccgccaaggacgtcatcgggcagtacacgaagctcaccggccgcccgatgctcccgcccatctacggcctggagatcggcgactccgactgctacctgcacaacgccaaccgcggcgagcgccacaccctggacgcgctcaaggtagccgacggctacgtcaagaacgacatgccgctgggctggatgctcgtcaacgacggctacggctgcggctacgaggacctcgcagagaccgccaagggcctcaactcccgcaagatgcagatgggtctgtggaccgagaacggcctggacaagctggccgaccaggtcaaggcgggccagcgggtggccaagctggacgtggcctgggtgggcgacggctacaagttcgccctggacggctgcaaggcggcgtaccagggcatcgaggacaacagcgacgcgcgcggcttcacctgggcgccggagagctggtcgggcgcgcagcgctgcggcgtgcagtggagcggcgaccagtcgggcagctgggactacatccgctggcagataccgacgtacgccggcgcgaccatgtccggcctcgcctacacctccggcgacgtcgacggcatcttcggcggcagcgccaagacgtacacccgtgacctggagtggaagtcgttcctgccggccgtgatgaccatggacggctgggcggccaaggacaagcagccgtaccagtacggagagccgtacaccagcatcaaccgcaagtacctcaagctcaaggaatccctgctgccgtacatgtacacgtacgcggccgaggcgaaccgcaccggtgtcggcgccgtccggccgctggcgctggagtaccccgatgacgcgaaggcggcgagtgacgccgccaagtacgagttcctgaccggcgaggacttcctggtcgcgcccgtctacagcgacaccacggtccgcgacggcatctacctgcccaagggtgactgggtggactactggacgggccggacctaccacgggccgaccacggtcgacggttaccaggcgcccctggacaccctgccgctgttcgtgaaggcgggcgcgaccgtgccgatgtggccgggcgtcaactcctaccaggaccgcacggcggactccccgctcgcctgggacgtctacccgcagggccgcagcaccttcaccctgtacgaggacgacggcgtgacccggcagcaccgcagcggcaagtacgccgagcagccggtgaccgtgaccgcgccgcgcagcggtgccggagcggtgcgcatcgcggtcggcgccgagcggggcgacttcgcgggcaagcagaagaaccgcccgtacgcgttcaccgtgcataccggttcggccccgcaccaggtccgcctggacgaccgcggcctgccccgcctcacctcgaaggccgccttcgacgccgccggtcagggctggtggtacgacccgtccgaccgggccggggtcgtccacgtcaagacccgctcgctgagcaccgccgacggcttccggatcgacctggacggggcgagcgcggtcggcggcaaggtgcccggtgccgtgggcaccgtctcggtgaccgcgccggacgagatcggcgccggtgtgtccggcaaggtcacggtggacttcaccgcgggccgcaccggcagctcggcgacccggttgtcgctgagcgcgcccgagggctggaccgtctcgcccgcccgcgacgccggcccggccacgcccggtgagcgggtgagcgcggagttcaccgtgaccgcccccgcgggcgcccaggcgggcgaggccgtgctgaccggcagcgcccgctaccgggcggccggcgaggaccacgtcgccacgcagcccactgccctgcgcaccatgcccgccccgcccaagggcgacagctgggccggcgacatgccctggctgaactccaccaacggctacgggcctgccgaacgcaacctcagcaacggggagtcggcggccggcgacggccacacgctcacgctgaacgggacgacgtacgccaagggcatcggggtgcacgcgaactccgacatcgagttctggctcggcggccagtgctcgtcgctcaccgcgaccgcgggcatcgacgacgagatcaacggctacggcggcgtctccttctcggtcgtcgccgacggcaagaaggtgtggtcctcgcccacggtcagcggcaagtccgacccgctgccggtggacgtgccgctcgccggagcgcgccatgtccacctggtcgtcaccgacacggacggcacgaagtccggcgaccacggcgactgggccgacgcgaagttccactgcgccggctgaccggcccgcctctctacggtgccccggccccaccggccggggcaccgtgctgtgcggtgctggcgcggacgatcaactggggttccacggaggccggttcgggcaccgcgcccgggtcggcgatgtatcgcagcaggtgggccacggcgagcgtgcccatctgggtgaacggctgggcgacggtggtcagggacggcgagcagtactcggccagttcgatgtcgtcgacgccgaccacggagatgtcctcgggtacccggcggcccagttcgtgcagcgccctgatcgcgccgaaggccatctcgtcgctggcgacgaacacggccgtggcgtccgggatgcggcccaggatcagcccgctgcggtagccggaggccggggaccagtcgccctccaggggcgggggcaccggccggccggcctcctggagcgtgctgcgccagccctcgcgccgggccgcggcctccagccattcctcgggtcccgcgatgtgccagacggtgtcgtggccgaggtccagcaggtggcgggtggccagccgggcggcgaggccctggtcgatggcgacgacctcggtggcgtcggtgcgcgagccgtcgatggtgatggtgggcgtcgcccgggtgagctgctcgatccgggggctgctgtggttgagcggcaccgacaggatgacgccctcgacgccctggtcggccagccgggacagggcggcctcgatggcggaggtgtccagcgacgtggtggtggccgtgctcaccgcgtacccggcggcctgggcggcgtgctcgatgcccgaggtgacggcggcccgggagtagaagttcgtctgcagggtgaccacgccgatggtgcggctgcgtcccgaggagagcatgcgggcggcgttgttgcgccggtagccgagctgttccacggcggacaggaccttggcgcgggtcttctcctggacgttggggtggccggacagcacccgggagacggtctgcgccgacaccccggcgacccgggccacatccgccatgcccggcggccgctccccgccgtcactgtgcttcgccatgggttccttcctcgtaccaggagtcgatgatatcgcccacacgcgctgccatctgcccattcacctgccgggcagcccgcggaagagcgcctattggcatcgataacattctctgccatagtttccgccatcagcgcgccgtcccaccgccgggcccctgccctccgcggtgtgcacggccccgcggaggcaactcctccgctccacccagcccttcaggaggagccgtgaagcgatccattgtccgtattgccgggatagcgggagccctgggactcgccctcaccgccacggcatgcggcagctccgactccggttcctcctccgcgtccggcaagggatcgatcacattctggggctgggcacccggctacgcggacgccgtggccgcgttcaacaagagccacccggatctgaaggtcacctaccaggccgtccagccgggcgccaagggcggctaccagaagatgctcaacgcggtgaaggcgggcaacgcgccctgcctggcccaggtcggctacgagaccctgccgagcttcgcggcgcagggcgccctcaaggacgtgagcaagtacgcctccgccgacgagggcgactaccagccggcggcctggaagtccgtgaccctgggcggcaacgtctacggcgcgcccgtggacaccggcccgatggcgctcttctacaacaagaaggtcttcgactcgctcggcctgaagccgccggccacctgggacgagtaccgggccgacgccaagaagatccacgcctccgacccgcaccgctacatctcctcgccctacctggactacgactacgcgggcctggcctggcagaccggtgccggctggttcggcgtcaagggcgacgcctggcaggtcaccatggcctcggcggccaacaagaaggtcgccgactactggcagggcctcgccgacgacaagctgatcagcggcgccccgatgtacgaccaggcctggtacaccggcatcggcaacggcgacatcgccaccgtcgtcggcgcggtctggcaggccggcgtcatcaagggcggcgcgaagagcggctccggtcagtgggcggtggcaccgctgccgcagtggagcgcgggtgccggacaggcgggcaacgcgggcggctccgcgacggccgtcctcaagggctgcgacaacgccgagggcgcctgggagttcgcgcactggctcggcaccgaccgcgccgccttcggcacgctcgtcgagaaggccgcgctgtacccggccgcgaagaagctcctcgacctgccccagctcaagggcggcgacccgtacttcggcggtcagaagatctacgacgtgttcgccgccgccgctccccaggtcaactcctcgtggacctgggggccgttgatgaccaagaccgccgccgacctcgacgacggcctcggcaaggcctgggcgggcaagggcaccatcgccgacgcgctgcgcaccgcgcaggaccagaccgtgggcgagatgaagaagcagggcctgaaggtcgccgagtgaacgagtccgtgatcgacgcggccggcgcggtgccggccgcccgcaccggccggcccgccgcggacacccgcgggcccggccccacgcccgcctccgccccggcgtccgcgtccgcccccgccggggcggcgcgctcgcgccggctgcggcccctgctgttctgcgcgcccttcctcgtcctgttcgcggcgatgtacgtcgcgccgatcgtctacgcggcggtcagcagcctgttcaccgtccaccgctctggcctcggcctcaccgcgccgaccaaggtcttcgacccgctgggcaactacagccgggcgttcggcgaccacgcgttcctgtcctcgctcggccgggtcgcgctgttcggcctggtccaggtcccggtgatgctcggcgtggccctcgccctcgcgctgctgatcgactcccgctcggcgcgcggcaagggcttcttccggctctccagcttcctgccgtacgccatccccggtgtgagcgccgcgctggtctggtcgttcatgtactcgtcgcagtccagcccgatcaaccggctgctgcacccggtcgggttctcgatcccgttcttccacagcgaggtggtgctgtggtcggtggccaacatcgtcacctggagctgggccgggtacaacatgatcatcatctacgcggcgctccagtcgatcccggccgaggtgctggaggcggcccggatggacggggcctcggccctgcggatcgcctggagcgtcaagatcccggcggtgcgcggcgcgctggtgctcaccacggtgttctccatcatcggctccgcgcagctctacaacgagccggccgtgctccagccggtctcggacggctcggtgtcctcgacgttcactccgatcatgtccgcgcagagcgcggtcgcggcgggcaactacccgtacgccgccgcgcagtccgtcctcctggccctcctggtgggtgtcgtgtcgttcgtgttcttcaagctgacccaccgcggggaggagcaggcatgagtgcgctgagcacgcggcccgccctggtccgctcgcgccgtgagagccgtccggcgagccgggtcacggtcatggcgctgctgggcctgtcggccttctacttcctcttcccgctgtggtggctgctggtgtcggcgaccaagccgttcggcgagcagttctccggcagcggcctgtggttccacggcttcggcctgttcggcaacatcgcccggctcagcggccaggacggcggcatcttctggcgctggatgctcaacagcgtgctgtactgcggtgtcggcgccctgctcggcacggccttctcggcgctggccggctacgcgctcgccaagtacgacttccccgggcgcggcgcggtgttcggcgcggtgctggcggccgtgctggtgcccaaggtgctgttcacgctgccgctgtacctgatgttctccggtgtgcacctgatcgacaatccgctggcggtgctgctgccgagcgtggtcagcccgttcggggtctacctgtcgcgggtgttcgccgcgcagaccgtgcccgacgaggtactggaggccggacggctggacggcgcgggcgagttccgcatcttccgtacgatcggggtgcggatgatgctgcccgcgctggtgacgatcttcctgttccagttcgtggagatctggaacaactacctgctgcccgccatggtgctcggcgacgaccggctgcagcccgtcacggtcggcctggtcgggtggaacgcgagccatgtcgccgttcctcccccgctggtcgtcatcggctccctggtgtccgtcgtcccgcttctgatcgccttcctcgcgctccagcggttctggcgcgcgggcatgaccgccggagccgtcaagtgaccacttccgcaccgcacaccgcggctgtccccgatccgctcaccaccgcgccggccgccctgaccttcgcggacggcactctgctgcgcgcgggccgcccgcaccgcgtcctgtccggttcgctgcactacttccgggtccgtcccgagcagtgggcggaccggctcgggcggctggccgcgctcggcctcaacaccgtggacacgtacgtcccgtggaacttccacgagcgcacccgcggcgacgtccgcttcgacggcgggcgcgacctcgcgcggttcgcgcggctggcgcaggagacggggctggacgtcatcgtgcgcccgggaccgtacatctgcgccgaatgggacaacggcgggctgcccgcctggctgaccggcacgcccggcatgcggccgcgcacctcccaccagcccttcctggacgctgtcgagcgctggttcgacgagttggtcccgcgcatcgccgcgctccaggcggcccggggcgggccggtcgtggcggtgcagatcgagaacgagtacggcagctacggcgacgaccacgcgtacgtgcgccgggtgcgcgacgcgctggtggagcggggtgtgaccgagctgctgtacacggcggacgggccgaccgcgctgatgcaggacggcggcagcgtgcccggccacctcgcggcggcgacgttcggctcccgcccggaccaggcggcgcacctgctgcgcgagcgccgccggggcgagccgttcttctgcgccgagttctggaacggctggttcgaccactggggcgagaagcaccacgtgcggtccgcgaccagtgcggccgaggacctcggcgggatcctcgacgcgggcggttcggtgagcctgtacatggcgcacggcggcaccaacttcgggctgtgggccggcgccaaccacgacggcgaacgcctccagccgaccgtcaccagttacgactcggacgcgccggtcgccgaacacggtgcgctgacaccgaagttcttcgccctgcgcgagcggctggcggcgttcgccggaccggaccgcgcgcttcccgagccgcccgccgacccgccgctgctcgcgccccgcaccctggaggtcgcccggcgggcggcgctcctgccggcgctgcggtcggtgggcgaggcggtccgctcgcccgtgccgctgagtttcgaggagctggggcagtcctccggcctggtgctgtacgccgccgagccgctgctgccgccgggcccgcaggagctgaccgtcaccgggctgcacgaccgcgcccaggtgttcgtcgacggtgtccccgtggccgtactggaccgtgagaccgcctcgttcagcgtgcggggtaccggtgcgcgggtgcggctggaacttctggtggagaaccagggccggatcaactacggcccgctgctcgggcagggcaagggcatcctgggcggggtgcgcgtggaacggcggctggtccacggctggacgatgtaccggctgccgctggacgagtgggggcagcgggccgccgaccgggccgcctcggcggcgccgtgcgacgaccgggccggcttcgccaccgcccggctgacggtgaccgaacccgccgacaccttcctcgccctgcccggcttcggcaaggggttcgtctgggtgggcgacacgctgctgggccgctactgggagatcggcccgcagaccacgctctacctgcccaggccgctgctgcgcgagggcgagaacacgctcaccgtcctggaactcgaacgtttcggcgaccacctcgccctcaccgaccgccccgccctgggaccggccgaggagtacgtcgagacgttcgactgacccgcggaaccacggccgccgacagcggcgtgggcacgcgaacgggggccacagaccggaccggccctgacaccggtccgccgtcacgcacaggaaccacatccaggggccgcgcagcccggcgcggccccgccccgagcaaggaggacctgtgtcacctcaccgcaagagactggccgcggggctggtcgccacggtcgtcgccacggcgacggccctgaccggcggcagcgcgctcgcggcccccgccgcaccggccgccgacgcaccggcgtacaccgtcaccgtcggctcgaagggttcctggacccacccggacgacactccggccgccccttacatcgacaaggacggcaccttccacttccagcaggcccactccctctacggtgcggacgacagccgtgcgtggaccttcttcaccggcaaggacttcgactccgccacccgtgacagcaccctgagcggcgcggtgaacccggccgactcccgcgaccgcaacgacgacaccacctggcgctgcaacaacagccccaccggcgtggagtcgagctacgcgcccgccggttcgcactacgcgcagaagaactactgcgacctggcgggcgtgtgggtcgacccggacaccggcgactggtacggcctgatccacaacgagttcaccccgcagcccttcggtgacggcctgcactacgacgcgatcgactacgccgtctcccgggaccagggccggacgtggaccatcaaggaccacgtcctcacctcgccgtacagcacgaagcgcggcgacacggcggcgttcccgcagcagacgttcgactacggcgacggcgacccgcgcctgttcgtggacaccgcctccggctacttctacgtcttctacggctcccggatcgtggacaagggcggcagctggaaggccttccacgcccacgtggcccgggccccgatctccggcaagatggcaccgggctcgtggcgcaagtggtacgacggcgcctggtcgcagcccggcgtgggcggccgggagagcaacatggtgccggccgacaccgcgcaccccacgggctacacccccgccggcaaggagtacgacccggcgaacagcgggacgacgagccagcaggtggcggcgggcacgatgccgccgacctcgcccctgttcgtcatggacatcacctacaacgcctacctggggctgtacatcggcgaaccccagggcgtggaccagagcggcaaggcaccgcagcagttctacgccaccgatgacctggccacgcagaagtggcggctgatcggcgacaccggcagcctcaccaacgcctcctggtaccgctggttcctcgacccggcgaacaagaccggctcgggcatcgtcggcaagtcgttccgttcgtactgctccttcggctgctcgggcggctcgtccggcgagtacgcgaacgtcaccatcggcacctcggcgccggccgctcccgtcgacacgagccgcgcctaccgcgtctccagcggcgccggccgtgtcctcgcccaggtctccggcggctccgcgaccacctcggacgcccgcgcgaacggttccgcccgggagtcgtggatcttcacgggcaacggtgacggctcctaccgcatcaccaatgcggacaccggcggcctgctcggcgtggactcctcgaacaccgcgcagcgcgcctgggggacccggcccaccgtcaccgcggcggggcccggcggtgccggggtgggtcagcagtggtgggtgatccagggcacctcgtccgacggcacgcccaacggcacgtaccggctggtcaaccgctacagcggcctggtgatcggcctgtccggcgactccgcgcaccccgccgagaccacgcccgcgcggtactggaacgccggcggcgccggcacggtcggcggctcgcgcaccgcggccgaacagacgctgacgctcacgcccaccggcgcggcgcccgcgccgctcgacggcacgcgcacgctcgtcaccgccggcaaggccctggaggtccccgggcacagcaccgccgccggcgcggggctcgccacctggacgcagaacggcggcgcccaccagaagtagcgcctcagccggcaggacgacggctcctacgagatcgtcaacaccgcgtcggggctgtgcgccgacgtcgacggcggttccaccgcggccggcgccgaggtgatccagtggccctgcaccggcggcgagaaccagcgctggacggtcaggcgcctgagagacgggtccttcaccatgacctcgctgcacagcgggctgctgctcaccgcggcctcggcggaccggggcgccgccgtgacgcagcgcccggccgacggctcaccgctgcagcggtggcggatccgctgaccgcaccggccggggcgccaccgccccggccaccggcgtgtttacgccccgggcggccgggtcactcatccgtactacggcccacggcagggagcggcagggagcagacatgattcgttcggcggacctccgtgaatggcgcaaccgcgacgtggtcgacgtggagggtcacaagatcggcgcgctggaggcggtctacgtggacacgggcaccgacgagccgtccatggtgaccgtccgtgcggggctgcccacccggcagcgcctgctgttcgtcccggtggacgacgccgtcgtggggcccgactacgtccaggtcgcgcagcccaagggcctggtgaagaaggcgccctccatcggcacggacgacgtgctgcccgccgagcaggaggccgcggtcttccagcactacgacctgccctacgtgcccggcgccggcggtgaacggcggctcgcccgccgctgaccgcccgggcccgcgccccgcgccccgcgcccgaggaggagcagatggccatcgacaccgtcgagcggttcctggccgccctcgatccgcaccaccgcgaacacgtgaggggcctgccgcgcgcggagcaggagggcctcgccgccacctgggaggacgagctgcggcaggacaccgacctggacacgctcagcgagctgtcccccgccgccgccgagagcgaggcggcggcgcgggtcgcccggaaggtcctcgaccagccgcggcggtgagcaggcgagcgggcgccgccgccccggtcgaggactgaccttgaccggggcggcggtgtccgggcgccgtggcggtcaggccaggtcgaaccggtcgaggttcatgaccttggtccaggccgcgacgaagtccgtcacgaacttctccttcgcgtcgtcgctcgcgtagacctcggcgacggcacgcagctcggagttggagccgaagaccaggtcggcccggctgccggcccacttgacctcgccggtggccgcatcgaagccctcgaaggtggtcgcgtcggcggaggccgcccgccactgggtgccgaggtcgagcaggttgacgaagaagtcgttggtgaggacgccgggcgtggtggtgaggacaccgagcggcgactgctggtggttcgcgcccagcacgcgcaggccaccgaccaggacggtcatctcgggtgcgctgagcgtcagcaggttggcccggtccaggagcaggaactcggccgggagccggttgcccttgccgaggtagttgcggaagccgtcggcggccggctccagcgcggagaacgactcgacgtccgtctgctcctgcgaggcgtccacgcggcccggcgtgaagggcacctcgatctcgaacccggcctccttggcggcccgctcgatgccgacgccgccggcgaggacgatcaggtcggcgagcgagacgcccttgccgccgctctggccggcgttgaaggactcctggacaccctccagggtgcgcagcacgttcgcgagccggtcggggtcgttgacctcccagccgcgctgcggctccaggcggatgcgggcgccgtcggcgccgccgcgcttgtcgctgccgcggaaggaggaggccgacgcccacgcggtggagaccagctcggccaccgacaggtcggtggcgaggatcttcgccttgaggtcggcgacgtcgtcggcgtcgatgaggccgtacgtgcgctcgggcagcgggtcctgccacagcagggtctcggcggggacctcggggccgaggtagcgggagaccgggcccatgtcgcggtgggtcagcttgaaccaggcgcgcgcgaaggcgtccgcgaactggtcggggttctccaggaagcgccgcgagatcggctcgtagaccgggtcgaagcggagcgagaggtcggtggtgagcatcgtcggctggtgccgcttggacgggtcgtgcgcgtcgggcacggtgccggcgcccgcgccgtccttgggccgccactggttcgcgccggcgggggacttgaacagctcccactcgtagccgaagaggatctcgaagaaggagttgtcccactgggtgggggtcggcgtccaggtcacctcaagaccgctggtgatggtgtcgccgcccttgccggtgccgaaggtgttctgccagccgaggccctgctgctccagcccggcggcctcggggtcggggccgacgttgtccgccgggccagcgccgtgcgtcttgccgaaggtgtggccgccggcgatgagggcgacggtctcctcgtcgttcatcgccatccggcggaacgtctcgcggatgtcgcgggccgcggcgatcgggtcggggttgccgttggggccctcggggttgacgtagatgaggcccatctggacggcgccgagcgggttctccagctcgcggtcgccggtgtagcgctcgtcgccgagccaggtggtctcaggaccccagtagacgtcctcctcggcctcccagacgtcctcgcggccgccggcgtagccgaaggtcgtgaagcccatggtctccagggcgacgtttccggcgaggatcagcaggtcggcccaggacaggttgcggccgtacttcttcttgaccggccacagcaggcggcgggccttgtccaggttggcgttgtccggccagctgttgaggggcgcgaagcgctgctggcccgcgccggcgccgccgcggccgtcgctgatgcggtaggtgcccgcgctgtgccaggccatccggacgacgagcgggccgtagtgcccgaagtcggcgggccaccagtcctgcgaggtggtcagcacctcggcgatgtcccgcttgacggccggcaggtcgaggctgttgaacgcctcggcgtagtcgaagtcctcaccgaacgggttggcgacggcggggttcttggcgaggatcttcaggttcagccgctcaggccaccactggcggttcccgccgccctgcgtcggatgcggtgcgcgtccgtgcgcgaccgggcagccgccgcccgcatcctccgtcttcggatcggtgacgatggcctcgtggttctcggacatgggaatccttccggactgggcggatcacggtgctcacgtgctgtgcgcggtggaacaggcggggcacaggccccagtagacgacctcggcctcgtcgatggagaagccgtgggcggcggacggggtcaggcagggtgcctggccggtcgcgcagtccacgtcggcgacggcaccgcacgaccggcacacgacgtggtggtggttgtccccgacccggccctcgtaccgggccggactgccggccggttcgatacggcgtacgagtcctgcctcggtcagggcgtgcagggcctcgtacacggcctgcacggagacgtggcccacgcgtgcgcgcaccccggaggcgaggtccgccacgtcgagatggtcacccgcgcggacggtctccaggagagcgacacgggcggccgtcacacgcaggcccgcggcgcgcagttcctcggcggtcgtcgggtgccgggctgccgtcatggcgccgaacctaccgccgcaaacacgaatggttcaagaaaacgaagggtcaaagtctggtgtgattcgcacggacggccctcagacgggaccccgggcggccctcagcgggaaggaggaggcgtcccggccgtggccggcaccctgggcaggggcaccggccacggccgggacggctcagcggctcagccgccgagcgccgccaggacgacctgctgggcctcgtcctggacctggcggaggtggtcggcgccgcggaaggactccgcgtagaccttgtagacgtcctcggttccggaggggcgggccgcgaaccaggcgttctcggtggtcaccttgatgccgccgatggaggcgccgttgccgggtgcctcggtgagcacggcggtgacccgctcaccggcgagggtgtccgcggtgacctgggccggggacagcttggcgaggcgggccttctcctcgcgggaggccggtgcgtcgatacgggcgtaggcgggctcgccgaagcgctcggtgagggcggtgtagtgctgggagggcgtcttcccggtgacggccgtgatctcggaggcgagcagggccaggatgatgccgtccttgtcggtggtccacaccgagccgtcccggcgcaggaaggacgccccggcggactcctcgccgccgaagccgagcgagccgtcgaccagtccgtccacgaaccacttgaagccgaccggcacttcgacgaggcgccggccgaggtcggcggcgacccggtcgatcatgccggaggacaccagggtcttgcccacgcccgccccggccggccactcggtgcggtgggcgtagaggtaggagatggcggtggcgaggtagtggttggggttcatcagcccggcgtccggggtgacgatgccgtgccggtcggcgtcggcgtcgttgccggtggcgatctggaaccggtcgcgctgctcgatcagcgaggccatggcgtacggcgaggagcagtccatgcggatcttgccgtcccagtccagcgtcatgaagcgccaggtcgggtcggtgagcgggttgaccacggtcaggtccagccggtgctgttcggcgatgcggccccagtaggccaccgacgcgccgcccagcgggtcggcgccgatgcgcacgcccgcgccgcggatcgcgtcgaggtcgaggacgctcggcagatcgccggtgtaggcgccgaggaagtcgtagcggccggtggtccgggcggcgagcgcgcgggtgtacgggatgcgccgtacgtccttcaggccggcggtgatgatctcgttggcccggtcctggatccaggaggtggcctcggagccggccggtccgccgctcggcgggttgtacttgaagccgccgtccgcgggcgggttgtgcgagggggtgacgacgacgccgtcggcgaggccggaggtccgcccgcggttgtgcgtgaggatggcgtgcgagaccgcgggggtgggcgtgtagccgtcggccgtgtcgatgaggacggtgacgccgttggccgcgaacacctccagcgcggtgacccgggcgggctcggacagggcgtgggtgtccgcgccgaggaagagcgggccgtcggtgccctgtccggcgcggtactcgcagatggcctggctggtggcggcgatgtggtcctcgttgaacgccgtcgccagggacgagccgcggtgcccggacgtcccgaacgccacgcgctgcccgggttcggccggatcggggtgcagcgtgtagtacgcggtcaccagccgggccacgtcgatcagctcgtccggacgggccggctcgcccgctcgttcctggcgcatgacacccactcctcgtgttcggtcctgtgtccgctcgcgatcaccatcttcccccgcccgcgaacgggaggcgcccccgcgtccccggggcaccgccccgggtcgcgcaccccggtgcgcctccccggccgtccggccgctcccggccggccccggttcaccgtccgggcacgctgtccgacagcgcggcgccgcccagttgctcgaaccgctgctggacgttggcggcgaaggcctgcgactcggcaccgccgtaggcctgcccggtggtgttcatcgccaccgtgaggacacccttgaagggcgcgctgggcgaggtgcggatcggcgtgcacaggaagtcgaagtcctgcggggtcgcggagtcgtacgtccgcagcgaggcccggggcaccgtggtgggccgtccggtgcgcagcgcgtcgtccatcgcggcgaagacgccgatccggtccaggccgggcagcacgttccggccgaggctgaactgggggaccatgccgaaggcctggccctgcctgccgttggcgtagcgcagcaggtggtcggggccctcggtgagcatgatcgggaagggtgcgccgtcgaagaccgcgaacagttcctgctgctgggcgaggaggctgtcgcgcagcttgaactcggacagcagggtctcggacaactcctgcatgcccagcttgagctgccggtcccaggcgcgcggtttgaagtcggcgacgcacacggtgccgaggatcacgcccgtgttgtcgcgcagcggcgtgcccaggtaggagcgcacaccgaggtcgttgacgagctcgttgcccttgaaacgggggtagtcgaagacgtcgtcgagggcgagctgggactgctgggcgaccacgtgcgggcagaagccgtagtcgccgggcgcctcgcgggcgaggttgctgaggtcgaaggggatgccgccgcccgagacgtccacggggtcctcgggggtgccgccgggcacgtacatgccgcggaacatctggcgttcgtcgttgatgaagttgaccatggccaggggggactgggtgaacgtggccgcgagccgcgcgatgcggtcgaacgtggcctccgcctcgaccgtgttgaggccgagaatcctcagccggttcgtccgctgctcgcctgcggcacggtgctgttcgggtgacagggattccatggggtcagatcaaagcagagatccggccgccgcggatcacctctccaggtcattccggtttcagctgcctcatcgtcaacacctcgttcgatgggggcacttgccgactccgccggtccggtggcgctgcctccgcggggccgcgcacggcttccggtggtccgtcggcggctgccaggtggccatccggagagtctgtccaaacttttcaatgtttcaacatcaagcgatcacttcccgtcattcttggagcgcacatcgttccgaaacgatttcgcacctgacaatcatccgatggacgtgactgccgctcctgatccgtccggtccggcgcgacaccagatgatcgaatactcgttcgaaattgggaaggtgaggcgggtgcgcggtccccggtccgtgccggaggcacgggaacgtcgagaccgccggcccctcttcccccggcacgtcttaccccacgatccgcgccgtctgccgtgaccggacggtccctgcgaggcggccgcccgcccgcctgaaaccggcgccgcctcccccacggccgcgccggcgggccgcggaagccgggaattccccgcgccggccgccggccgcccccgagccgtcccgcccccggacggcaccggatcgccgcggacatgtgacacaggcgcgggacaagtgcgtggggcatgttgcgatggggcaaggtcgacttcgccaaggcgtagggaccgtgcgacgt

SEQ ID NO: 561 - DNA, 12230 bp, Unknown
  Kingdom: Bacteria, Phylum: Actinobacteria, Class: Actinobacteria, Order: Streptomycetales, Family: Streptomycetaceae, Genus: Streptomyces
ggctgtgcggcgggcggcgcggcgatcaaccgtgcgcacgacttctgcacggcctacccggaggccaacgcgctcatcgtggcctgcgagttctgctcgctgtgctaccagcccaccgacctcggcgtcggctcgctgctgtccaacggcctgttcggcgacggcatcgccgccgccgtggtccgcggcaccggcggcaccggcgtccgcctggcgcgcaacggctcgtacctgatccccaagaccgaggactggatcgcgtacgccgtccgggagaccggcttccacttcctgctggacaagcgggtgcccgccaccatggagccgctcgccccggcgctgcaggacctggcgggcctgcacggctgggacgcctcggacctcgacttctacgtcatccacgcgggcggtccgcgcatcctcgacgacctcagcaagttcctgaaggtcgacccgcacgcgttccggttcagccggtccacgctcaccgagtacggcaacatcgcgagcgccgtggtcctggacgcgctgcgcaggctgtgcgacgagggcggcgtggaggacggcgcgcgcgggctgctcgccgggttcgggccgggcatcaccgcggagatgtccctgggcaactggcagatcggggacggggcatgaccgaggagacgctcatcccgcccgaccgggccggtgaggaactgtgcccggtgcggcactggcccgccctcgacctgaccggggtcgacttcgacccggtgctggccgacctgatggaggagggcccggtcacccggatcgagctgcccaacggcgagggctgggcctggctggtgacccgcatggacgacgtccggctggtcgccaacgacgcccggttcagccgggaggccgtgatggaccggcaggtcaccaggctggccccgcacttcatcccgtcccgtggcgcggtcggcttcctggacccgcccgaccacaaccggctgcgccgttcggtcgcgcccgcgttcacggcacgcggggtggaccgggtacgggacagtgctcggcggatgctggacgaactggtcgacgagctcctcgccgccggggcgcccgccgatctcaccagtgcggtgctcagcccgttcccgatcgcggtgatctgcgaactgatgggcgtcccggcggcggaccggcacggcatgcacacgtggacccagctgatcctgtcctcctcgcacggcgccgatgtcagcgagcaggccaaggaggagatgggcgcgtacttcacggagctgatcgacgcgcgcacggacagcggtggagaggacgtcgcctcgctgctcggcgccgccgtggggcgccgggagatcaccgtggaggaggccgtgggactggcggtgctcctgcagatcggcggcgaggcggtcacgaacaacagtgggcagatgttctacctgctgctgacccggccggagctggccgaccggctgcgcgcggacgcctcgatccgtccgcaggccatcgacgaactgctgcgctacatcccgcaccgcaacgcggtcgggctgtcccggatcgccctggaggacgtggagatcaagggggtgcggatccgggcgggagacgcgatctacgtctcctacctggccgccaaccgcgacccggacgtcttcacggctccggagagcatcgacttcacgcgcagccccaacccgcatgtggcgttcggtttcgggccgcactactgtcccggcggccagctggccaggatggagtccgaactgctggtggacgccctcctcgaccggctgccggcgctgcggctggcggtgccgccggaccaggtgccgttccggaagggcgcgttgatccgcgggcccgaggccctgcccgtggcgtggtgagcgccgatgacgacgatcgagccgccgcttcccgcactcgaggatccccggctcaccggtcccggactcgccgcggtggacggcctgctcgtgccgccgggccacggccgggtggtcgagacggccgcccagcgcgtgacgttcaaggtgaccggttcgcactcgcggacggcctccaccttcgaggtggaggtcccgccgggcttcgacgtgggagcccatgtgcacacgcgcagcgaggagttgttctacgtgctcgaaggcgagctggacgtgctcgccttcgagccgcggatccggacgcccgaccgctggcagaagtgggagtccccgtccggcaaccgtgtggtgcgggcgaccccgggcacggtcatcgtcgtgcccccgggctgcccgcacgccttcgccaaccccacggacaacccggcgaagatgttcttccaggcgtccccgccaccggaccacgagcggtacttcgaggaactgctggagatcctcggcaacggcggcccaccggaccacgcggcgatcgaggccctgagacgccgctacgacatcgagcagctgacgcctctgaggcatcgctgagccccggcaccgagtgccccgcccgcgcatgacgggcggggcacgggcgctgcgggcggttcagcgttcggcgagcttggccaccttggcggtcagggcgtccacggcctttttgaggtccgcctggttcttgcccagcgcctcggtcaggccctggacggccgcggccagttccaggttgctcttggccacggcgaggtcgatcatgcgttcggcctcggcgatcgccgtgggatgggcgccgagtgcgttgcgtccggacacctgctggtgcttgctttccgcgtccttcagctgctgctgtgcggtcgtcgccacgaatcccccctggctgccggtgacgtctgcgccatcacggtagcccggcggtcatgggcggaccagggggcgtggcggcggccggcgggggcgcctagcggatcggcaggcccgagatcgtgcgggagatgaccagtcgctggatctcgctggtgccttcgaagatggtgtagatcgccgcatccctgtgcatccgctccaccgggtactcgcgggtgtagccgttgccgcccaggatctggatcgcctgggcggtgaccttcttcgcggtctcgctggcgaacagcttggacatcgagccctcggcggcggtgaacggcttgccgttgatcgccatccaggacgcgcgccacaccatcaggcgggccgcgtcgatggacgtggccatgtcggcgagctggaaggccacgccctggttgtcgatgatcggccggccgaactgctcgcgggtcctggcgtagtcgagggcgacctcgtaggcggcgcgggcggtgccgaccgccatggcgccgacggcgggccgggaggcctcgaaggtggccatcgccgcgttcttgacgcgctcgccgcccttcttggcccgctcgcgagcgcgggcgaggcgctcgtccagcttctccttgccgccgagcaggcaggaaccgggcacgcggacgtcgtcgaggatgacctcggcggtgtgcgaggcgcggatgccgtgcttcttgaacttctgtccctgggagcagcccggggtgcccggcgggatgatgaaggaggcgtgccccttggaacccagctccggatcgacggaggcgacgacgacatggacattggcgatgccgccgttcgtcgcccaggtcttggtgccgttgatgacccactcgtccttggcctcgtcgtagaccgcgcgggtgcgcatcgaggcgacgtcggagccggcgtcgggctcggaggagcagaaggcggcgaccttgacgtcggtggcgtcgccgtacatctgcgggatccaggtgccgatctgctcctcggtgccgttggcgaggacgccgaccgcggccagtccggtgccgacgatggacagggcgatgcccgcgtcgccccagaacagctcctccatggccatcgggatgccgaggccggtcgcgtcgaagtactgctgggcgtagaagtcgagggagtagatgccgaccttggcggcctcctggatgaccggccagggagtctcctcacgctcgtcccattcggcggccgcggggcggatcacgtcggcggcgaacccgtgcagccagtcccggacctccttctgttcgtcgttgagctccatggtgaactcggccatgtcccctccagcggtacccatatggtgttacttgcggtaaccgtactgtgttaccgaccagtaggagaagtcaagtcccgctcttcccgccgcggtgccccggcagcccgttcgaggtccggggcccggtcagtgttagtttgcgcaggcgtcaccgaatcagcacgggtggggagagatcatggacaccacgcagcggaccgatcagcagcggtccgccgaccgcagacggcgcgagctgctggaggccgccgaccgggtggtgctgcgcgacggcccgcacgcctcgatgaacgccatcgccgccgaggccggcatcaccaagccgatcctctaccgccacttcggcgacaagggcggtctgtacgccgccctcgccaagcggcacaccgacgccctgctcgactcgctgcgggccgcgctcgacgcgccggccgagcggcgcgagcgggtcgaggcgacgctggacacctacctcgccgccatcgaggccaggccgcaggtgtaccggttcctgatgcacccggccgagggcggccagggcggcgaggcgggcttcgatgtcggcaagcactccgcaccgctgctgcgccgcatgggcgaggagctggcccaggtcatcgaggagcgcctcgacctcggaccgggcggccagcagctggcccgggtctggggccacggcatcgtcggcatgatgcacgcggccggcgactggtggctgggcgagcgcccctgctcccgcgcggaactggtgcgcagcctcgccgacctgctgtggggccggctcgcggcggccggcgacaaggcgggcggccccggcttctagacccctggcccccaggcttccaggccctgacctccgggtcccggcttccgggccccggctctaggaccgggcgccctgggattcccgcccccagggcgccctggccgcctgccggaacaccctgcgccggcgccagccagtgagatgatccacatacaggcggccgtccagatggtcgcactcgtgctgcaggcaccgggcgaagaaccccgtcccctcgaccgttaccggctcccccgtcactgtgagacccgccacgaccgcgcggtcgtgccgctcggtgcccgcctcgagtcccggcagcgacagacacccttccgggccgcgcagtaccacaccgtcggccgccaccaggcgtgggttcaccacatgccccagatgccgtacgtcctcgtcgtccgggcagtcgtagacgaacacccgcagtgcctcgcccacctggttcgcggccagtcccacgccccgcgccgcgtacatcgtggcgaacaagtcctccacgagcgcggccagttcgggaccgaagtcggtgacctcccggcagggcgcacgcagcgcctcgtcgccgagcagggtgaggggccgtacgcgcccgcgggcgcccgggatcgagccgtgtcgcatggcggcaagggtacggtcctcctgcacgcgcgaacggcgcgcgggcgccgcggggtgccgggattcgggagcacgatcggatctcgataggctgaggcccacaccacgttgccggatggctcaggcgcggcgcgtacgcaaggaggatcgagaactgatggcaggcaactcggacccgctcacgccgcgggccaagctggccgtgaccgcgggcaaggcggtcgcggcggcatcgcgcgccgcggggcgcggcagcggttcggtgatcggcggccgggtggcgctcaaactcgaccccgacctgctggcccggctcgcccagaacctggacgtcgtcctggtgtcggcgaccaacggcaagaccaccaccacccggctcatcgccgaggcgctgcgcgccgcgggcccggtggtctccaacgcgctcggcgccaacatgcccgcgggcatcacctcggcgctggcgggcggctcggacgcgaagttcggcgtcatcgaggtcgacgagaagtacctcgcgggcgtggcccgggacaccgaccccaagtgcatcgcgctgctcaacctctcccgcgaccagctcgaccgggccgccgagacgcggatgctcgccgagcactggcgcgaggggctcgccggttccaaggccgtggtcgtcgccaactgcgacgacccgctggtggtgtgggccgcgtcgtcctcgcccaacgtgatctgggtggccgccggccagatgtggaaggacgacgcctggtcgtgcccgtcctgcggcggtgtgatgcagcgtccgggcgacgactggttctgcgccgagtgcggtttccgccgccccacgccgagctgggccctgtccggcgaccacgtcctcgacccgcacggctcggcctggccgatccacctccagctgccgggccgcgccaacaaggccaacgccgcctcctccgcggccgtcgccgccgtcttcggcgtgccgccgcaggtcgcactggagcggatgtaccaggtgcaggcggtcgccggacgctacgacgtcgtccagttccagggccgtgacctgcgcctgctgctggcgaagaacccggccggctggctggagacgttctccctgatcgacccgccgcccgccccggtcatcctctcggtgaacgcgcgcggcgccgacggcaccgacacctcctggctgtgggacgtcgactacacccggctcaccggccacccgctgctggtgctcggcgaccggaagctggacctcgcggtgcgcctggaggtggccaaccagcacttccaggtctgcgagaacctcgaccaggccgtgcagcaggccccgcccggccggatcgaggtcatcgccaactacaccgcgttccaggacctgcgccgccgcgtcggcaactgatcacggaggacgaccacttcatgagcgacaaccaactgcggctggtgtggatctacccggacctgctgagcacctacggcgaccagggcaacgcgctcgtcgtggagcgccgggcccgccagcgcggcctggacgtggcgcgtctggacgtgcgcagcgaccagccgatcccgacctccggcgacatctacctgatcggcggcggcgaggaccgtccgcagcggctcgcggcggagcggctgcgccgtgacgggcacctgtaccaggcggtgcagaacggcgcgatcgtcttctcggtctgcgccggctaccagatcctcggccacgagttcgtcaacgacctcggccagcgcgagccgggcctcggcctgctggacgtggtgtcggtgcgcggcgagggcgagcggtgcgtcggcgacgtgctcggcgacatcgacccgcggctcgggctgccgccgctgaccggtttcgagaaccaccagggcgtcacccacctcggcccgaccgcccgccccttcgcccaggtccgcgtcggccggggcaacggcacgggcgacggcaccgagggcgcgtacaacgacaccgtcttcggcacctacatgcacgggccggtcctggcccgtaacccgcagatcgcggacctgctgctgaagctggcgctcgacgtgaacgcgctgccgccgatcgacgaccgctggtacgaggccctgcgcaccgagcgcatcgcggcggcggagcagcccgcctgacggcacaccgccgcgcagccgtccggaacgcgccagggggaccgcccccgggcgcgttccgcgcgttcaagcccgcgccgcctgtactccagcccctcgcaagctctccgcaaggcggctgcgggacgctcgtcaccgggcccgcctgacgacgccgccgctcacctgtgcacccgcgtccaccagccggacggcccgtacggcaccaccccctgtcgccggtagggtggccgggatcgagccggacagcgcggtccggtcccggcccacgtggagaaggttattcgggctatgcgcattggtgtcctcacgtccggcggcgactgtcccggcctgaacgccgtcatccggtccgtcgtgcaccgcgccgtcgccgaccacggcgacgaggtcatcggcttccgggacggctggaagggcctcctggagtgcgactacctcaagctcgacctcgacgccgtgggcggcatcctggcccggggcggcaccatcctcggctcctcccgggtccggcccgagcacctgcgcgacggggtggagcgggcccggggccacgtcgaggagctggggctcgacgcgatcatcccgatcggcggcgagggcaccctgaaggcggcccggctgctctccgacaacggcctgcccatcgtcggcgtgcccaagaccatcgacaacgacatcgcggtcaccgacgtcaccttcggcttcgacaccgccgtgaccgtcgccaccgaggccctggaccggctgaagaccaccgccgagtcccaccagcgggtgctgatcgtggaggtcatgggccgccacaccggctggatcgcgctgcagtccggcatggcggccggcgcccacgccgtggtcgtgcccgaacggcccttcgacatcgaggagctgacgaagaaggtcggcgagcggttcgaggcgggcaagcggttcgcgatcgtcgtcgccgccgagggcgccaagccgctgcccggcacgatggacttcgacgagggcggcaaggacatctacggccacgagcggttcgccggcatcgcccggcagctctccgtggaactggaggagcgcctgggcaaggaggcccggccggtcatcctcgggcacgtccagcgcggcggcacaccgacggcctacgaccgggtgctggccacgcggttcggctggcacgcggtggaggccgtgcaccgcggcgagttcggccggatgacggcgctgcgcggcacggacatcgtgatggtgtcgctggccgaggccgtggagaccctgaagacggtgccctccgaccggtacgccgaggcggagtgcgtgctgtagaacacgtcccggcgtcagccgcccccggtcgcgggcgcggccgggggcggttctagtctgggtgcggacagacagctggggacagagggtcacggacacccccagctgtggtcggacagtgcgcacccccacgaatcaggagccggcggatggatcacagcgggcacggcatgaccatggatctgccgccgttcacgctgggacgcggcctggaatggtccgcggacccgttcttcctcgtcgcctgcctcctcggtctcggcctctacgggtggggtgtggtgcggctgcggcggcgcggcgactcctggccggtgggccgtacgatcgcgtacgtcgtcggggtgctgaccgtggcgctgatgatgtgcaccaagctgaacgactacggcatggtcatgttcagcgtgcacatggtccagcacatggtcatcagcatgctgtcgccgatcctgatcctgctcggcgcgccgatcacgctggcgctgcgcgcgctgccggtggcagcggtgaggggccgcaagggtccgcgcgagctgctgctcgccctcctgcacagccgttacgtccggatcatcacgcatccggcgttcaccatcccgctgttcgtcgccagcctgtacgcgctgtacttcacgccgatcttcgacttcctgatggggtccagggcggggcacatcgcgatgatggtgcacttcctggcggtcggtgtggcgttcttctggccgatcatgggcatcgacccgggtccgcaccggccgggctatctgatgcggatgctggagctgttcgcgggcatgcccttccacgccttcttcggcatcgcgctgatgatggggtcgacgcccatggtgggcaccttccggaatccgcccgcctcgctcggcatcgacgcgttgtccgaccagacggcggcgggcggcatcgcgtgggcgttcagcgaggtgccctcggtgctggtgctgctcgcgctgctgttccagtggtaccgctccgaacagcggcaggccaagcgcaaggaccgggccgcggagcgcgacggcgaccaggagctggccgcgtacaacgcctatctggcctcgctcaacacccgcggcaactgaccgctctcccggccgcgtcctgttcctccctctctccggtccctctcctgtcctctcctgccccgcgtcctttccgccctttgtgcgcactgccgcctcccgaggcgcggaaccggggcaccatggggggaggacggaccaggaggagggtgccgatgcccggctcgacggacggttccacgagagcgatgggggtgctcaccgtcggcgccctggtcgcggtgacggcgtacacggtggcgctcggcggcaacggctggctgtggttcggctgggtcgtgctgggcctggtcaccctgggcatggtcgtctcccacggcacctgagccccgcccccgccgtgccgctcactccccggtgaggctgcccagccgtcccgaggagtgcacgcccggctggtacttgggcagccggacggtgatcttcatgcccgcgcccggcgcggtctcgacgaccaggccgtggtcgtcgccgtagacctggcgcagccggtcgtcgacgttggacagtccgatgccgccggaggggctgtcctccccggcgaggatgcggcgcagcaggcccgggtccatgccggcgccgtcgtcctcgatgacgaccagggcctcggcgccggcgtcctgggcggtgatgcggatgcggcaggtgccggccttgccctccaggccgtgcttgacggcgttctccacgagcggttgcaggcacaggaagggcagggcgacgggcagcgcctccggggcgatctgcagggtgacggcgaggcggtcgccgaagcgggcccgtaccagcgcgaggtagtgctcgatggcgtggagttcgtcggcgagcgtggtgaagtcgccgtgccggcggaacgagtagcgggtgaagtcggcgaactccagcagcagctcgcgggcgcgctcggggtcggtgcggacgaacgaggcgatcaccgcgagcgagttgaagacgaagtgcggggagatctgggcgcgcagggccttgatctcggcctcgacgatccgggtgcgggagcggtcgagttcggccagttcgagctggacggagacgaaacgggcgacctcggcggcggcgcggaccaggacggcggactcgcggggcgcgcaggccaccagggcgccgtgcacccggtcgtccacggtgagcggggcgacgaccgcccagcgcaccgggcagtcgggtgcctggcaggtgagcgggaacgcctcgccccggccggtgtccagggcgccggtgaggcggtccatgatctcgtcacggtggtgggctccggtcccgtcccaggccaggacccggctgtcgtcggtgaggcagagcgcgtcggtgccgagcagtgagcgcagccggcgggccgccttgcgggcggtctcctcggtgaggccggcccgcagcgggggcgcggcgtgggaggcggtgtgcagggtctggaaggtggcgtgctcgacgggtgtgccgaggtcgccgaggtgccgtgggcgggcggtgcgccggcccagccagaacccggcggccagcagcggcagcacggcgacgcacagtccggcgaggaatccgctcacgccctcacctccgcgtccggctgctcgggcaggtggaagcgggccaggacggccgccgtaccggccggcaggcggcccggcgtggccagggacaccagcaccatggtgaggaagcccagcggaaccgaccacagggcgggccaggcgagcagcgcgtgcagcggtccggtgtccgggaaacccgccatcgtcacggcgacggcgaccagcgcggccccgccgccggccagcatgccggccgccgcgccgggcggggtgagccgccgccaccagatgccgaggacgagcagcggacagaaggaggaggcggacacggcgaaggcgaggccgacggcgtcggcgacgggcagtccgccggccaggacgctcacggccagcggcacggccatggcgagcaccgtgccgagccggaagtgccgcacgccgcgggcggcgccttcgccgcgttcctgtccaccgcgtcgggactgaccatggcggtggccggggtgctcacccaggacgtgctgccctcgcgcggcccgctgcccgcccgcggcgtgcggcact

SEQ ID NO: 562 - DNA, 3365 bp, Unknown
  Kingdom: Bacteria, Phylum: Actinobacteria, Class: Actinobacteria, Order: Streptomycetales, Family: Streptomycetaceae, Genus: Streptomyces
gaccgtcagggcgcgggccgtgcccgccgacccggccgtggtccgcgtgcaggtcaccaaccacggacggacgtgcaccctcgaccgcgtccccacggtcaccttcggggacctggacggcagcgcgcagcccgttccgccgggtgagagcggcccgtaccggctgggcgccggccggaccgggtacgcggcggtgcgcaccgtggcccacccggcggaccccgaggtccgcagggtgggcacgctgaccgtcgccgcggacccgtcgggaccggggcgcaccttcaccgcggccgagctgggggcgggcggctcgatccgggtgtgggagccggtgacgacgtggtggcagccgtcggccgccgccgcggaccgggccatcgggctcagccggtgacgatctccggcttgtagaggtcgagccacgcggccaggtcgagggtcttctccaggccgcgccgcgccgcctgcgtgctgacgggggtgtcgcggtgcgcggcttggcgcacccgttccctgtccaccagttcgaacaccgggtggccgggccgggcgaggaggtccttgacgtggttctgcagggcggtcgcgtacgcggggtcctgggtggacgggtagggactcttgaccctgtcgtagacggacttgggcagcaggtccgcggtggcctcccgcagcaggctcttctcccgtccgtcgaacgacttcagggaccagggcgtgttgtagacgtactccacgagccggtggtcgcagaacggcacgcggacctccaggccgaccgccatgctcatccggtccttgcggtcgagcaggacgcggacgaagcgggtcaggtgcaggaagcagatccgccgcatccggtactcgaagtcgctctcgccgtccaggcgctggatgtcgcggacggcggtgcggtagccgtcggcgacgtacgcgggcaggtccagggcgcgggcgaggtccgggcgcatgacgtcgccgtcgtcgccgaagtcgcggtggaagcggaccagccaggggaaggtgtcggcgcggcgggcctcctcgtcgaagaactggaggtagccgccgaacacctcgtccgcggactcgccggacagggcgacggtcgagtggtcgcggatgctgcggaacagcaggtacagcgaggcgtccatgtcgccgaagcccatgggcaggtcacgggccctcagcacccgcgcccgcacctccgggtcggccagggactgcgcgtcgagcacgatgtcctggtggtcggtgtcggcggcacgggccacgtcgtgcacgaacggcgtgtcgggggtggcgcgcagttcgtcggcgacgaaccggtcggcctggcccacgaagtcgacggcgaagctgcgcaccttctcgccgacctcggcgagttggcgggcggccagcgcggtcatcgcggaggagtcgaggccgccggagagcagggtgcagcggggcacgtcggcgacgagctggcggcgcacgatgtcgtcgaggagggtgcgcacggcggcgacggtggtgtcctggtcgtcggtgtgcggccgggtctccagctgccagtacacgcgggtgcgcaggccgccgcggtcgacggtgacgaccgtgccgggctggacctcgtgcatgccgtcccacaccgcgtgcccgggggtcttgatgaacgtgaacagttcgcgcaggccgtcgagggtcacccgggggcgtaccagcgggttggcgaggatcgccttgggttcggagccgaagaggactccgtcgggcgtcgggtggtagtagaacggcttgatgcccatgcggtcgcggatcatgacgagcttgtcgtggcggccgtcccagatcgcgaaggcgtacatgccgttgagccgctcggcgacggcgtcgccccattcgaggtagccgcgcagcacgacctcggtgtcggagtcggtggtgaagcggtggccgcgcgcggtgaggtcggtgcgcagttcggtgaagttgtaggcctcgcccgagtagaccagggcgacggtgccgtccggggtggtcacgctcatgggctggcggccgccgggcaggtcgatgatcgcgagccgccggtgtccgagcgccgcggggccctcggcccacgtcccccggtcgtcggggccgcggcaggccatcgtctccgtcatcgcgtccagcgtcgcggcctcggaacgcaggtcgcggtcgaaggagacccagccggtgatgccgcacatgtactacctccagcgaaccagttgtatccagcacctatatgacgagcgtgtttcaccggcccggggccgtcaacgcggccgtgccgcgcacggccgtgcgacccccgcgctttcggccgcattttgcctccgggagatccgccgctccgccgccgaccgccgccgaccggcggcgggccgcggtggtccgccccgatccggccaccggcaaagacttgccaagacttgcccgccgacaggcgcctcttcgggccgtcgggcggacttgccaaggcttgtccgtcggcagacgcctcttcgggccgtccgccggcaagcgagttcccgcagcaacgagttaccccgcccagggcagccgattactccaaatgcccgatatgtgaatccgccctatggtgctgtcatggagcacgatctgagtcccgcgaccctcgccgagctgcggcgcccgcgcagctaccccgcggtgtccgtgctgacgccgacgcaccgcagggagcccgacaacgcacaggaccgggtccggctgcgcaatgccgtggccgaggccaagaagcagctggagaccgatccggcggtcacccgggaacgccgggccgaagtcgaacgccagctcgaccaggcgctggcggaggtggatctcacctacgccgaggacgggctgctgatcttcgccgcgccgggcgagcaccaggtgtggtcgctcggccgcagcgtgccggagcgggtggtgctctcggacaccttcctcacccgcaacctggtctccgcgaacgcggccgagcgcccgttctgggtgctgtcggtctccgccgaccgcatgaccctgtggagcggcggcgggggccggatcgccgaggaccgcaccggcggcttcccccgcacccgggacctcgacgagaacttcgacgccgaacggcaggagcgcatcggtgacgcgccgagcaccttccgcgacgagcgcacccgccagttcctgcgggagaccgacaccgcgatgagcgcggtgctgcgcgaacacccgcgcccgctgtacgtcaccggcgagccgggcgcgctggccgtcctcgacgagtgcggcggtgtcgcccgcgacgcggtgcacgtcccgcacggcggtctggcgcacggtacgtc

SEQ ID NO: 563 - DNA, 6794 bp, Unknown
  Kingdom: Bacteria, Phylum: Actinobacteria, Class: Actinobacteria, Order: Streptomycetales, Family: Streptomycetaceae, Genus: Streptomyces
cgcgcaggaactgggcccggcgccgacgacgctcggtgtcggcgtcggtgtcggggctggtgctggtggtcgtgtcgggggtgggggcgagaccggtgccgctgctgacgccggctcctgggttcggccggccggcgtcccggccggtgccggtgcgtcgggtgccggtgcgtcgggtgtcacccggctcccggccgttcccgcgagccgtggccgtggtggccctcgtggtcaccgcggcagccgtgggctccgcgtcgtccgccgtcccgggccgctcacccggtgacggctgcttgtgggatcgccgctcaggcatcggtccaccaccccagtccgtccctcccactttcccccggacggccggtttgatgccacagcggtgcgggacgcggcgggtgcggcggcggccggcgggaggacggtggcgggcgggcgggcgctctcggcgcccggttactgttggcacatgcgtctccacgtcgtcgaccaccccttggtcgcccacaagctcaccacgctgcgcgaccggcgcaccgactccgcgaccttccgccggctcgccgacgagctggtcaccctgctcgcctacgaggcgacccgggacgtgcggaccgagcaggtcgacatctccacgccggtcgcacagaccaccggcgtcaagctcgcccgcccgcgcccgctggtggtgccgatcctgcgcgccgggctcggcatgctggacggcatggtgcggctgctgccgaccgccgaggtgggcttcctgggcatgatccgcaacgaggagacgctgcaggcgtccacgtacgccacgcgcatgccggaggacctctccggccgtcaggtctacgtcctggacccgatgctcgccaccggcggcacgctggtcgcggcgatccaggagctgatcaagcgtggcgccgacgacgtgacggcggtggtgctgctggccgcccccgagggcgtcgcggtcatggaacgcgacctcgcgggcaccccggtgagggtcgtgacggcctcggtcgacgaacacctgaacgagcagggctacatcatcccgggcctgggcgacgcgggcgaccggatgtacggggcggcggagtagcggaacgccacggcgcgggccgcagcgcagggaggacggccgaccgcctgtcggcggccggccgctcgtctcagcagcccttctgcggggtgccggccgtcggcttcggcgcggccagggcggccagtgccttctgggcggccggctgcgacgccagctgcttgaaaccgtcgccgatgaccaggtcgacgtcggtgcccttgcgcgtgtcggtacggctctcggcccccgggagctgggtgcccaggacgggcagcgaggtgtcgagggccgacgcgggtccgagcagcagcccggcgcccttgaccttcttgtcgaactccttggtcgcgttgcccacgtgaccgatgcggaagccgcgcttcttcagctcgtcggcggtctgcttggccagtccgccgcgtggcgtggcgttcaggacgttgaccgtgatcgcgcccggcttgggcagcgtccgggccgtggcctcgggggagggaccggaccgggccgccgcaccggtcgcgcagtgcgtcttcgcgccggccgccgaggccttcgtgtcgccgccggtgaagacgtcgatgagctgcagcgtgccccagccgatcacaccgagcgcgacgacggaggcggcggccacgaacacgagcctgccgtgccgccggggccggcgcatccgcgggtacttgttccccgtgatccggtacttcccgcccatgccggggggagtcagcatgctcatgggcgcagcgtagtgcgccggggcggcgattcctactagatgatcattggatatcgcccagtagaacccgaaaggtccaaaccgttacccgtcaggccgcaccgaggcccggcccggcccgcccggagaccggactccagcaccgtcctgagtcctggctcggggccgccctgagtcctggctcagccgtccgtccggaggtccggctcggtcgcgcggaggtctgctcagcccagttcgagtacgcgtgcgtgcagcacctgacgctgctgcagcgccgcccgcaccgcgcggtgcaggccgtcctccaggtagaggtcgccctgccacttcacgacgtgcgcgaagaggtcgccgtagaaggtcgagtcctccgccaggagggtctccaggtcgagctgctgtttggtcgtcacgagctgatcgaggcggaccgggcgcggcgcgacgtccgcccactgccgggtgctctcccggccgtggtcggggtacggccggccgtttccgatgcgcttgaagatcacacggaaagcctaccggcccagagcttccgggcgcagcctcggcagcgcagtgcgacgctggaaaagccgcggcaaaccgggcgaatcgggaccaggggccgaacaggggcttgatgtgagcgacggcgagaccgcgcccgggactccgtggaacgacccggcgctcccgcccgaagcccagcgcatcgcctccgggtgcgttatgcacaggctgtggacagcgagtcggcgtacggggaactgacggcagctcaggcggctcaggcggctgaggcggcgggacggcgcaggtcgcccgggaaggagccgtcggggccgtcggagccatcgctcgtcgaacaggtcgtcagcaggggggcattcaagtctctggcccggtcggtgggtactcagctcggccgggagatcccccgctccctgttcggcacggcccgcaggaggcggtgagcggtacgccgagggggacgggcatcagacggtgcgcggcacctgccgggcgtggcggcggacgcggaaggcggtggcgatctccatcacgccgacgacgaccagccaccagccggccagcagggtgagcacggcgaccgacgccagcggcgagtcgatcaggacgatgccggcgatgaaggtgagaacgccgaggaagacctgccagccgcgggccggtgccgtccggtcgtggacggcggcgatcgtctgcgtgatcccgcggatcagccagccgatgccgatccagagggccagcagcaggatcgactgcatggccccgcggaaacagaacaggcccagcaggatcgacagggcgccgctggcgaaggccagcacgcgcaaggccgtcgacttgtgcgtgccgaaggcggagaccagctggagcaccccgctgaccacgaggtagacgccgaagaggatcccggcggccagcagcgaggcacccggccagaggaggacgaggatgcccaggacgagggcggccacgccggtggcgaggaccgcctgccaggcggctcgggagaggtagtgcagggggccttccagcggtggttcagcgcggataccctcgtagggcgcctgtgccgtctgggttccctgtgctccctgtgctccctgtcctgcctgtgttgtttgtggtccctgcgccatgcgtgtttcgtgtgggccctgcgggtctcgtgggtcgcgcatcgcgtggacgtgacggtcgtcgtagcccggcccgccggggccgctgctcggtggctcggtcatggttcatgcttggcccgcgctcgggccggtcgccaccgctgtaggccgtccgggcgacgggctcggccgcgcgccccgtcacttcccggcggacttcgccgccttcgccgcggccttcatctcctgcttgtgggcccgcaccttggccagcgactcggggccggtgatgtcggcgacggaccggaaggccttcgcctcgccgtacgccccggcggcctcccgccagcccgcgggacggacccccagctgcttgccgagcagcgcgaggaagatctgtgccttctgcttgccgaagccgggcagctcctccaggcggcgcagcagttccggtccgctgtccacgtcccgccacagagcctcgggatcgccgtcgtagtgctcgacgaggtactggcacagctgctggatcctcttggccatcgaacccgggtaccggtgcacggcgggcttgtccgacagcagccgggcgaaggtctccgggtcgaacgccacgatctcgtgcgcgtccaggtcctcggtgcccatgcggtgggcgatcgtcgccggtcccttgaacgcccactccatcgggatctgctggtccagcagcatcccgatcagcgcggccagcggactgcggctcaggagcgcgtcggcgtcggggtcctgggcgaggtgcagggtgacgttcatgtcctgatgatcgcctgccggaggacaggccgcacggctgtggccccggggacttcggaggaggcccgcgcgttctgcccctccggccgctccgcgtcgcagacgggaccgacggcgaaggcgggactcacggtgcaggcgggacctagggtgctggcaggaccgagggtgcaggcgggaccggccgcgccggaggcgacgccggggcgcgcatccacgccggctcctgcctcccaccgcgcccagcaccgctccgtcctcgccgaggccgcagtgggcgtggcggtgctggtgatcaccacggtcctgaccggaaccctccccggccgtgtcgtcgccgaagccgccagggagggttccggggccggtgtcccgggcgcggccgtcgtggtcgacccgttcgccgccggagccccgggcggtcgcggcagcgtgcagatcaccctggagccgggccgggtcggccagaacgcggtggaggccgtggtcctcggccccgacggcggcctgtcggccgtcccggacctacggctgtcgctctcgctgccgtagcagtacctcggcccgctcgacgcccggctcaccgacaggggcggttacagggggaccggctccctcaccgtcccgatcgccggcaactggaccgcgaaggtgacggtgcgggtttcggaactggaccaggcgagcgcgacgaggaccgtaccgatcaggaattaaccgtactgatccagaactagtcgtattgcgcgaccgtggttcggtgatcttaatattgggccacccgaggccttttgttccacttccgtaaccttgcatattccagggcgttatgcgggtgtcgcgcccaccgcgcccagggagagaaatcatgtggaatgtcaccctttggatgctggtcgtgtgtgcttctgcctgcaccgcggggtccattctcgtgccaccttatcaatgtcgcatgtggcgggtcgatgcggaggaattgcgccgccgtcggcgcatggacgccgttctgcaaagcaatacgcggccgatggaagatcgcccagccgtcgaggagccgtcgccggacgcccatctcgtcggctgaacgatgaagcatccgatcgcacaatataggtccgatcaggtaattccttcacccgtttgccgcgcatccggggaagtcggatggcgttagtcgggacatgactaaggcatcgagggaagggtacttgggtctgctcgtgggccgcgagcgcgaggacacgagtgccggacacgcggtggcgttgggtccctacacctacctacccgcacccgtgcacccgacggtcggcgccaacggcatcctgaccaggggtggtccgccggtcgcgctgaaggcgaccgagtcgctgctgcgggacttcctggacgcgatgagcgcgctcgaagccgacctggcccgccgatgggtcggttcggacggccgtcccgtcctcgcgcgacccgaataaccgggccgccgcatgtatgacgaacgtaccggccgacgcacaggatattccgctgattatccctacgcggaagcagcaggtttcgacgagccccgcccgcgtacgggtaccggtcggcaccgggccccgacccagttcttctcgggcaccctcgggcccctgatcccaccggactcggcgtgggacccggccgaggagctggccttcatgctccaggacgccatggagcggcagtcaccgcgcacgcctgtggaaggcgaatggacacaggccggcggccgactcgccgaaaaccaggtgacaccgacgggtcacccggcccccgcgggttatgcgggaccggcagattacgcggggcccgcagattacacagccgccccgggccaagcggcttccgcagattatgtcggcaccgccgactatgcggcctccagaagcaccggaagcaccggaagcaccgtaaacacccgaagcgccggaagcgccgggggcagcggaaatccggaaaccgcggcggaaccggaaaacgcggcgaacgaccccgtaccgccgaacacgccattggagaatctccaggaaatcacggcggaactccctcccctgcggcgtgtctcccgcggccaccggaaggtccgtccacgcaggcggaggagcggcgtgcgcaccgccagccacgtcatcggcgcactggcggcggtgaccgcctccacggtgagcttcttcggcggcatggtcgcctacgaccccctgcgcatcgtggccgtcgcccggatgcaggacggcatcgcctcctggtggccgctgctggtgtacgggccctggctcgtggcgtcgctgtccgtactgcgcgccgcactgcaccggcgccgagccgtccactcgtggtgcgtggtgctgctcttctcgtccatcgcgatgctcctgtgcgtggtccaggcgcccaagacgctcgtcgacatggcggccgccgccctgccggggctggcgtccctggcctgcttccagcagctcgtacgccagatcaccctgacccgcccgccccgccgcac

SEQ ID NO: 564 - DNA, 8006 bp, Unknown
  Kingdom: Bacteria, Phylum: Actinobacteria, Class: Actinobacteria, Order: Streptomycetales, Family: Streptomycetaceae, Genus: Streptomyces
ggtcgcggctgccgtccgggaggccaccgcgctcggagcggaagtacgcctcctcgcgtgcgacgtgggcgacccgcggcaggtccggcgcgccctcgacatcgtcgcggcggccttcggaccggtccaggggctgctgcatctcgccggggtcgcgggcaacgggatcctgcaggtccgcgacccggcgcaggccgccgaggtactgcgccccaaggtgcacgggacgctcgccctcgcggaagcgctcgcaggccggcccgtactcgactgggtcgtgctgttctcgagccgcgccgccgtcgacggcctcatcggcggcggggactacgccgcggcgaacgcggtcatggacctgtgcactcgtctcgacctgttccccgcgcacagggtactgagcatcaactacccgagctggaccaccatcggcatggccagccggcccgacggcgcgcccacggtgggcgaactgcactggacgaccacgctcggccccgaggacacctgggcgctcgacgagcaccggctcgacggcacacccgtcctgcccggaaccgcccatctggacctgatcacacgcgcctacgaccacaccgtccccgcggacggcggtcgcgcgctggtgctctccgacgtcgctttcgtcgcgcccctgaccgcgcgccgggcgaggcgcgtcaccgtcgtgttcgtccccgacggtgcccgccaccgcttcgaggtccggtcccagcccgaggacgacacgaccgcacggtgggtcacgcacgccaccggacggatcgaacgcctcagcgtcgaggcgcctgcccgcgatctcgcggcactgcgcgaggccacccgtgcgacgaccggatccgctgccggggccttcacgctcggcccgcgctggaactcggtccaggaagtccgcgacggtgcggacgacaggctcgtcgagctgcggctcccggcgccgttcaccgacgatctgcgcacacacccgctgcacccggcgctgctggacgttgcgacctccgcgctgcgcgggtgcccggggccgggacccgaggaccgcgccgatgaggcgtatctgcccttcctctaccgtgcgctcacggtcttcgcgccgctccaggtcgagatcaccggccacatccgcaagaaggagagccaccacggacaactcgtggcggacatcgacgtgatcggctccgacggccgcgtgctcgtcgccgtcgaaggcttcacgatgcgcaggacggaccggacggcgttcgacgccggactcgacgaccagagagccgacaccgaggaccacgtgggcatcgacccgtccgtcggaaccggcatgctgatgagtctgctctcctcccacacccccgatcaggtgcttgtccgcccgcaccggaacgggcagccggtgccggtggcggtgcctgcggcagtgcctgcgcctgcggcagtgccggtgccctctgccgcgcaccccgcttccgggcagccggctcgcgaatccactcgcgcggaaccttccctgccacggccgagagctgaatccggcaacgccccgaccgggcccgcggcaccgcccgccggcccgccggcggatacgccgggctcgacctcggaccgtcttcgcggcctgtggacgcgcaccctggggcacgaccggatcgaacccgacgacgacttcttcgacctggggggcgactcactgaccgcgatcgacctgatggcgcagatcagagaggtgttcgacatcgagttgtccgtcggattcctcttcgaggcccccaccttggccgaactcgccgaggtcatcgaccagcgggtgcggtgatgacggccgcaccgcacacctccgctgcccctgcccccgagtccgcggcgcagcccgcgcatcgcctcccgttgcacggcaactggtcgctgtggcggccggccgccctgcgcagcgcgggcatgccgttctcatggctcgaccagttcgcggtgcccggttgcgcggacgacgactccgacacccgcagccgggagacctccgcggccgcggtacgctccgtcgtcgcgcaacccgcgttcctcgaggccgtcacctggcagaatccggctctcatccggaactggatgggccggttcgccgccgatctcgccgcggacggggacgggcacctctcccgcagggaccaacgcgaagcgctcgtcgccttcctcgcacagcgctactgcgcgaagaacgagaccataggcttcttcggccccgtcgcctgggtacggttcagcgacgaccaccccggagtccgtacccgcggcactgccggcctgcgcagccgcacgctctttcgcgagcattgggccgtcgacgcgatcgcccgcgccttcgccgcgcggccggcactgcgcacccacctgatcgcgcgacgccacccggcgtgctccttcgacggcggagtactgcgccggccacgacgccgaccgcagcctctggacgccgacgaggccgccctggcagctctcctggaccggccgcgccgggtgggcgaactactgggcgcgtacggacctcccggaacggcaccggccgccgagcaggcgctggagcggctcgcggcgaccggggcagtcctgatcgggttgcccgtcccggtcaccgatcggcccgaggacgtgctgcgcgaactcctctcgccgatcccggacgagaagctgcgcggcgctctgctggccgaactcgaccgcctcgacgaagccgtcggcgccgtcgcggcctcggccggcgacccggtggccctgcgcgacgccctggacgggctggggacggagttccggtccctgaccggggtcggcgatcaacgcgccaaacccgatcgcgacctcggccggtgcatcgtgtacgaggactgccggcgggacaccgacgtcgacatcggcggtgacctgatcggcgatctccgtgccccgctcgcgctcctcctggacaccgcccgctggctcgtgtgcgagagcggagcggagctggagcgggatctcgcagcacgcgcggagtccctgcgcgccgcctcgggacggccggtggcactgtgcgacctggtgatggcctccggtgacatcctcagcggactgcccggcaccgcggtcgcgcgagtcgccgccgacttccaggcacgctgggcggaactgctcgccacggcaaccgagtcctcggcgtcctcggtcacgctcagcaccgcggcgatggcgccgctggtgcgcctgctgttcccggccgggcaggtgggatggcgtgccgcccggcagcacagcccggacctgatgctccgcgaacgccccggccgccgtccgcaatgggtgctcggcgagctgcacctggccgtcaacacgctggagaaccgcgccttcgccacccaggccgacgatcgcgcggaactgctcgcggcgaccgcggccgatttcccggacggccgcttcgtgcccgtctacccggccgcgtcaccggcggtcacctcgcgtacctacccgccgctcgccctcgaccttcccgacctgtacgagtactggtcctgggccgcggacgagggccatccctcgggcaggacggcactgcccggcgccggactgctcgtcgaacaggacgacagcgacgacggcagccggctcctcgtgcgctccgccgacggcaactggcgggcaccgctgaccgaggtactcggcgaattcctcaccgcggtcgtcgccgaccggttcagcatccgggcccgggccggccaccagccccgcctgctgctcgacgacgtggtcatcgcacgggaaacctggcatctgccggtgtcggaactcccctacaccgtcgacaacgactaccggcaccgcgcgctgcgcagccggctgcaggaactgggcatgcctcgctgggtgttcgcccggaccccggaccagccgaagccctacctcgtcgaccaggacgcgccgctgtccctgcgcaatctggcgcgggccatgcgccgaagcgccgcctccgacgccaccgccgccgacaccgcgcccgccgccaccaccttcatcaccttcaccgagatgcttccgggccccgacgagctgtggctcgccggacccgacggcctgccccacaccagcgaactgcgtgtcgtcgtccacgacgacgcccagatccggtccccgctgacgacgccagatcggagggcacccgcatgaccgcattctcgtcggcctggttcagcgacgtgatcaatccggacggggacggacctctcgtgatcgcgctgccgtacgccggcgggtcggggcgcgcgtaccgccggctgcacgagcacctgcccggcgacagcgtcctcgtactcgtcgacctgccaggacacggaccccggatgtccgaaccctgcctgcgcgatgcggacgacgtggtcaccgggctgctggaggcgttggagccactaccggcggagcggatcgtgctcctgggatacagcatgggcgggtggctcgcctacgaagcggccgcacggctcaccgaggcgggaaccgcgcccatgggcctcgtcgtgtgcggcacccgcgctccccagaccgggatcgggcacccgtcggtcacggcgcatccccccggcagggaattcctgcgcgaagccgtcgagatggggctcgccgccccggagatgctcgaagtcccgggcatggccgaactcttcgccgagccgctgcacgccgacttcgcggtggtgcagagctaccgccaccggccgcgcccccctctgtccctgccgagctgcgtcgtcggcttcgactccgactggctggtgcccgagccggcgctgcgggcctgggacgaggtctgcgcgcacccgctgcacagccgcgtcaagggctcccacctcgcactgcacgaggacgaggaagcgttcggcgcggcggtggcggcagggatctcccacatcaccgccgcccgccgccccttccccgactacgtcaccgcggcaggtctcgtcgcgcaggcggcacggcggacacctgacgcaccggccgtcgtggagaagggccgcgtcgtccacacctaccaggagctgctgaaactctccgcacaggtcgcccggctcctccacgagcaccgcatccgagccggggaccacgtggccttcatcggacgacgcgatccgggatccgtcgtcgcggtactcggcacggctctggcgggcgccgcgttcgtgcccgtcagcgacacgtggccgctcgaacggacggcgtacgtccttcgctcgacgggcgttcgctgcctgctcggcttcgccgaggacgtggcactgttcgggcaactcgcggcccactgtcccgatctcaccgacctcgtactcctcgatgtccactcgcaacaccctccgcagccgcgcgacgcgttcccgcacgccgaacaagccgccgtggtgagcgacttcggagagatcgccgagtgcgtcctggccgaacagccgagcaccgtactgcagatcggtctggggcagggcgaactgctgaagctcgtcgcacctcaggtggacctgttcaccgccgtcgacgccgacctggacgcggtacggacggcgactgcgtgggccgaggaccacggcgtgttcgccgatctcgtcgtcggtcacccggaacgcgtcgatgagctgctgtcgaccaccgccgacgtggccgtcctgcccgcggcgccctccccggcgctgctggacgccctcgcggcggccgtccggcccggcggtgccgtactgctgccgggtcctctcacgcgcggacccggccacgcctgggcggtgcagcctccggcgccgggcaggcggacgaccgtgctgcgccggacggatcttccaccggacccagcggaccagcccgcccggcgcatacacacccgatggcacctcgcccggcagcccgattccacgccgtccctctcggccggtccgggcgacgtcgcctacgtgatctacacctccggctccaccggccgccccaagggcgtcgcggtcagcaacagcgcactgctcaacacgctgtcggcctccgccgaccagttcgccgtccgagccgacgacacactcctgcaggtgacgtcgttctgtttcgacctctccatcttcgacgtcttcggggtgctgtcggccggaggcgccctgcgtatcgccgacgacaccgaactcgccgaacccagagtcctcgcacgggtgttgctcgacgaagagataaccctgtggaactcggcgccctcgatgttcgtctggctcctgccgttcctcaccggcagcgacgcgcccctcgatcaacggacgtcgctgcgcctgatgttgctcgccggcgactggatccccgtgtccatgccggacgaaacccgtgaggtctttcccaaggtgcggatcgtcaatctgggcggcgcgaccgagaccgccatctggtcgtgcttctacgagatcggcaccgtggacccgcactggccgagcattccctacggacgcccgctgaagggctcgcactactacatcctcgacgaacagcggcagcccaccgcgctcgacgaggccggccagatctacacggccggggactcacttgctctcggctaccacggggaccccgcacaaacggcccggagtttcgtccccgatccgttccggcccggacagcgcatgtacgccagtggtgaccgcggccgctggcgggccgacgggcagatgcagttgctgggccggatcgaccatcaggtgaaggtccgcggataccgcgtcgaactcggggagatcgaggccgtgatggccagtgcgcaccatgttcgatcggccgtcgtcgtcacctgtgaccgcgacgggaaccggacgctcgccggcttctacacctgccgcggaccggggacgtccggtgccgagatgcgcgagctgctggcatcccgtctgccgtcctacatgatcccgagccatctcggccgcctggacgaactccccctcaccccgaacggcaaagtggaccgggccgcgctggcacagctcgtgatccaggcggatcaggccgccgccacccctcccgggggtcaccggtgaccggccccgacagcagtctcgcccgccggctgcacgccatctggaccgacctgctcggcgacaccggaccggatgccgggttcctcgaagcgggcgggcactcggtgctggcagccagactcatcgctcgtatcggcaccgagctggatgccacactcagcctcgccaccctcatcagggacaacccctcactcaccggcctcgtcgcgctcgtcgagcaggccaggcacgaacccgatccggccggcgcacgtccccccgcctcggagaccacacccggccatcacccgcgatcggcgcccgtctcccctgccatgcgcaggatctggacgtggcaccgactccacccggactcccccgcctacaacgtcgtgcgggtcctgacgctcgacgcccaggtgcgacccgcgccgctgcgcgccgccctcgcggacctggcggaccggcacgacgccttgcgctgccacgtcgtcgaaccctcgcccgcccgtccagagatcgtcatcgacgaggcagtctccgtaccgctcgtgatcgacgtcgtacgcggcacgtcacacggcgacgtggccgaccaggtggatgccgcgctgcgccggagcgccgaccggccgatccccctcgacgccggaccgctgtggcgatgcgggctcatctggtcgcccggcaccgggcgcagctggatcgccctggtgatgcaccacctcatcagcgacctgcgctcctcggacatcgtgctcgacgacctggccaccgcctacgccgcacgccgggacgggtccgcaccgcggtggccgcgcccggcgcccggcctcctcccccacctgcgccgccaggccggcctcgccgactccgcgcgctggaaggccgacctcgactggtggtgccggcggctggccgcccacgcccgcaccacgccgcccgcgcccgctcccctcgcag

SEQ ID NO: 565 - DNA, 1263 bp, Unknown
  Kingdom: Bacteria, Phylum: Actinobacteria, Class: Actinobacteria, Order: Streptomycetales, Family: Streptomycetaceae, Genus: Streptomyces
ctccggctccaccggccgccccgccgcgatgcccaccaggtgcgtccacgacctcgggacgacgtccaccaccgcgtacccgccaccgcccagcgcgacccagcgaccgtcggcgtactcgtgcgccagctcgtggcacgccacctgcacggcacgctgcgcgtcgagcgacaccgcgaggtgcgccagcggatcctcgaagtgggtgtcggcgccgtgctgcgtcaccagcacctgcggccggaaatccgcgatcagctccgggacgatcgcgtggaacgcccgcagccaccccgcgtccccggttccggccggcagcgccacgttcaccgccgagccctccgcgcagtcggcgcccgtctcctccggccagccggtctgcgggaacagcgtccggggatgctcgtgcagggagaccgtcagcacccgcggatcctcccagaacgccgcctgcaccccgtcgccgtggtgcacgtcgacgtcgacgtacgcgacccgctcggcgccgagttcgaggaggcgggcgatggccagcgccgcgtcgttgtacacgcagaagccggaggcggcccccggcatggcgtggtgcaggccacccgcgaagttcaccgcgtgcagcgcctcgccgtgccacaccgcctccgccgcccccaccgactgaccggcgatcagcgcggagacgtcgtgcatcccggcgaacgcgggatcgtccagcgtcccgaggccgtacgcgtcgtccgccgccgccggatccgccgacgcggccttcaccgcctcgatgtagtccagccggtgcacgagccgcagcgtcgactccccggccggctgggccgcgaccagccgcacctcgcggtcgagccccagggcgccgaccagtttccgggtcagggccaggcggaccgggtccatcggatggtcccggccgaagtcataccccgttactgcctcgtcccacatcagctgtgcgcggccgctcatgcccgccaccgtatcggtccgcccgcggcgcgaacgacctggcgtacaccagcgtcaccagcaccagaaccatcggcaccagcatcgccccgcgatagctccacgcgtcgcccagcgcacccaccagcggcgagccgaccaggaaacccacgtagttgaagatgttcagccgagcgatcgccgcgtccgacgcccccgggaacaaccgcccggccgccgcgaaggtctgcggcaccagcacgcacagcccgagccccagcagcgtgaacccgagcatccccaccc

SEQ ID NO: 566 - DNA, 5965 bp, Unknown
  Kingdom: Bacteria, Phylum: Actinobacteria, Class: Actinobacteria, Order: Streptomycetales, Family: Streptomycetaceae, Genus: Streptomyces
ccccagccgccgccctggttgccaccggcgctcccgccggtggcaaccagggcggcggctggggcggtggctccggcggcaccggcggtggctactcggacgagccccccttctaggccttcgcgccggtctgcggaccggggcgggtcgaggggcgggccgtacccacacttcttgatcacacaggagaaacatcatggcgaagccgcctgtgcgcaagcctaagaaaaaggtctgcgcgttctgcaaggacaaggtcacgtacgtggactacaaggacacgaacatgctgcggaagttcatttccgaccgcggcaagatccgtgcccgccgcgtgaccggcaactgcacgcagcaccagcgtgacgtcgccacggccgtcaagaacagccgtgagatggcgctgctgccctacacctccaccgcgcgataagggaagggtgagccattcatgaagatcatcctcacccacgaggtctccggcctcggtgccgcgggcgacgtcgtcgacgtcaaggacggttacgctcgcaactacctgatcccgcggaagttcgctatccgctggaccaagggtggcgagaaggacgtcgagcagatccgtcgtgctcgcaagatccacgagatccagaccatcgagcaggccaaccagatcaaggcccagctcgagggtgtgaaggtccgcctggccgtccgctccggcgacgccggtcgtctcttcggttccgtcacgccggccgacgtcgcttcggcgatcaaggccgccggtggtcccgaggtcgacaagcgccgcatcgagctgggtgcgccgatcaagaccctgggcgcccacgagacgtccgtgcgtctgcaccccgaggttgccgccaaggtcaacatcgaggtcgtcgcggcctgatcgccgtgctcggctgaccgcagtcgacagagggggccgtacccggcggggtacggccccctctgcgtggtcgcagcggcgcgtgacggtgaggcgcagggcgcgtttcacgtgaaacaccgcttgacggcggcgactgcgaagccggtgggcgcgctgcctcagcgcgtcgcgcccgtcaccagccagcgtcccgaacgggtacgcatccacagggtcagcatgcgtaccgtcatcatgagtgtcatcgctgcccacagagtggtgagcccgcctccgaacacgggcaccagcagcgcggcgggcgtgaagaccgccagggtcagcagcatcgccccggccaggtagggaccgtctcccgcgcccatcaggacaccgtcgaggacgtagacgatgccgcagacgggctggcagagggccaccagcagcagtgcgggaagggcggcgtccttcacggtggagtcgtcggtgaacaggggcaggaacgccggacgcgtcacgatcaccagaagccctaggacgaccccggccgcgatgccccactgcaccatgcgacggcacgcaccccgggcgccctcgacgtcctcggcgcccaggaagcggccgatgatggcctgtcctgcgatcgcgatggcgtcgagagcgaaggcgagcaggctccacagggacaggatgatctggtgggcggcgatgtccgcgtcgcccagacgggccgcgaccgcggtggcgatcatcaggatggcccgcagggagagcgtgcggaccagcagcgggacaccggcctgagcgcacgccctgataccggcggcatcagggcgcagggacgccccgtgcctgcgggcgccccggacgaccacggcgagatagaccgcggccatgccccactgggcgatgacggtgccccacgcggagccggcgatcccgagtccggccccgtagacgagccctgcgttgagcgcggcgttggcgatgaagcccgcgacggcgacgtagagcggggtacgagtgtcctgcagtccgcgcaggacaccggtggcggcgaggacgacgagcatggcggggatgcccagcgcggagatgcgcaggtacgtcgtcgcgtagggtgcggccgtctgggaggcgccgaagaggtccaccacgccgggggcggtgggcaggactgccacgatgacggcggctccgagcagcagagccagccacaccccgtccatcccctgacggatcgctgcctggaggtcacccgcgcccacgcggcgggcgacggcggccgtggtggcgtaggcgaggaagacgaagatgctcacggcggtcgtgagcagggccgaggcgacgccgagcccggcgagctgcgccgtgccgaggtgaccgacgatcgcactgtcggccatcacgaagagcggctcggcgacgagtgcgccgaaggccggtacggccagcgcgacgatctcccggtcgtgtctgcgccggtcggccgcggggcgggcgggggcctgtgtcatgggcaccaatctatccgtccacaggtaagagatgcaaagcccattgggtccttacgtggctgcgcgagccgtgcacttttccggcgcgccaggaccgatcttggcccgatggggaaagtttttcttctgcacagccagtggatggcaaaggcgcaggtcaggcgggttcggcggaaaccggcgagggcttgttcacagcgctgtccaccgaatcgtgcacaggtttcgaggagttctccacagcatagggccggtcgtccacatggcctgtggataaccagattggctgacggtgcccgggggcctaccgtggtccggcgcccgctccgttcgccggcttgtgaaccgtcgtgaaacgacgcgccggaagtggaggcgggcctctcgatttgtcagtgccgtgccgtagaaaagaggggcacggcgaggtccgctcggcggacgggaggaggccgctcggtgagcatttccgagcccttggacgacccgtgggccgacagcggaccaggtgatcgtctgcctgcctcccgacggcggcccgacggcggaaacggacgcgacgaacagcacgaccggggccgggagaacggcgcctgggacggcgggggctcggcgttcgagcgggtccccccgcaggacctcgacgcggagcagtccgtgctcggcggaatgctcctgtccaaggacgccatcgcggacgtcgtcgagattctcaagggccacgacttctacaagccggcccacgagacgatctaccaggcagtcctcgacgtctacgccaagggcgagcccgccgacccgatcaccatcgccgcggagctgaccaagcgcggcgagatcaacaaggtgggcggcgcgtcctatctgcacacgctcgtgcagacggtgccgaccgcggcgaacgccgcctactacgcggagatcgtccacgagcgtgcggtgctgcgccgcctggtcgaggccggcacccggatcacgcagatgggctacgcgggcgacgacgacgtcgacgagatcgtcaaccgcgcccaggccgagatctacgcggtcaccgagcagcgcaccagcgaggactacctgccgctgggcgacatcatggagggcgcgctcgacgagatcgaggcgatcggttcgcgcagcggcgagatgaccggcgtacccaccgggttcaccgacttcgactcgctgaccaacggcctccaccccggtcagatgatcgtcatcgccgcccgtcccgcgatgggcaagtcgacgctcgcgctcgacttcgcacgcgccgcctcgatcaagcacaacctgccgagcgtcatcttctccctggagatgggccgcaacgagatcgcgatgcgcctgctgtccgcggaggcccgcgtcgccctgcaccacatgcgttcgggcacgatgaccgacgaggactggacccggctggcccgccgcatgccggacgtctcggccgcccccctctacatcgacgactcaccgaacctgtcgatgatggagatccgcgccaagtgccggcgcctgaagcagcgcaacgacctcaagctggtcgtcatcgactacctccagctgatgcagtccggcggttccaagcgggccgagagccgtcagcaggaggtctcggacatgtcccgtaacctcaagctgctcgccaaggagctggagatccccgtcatcgcgctctcccagctcaaccgcggccccgagcagcgcaccgacaagaagccgatggtctccgacctgcgtgagtccggctccatcgagcaggacgccgacatggtcatcctgctgcaccgcgaggacgcctacgagaaggagtctccgcgggcgggagaggccgacctgatcgtcgccaagcaccgtaacggccccaccgcgacgatcacggtcgccttccagggccactactcacgcttcgtggacatggcccagacctgaaccggcgccgccgggctcgccgctgcgacccgcgggcgcgtgatgtgtgccggggcccggtcagcggcccccgccccgtccggacggtgctcgcccggtggccctcatcacgtgcctctcccccctgctgccgcacacaccggacgacgcggaccagaggtgagcacgtctcgtccgggtcgtccgcgggccgtcagggtcggtgcgtacggcgaaagcggtcaggccccggcgaaatcggctcgacgcgcgcgctccgtcccggatggactgggggtatgacgacacctcaggatgaactgctgcccggcacccgccggtccctgacccaccggatcgccgtcgcccaggcggaagggcggacgccgtccctggtcgcctccgtcgtgcggggcggcaaggcggtctggcacggtgcgcggacgtcggtggacggacacgcaccggacgagaacacgcagtaccgcatcgggtccatcaccaagacgttcaccgccgtgctcgccctgcggctgcgcgacgaggggctgctcgacctcggcgatccgctggagaagcacctgccgggcacgggggcgggagacgctacgatcgccgatctgctggcccacacgggcgggctggccgcggagtcgcccgcaccctggtgggagcggacgccggggacgctccgtcccgaactcgccgacgtcctgggcgagaagccgctgcggcacccggtgggcaggcggttccactactcgaacccgggctacacggtgctgggcgcgctcgtggagaagctgcgtggtgctccgtgggaggacgtgctgcgccgggaggtgctcgaacccctggggctgagcagcacgagcgcccggccgcgtgcgccgtatgcgggtggctgggccgtgcatccgtgggccgacgtgatgcttcccgagcccgtcgaggacctcggccggatggcgccggccgggcaactctggtcgaccgcggaggatctgggccggttcgccgcgttcctcgcccggggcgacaagcgggtactgagtgccggatcggtcggggagatgcgcaccccggcggctccgcccgaggccacggacgtgacggcgggatacgcgtacgggctggggatggagctgaggcgctccggggagcggctcctggtggggcacacggggtcgcttccgggcttcctcgcctcgctcaccatcgccgtggaggacgacgtggccgcggtggtactgaccaactgcacctccggcgtcgcggtggcatccctcggggccgatctcgtccgcatcgtcgccgatgccgagccgcgcatcccggacccctggaagccgctgcgggacatcgatccggaggtgctggagctggcgggccagtggtactgggggactcacggcttcggtctgcgcctgaccgccgatgggcttctctcgctggagccgttggcgggcaacggccgcaggtcgcgattccgggcgaacggcgacggcacctggacgggcctggagggctactacgccggggagctgctgcgggcggtacggcgaccggacggatccgtggaccacctggacctcgggtcgttcgtcttcacccggcagccgtacgacgccggggccgaggtgcccggggg

SEQ ID NO: 567 - DNA, 3147 bp, Unknown
  Kingdom: Bacteria, Phylum: Actinobacteria, Class: Actinobacteria, Order: Streptomycetales, Family: Streptomycetaceae, Genus: Streptomyces
ggggtgcgggcggccgggtaggccgccgcggcgtgctcgcgcagcagcaccgcagcgtcgtggacggacagccgggccggactctgctcggcggtctgctcccgcagcttctcctcgtgggccagcgcggccgcgaacaccgcgtggactgcgaccgggccgccggacgccgccagttcctcggcggcgggcacgcgctcggtgacggcctccaacggcagggaccgtcgccgcttccggagccgccggtcgcctcaccgctccgtcggggacagtcgccaaagcggcgacgcctgccgggccggggacaccgcgaggaggtaggcgcgtagctccgccaactgatgtgggaacagcgccagttcctcggcgatgcggcgggtcgtgacgtaggcgatcccgcggcgagcggtcgactgctcccagcgtgcgaagcgctcggggagtgggacgctgccgtggagggaggggagcgagggggcgtcctggtgtgagccggccgcccgtgcgcgttcccgggcgacctcggagaagccgcacacctggaggctggcccgttccgccgcgtcgaggtccgtggtgccggccaacgcccgtgccagcgagtttagttccagggcgcgtgccagggtgagccggtagacgccggggctggcgtcggtgagggtgacgggttcgggggcgtcgcgtgttccgcagaccccgcggatgccccgcgccgcggcgaccagcagagcgctcgcctccgacgggtgccagtcgaagacgcgctgcacgacctgggtgtcggcggtggtcagggtgcggaacggcgctccgagtgagggcagcagggtcgcttcggggacctccgagtcgagccccggcccggcgacgtgcaccgaggcggagatcgaggcgtgcgcgcaggcggcgagggcgagcgcgtcgccgagcggactgcgcagggtgggctcggtgccgtcggccaggacgtcgcccccgacgtccacgacatcgacgtgatccgtaccgcagtacgcggcggcctccgtgatctgccgggcgagccccacagccccgccgtacgggtcgagcagccccagttccgtgcgcagatccgcggcgagccggggcagcagcgagccgaccggcggccggggcgcggagtccggggtgaccaggcgcagcgtagggcccgctgggacggtgccggtgaagtcggtcggccggcgcgggcccggcaccggatcgaccaccagccgctcccaggcgtaggtgaggatcagcgcgggttcgtcggggccgtggagggcggcgtgcaccatcgccgtcgtgatggcgtccccgcccccgccggcggccagcagaagtcgcttcatggacgacatacgtatctcaacaaccgggtcgattccagggtttcccggctcctgccgaccgtacgaggccccgccatgtcatgccaaatgtgttcgggcaaggcgcggaaggtgccaactttgttaaaggaaccgtcaattacttcggtggatcacctcatgtcttctgtcaccctgtgtcgagcaagctgtcacttgacgcgaccgtcggacgggatcgacccccaatcccgatcccgatcccgatctcgattccgatcttgaccccggaaggaagcatcgcttaagtggcaacctcgttaccgctccggatttcccgctccgtccccgacgagccgacgaccccgtacaagcagtacgtgtacgcctacccgcaccagaaggcgtaccggctgggtgaggaccggccgctcctcaccgacgtgtgggccggtgagcggctggacgcgctctccctctacgtccacatccccttctgcgagatgcgctgcggtttctgcaacctcttcacccgcaccggggcgcccgaggacgtgacccgcggcttcctggacacgctggagcggcaggcggccgcgacccgggaggcgctggacgccaacggcacaccgcgcttcaccctcgccgcgttcggcggcggcaccccgacgtatctcaccgccgacgaactccgtcggctgtgcgacatctgcgagaacgtgatgggcgcggatctggcggcggtgccctggtcggtcgagacctctcccgccaccgcgaccgcggaccgcatcgcgcttctcgcgcagcgcggcgcgacccggctcagcatcggcgtgcagagcttcgtggaggaggaggcgcgagccgcgatacggccacagaaacgcgcggaggtggacgcctcgctctcccggctgaaggaggccgccttccccatcctcaacatcgacctcatctacggcatcgacggccagacggagcagtccttccaggtgtccctggacgcggcgctgagctgggaaccggaggagatctacctctacccgctgtacgttcgcccgttgaccggcctcatggccaagcacgacaagagccgcgagagttgggacgaacagcggctgcgcctgtaccgcttcggacgcgaccacctgctcgccgccggctaccggcagacgtccatgcgggtgttcagccggatcggcaccgccgcggtcgacggggcggacgacagcaacatcagcgagtacaaccaacaggccgggatggtcggactgggcgtcggcgcccggtcgttcacgacggacctgcattacacgaccgactacgccgtcgccgtgccggaggtccggcgcatcatcgacgactacatcgccacgccgaccgatgacttccggcgcgcccagtggtcgttccgcatggacgacgacgagcggcgccgcatgtacatcctgagcatgctgctggaagcggacggactgcgcgtggaccggtacgcgaacctgttcgggagcctcccgcaggacgacttccccgctcagttcgccctcgtcaccgagcgcgagtggttgcgggaggacggcgggcggctgcggttgaccctggagggcatggcgtgggccgacgccatcggcccgctgttcttctcgcaccgggtgaacgaggccatgtcgtcctaccaggaccgctgaccagccacccgcgagccgctgaacggctgccggtgatccgctgagcggcctcccgcgtccgccccctcctgacgcattccgcgccgcccccgtccgggcggcgcgggaagcgtcag

SEQ ID NO: 568 - DNA, 2669 bp, Unknown
  Kingdom: Bacteria, Phylum: Actinobacteria, Class: Actinobacteria, Order: Streptomycetales, Family: Streptomycetaceae, Genus: Streptomyces
ccgcggcgcggtgcagagcggtgagacccgtgccgcggagttcctggacgccctcgccgaccggctgactctcgcggctgcctccgtggtggccgtactggaccccggctgcgtggtgctgggcggggagatcggacgggtcggcggggacgcgctcgccgcgcgcgtggcgcagcgggtcgcccggatgtcaccgctgcccaccgaggtccgggcgagcacgctgggcggcagtgcggtgctgcggggcgcgctcctgacggcacgggaccgcgcccaggagatcctcttcgcgccccggcccccggccggcccgccacctcacgcgcgtgaggcggccggtcccgcgaccccggtacgctccggtgacgccgcggccctgtcagggaactctcttgacacgcgcgcctgttgaccctctggtctagtccacctagggtctgaccgggcccggcggcggtgacgacggcccttgcccgccgccgggcctcccggacgctcgcgcgcggtcaggctcccgatgctctctgtgagcgagcccacaccgatcgcccgtatggacgccgggagggcgtggcacactggccctgtaccagtagcagcgcactccggggtcggtgaaagtccgaaccggcggttacagtccgcgacccggtcgcttccagcggccggttgaccaggtgaaattcctggaccgacggttaaagtccggatgggaggcagtgcgcggcgagcgggcacacctgtgcgcgtcgccgtctacgggctcgtcctcgcgacgggttccgctccggcgccgtcgccacccgtgcgttcgttcgtgtgtcctgccgtcctcggcagccccggagtccgtgcccgaagaggcaggaggacccgggaagtgttcaccggaatcgtcgaagagctgggtgaggtcaccgccgtcgagaacctcggcgacgccgcccgcttccgcctccgcggccccgtcgtcaccgagggcgcgcggcacggcgactccatcgccgtgaacggcgtctgtctcaccgtcgtcgaccacgagggcgccgagttcaccgccgacgtcatggcggagaccctcaaacgctccagcctcggcgtcctcgcccccggctcccgcgtcaacctcgaacgccccaccgccgtcggcgcccgcctcggcggccacatcgtccagggccacgtcgacggcaccggcaccatcctggagcgcaccccctccgagcactgggagatcgtgaagatctccctccccggggacctcgcccggtacgtcgtcgagaagggctccatcaccgtcgacggcatcagcctcaccgtcgtcgacgcgggcaccgaccacttcaccgtcagcctcatcccgaccaccctcgcgctgaccaccctcgggctgaagcagcccggcgagccggtcaacctcgaagtggacgtcgtcgccaagtacgtcgagcggctgctcggcgaccggaccgcggcggcggaccggagcacgggggccggccggtgaactggctcaactccgaggccttcacgctcttcggccagcacatcaagtggtccgacatgatcggcaacgtcatcggcctgctcggcctggcgttcggctggcggcgttccctgtggagctggcccacccagttcctgtccggcgtgatcctcttcgcggccttcgccaccgcccacctctccggcagcgccggcaagcagatcgtcgtgatggtcgtcgccgtctacggctggtggcagtggaaccggggcaagggcgccggggacgacggccacatcgccgtacgcttcgccacctggcgcgagcgggccgccctgctcgccaccgccgccgtcggcaccctcctggtcggcgccctgttcgaggcctacccgtccctgtcctgggacccctggcccgacgcctacatcttcgtcggcaccgtcgtcgccatgtacgcccaggcgcgtggcatggtcgagttctggttcgcctggctgctcgtcgacgcggtcggcgtgcccctcaacttcgccaacggcttcgccttctccggcttcgtctacgtcatctacggcgcactcgtcctgtggggcatgcgcgactggtggctgcgctcccgccagggcgcgcggcccgtcccggaaggagcgcccgcatgacagcccgcccgtctcccaccaccaccccaaccgaggcgcatcgcgccgcccctttgatcccacccatcctctacagcaccgacaacatcgaggacttcgcgctcgacccgatcgagcaggccgtcgccgacatcgcggccggccgccccgtcgtggtcgtcgacgacgagaaccgggagaacgagggcgacctcgtcgtcgccgccgagaaggcgaccccggagatcgtcgccttcatgatgagcgagtgccgcggcctgatctgcgcccccatggagggcgaggaactcgaccggctgcacctgccgcagatggtcgaggacaacacggagtcgatgaagaccgcgttcacggtctccgtcgacgccagcgccgcgcacggcgtcaccaccggcatctccgccgccgaccgcgccaccaccctccagctcctggcgagcggcaccgccgttcccggcgacctcgtccggcccggccacgtcttcccgctgcgcgccaggcccggcggcgtcctcgtc

SEQ ID NO: 569 - DNA, 12597 bp, Unknown
  Kingdom: Bacteria, Phylum: Actinobacteria, Class: Actinobacteria, Order: Streptomycetales, Family: Streptomycetaceae, Genus: Streptomyces
aagagacaggccgcggcccgtgcctcggccgtccaggcgggcaaggacgcgcagaccgccgcggcggcggcgagccaggcccaccagatcgccgcggccaagcggaaggcggagatcgcggcggcggccaaggcggcggccgacaaggcccgcaaggccaaggaggcgggtcagaacccggccgacacgtcggacaacgacgacgtcaagggcggcctgccgtggtggaagaaggacgccaggtggctggcgaacgccacgaactgggcgagcatcggcaccgggttcgcctcggtgggcatcggcctcgtcggtctcggggtgggcgtcttcttcccgccggccggcgtggtgctcgaaggcatcgcgacgggcttcggatatgcctcgctcgcgttcaccggactgaacgtcctgttcaccggaatcggctacggctggacgagcagcgagttccagtcctcgctcggaagtgccgcgctcagtctgatcacgttcggccagtcgaagtggatcggcgcgctcggcggaacgaaggtcgcgaccaagctcacgcaggcgggacacgatctgatctcgccggtgaccggtctgctcggatccctcttctgagccgtccggtgtaaggtccccgcgaggcccggcgtcgcatccgccgccggacctcgcgggcttttccgaaaggaccggcgatgcttgcgcggcttcccctcgtctggctgctgctcatggcggctttcgccactttcctgctcagtgcggagttcgcccgctggatgaaggtccgcaagctgaccctgtgggtcgtcgccgtttccgccgtctgctgcctcggtatggtcgcggtgggcagtctccagcaacagcactggaacgcgcggcagatgctggttctctactccttcacctggacgggtctcgcgctcggcctgctgccctccgggaaactcttcaccgaatggtgcgaagaatggcgaaggggcgtgcgcagggacaagtacgagtaccctgcgcgataccaggcggcagtctatggttcggttatcgtgatgggatttctggcgttcctgctggctgtctgagaaacaccagatctctgtgattcacctcacaacgagggttccactttacgccccatttaagtactttgcgaagtggacaacagttcaccacagagggttttatagccgagttcgagcagtttcccgacagtcggacagaagcccggtcagggccgtacgccatatgaatggcagggcgggcacggttgccattcgttcgattgccgggagtgggggcactgcacggcacttccggctgccttcacaccgctgcatgaaagcgctccggggtcttcggtccggagccgaccagtgaggactgtgatgaaggcacgtgccgtaatggcgaagccgtaccagagaaggatcgccggcaccgttctggccgccgcggccgcgggtgccctggcgttcacggcgctgacgggcggcgcctccaccaggaacgacacggccgacgcggtcacctccgtcgccggcgaggcccccggctacgccgtggaggacttcaactacccgggcgccgacaagatcctcgcggagaagaacatcgtcctcaagcgcggcgacgggcacatcacgctcgccgactgtgcgagcggcaccggcttcctggaggtctgggcccgcagcaaggacaagatctgcttccaggtcaccggcaactccggctggctgacgctggagatcccctccgtctacgccgtccggggcaacgactacgcggcccaggtcgacatgaccgtcggcacggaggagaagagcttcgacatcgccaagaacacctggaccgcggtcggcgagagcgcggacccgcagggccgggagcacatgctcgtggagatccgcacctccaagtagccccgctccccgcgccgttcgccagcccgtccgcgcggccgcaccggccccgcggatcccgagcacaaggaatcaccccatgccacgttccagacacgtgcgtctcgccgcactcgccaccgcggtcctcgcgggccccctggcggtgtgcgccgcgcccgcgtccgccgtcaccggcaccccggtcaccgacgcctccctcgccgccaccgcccaggtgatcgtcggcgaccacgaccgcggctgctccggcgtcctggtcgacaccgaatggctgctgaccgcggccagctgcttcaccgacaaccccgcggccggcctcaccgtgccggccggcaagccgaaggtgaagaccaccgcgaccatcggccgcaccgacctcagcggcaccgacggagccgtgcgcgagatcgtcgaactggtgccccgcaccgaccgcgacgcggtcctggcccggctgaaccgcccggtcaccaacgtcgcccccatcgccctggccaccaccgcgcccgccgccggtgaggaactgaagttcgccggctacgggcgcaacaagaccgagtgggcgcccctgaagctgcacagcggcgtgctgaccgtggactctgccgacgcgaccacggccgccgtcaccggcaaggacggcgccgccgcgtgcatgggcgactccggcggtcccgtggtgcgcccggccggcggcactccccagctggtcgccctcaacagccgctcctaccagggcggttgcttcggcatcgacgcgaccgagacccgtaccggcggcgtcaccacccgggtcgacgacctcgcctcctgggtgagttccaagaccggctcggcgcgcatcaccgacttcaactgcgacggcgtcgaggacgtcgccatcgccgacccgaaggcggccgtgagcggcaaggacggcgccggtgtcgtccgcatcgtctacggcggcggcaagggcaccgccgagatcaaccaggacctcgactgggtgcccggcggctccgaggccggcgactggttcggcgaggccaccgacaccgtcgactacaacgaggacggctgcaccgacctggtcgtcggcacgccctccgaggacctcggcaccgccgccgacgcgggcatggccgacatcctctacggcgcccccggcggcatcggcaccggttccctgaaggacacccacttcgagcagggcaccggcaccggctccttcaagtcctccaccgcggaggcaggcgaccgcaccggccagtccgtcgcggccggcgtcaccgccgccggcgagccgttcgtcgtgatcggcaccccgggcgaggccatcggcacggtcgccaaggcgggcatggtcttctacgtgcacggcgacaccaacatcgccatcagccaggacagcaccggcgtgcccggcgccgtggaggcgaacgacggcttcggcggcgcggtcgcggccgacgccaaccacatcgccgtctccgcctcgaacgagacgatcggcaccgacgccggcgccggcaacgtggcggtcttctcgcaccagctgaactccgagaagcggcccaccccgctgttcggcctcgaccaggacctggacaccgtctccggcggcgccgagccgggcgacgggttcggcaagtcgctggccatggtcacctaccgcccctcgggcgcggccaccgccaacgagtcgatcatcgcggtcggcgtgccgggcgaggacctggacgtggacggcgtcaacaagaccgacgccggcatggtgcagaccttccgcgtcaccgcggccggtacctacagccagctgaactcgtactcgtccggcaccagcaccgacaccgtgccgggcaccgccgaggccggtgaccgcttcggcaccgccgtggccgccgtgaacaccgcgccgcgcgcggtgagcaccacggcgacgatgaagctggccgtcggcatcaccgacgaggccatcggcaccaccgcgaaggccggagccatcaccacgttctcgctgctcggctcgcccggcgcgaacaaccgctggatcgaggccggcacctccggcatcccgggtccggccggtgccgaccagcacctcggccagagcatccactacaccggcacccagctgtacctgggcatgccctacggcccgggcagctacggcacggtctacgccctgccgctgtccaacgtgaccgcgggcggttccaacgcggcgatcaccacgtaccagcccggcaagggcggcctgccggcggccggcggccgcttcggctacgtggtccgctagcaccgccggatacaacggaaagggggcttccccggcaccgagtgccggggaagcccccttttccgtgtccctggcggctcagagctcgtacgggctcttcaccgggaagtaggcgcgcaggaacgagccgatgatgcgggcctgctcctggtccgggacctccgcgtcctgcgactcgcccaggcagaacgcgtcgtgcccgcggatcgcgaggagccgcgtcagctccgggtggcgggagtaggtgcccacgtcgatgtaggcgcaccggatgctgctcggcaccgcgctgcccgtcaggaagccgtagtggtggtgcagcgaggagaccatcgagatgtcctgccagccacgcatcgggttgccggccgtgcgggccacgctctcggggaagtccgcctcgatgctctccaggacgctcttgcgcagcgggtgcggggcgtgcgcgaagctgttcgccacggtcacgccgaagcgctcctcgagcagcttgcggttgttcttcgccgcggcgaagtagccctcgtccgtctcggccggctccccgatcggcacggtcgtgggcgtccagtagaagcggctggtgccgttcggctggaagaacttctgcgcgttgagcggcctgccgatgaacacgtcgtcgttcatgtacaggaagtgctcggacagcccgtcgatgtggtgcaactggctttcgatggcgtgcgagttgaacgtcggcaggcaggacgggtcggtgaagatctcgcggtgcgagacgacctcgatgtccgggtgctcggtgttcagccactgcgggctctggtcgtcggtgaccaggtagatcttgcgtacccagggcgcgaacatcgccagcgagcgcagcgagtagcgcagttcgtcccggttgcggaagcgcgcggcctcgtcaccggagccggaggcctcggcggcgaagccgagttcctcgcgccgccgcgcccgccgctcctgccagtcggggtccgagtcgtcgacccaggtgtagacgacgtccaccgggaaggtgatgtcgctgaccagcttcttggtgaacggctccagcgtcgggtactcccggtcgcgcacgcgcatccgggcgttggcggtcagcgtcggcagcttcgggccgacggcgctggcgcgcagcggcgcgacgaactggccgtcgccgccctcctcctccgggacctggcgccagaactcgacgtcgcagccgtaggcggggccgaagcgcagcgtgcggctcgaggtcaccacgggccggaagacccgcagcccggccacctcgccggcggcctccaggcgctcggcgagcaggacgccgggcgcgtgggtgcggggcttgaggagttcggcgtagaccgccttgccctcgtagtcggtggccagggccttgcggaccgccgcctggtggacggtgtccacggccaggcgccggcgcgggctgtcctcccggtcgcgcagcagcacgaacgggatgctgtgcttctccagggcggccacgaccgtctcgaagttccgctgcactatgtcggtgccctggaggtcgtcgtggacctcggagagccggccgctggcccgtaccagggagcggttggccgcgccgatcaccagctcgcgggcgcgctggtcgcccgaggagggcgcggtgcggtcggcggcgacggcggcgtggaagcggcccgcgccgccgtgcgcgacgcggtgggccatgcggtcggcgcgctgcgccatgcgctgcgggtcgtcacggcggtagagcagttcggtgaacagctcctcccactgcttgacgatgacgtcggcggcgaagcgggcggagccctcgtgggcgttctcgccgtaggagcgcagcagttcctcgtcgcccatgaggcgggagatcgcctcggagaggccctctatgtcgttgggcgcgacgagcaggccgtcgacgccgtgccggatgatctcggcggggccggtgacgatgtcgtacgccaccgccgggacgccggccgcgaaggcctccaggagcaccagcgggaacgcctcgccgtcctgcgacggcagcatggtgaggctggccttggcccactcctcggtcatgtgctggctggggccgaggatctccacggcgtcgtgcagaccgaggccctggaccatgttgcgcagccgggacatctgcgggccgtcaccgaagacgcgcagccgccagccggggtgctcgggcagtgccttggcgaacgcctggatggcgtggtcgacctgcttgtcgggcacgaggcggcgcggcatcacgatgctcttgccggtgaggctggagcgggggcggaagccctccgggatggcgttcgggatggccgccaggcgcggggccgccttgccgagcgactcctccagccactgcttggtgcgctcggtcagcacgaccagcgcgtcgatctccggggcccgcagcagcagcggttcgccggtgccgccgcgcagctgcgagggccggtgctcctggtggatggtgatcacccgggagggcaccaggtcggcgacggcggacatcagggccggcgaggtggtgatgaggatgtcggtgtcgagggtgcgcagggcgcggttcatctcgacgtcggagagggcgtcgaacgtcgcctcccacttggggctgatcaggtcgctgggcagcccggccaggcgccggcactcctcggcgccgatgtcgctctcgcgcaccgggcgttccgtcttgccggtgcggtccacgaggtagcgcacggggacccgctcgtccacggagaagaagggacgctcgcgggtcttgaagacgctgagcacctcgacgctgtgccggggcgccaggtgcgtcgcctgggtgtagacggcctgctccgtgccgcccatctcgtcgccccaggtgagcagaaacgtgatcttcattggtgtcaacatccagaggggaggtgggccgctcggaaggccaggctgccgatgggcgtgtaatacgggttgatcctgagcacggagtcgtcgtcggcggtcagcagccggtgcggcatgcggaagacgtccccggggctgcgtacgtcggtgcgctgccgggagatcttcagcgcccggcggcgcggacgctgcaggcgtacgtcgaagatctgctccttggtgccgacgtcgccgaagtcggccacggcgagcgagcagacgaagacgtcgccgtgccaggtggccgggacgacacgggccgccttgccgctgcggcggacgagttcgacgtcgccgctgcactcctcggccggcgcgttgaccagccggccctccagcgtcacctcggaccagccgatcctcacggagaggatctccgcctcggcgtcgtccctgcccacggacacgtaggcgcgtccggtgccggacgcgatgagacggcagtaggtgccgtccgggcgcaccggctcggggacggtggggccgtcgggcatcagccggggcgccttggcgaccgcgaagcggcgctcggtgcccgcggcctcggtgaagacgaccgagagccgccactggccggaccccagcaggaaccggcgcactccggcgggcaccggcgggtgggagtcggcgtccgcctccagcaggtcgaggacggcggtgccctgcgcctcgacctgtccgtcactgcgctggacgagcgtcagcgggatgaccaccggggtcgaggagccgcccagcagcagggaagcggccgaggcggtcacctcgtcgggcacgcggacgcagaagttgagcgtccggccgtccagcagggacaggtgctcggcggtgaccctcggccagtcgtcggcactcggcgggaccaggacgagactgtccagtcgcgaccgtgccgagcgcaccacgtcgtaccccttgcgcatcaccttgtgcggggtagggagttgtctcatcggttgtctgcaccacgctcgtaggggctggggtacgggaagtactcgtcgaggaagcgggccatcagggcctgctggcggcccagttcggcttccgtggaggtcgtgtcgttcaggcagaacacatgcgcgtcacgctgggcgagcagccggccgagcaatcgctcgacaccgggtttgcccacgtcgcagtagcggtacacgagtccttcgccggagaaggaacgctgggtgtggaaggcgtagtagtggtgcagggacgaggcgacggagatgtcgtcgacgctgcggaaccggctggcggcggtgcgccggtgctcctcggggaactcccgctcgatctcgtccaggacgctgcggtgcagcgcgtgcggcacgtgcttcatcttgcggaagatgttgtcgccgaagcgctcgacgatgagcctgcggttgttcttgccggccgccgccaccggcgggtcgtccggggaggactcgccgaagggcaccagggcgggcgagaggtagaacttgccgaggccgttgggcaggaagaagtgctgcgggagcacctcctggccgagcatcacgtcgtcgttgaagtacaggaagtgctcggagagcccctcgatgtggtgcagctggctctcgatcgcgtgcgagttgaacgtcggcagcgcgtcggggtcggtgaagatctgcttgtggctgacgaccttgatccgcgggtggtcggtgttcagccactccggggtctggtcggccgtcaccaggtagatgttgcgcacccagggcgcgtacaggtgcagcgagcgcagcgagtagcgcagttcgtcgcggctgaggtagcgggcggcgttggccgcctcctcgtggtagggcaggtcggagaaggcggcccgccggcgcacccagtccgggtcggagccgtccacccacgtgtacaccacgtcgacggggaacgtacgccgcccgacggcggccgcggcgaaggccggccgggtcggcacacgcaccggtccctgctcctgatccccctgctcgtcctccccccggtcctgctcccccggctccgcctgttcccgctcggcggggagcggggcgaggtcggtgaacaggctctcgtcggcctcgacggtcgcctcgtcgaccggtacggcctcggcgacaacgttgcgccggggtgagaggagttcgtcgccctcccgccgccagaactcgatgtcgcagccgtagcgcaggcccagcaccaggcggcccgtctggtcggtgaggtaccaggtgcacctgaggacgtcggcgccggcgagccgcttccacgggcccggtccgtaaccgggcagcacggactcctcctggggctggcggccgcggaccgggaccacgtagccgggccggatccggcaggcctggcgcagtgcggtgagcacgcgctcgcggtcctcccgccgtacggcgatcgccgcggaggtctcggaggccgagcgcacgcagaagtactcgacgcccgcgccgcgcagcgcggcggccacctcgtcgaggttggcccggcgggcctggagcggagtgacgccggggacgacgtgggcgatgcgcggtgtcccgtcgacgctgacgacggttctgtcgtgccgtgccagcagcgcccggtggcgccggaccacccgcacccgcttgacctggttgcgcacctcggccgcggcggcgatccccgacttgagctgctcgcggaagtcggtccccacgtgctcggcgatcactcgccgcgcgccgaccggcaccgcgcggcggtatacgccaaccaaccgggaggcttcagggtttcgcactgcgggagctcctccgacgggaacggctgggtgaacggcacgctcccactaggtgatccggtaaaaacacggcgagacaagtatgcagtgtgtttaccccacgtccccatggccgtgccacaaccgcaaccgtcagcaaatgcggcataccgggccaaccggccacgagcgttgacataaatcacagcacggaaccgggcacgttccagccgcgtccgggagccgtgcggctcccgggatcagcgtgaaacacgggcgggcggtaccgcctgaaaccggcctggaacgccgacgtggaacgccggtcagaacggctcgaagtcgtcgtactcctgctcggagtcgtcgcgctcggcctgccggtcgcggcggcgctgcgcggccgggcggggctcctcgaagcggtggtcctcgccacggcggccgagcatctccgcacccgccatcaccgacggttcccagtcgaagacgaccgcgttgtcctcgggaccgatcgcgacgccgtcaccggagcgggcgcccgccttcagcaactggtcctccacaccgaggcggttgaggcggtcggcgagatagcccacggcctcgtcgttgttgaagtcggtctgccgcacccagcgttcgggcttctcgccgcgcacgcggaacaggccctcgtcctcgcgggtgacggtgaaaccggcctcgtcgacggccttcggccggatgacgatccgcgtcgcctcctccttcggccgcgcggcacgcgcccgggcgaccaggtcggccagcgcgtacgacagctccttcaggccggtgtgcgccaccgccgacacctcgaagacgcggtaaccgcgcgcctccaggtccggccggaccatctcggcgaggtccttgccgtcgggcacgtcgatcttgttcaggacgacgatgcgcggccggttgcccagaccgccgtactggcgcagctcctcctcgatgatgtcgaggtcggagaccgggtcgcggtccgactccagggtcgcggtgtccagcacgtgcaccaggacgctgcaccgctccacgtgccgcaggaactccaggccgaggcccttgccctggctggcgcccgggatgagaccgggcacgtcggcgacggtgtagacggtcgaaccggccgtcaccacaccgaggttgggcaccagggtcgtgaacgggtagtccgcgatcttcggcttggccgcgctgagcaccgagatcagcgacgacttgccggcgctcgggtagccgaccagcgccacgtccgcgacggtcttcagctccaggacgatgtccccgaggtcccccggctcaccgagcagcgcgaaaccgggcgccttgcggcgggcgctcgccagcgccgcgttgccgaggccgccccggccgccctgcgcggcgacgtacgaggtgccgtggccgaccaggtcggccagcacgttgcccgccttgtccagcacgaccgtgccgtccgggaccggcaggaccaggtcctcgccgtccttgccggaccggttgccgccctcgcccggcttgccgttcgtcgccttgcggtgcggcgagtggtggtactcgagcagcgtggtcacggactggtcgacgatgaggatcacatcgccgccgcgcccgccgttgccgccgtccgggccgcccagcggcttgaacttctcacggtgcacggaggcacagccgtggcccccgttacccgcggcgacgtgcagctcgacgcggtccacgaaggtggtcatggtggtgcctccagaactacgggaatgtctcttacgtaacacgcgaaaggcggacccgccttcccgaccgggaagtgaggtccgcctcgcgaaagtctccggtcaggcgaccggaacgatgttcacgaccttgcggccacggtgggtaccgaactccaccgcaccgggctgcagcgcgaacagcgtgtcgtcgccgccgcggccgacgcccgcaccggggtggaagtgggtgccgcgctggcggacgatgatctcaccggcgttcacgacctgaccgccgaagcgcttcacgccgagccgctgggcattcgagtcgcgaccgttccgggtggacgatgcgcccttcttgtgtgccatgtctcctcagtcccttacttcgcagccgcggggatctcagtgaccttgatcgccgtgtactgctggcggtggccctgacgacggcggtagccggtcttgttcttgtagcgcagaatgtcgatcttctgccccttgtggtggtccacgacctcagcctggaccttgatgccggccagcacccacgggtcgctggtcacagcgtcgccgtcgacaacgagcagggtcgagagctcgaccgtgtcgccaaccttggcagtggaaatcttgtcaacctcaacgatgtcgccgacagcaaccttgtgctggcgaccaccgctgcgcacgatggcgtacacgcggatctcactctctcgctcgggaaacggcacccccgcaggccagccgcccgcactgcggacgacctctcccggccagcccagtgcccgggaggaagaggtttacggggatgtggcgcgctcagtcggcacgccgacggtcaagattacgggcccacacccgagggggtcaaaccgggccggggcccacgggtgtgccgctgctcacggctgggggccgtgggccccggcccggttt

SEQ ID NO: 570 - DNA, 7117 bp, Unknown
  Kingdom: Bacteria, Phylum: Actinobacteria, Class: Actinobacteria, Order: Streptomycetales, Family: Streptomycetaceae, Genus: Streptomyces
cggcgagcgcctcggcggcgggcttgcgtacgccgtcggcggtgcggaccacgccctcccccatgacggcgagcgcgcagtgcgccagcggagcgaggtcaccggagcagccgagcgagccgtattcgtgcacgaccggggtgatgccggcgttcagcagcgcggcgtacgcctccgcggtctgtgtccgtacgcccgtccggcccgtggcgagggtggacaggcgcagcagcatcagcgcgcggaccacctcccgctcgacctcgggacccgaacccgcggcatgcgaacgcaccagactgcgctggagctgggcgcgcagctccgtggggatgtggcgggtggccagggcgccgaagccggtggagacgccgtagtggggcttggcgtcgtcggcgagggcctggatgacctcgcgactgcgggcgatttccttgagcgcctccggggcgagggccacgggggctccgagacgggcgacggacacgacttcgtcggcggagagtgcgccgacaccaacaacaacggtcatgtccctatgaagccgcaggtgaacccgggtccgcgagaggagccgggccggtactgtctggtatcccagacaaacaacggaccgttctgtctgagatcccagacagttggtccacgacgtctctggtctacgctcgggccatgagtatcgtccccgccgccgctcaggtactggccgtgctgcgctacctggcgcggcaggccgcaccggtgcccgcggcggccatcagccgtgacgtgggtctgccccgctccacgacgtaccacctgctcgacaccctggccgcggacggcttcgtcgtccacctgccggaggagcggcgctacggcctcggcgtcagcgccttcgagttggcctccggctacgagcgccaggcgccgttccagcggctggcgagggcgccgctggccacgctcgtggaccgtaccgggcacaacgcgaacctcgccgtactgcacgggcgcgaggtcatctacgtgatcgaggagcgcgccccgggccggccaccgctcgtcagcgaggtgggtgtgcggctgccggcccacctgaccgccagcggccgggccgtgctggccctgctgccgcccgcgcaggtgcgggccatcttcccggaccggtcggcgttcgtgctgcggcacggcgtcggtcccgcgtcgctgacggccctgcgggccctgctggcccaggtccgccgccggggctacgcgacggaggagggggagatcacccccggtctctcctccgtcgccgcgcccgtgctggaccaccacgcccacccgatcgccggggtctccgtcaccttccccggtgagtcgtgcgacgagggcgaccgcgaccggatcgccggtcatgtggcgcagacggcgcgggaactgacccgccgggtgggcggcgtcaccacggcgcggcactgacggatccccctggggcgcccggtcgcggcgcaggcgttcggcaccgtgtcgttcaaccgtcctgccgaccgggaaggtcgctcccccgaccgggaggtccgccgggtcgggccacgcccaccgctcagcgagactcggggcgcggcgtcgcgcggggcgcgggcggatcttccgtgccgtcctcgaagagcatgcgcagcgccacgtcccggtagtggcgtacgtgctggagcgaggcggtcgcggacgcgtccggatcgccggccgcgatcgcttcgtacagggcgctgtgttcttcccagagcgtgtcgggttcgtcgatctgctggaagagccagcgcagccggccttcgaggggctctagggccgaggcgagcagttcgttgtcggcgagttccacgatctggtggtggaaggcggcgttggcgcgggagatgcgctcgggtctgccggagagggtggcgcgccgagcgtccgcgaggagacgtcgcagtgtcgcgaggccgggcgcgccggagcgttcggcggcgcgtctgacggccaggacctccagtgcctcgcgcaggtcgaagaggttctccacctctttgcggtcgtagcccttgacgacgatgcggcggggcgaggcggcggtgaggaagccctcggcgagcagaccgcggatcgcctcgcggaccggtacccgggagacgccgaactcctcggccaggtcgcgttccacgagccggtcgcccggggcgaggcgcccggtgatgatgcggtcgcgcagttcctcgctgacctggtcgcgcagccacaccgtcccggtggaggaaggggcgggctgcggttcgttccggctcatgtttcctcccgtggggacggcacccaattaaggtataccaaacgcttgacgccgaagggcaggccgccccagagtgtttggtatgccatagcgcggaacgtcgacgtcacgcccccggcagtccccttcttcctgccccctgtactccgtcctgcccgaattgagggtatgccatgagttcacactcggccgtagaggccgcacactcccccgagggaaccagaaggaccagaaggaacggtcccggaagccggcccagccgggtccggtggaagatgttcgtcctgctcctcggcgtggtcgcgctcaactacatcgatcgcggctcggtctccgtggccctgccgctcatcaccgacgacctcgggctgagcaaggagaccaccggcttcgtcctgagtgccttcttctggtcctacgcgctgatgcagatacccgcgggctggctcatcgaccggttcggcccccggctgatggcctccggcgcatgtgtgggctggggcgtcgcccaggcggtcaccgccgcctccaccggcgtcggttcactgctcggctaccggctgctgctcggcgccgtcgaggccccggtaatgccggccggcggcaagctcaacgcccagtggctgcccgccggggaacgcggccggggggccgtgctcctcgacggcggcgccccgctcggcgcggcggtcggcggtgtcgtcatctcgggtctcatcaccttcaccggcagttggcgcaccagcttcgtcatcacgggtatcgccaccaccgtcgtgggtgccttcgcctactggtacatccggaacaccccgcgcgagcaccccggcgtcaacgaggccgaggccgcgtacatcgagcgcgcccacgccgaggaggatgccggggcgcccggcaccgaggaacgcgccgggctccgcccctacctcaagtaccgctccttctgggccatgtgcctgggctggatgggcttcaacggcgtcttctacggcctgctcacctggggcccgctctacctgtccgaggccaagggcttcgacatcgcgaccatcggctcctcgacccttgtcatcttcggcgccggcttcgtcggcgaactgagcggaggctggctcgccgaccactggcggtccaggggcgcgggcgacaacagggtcatgcgcacgctcatgggggtcgccggggccgcggtcaccgccggcctgctgggtgtggtcctggtgcccgacgcgctgaccgccgtgctcctgctggccggagtgctcttcttcctgcgctgggccggtctgtactggtcgctgccctccaccttcggcggtcgccccgacgcaggagtcctgggcgccgcgatgaacctcgccgggaacatcgcgggcatggtcaccccgatcgccgtcggcttcatcgtcggcggcaccggctcctacacctgggcgctgctctacttcgtgggcgccgcgctcctgttcaccgcctcgtccctcgtcctcgactacagcaggaggctgtccgtccgatgagtgccgtccgtatcggaatgctcaccccgtcctccaacacctgcctggaaccggtcacctacgacctgctgcacggcaccggtgccgccaccgcccacttcgcccgcgtccccgtcacccgtatcgccctggacccgggatccgactcccagttcgacccggcgcccatgctcgccgcggccgggcaactcgccgacgcccgcgtcgacgtcatcgcctggaacggcacctccggctcctggctcggcaccggccacgaccgcgcgctgtgcgaggcgatcaccgcggccacgggcatccccgccaccacctccacgctggcgctgctcgacgcctgtgccgcctacggcgtggcccggctcgggctcgccgtgccgtacacccgggacgtcggcgagcggatcgtgcgcacctacgccggggagggcatcgcctgcaccctcgccgaaccgttcggcatcagcgagaacgaggccttcgcccgcatcccgcactccgaggtcgcccgccagatcgaggcggcggccccggacaaccacgccgtcgccgtcgtgtgcaccaacgtgtacggcgctcgggccgccgcggatctcgaaccggcgctcgacatcccggtgttcgactcggtcaccgccaccctgtggaaggccctcgacctcgcgggagcgcgtcccgcgctgcccggccacggcgacctcctgcgctccggcagcctgcgggcccgcttccaggagatcctcaccgaactgctcgcgcggaccggcgcccatcgcaccaccttccggatcgaccttcccgagcacggcctcgaggtcgacctcaccgcgggtgaggcactgggcaagggcattcgctccatccgccgcgacgcctccctcgaccagcgccgcctcgacacggtgcagtggctggagcaccaccgcgtcccgctggtccagccccacttccgcgacgccccgcacccgccccaggcgctcgtcgacgtctacggcgtccaggcccaactgctcgcgccggtgctgctcgacgccaccatggccggctggatctccgtgcacagcatgaccgaacgcgactggaccgaacgcgaccgcacggccgtcgccaccgcggtcacccgcgtgcgcgacaccctcggcgcccgctgaaccaccgacgacccctcccggaccgcctcacattctcaaggaacacacatgaccaaggacatcaagatcgccctcggtgtcgacgtcgacgcggtcgccggatggctcggctcctacggcggcgaggactccccgaacgacatccagcgcggcgtcttcgccggcgagatcggcactccccgcctgctcacgctcttcgagcgctactccatccgcacctcgtggttcatccccggccactccatcgagaccttccccgcacagaccgagatggtcatcgcggccggccacgagatcggcgcccacggctactcgcacgagaaccccatcgccatgaccccggaacaggaggaggcggtcctcgccaggagcgtcgagctgatcgagtccttcgccggccgcaggccgcgcggatacgtcgccccctggtgggagatgtccgcccacaccgcgtccctgctccaccagtacggcttctcctacgaccactcgcagaactaccgggacttcacccccttctacgcccgcgtcggcgactcctggacgaagatcgactactccaaggacgcgcaggagtggatgaagccgctcgtccacggccacgaggtggacctggtggagttctgcggcaactggtacgtcgacgacctgcctcccatgctgttcaacaagcacgcccacaacagccacggctacgtcagcccgcgcgccctggagcaggactggaaggaccagttcgactgggtgcaccgggagttggactacgccgtcatccccgtcaccctccaccccgacgtcagcggccgtccgcaggtcctgctgatgctcgaacggttcatcgaatacgtctccgcgcgacagggcgtcagcttctgcacccttgaggacgccgccgacgacttccgccaccgcttccccttcacgggcaaggagcgcccggccgacatgcgctgaccgccaccggatcgtccctgggatcaaacgtgcgtccctgagctgaccccggcggtcccccggacggctcccccctgcggagagccgtccggcggaccgggcaggacgtggtcagcgcacggcgtacgcgtcggtcacggtctggacgacggagttgccgcccgcgtcggtcagttcggtcctcagcgtgacggacttgccggccgcgcccgtgtggtccacggtcgcggtccagcggccctggtgctgcgaggtggtggccgcggtccaggtcgtgccgccgtcgtacgagtacgagacgttggcggccaccagcttgccgggtgtgtagcccgcgtggccggtgacgctcagcccgatcgtctgaccggccttcgccgggagcgtcttgagcccgtccgtgtccaggtcgtactgcgggaagagcagcggaacgccctgcgagtagacgttctcgtcccggtgcgagcggaacctccagacggtccgggtctgggtggaccgcttccatgcggcagcgggctgcccgaacttggcggtgtccagggtgagttcgtacggcgcgtccttctcggggacggcgaacgtgccggacggccacccggtctcgccgatcaccttgccgccgctggtgagccgcatgctgccgaggtccccgaaggagccctggatgcccatgtgctcggtgtcgccccagaaggcgggtgccacaccgatgaggttgtcctgccgttcggcggccagctggagcttgcccgcggcgtcacgcggggcggcgggggccaggatgccgcggtaccagttctcggtccgctgcgagccggcggtgtaggtgcgtgcgcggtcggccatggcctcgccccacgggaagctggaggagaggtagcgcgtccacgcggtgtcgcccgccgagtagtactcggtgcgtttgccgggcacggcgacggagtcggtggcggcggagaacaccccgccgtacggccgggccatggccatcgtgtcgacgtagtccgccgcgacgcccatcgcctcgtaggtcgcggtgaccgcgccgagcttcttgtcccggacctggtaggtgcggtccgaggtgagcgggccggtctcggggaaggcgaggttgtagacgaacgggctgacggcggtggccttccagcgcagcgtcaccgcgcccttggccagggcggcccgctcacctcggaccg

SEQ ID NO: 571 - DNA, 3124 bp, Unknown
  Kingdom: Bacteria, Phylum: Actinobacteria, Class: Actinobacteria, Order: Streptomycetales, Family: Streptomycetaceae, Genus: Streptomyces
gtgggccgtgggaggcggcacgaccaccagcgccgcgccgcctcccacggcccacaacaccgggtcccggtaggggcggcgggggagggcgggtgacgcgtcgagcgggatgacggcggtgtcgttgccgggggtgcggtcgtacgggttgtacgtgcggatggtgccgtgggcgccgggcacccgccggtcgatacggacgtggaacccgatgacggtcgtccccccttcgtgccggacctcggagaaaccgtcgcggccgatgtcgcagacgaacggcccgccgggcctgtccgggcgtcggcacgcccacgtgccgcccgagtcctcgaaggtgaacgggacggaggtgacggtggtcccctccggcgggaccacctcgaaaccgcccagtgcctcggcggtgtccggccggccggggccgtggtcgcgcagcccgagcagcaccgtcaccgtgtcgccgacccggccccgtacggtcgccgtcaccggctcgtagtcggcctgcacggtggtctcgacgccgacctgggcgctgccggccgtgaggccgcggtcggccgccgggaccagcgtcagcggggcgccggtgccgcgcaccgtcagaccgtccggcccgttccgtccgccgtgtccgtcccgtccatcccgtccgttcggtccgtccggtccgtcggggtcggacgaccagctgtaggacagtgtgcccgtcagcttcccggcaaccgcggtgaaggtgaccggggaccgggtgcggtaggcggtgcccggcgcggccttcgtggagaacctgcaccacgccgaggtgaaggcggcgtcgaacgagcagttggcgggccgtgaggtcagccgcagaccgtcccgcgcggtgatccgcagggccacgccccgccgggcggtgaagcggctgtggttggcgaacctgggggtcagcggcacgggatcgcccggctgcacaccccgcaccctggcctcctcctcaggcgagagcagcgcgggtccgcccacggtcatccgggtggtgcccgtgacggggggcgcgttgtcggccgtggccctgtacgtcaccgtcccgccggcacccggctcgacgccgtccaccccgtggaggacgaagggcgtctgggactccccgtcgccgttctgcacgtctccgtacgagcaggtgaacaccgggcccgcgcccgtgcagttcccggcgccgcccccgctcacccgggcgacgccggacagccccgaggcgtccacgacgaccctgacggcgcgggccggccccgcgccgccgggcaggacggcgacgggcacgacgaagtcgctgttcgaggcgccggcaccgtcgtcggcgccgtacatccggaaggtctccgggacctcgaaccgcaaggcgacacggcccgagccgtccccggccgcggcgggcgacgggagcaggacgagaacggccgcgagcacggcgcccagaacggcgaggggggtgacacgggcagcggcgggggcagccgggcgtccggcgacacgcgggggtcggagcatgtgcgcactatgccagtgcccgccgacggccggagcgggcggtgcggccctgcgggatcggcaaccgccttgtgccgcagggaagttcatgcctgaacggaagtccgcgcccgcgggaagttcgtgcccggaggaagttcgcgcccggggtattcccaaaatccttaccgaccagtaagaaccgtgggtaaccccatttggccaggaggtctcatgagacgcaccaggcgcagactccggtggaccaccgccgccgccgtcgcgaccgccgccctgctcggcacggcaccgatcgccgtcccggccgcggcggcggacgccaccggcacacggcaggcgtccaccgccaccccgctcccgccagaactggagaagatccgggccgcggaggccaccgcgctctacggcgaccccgccgaacgcccggccgcccagcgcaagacctcgctgatctccctcggcgacagcgagatctccggcgagggagtcggcacctacgaaccgccgaccaacggccccgacaactggtgccaccgctcgcccgactccgccatccaccgcaccggcatccccgccgacctcaccctcaacgtggcctgctccggcgcctacaccggcaacatccggatcggcggctcgaagcagtacgccgacgaactcgtccagagcgacagcctggccgtcaaggcgcgcaacacccgcgtcaagatggtgctcctcgtcgcaggggccaacgacgacctccagttcggccccgtcatgaccgactgcgtcgaacgctacctgctctcccagggaccctgcgccgccaagtacgggccgggctggcagtccagggtcgacgccctggtccccaaggtcgagcagaccgtgcgggacctcaagtcggtgatgcatgacgccggttacgccgacggcgactacaagctggtcgtcatgagctacccgagccccatcggccccgacttccgcgacaacccgagcttccccggcaagctcgcctgcggcggcctcggctacgactccgacaccgcatggggccgcgacgtcgccgtccccgccttcgaacgcggcatccgcaaggccgcggccgacaccggcgcgctctacctcgacaactcacgcctcttccacggccacgaggtgtgcaccgaggacacctgggcccgcggcctctacatcgacacctccaagcccggtctcccggacgagaactccgtccggcagtccttccaccccaacacccgcgggcacgccgccttcgccgactgcctcacccggttctacggctccgggctgcgcgaggcgtcctgcgccgacaccaactcctcggggacgcccacactcttcccgtacgcctgggacgacgtgttcaagccgctgaagaacgaggcgacgggcggctgcatggacgtctcggcctccgagagcgccaacggcaccgccgtgctcggctgggactgcgccggcacccgcaaccaggactggtggtacgacccggcacggcagaccttccacaccgaactcacccaggaccgctgcctggacgtgcccggcgcccggtacacggcgggcacgtccaggcagcggt

SEQ ID NO: 572 - DNA, 1233 bp, Unknown
  Kingdom: Bacteria, Phylum: Actinobacteria, Class: Actinobacteria, Order: Streptomycetales, Family: Streptomycetaceae, Genus: Streptomyces
gtgcccggcaccgacaccggcacgccgcgcctgtcgccgttcgaggcgatgggtatggcgacggcggtgtccgctccggccagtccggtcacggtcgagcgggccgactcccccgggtccgtcgcggccacgtccggcgggggccttcccgtcggcacctcgagcacgagcacgaaggagaacagcgtgagtgacgcctggctgacgaagtggggcagcggcagcgtcgcggacatggacgcccagcacgagaccgaggtcaccctcgacgacacgctcgacgtcctggaggagctcaccgagcagtcgttcaaggcgcacgagacctgccgcaagctctccgagaaggcgcggcagatccggtacgagctggacgaactcgccgccgacctgcgctccacgcacaacgtcatcggccgcatgaccggcgccgcgatggccaagctcgcggagtccatggagctgctggcccgcaaggccgacgagatgtccaccaagtccctgacggcggcggagctctccgagagcgcggagaacgcgatgttcgacgcctaccggcccctccagcaggccaccgaggacgcgggcctggccgtgcccgccgcccgcattcacaacgagaactgagaggagatcacgtgagtgacaacctccccgccgtcccgggcatgaacaacaacgtggccagcggcggcgccagcagcggtaacggcttcctcgctctggccggccggaccgccaagctcgccgcctccgccctcttcctcaaggagggcatgcacctgctccgctcccacatgcaggccaacgccaacgccgccatgcgcctgtcggagatgtgcggccaggccgaagtcgagccccgcttcacctcgatgatcgaggacgtctccacctccctgaccggggtcgcggaggcgtccggggagatggtcaacgccgccgacgccgtcgacaacgacgcacgcggcttcaacaacgcgcacgaccgggagtaccgccccggctacgaagcctccaacggctccggcgtgcggcaggccaagcccggcttctaccggcgcaccggccgccgctgacccacccacccccgcagcagcaggggccgggcccgcacgccgggcccggcctctgctgtcccctgcccctgaacggaggctgtgttgagcaccatcgaccaggcggcgccggccgccgacaccactaaacgcgtcccgggccacgtcatctacc

SEQ ID NO: 573 - DNA, 5092 bp, Unknown
  Kingdom: Bacteria, Phylum: Actinobacteria, Class: Actinobacteria, Order: Streptomycetales, Family: Streptomycetaceae, Genus: Streptomyces
cacaacccctccggcggccagggcctcaacctcggggtgcaggacgcggtgaacctcggctggaaactggccgccggaggggttgtggatgtgcgcggcgtcgcctgccaggaacacccggcccacccggtaccggtcggcctgtcgggcggcgtcgccgaaccgcgagacccagacggcgtcccgcatgccgtggtcggtgcccgcgatgcggcggaacgtgtccctgaactcctcgaaggtgacgggcacttcggcgtcggccacggtgtcgtactggatggtcatcgcccggtacatccccgggctgtactccagcaccccggcctgcccgccggagaaccgggccagcaggctcggcgtcgcgggcgggttgtcgagggacacgtcggcgatcatcgcggtgagcgtggccggggtgccggggaagtccacgccgagcagccggcgcacggtgctgcggctgccgtcgcagccgaccaggtaccgggcgcgcagcggggcgccgcccacgatctcgacgcccactccgtcggcgtcctgggcgaagccggtgacctcggtgccgtagcggatctcgacgccgagttcggcggcgcgctcggcgagcagccgctcggtgtgtgcctgcgggatgagcagcatgtacgggtggcgggttccggcggcgtcgaggcgcagggggcgcagcccggcgaagtgagtggtgggggcccgcttgtgcccttcaaggaaacgctcggcgaggccgcgctggtccagcacctccagggtccgcgcgtgcatgccgagcgctttggaatgcggtacgcgctcgcgaagccgctccagcaccagtacgtccactccggccagccgcagctcgcacgccagcatcagtccgaccgggccgccgcccgcgatgaccacgtccgtcatggcccacctccccaatcttcgtgtgtcgcgtgtgtcgatggcgcgaggcttcggtgcgtgcctcgacgggtcatggtggcgggtgcggggagccgggaaggggccggaaacggccgactgcacccaaggaaccacggaaaaaattcgcggcgatgcgcggggatgcaccctagggtgcagatgcaccgtccggcgccggaaagcctcgtagcgtgctcgtcgtggccgagataaccaacggaatactcatcacgaagtcgcagcctcacgtcgcctttcgttacgcacggctttctctgatcgaggcgcgcccgaccgttcagatcgtcttcctgctgcggttcgcattgggcgccgcgttctccgcgcgtcaccacggtgcgcacctcacgcagctggcgatcgggactctcgcctggtggctggcggtggtcgccgcctacctcatcaacggcgtcatggacgtgaaggaggaccgcgcgaatgggtccgtgcgtccgatcgcccggggggagctgccggaaaggacggccgcattcatcaccgcgggcgccgcactcggttcactgctgctttctcaattcgtgcccggactcacgatgtggacggccgcattcctgttgctgggctggatctattcggcgccgccttttcccgcgaagcggtggagcagtgcgtgcgcggtggtggtgttcgggctcggctgggcctcgttcgcgggcggtgccgccaccgccggcggcgggcaggacgtggccgggatcgtcttcgccacggtgatgagtgcctggatggcgctcgtcggctcggtggtcaaggacctcagcgacgtcgacggcgacgccagcggcgggcgccgtacggtggcggtccgtcacggggcctggctggcgcgggcgctgggcgcggccggtgcgctcaccgtcggggcgggcgcggtgctggcggcgctggtgtgggcgccgttcacgctggtcgcgatggtgccggtggcggtcggggccgtctgcgtggtcgtgcagatcgtccgcaccgcccgcatcgagggcgccgacaagcggacccggcgcagcgcctaccgcgccttcatgcgcacccagtacacggccaacctcgtgatggtcgcggccctggcactgcacgcctggcagcggtgagcctgccggccctctccccgggagccggtccgcgatccacgtcgcgggccggctccgcggtgtgtccccgctcagcgcctgccgtaggccttgttgatggcgtcgatgcgggagtccgcctggagcttggcgtagatgttgttcaggtggcgtttcacggtcgccgtctcgatgccgaggtcacgcgcgatctggctgttggtcatcgctctcgcgactctctccagcacctgtctctcccgctgcgacagccccgcgcaggccgccggctggagccccgtctcggcctgggcgtccggctcggccacctcgaccaccaccggctcggacagcggcggcggggcggcgtcgtagccgacggcaccggcgtagagccggctctgggagctggcccggaacaccgtgctgatcagcagcagcgcggcggtgcggcgcgcctcggcctcgcaccggacggcgctgcgcacggccggctgcatggcgctccacaggatgtccaccgcacggaccgactccgccaccgcgatgccctgcgcggcccggtcggcacccaccccgtgcgagtaccggcgcgcctgggccggtgccggcggctgctgccccgtcagcgcggtgacgcagtcctcgatgatcgcccgggcctggtcccggcacttgggccaggcctccttgcgggtggccaacgggctgcggatcgcgtgcagcgcgctctggtaggagcggatgacgtcaggaatagccgtgcgcaggaactgcgcggcagccggataagacactggtcccccttcttcatgctccgccagtgaacggagcacaagcactgatgtcgccacccgacggcacgtcgacgggccgtgaggcagcacccacccaaggtagtccgctcgagaaccgcttgatatcggcttgtgatccgcgtcacgaaggaaacaggggccctcgttccgcatcgcactgaccagggcgcaggcggccacagccgtcaagtccactgcggtcaaggtcgttaccagggagggcaaagtcgacacggggtcgcgccgtgtgctactggacgatcttgccgaccgcacccgaccgcacccgaccgcacccgaccgcacccgaccgcacccgaccgcacccgaccgcacccggccgtggcggccgtgggcactcgccgccggtgggctgtcggtgggctgtcggtggcgggggcgggcgtcggtgggatgtcggcggtttgtcggtggtgggtgggatcgtcttcggcatgacgcgaatcgacaagaaccccggcggcgcgggcgacgccgtgacggtacggggactggtcaagcactacggcgagaccaaggcgctcgacggtgtggacctggacgtgcgcgagggcaccgtgatgggtgtgctcgggccgaacggggccggcaagacgaccctcgtccgcatcctgtccaccctgctcacgcccgacgcgggccaggccaccgtggccggctacgacgtcgtacggcagccccggcagctgcgccgggtgatcggcctcaccgggcagtacgcctccgtcgacgagaagctgcccggctgggagaacctctacctgatcgggcggctgctcgacctgtcccgcaaggacgcccgcacccgcgccgacgagctgctggagcggttctcgctcaccgaggcggcccggcgcccggcgagcacgtactccggcggtatgcggcgccgcctcgacctcgccgcctcgatgatcgggcggcccgtcgtcctctacctggacgagccgacgaccggcctcgacccgcgcacccgcaacgaggtgtgggacgaggtcaaggcgatggtcggcgacggtgtcaccgtcctgctgaccacccagtacatggaggaggccgagcaactggcctccgagctgaccgtcgtcgaccgcggcaaggtcatcgcgaacggcggcatcgaggaactcaaggcgaaggtcggcggacgcaccctgcgggtgaagcctgccgacgcgggcgagctgcgcccgctcgccgggatgctcgacgagctgggcgtcaccggcctcgcgaccaccgtcgtcgacagcgagagcggctccctgctggtgccggtcctcagtgacgagcagctgaccgccgtggtcggcgccgtcaccgcgcgctccatcaccatcagctcgatcaccaccgaactccccagtctggacgaggtcttcctgtccctcaccggccaccgcgccagtgccccgcaggacgcccgccccagcgacgaccgcgaggaggtcgccgtatgagcgccgtcaccgccgacgcccccgccgcatccaccgccgacgtccgcatcccgctgcgcgggcacctgcggcacaccggcgcgctgatccgccgcaacctgctgtggatccgccaggaccccgagtccatgttcgacgcggtactgatgccgatcgtcttcaccctgctgttcgtgtacgtcttcggcggctcgatcgggcaggcgctgggcggcggccagaaccagtacgtccagtacgtcatccccggcatgctggcgatgaacagcatgacgctgtcccagggcgtcggcacgggcttcagccaggacttcaacagcggggtcatggaccgcttccggtccctgccgatcggccgcggctcggtgctcttcgcgaagatcgcggtggaactgttccggatgatcttcgccacggtcgtgctgatgatcgtcgccgtgctggtgggcttccacatcggcaactggcccggcctgttcgcgaccgtgggcctgtccgcgctgttcgcctcgtcgatcatgtgggtgttcctcaccctcggcgtgatgctgaagaacgcgcagtccgtgcaggcgatgggcttcctggtgctcttcccgctccagttcggctcgtcgatcttcgcgccgaccaagtcgatgccgggctggctgcagcacttcaccgactacaacccgctgtccacgctcgccgacgcggcccgccgggctgatgctgggcgggccgcgtcggcgagcgt

SEQ ID NO: 574 - DNA, 934 bp, Unknown
  Kingdom: Bacteria, Phylum: Actinobacteria, Class: Actinobacteria, Order: Streptomycetales, Family: Streptomycetaceae, Genus: Streptomyces
  misc_feature (625)..(673): n is a, c, g, or t
gggctcgacgagttccaggccgtcgaagaactgcgcgaccccagcgcgggtacggaagccgaggcggatgccgcccttggcgtactcggcggtgacctgctccgccagctccgggtagatgtccgaggccgcgtgggacagcacgaggtagctgccggacgggagcgccgcgcgcaactcacggacgatgccgtgggccacctcgtcgtcggcgatgaagtgcatcagcgcgatcagcgacaggacgacggggcggtcgaagtcgaggatcttgcgggcgtgttcgaggatctgggccgggcggcgcacgtcggcgtcgatgtagtcggtgacgccctccggacggctgaccagcagcgcctcggcgtgccgcagcacgatcggatcgttgtcggcgtagacgatcttggccgtcgggacggcgcgctggacgatctggtgcaggttcggctccgtcgggatgcccgtcccgacgtcgaggaactggtccaggccgcgtgaggcgagccaggccgccgcgcggtgcatgaacgcgcggttctgccgggccgcgtcatgggcctcggggggcagcttgcggccgacggcctcgtccacggggtagttgtccttgccgccgagcagnnnnnnnnnnnnnnnnnnnnnnnnnnnnnnnnnnnnnnnnnnnnnnnnngccgccgagcagccagtcgtacacccgggcggggtgggccttgctggtgtctatctgcggggacgggaggtcgggggtgccggtcgccatggcggactccgtcgtgcgagtggatcgggcgggatgtcgatcaccgcagtctcgcacaccgtttcccttgcccgtaagcgagttggccgcctgtcggggccgccccgcgtcacggcgaggccggccctcggcacgaggccggccgtcggcacggcggcgccggtcgtgtga

SEQ ID NO: 575 - DNA, 2593 bp, Unknown
  Kingdom: Bacteria, Phylum: Actinobacteria, Class: Actinobacteria, Order: Streptomycetales, Family: Streptomycetaceae, Genus: Streptomyces
gacgggggtgccgtgggtggggcggtcggtgtcggtcatggtggtcacgccctgtccgcgacgcgttcgccgagcaggccttgtggcctgaagaggaggacgaggatgaggaggacgaaggcccagacggaggcccagccctggccgccgaactggtccatgccggggatgtcggcgatgtaggcggtggcgagtccttcggcgaggccgaggacgatgccgccgagcatggcgccgtagatgttgccgatgccgccgaggacggcggcggtgaaggctttgaggccggcgacgaagcccatgtcgtagttgacgctgccgacgcggaagccccaggcgacgccggcgacggcggcgaagaagccgccgatggcgaaggcgatgacgatgatgcggttggtgtcgatgcccatgagctgggcggtgtcggggtcttgtgcggtggcttgcatggcgcggccggtgcgggaggtgcggacgaagaaggcgagggcggccatgcagaggggggcggctatgaggacgaagagttcaccggactggagtttgaggttgtcggtgatgttgaaggggccgccggggagctgggggaatttgcgggcgttgtcggcgtgcgggtaccagttgaagacggcttgctggagggcgagggagaggccgatggcggtgatgaggggggcgaggcgtggtgcgcctctgagtggccggtaggcgaatcgttctgctcccactgcgatgaggacggcgacgaggccgccgccgatcagcatgagggggagggcgatccacatggatgtgccgtcgggcaggacgagatagacggtgagggcgccgaagccgccggtcatgaagatctcgccgtgggcgaagttgatgagctggacgatgccgtacaccatcgtgtagccgatggcgatcagcccgtacatcgagccgaggatcagcccgttggccagctgttgcggcagggtgtgcaccgcaaggcctccatgtgggtgcggagagtgacgggggagagaggtcgggccgcgcggtgacgggtcgtcgtggccgcgcggcccggggtggttcttgctggtgtcgggtcagccggcgttgtacgtaccggtcttgacggacttccacacgccgttggtgacttggtagagggtgagctgcttgttcttggtgtcgccgtactggtcgaagccgacggggccggcgatgccctcgaagtcgatcttctggagctggtcgacgacctgctggcgggcgtcggacggaaccttgccgtccttcacgacgttgccgatggccttgatgatggcggtggcggcgtcgtaggagtagccgccgtaggtgccgtagtcgcccttgtagccgccggacttgtacttgttgatgaagtccttggcggcgggcagggtgtcgacggggacgccgacggaggtgacgaggtcgccttcggcggccttgccggcggtctggatgtaggtcggggtgaacatgccgtcgccgcccatgagggggatcttggcgccggcgtccttgagctgcttggtgaggacctgcgactcgtcgtactggccgccgtagtagaggagttcggcgccgctgttcttgatcttggtgacgagggtggcgaagtccttgtcgccgacgttgacgtggtcggtgccgacgacggtgccgccctgctccttgaacttcttgccgaagatgccggcgaggccggcgccgtaggtctgcttgtcgtcgacgacgaagaccttcttcttcttgagggtcttgtagacgtagtcggctgcgaagccgccctggacctcgtcggtgatggcggtgcggaagtaggtcttgaaggggcggaccttgttgccggagacccagttcttgccctgggtcagctcgggcgcggtgttggacggggagatctcggcgaggttggcggaggcgaagaccttctgcatggtctgtgcgacgccggagttgagggggccgacgacgccgaggacgtccttgttggcgacgagctgggaggcgttctgctggccggtgggcggcagggccttgtcgtcgagggcgacgaccttgaaggtgacgccggggacgagtttcttctcgttggcatccttgacggcgatctcgacgccggactggatgccgaggccggtggcggagttctggccggtcaggggggcgtcgacgccgatgacaatggtggtgccgcccttgtcgctgctcttgtcgtcgccgccgcgggagccacatgcggtgagggccagagctccggttgtgaggacggaggtgagtatcaccagggaacgctgtcgcacaatcagtcctttccgcaggcatgaccgccctgtgtgggggtggcacatgtcgcgctggtaccgaactcccggtggagcggtgactggccgtgactctaagcctggttgtggccatgggcatggtggtgggctggcttgtgactttcttgttatgacgttccggttgatgggcttctcggaaggtcactctcggccgttttggcggaattcccgtgtggtccgcattctgagaatgcgcacttccggttggccgtcggcggggcgtggggcgcgctgggggg

SEQ ID NO: 576 - DNA, 8336 bp, Unknown
  Kingdom: Bacteria, Phylum: Actinobacteria, Class: Actinobacteria, Order: Streptomycetales, Family: Streptomycetaceae, Genus: Streptomyces
ctgtgccgcacgctcgttcaaacggtcccccgcgccttgaacgagcgtgcggcacagatcgtccccgctcatcccgccgtcccggtaggtgagccgggcgcccggcgagatcacgaagggcgggttggacacgatcaggtcgaacctctcgtcctcacggaccggttcgaacagcgagccctcccgcagatcggcggccgggaccccggacagggcgagcgtgagcgcggtgatgtgcagcgcgcgcgggttgagatcggtcgccgtcacgcgcgtggcgtgccggctcgcgtgcagcgcctggatcccggaaccggtgccgaggtccagcgcggagccgacgggcgtacggaccgtgagaccggccagggtggtggaggcgccgcccacaccgaggacgacgccctcctcgcggctgccgatgccacccgcgccgccgaccgcgcagcccaggtcggagacgatgaaccagtcctcgccgtcgagtccgccgtacggccgtacgtccacggtcgcggccacctcgtcgccgcctactcgcgtcagccagcccgtctccacgcaggcatcgacgggcaggacgtccgccacgcgcgcgtgcggcacgggctgctgcagcaggaagaggcggacgagtacttcgatcggcgtgtccccgcgcgtggcccggagcgcgggcacggtctcgctgcgggcgagcgccgcgtacgcgggcgcaccgagcagttcgagcagtccgtcggcggtgaacgacgcgtcgagcagggcgtcccggagccgggcggcgacctccggacggtcggcggcgggcagggcggtcggggcgggcaggctggagtcactcacgcacccattgtgtcggctcccaccgacatcgcacgcccgcggacgactcggccccgatgcacgcgtatccatcggccgacgcccgcgtacgacgactccggccgatacgctcgcccgtctccgccgacgcgcgcgtccgtctcggcacgcgcgcgtacccctgcgcatgtcttcatgaacgcgtacggccggcacgcgcgcgcgtgccggccgggtcacgtccaaggcggtggcccaggcgggtcacgcgtcagagacggtgcgtcagccgttcgccggtgaggcggtcgcggaggaggcggcggacggggcggacttgcagctcggctggttcgccatcgccttgccgacgtcgccctcctccaggttcttcagcgcgtcgttcccggtcttgctcagcttgtccagctgggtggcgatgtccttgagcccgtccgcgaacttggcctggtccttggtgtcgagcttgtccacctgctgcttgagcgaggcgtaggaggcgccgaggtcgttgagttccttgaccgcgtcctgctgcttcttctggccgccgtcgacctcgggcgcgccggccttgttcacggcggcgccgatcgccttgtaggcgtcggacatgtcctggaaggcctgggcgtcggtctcctggaccgtcttcgtcggggtgtcgtccgaggtctgcttctggatcgcggcgctggcggcctggatcttcttcgcctgcggctggacgccgtcgcacacctgcttggcccaggtgttcagggcgtcgttcttgccgtcgtcgctgctgccggagcatcccgtcagtgccagtgccagtaccgcaccgccggacagtgcggccgcgagcttcttgttcaccggatcggtcccttccatggctctcggccccggaacatacacgccgttcggacgcggccacggttcgatccagggtttgatcacccgttatccgccgtcttgccgccatttgcaccaagcgagagaaggctcaccaccaccggcacgcagcgggcgggcgaacaccgcgcacgcagcgggcgggcgacgcgtcgaacgcgccgcccgcccgctcccgagccggacccgccgtacaggccctgcgaacagttctacgaacagtcctacgaaacgaccgccggatcgaccgtcttggacacccgttcggcaccgtcctcgtcgtccccgacggcgataccgcgccgcttggagatgtagaccgacccgacgatgacgatcagcgcgaggatcgcgatcacgatccgtacgccgatgctcttgtcgtggccgtaggagaacttgatgaccgcgggcgcgatgagcagcgacaccaggttcatcaccttcagcagcgggttgatcgccggtcccgcggtgtccttgaacgggtcgccgaccgtgtcgccgatcaccgtggcggcgtgggcgtcgctgcccttgccgccgtggtggccgtcctcgaccagcttcttggcgttgtcccaggcaccgccggagttggcgaggaacaccgccatcagcgtgcccgcgccgatggcgcccgccaggtacgcgccgagcgcgccgacgccgagcgtgaacccgatgaagatgggcgccatcacggcgagcagcccgggcgtggcgagttcgcgcagggcgtccttggtgcagatgtcgacgacgcgcccgtactccggtttctcggtgtagtccatgatcccggggtgctcgcggaactggcgccgcacctcgaagaccaccgatcccgccgaccgcgacaccgcgttgatcgccagccccgagaagaggaagacgaccgcggcgccggcgatcagcccgaccaggttgttgggctgtgagatgtccatgatcagggtcatcggcgccccggcaccggacagtttcgccccgacgtcgctcgcgccggtggtgatggcgtcccggtaggacccgaagagcgccgaggccgccaggaccgcggtggcgatggcgatgcccttggtgatggccttggtggtgttgccgaccgcgtccaggttggtgagcacctgggcgcccgcaccctcgacgtcaccggacatctcggcgatgccctgggcgttgtcggagaccggaccgaaggtgtccatggcgacgatcacgccgaccgtggtgagcaggccggtaccggccagcgccaccgcgaacagcgccagcatgatcgacgtgccgccgagcaggaacgccccgtacacaccgagcccgatcagcagcgcggtgtagacggccgactccagaccgatggagatgccggcgaggacgacggtggccgggccggtgagcgaggtcttgccgatgtcgcggaccggccgcctgctggtctcggtgaagtagccggtcagctgctggatcacggcggccagcaggatgccgatggcgaccgcgaccagggcgaggatccgcggatcgccgcccttggctcggatcgccgcgtcggtgacgccggtcaggccggcgtaggacgacggcagataggtgtagacggccgccgcgaccagggccagcgagatcaccgcggagatgaagaagccgcggttgatcgcgctcatgccgctgcggtcggcgcgccgcggtgccaccgcgaagatgccgatcatggcggtgatcacgccgatcgccgggaccagcagcgggaaggcgagtccgtcgttgccgaaggccgccttgccgaggatgagcgcggccaccagcgtgacggcgtacgactcgaagaggtcggctgccatgcccgcgcagtcgccgacgttgtcgcccacgttgtcggcgatggtcgcggcattgcgcggatcgtcctccggaatgcccttctcgaccttgccgaccaggtcggcgccgacgtcggcggccttggtgaagatgccgccgccgacacgcatgaacatggcgatcagcgcggcgccgaggccgaagccctccagcaccttcggcgcgtccgccgcgtacacgagcaccacacaggaggcgcccagcaggccgagccccaccgtgaacatgccgacgacgccgcccgtacggaaagcgatcttcatcgctttgtgcgagacggtggtgagatccttttccggttcgccctgggcgggagtcgcttcccgggccgcggcggcgacgcgcacattgctgcgcacggcgagccacatgccgatataacccgtggccgccgagaatccggcgccgatcaggaagaacaccgaccgtccggcgcgctgattccagtcgtcggcaggcagcagcaggagcaggaagaacaccacgacggcgaatacgccgagggtgcgcagctgacggcccagataggccttggcgccttcctggaccgcttccgcgatcttcttcatgctgtcggtgccctcgccggccgcgagcacctggcgcaccaggacggccgcgaccacgagcgcggccaccgcgacggcggcgatcaccgccaccatgatccgattgtcgtcggtcagcaccgcggctgcgaaagttgtgggttgacccgactgatgaggggtaaaaagccccgccattcgtcctccttgacgcttgggctgagctcaagatgtggacggattgtaggtagctgaacccgatctaaacagtgtgcggtaaatggaatcagcccgcacatgcttcccagcaaatgatcgccgaccaccatggaacccgaaagtagtaatgcctcaaaagcattgacccttgatccattatcaggcaatcgatcgtgaatgaattcacgaaatcatggcgggcctgcgatgtccagcacttcgggagcctgaccggacacgcccgaaggggcccaggacgggcgaagggacgcccggcatgccgaagggccccgcaggtgcggggcccttcgcaacgatctgtgtcgcaggggttcgctcaggagaggacgacgtccggcggggccgtcggccaggtcatcttgatctgcccgccgtcctccccggccgagacctccacgtcgtcgacgagcccgctgatgaccgcgaggcccatctcgtcctcctcggcctccgcatcgtccacggcgcccggggcgtccccggggtggtgcggagcgtgccgggcctcgtcgccgacctcgatggagaactgtttctcctcctcggtcagcaccacggtcaccggcgccgcgatcccgccgctctgatgcagcccgacggcacgggagcaggcctccccgacggcgagccggacctcgtcgaggacggcctcgtcgaccccggcccggcgcgccaccgctgccgccaccagccgggcggtcctgacgtgctcgggcagcgcgctgaagcggagttcgacggtggccatgcatccccctaggagctacgggcgtgctgtcgaggggccgggccgccgagagtccggccccccgcatgaacttcttccgccccggacaccggcccggggccggcggtcagtcggtggccgccaccgcttcgtcgaccgaggtgtggatggggaacaccttggtcagaccggtaatgcggaagatcttgagaatgcgctcctggttgcagaccaggcgcagggagccctcatgggcacgcacgcgcttcaggccgcccaccagcacgccgagcccggtggagtcgaggaagtccacgccctccatgtcgacgacgaggtgaaaattcccgtcgttcaccagctcgaccagctgctcgcgcagcttgggcgcggtatatacgtcgatttcgccaccgacctcgacgaccgtacgatcgccgacggtacgggtcgacagggacaggtccacggatcctccagcaccttgctatcgagcggtcgcccctcgggcacctcggcttgaagcccccaggacggttcgccagccgcgatggcattcaatcacttaccggcaggcgtgcacgacgccttggctccattgtccgtcacgccggtgacacactcggtgccaatggccaagaatcaccgatccgatcgaaccccggcggaccacgcaacccgcctgccgccgggcgcggttctggaccggctcacctccggaccgagccgggcttcgcgcatcactcatacggagcacttgcccccgcgggcgggtcgccatgccgtctggccggaccggattcgtccggaggtcatcgccgccgtccaggcgtgcggcatcgagcacccctgggcccaccaggcgcgcgccgccgagcacgccctcgacggcgagtccgtggtggtcgccacgggcacggcgtccggcaagtcgctcgcgtatctggtgccggtgctgtcggcgctgctggagggttccgaggctcccaacggccggggcgccaccgccctctacctggcccccaccaaggccctggccgccgaccagtgccgcgcggtgcgggaactggcccggccgctcggcaccgcggtacgccccgccgtgtacgacggcgacacgccggtcgaggaacgcgagtggatccgccagtacggcaactacgtcctgaccaatcccgacatgctgcaccgcgggatcctgccgtcccacccccgctgggcctccttcctgcgcgccctgaagtacgtcgtcatcgacgagtgccacacctaccgcggcgtcttcggctcccacgtcgcccaggtcctgcgccggctgcgccgcctgtgcgcgcgctacggcgcctcgcccgtcttcctgctggcctcggcgaccgccgccgagccctcggtggcggcacgccgtctcaccggcctgcccgtggtcgaggtggccgacgacgcctctccacgtggtgaactggtgttcgccctgtgggagccgcccctcaccgaactgcacggcgagaagggcgccccggtccgccgcaccgccaccgccgagaccgccgacctgctgaccgacctgaccctccagggcgtgcgctcggtcgccttcgtacgctcccggcgcggcgccgaactgatctcggtgatcgcccagcaacggctggcggagatcgaccggccgctggcccggcgtgtcgcggcctaccggggcggctacctccccgaggagcgccgcgccctggagcgggccctgcactccggtgagctgctgggactggccgccacgaccgccctggagctcggcgtggacgtgtccggcctggacgccgtggtgatcgccggatacccgggcacccgcgcgtccctgtggcagcaggcgggccgcgcgggccgcgccggacagggtgccctcgcggtgctggtcgcccgcgacgacccgctggacaccttcctcgtccaccatcctgaggccctgttcgaccagccggtcgagtccaccgtcctcgaccccgacaacccctacgtcctcgccccgcacctgtgcgccgccgccgccgaactgccgctcaccgaagaggacgtcgaactgttcggtccggcgtgtgaggagctgctgcctcagctggaggccgcgaagctgctgcgccggcgggccacggcctggcactggacacgccgggagcgggccgcggacctgaccgacatccgcggcgagggcggaacgccggtgcagatcgtcgaggccggcaccggacggctgctcggcacggtcgacgaggccgccgcgcacacgagcgtgcacgagggcgcggtccacctgcaccagggccgtacgtacctggtgcgctccctggacctggacgactcggtcgccctggtcgaggaggccaacccgccgtacacgacggtggcccgcgacacgacggcgatctccgtcctggagacggacgtcgaggttccctggggcagcggccgcctgtgctacggctccgtcgaggtcaccaaccaggtggtctccttcctgcgccggcgggtcatcacgggtgaagtgctcggtgagacgaaactcgacctccctcctcgtacgctgcgcacccgcgcggtgtggtggacggtcaccgaggaccagctcgacgaggcccggatcaacccggagatcctcggcggcgccctgcacgccgccgagcacgcgtcgatcggcatgctgccgctcttcgccacctgcgaccgctgggacatcggcggtgtctccatcccgctgcaccccgacacgctcctgccgaccgtcttcgtctacgacggccatcccggcggcgcgggcttcgccgagcgcgccttccacaccgcccgcgagtggctcaccgccacccgcgaggccatcgcctcctgcgagtgcgacgccgggtgcccgtcctgcatccagtcccccaagtgcggcaacggcaacgacccgctccacaagagaggtgccgtacggctgctgacggtgctgctgaagggggcgcccgacaggcccgccgaggaggaggccggcccgccccggtgaacgtgcgccgggcctcctctccccgggacctggaggtcccgctctggcccggacccgtgccgcgaacgggccgccgcccgaggcggccgtgacgtccgagatgtcgccggtgaccacgcaccggacgaggcgggcgcgctgagcccgtgccacc

SEQ ID NO: 577 - DNA, 11924 bp, Unknown
  Kingdom: Bacteria, Phylum: Actinobacteria, Class: Actinobacteria, Order: Streptomycetales, Family: Streptomycetaceae, Genus: Streptomyces
gcccttgggggcgtgggccgagccgcgtacgccgatgccgctggaggcgggggcggtgcaggcggcgccggtgttgagcgcgggggcggtgccgaggtcgagaccgttgcggtagcgggtggcgccgtaaccggcggtgcagggcaggggtttgaagaaggtgacggccatgccgaagttcagttttcctccgtcgacggcggtggcgccggcggcgacggccgccgggtacttcacgagcagttcctcgatgccgtgctgccgggtgacggcgacctcggaggtggtgagcaggttggcgaggacgacgccaaggctcgggtcgaggtcgcgcaggacgccgctgatctgggtggcggcgtcgggggcgacggtgagcaggcggcgcaggtcggcgtcggagcccttgagggtgctcgcgagttccttggcgccggtggcgaagtcccgtacggcgcgaccctcttcggcctgggtgcgcagcacggtctcgccgtcgtcgatcagacgcgtggtggcgggcaggttgcggtcggcggcccggacgaactcgctgccgttgtcgaggaggacctggaggtcgtcgccgtggccctcgaaggccttgccgaactcgtcgaccacggtgcgcagatcgtccagcggtaccgacttggtgaggtcgttcacgctggtgaggacgtcggtgacgggcgcgggcacctgggtgtcgggctcttcgatacgggcgccgtcggcgaggtaggggcctttgtcgctctgcggccgcaggtcgatgtactgctcgccgacggcggacagcccggcgacgacggcctgggtgtcggccgggatgtgcggggcggacttcttgatgcgcagttccgcgacgacgccgtccccggtgaggtcgatcggtccgacccggcccaccgacaccccgcggtaggtgacgtccgagtgcgtgaacagaccgccggtgcgcgggagtcggacgtccacggtgtagtagtcggcgacgccgaggtagcggccgaggtcggcgtagcggatgccgacgaagccgaggacgaggacggcgatgacgaggaacgcgaggttcttcaggcgtacggcgagggtgatcaccttggctggcctccgtcctgggccgggctgggcaccgagggcagcggcagcggtgccgagggagagacctgcggggtggcggctccggccccggtcccggcagtggccttcccgcctcccccggacctggtgctcgctccggccttcccgctcttgtcggcacccggtgtgccgccgttcgtgccgcgcagggccgccggaggcggtgcggtcggcgacggcgaggagtcggcctgcggcaccagggccgggatgatctgcgtgcccggcagggcggtcatgttcaggtacacgttcaggtagtcgcccttgatgccgtgcagcacctcgtcggtgaacgggtaggtcaccagcgcctggagcgagtcgggcaggtcggtgcccgcgtccgcgagggccttgagggtgggggcgagtgccttgaggtcggcgaccatgtcgtccttgctggcgttgacggtggagacggcgacgccggacagcgtgtccagggaacggagcatggtcagcagggcgccgcgctgctcgtccagggtcttcaggccgggtgagaggccggtgaggacggtctggacgtcggtcttgcggtgggcgagggtggcggcgagccggttgacgctgtcgagggcgtcggtgatgtcgccgcggtgctggtcgaggtcggtgaccagcgtgttgacgcgctggagcatggagcggacctcgggttcgcgtccgccgatggcggtgttcagttccctggtgatggtcttgagctggttgacgccgccgccgttgaggagcagggacagtgcgccgaacacctcctcgacctcggtgttgcggccggtgcgggtgatcgggatcttgctgccgtcggtgaggtgccccgcggtggtgtccttggcgggggcgacgagctggatgtacttctcgccgagcaggctggactgttccaggcgggcgccggcgtcggcgggcagccgcacaccaccgttgatcttcatggtgacgctggctttccagccgtcgagacggatggcggtgacccgtccgacggcgacgtcgtcgaccttgaccgccgcctgcgggacgaggctgaggacgtcgtcgagttcggcggtgacggtgtaggggtgggagccgaggtcggcgccgccgggcagcggcaggtcctcgatgccgtcgaagtgcggggcgtcgacggagaacgcgccgaaggccagcgagaatccgagggccagggcgatcaggccgccgattccggctccgagggcagcgccgccggtgcgcagggtgcccttcacctctcccccttccccgcgccgccgtccgtggtcgcggcgccgccgctggcgggcagcggcagcagcgggccgcccatgctcagctcgttgaggtcggtgcggccgtcgagggtgcggtggtcggtgtcgtaggcggcgacgacgttgccggcggccaggggggcgtcgtccagtgcctcggcgagggaggcccgctgccgtacgagggtctgggtgatgggcaccagtttgtcgacgttcttcttcagttcgccgcggttgctctggatgaactgcttgacctggccgagtgccttgccgagttcggcgagcgccccggcgaggtcgttcttgttgtcggcgaagaagctgacgacggtgtcgaggcgttcctgggcggtgcggacgtcggtgtccttgtccttgagcatggtggtgaaggtctggagtctgctgagggtggcgaacaggtcgctgctggagccgttgagggtcttggcggccttgccgaactgctcgatgctgtcgccgatggccttgccgttgccgtcgaggttggcggcgccggtcttcagcaggtcggagagggcgccggtggcgttggcgccgtcggggccgagttccttgctgaggtcggtgatcgaggcgtagagctggtcgatctcgaccggggtgcggttgccggaggcgggcagcctggcgccgctggggagggcgggccccgaccggtaggcgggggtgagctgcacgaagcggtcggcgacgacgctcggcgcgacgatgacggcgtgcgcgccgcgcgggacctggatgccgtcgtcgagccggagttcgacgcgtacctgggtgccctcggggtgtacggacgtgacctctccggcccgtacgccgaggatgcgcaggtcggatccggcgtagatgccgacggcgcggtcgaagtaggcggtcaggcgggtgccgccggagtccaggacgcgggcgacggcgaggccggcggcgacgaccaccagggcgacggccgcggcgaggagtttcctgcgtctgctcatcactctccgctcccctgggccggcgccgactgcttcggcggcatgcagccggtctcgggctgggactgggcgggcaggtagtcgcgggggacgacgccgcacaggtagctgtcgaaccagcggccgttgccgagggtgttgccgatgaggcggtagtacgggccgaccagggccagggtcttgtcgagctgggtgttgttctcggcgaggacgtcggtgacgcggccgagtgccttgagggtggggccgagctgcttgtcgttgtcctggaccaggccgctgagctgggtggccagtgccctgctgccggtgagcagggcgcggatggcgtcgcggcggtccttgagttcgccgagcagcgagccgccgtcctcgatgagcgtctcgaagctggacttcttgttcttcagggtctgcgtgaagcgagcgcttccctggaggagttgggagagttcggcgtcgcgcttggagacggacctggacagggcggacaggccggtcgcggcgttgcgcacggcgggcggcgagtccttgaaggtctgcgagatggtctcgaagctcttggcgagctgctgggtgtcgatccggtcgacggtggagctgaggtcctggaaggcctgggtgacgtcgtacggcgaggtggtgcgggtcagcgggatgcggctgccggggtcctggcgggcgctgccgagcgggtcgagcgccaggtacttgtcgccgaggagcgtcttgatggcgatggcggcggtggtgcggtcgccgatccaggcgcccttggtctcgaagctgaccttgaccttgccggcgtccagggagaccgcggtgaccttgccgaccttgacgccggcgatgcgcacctcgtcacccttctcgagtccggcggcctcgctgaagtcggcgctgtaggtggtgccgccgccgatcaggggcagccggtcggcgttgtaggcgaagacggtgagcagggcgagcaggagcaggccgacgagggcgacggcgatcgggttgcgttccttgacgggcttgacgcgggggcggtgggtgcggcgggccttgacgggcggctcgtcggggcgggggcgttgcaggagtgtcatgcgccgcacctctgttccgtgaccgtgatgccggtcggcggcttggagccgtccgaggtgctgactccgctcacgcgcgcctcgcagaggtagaggttgaaccaggacccgtaggaggacagccgggccagcgcggtcatcttggcggggctcttggccaggaagttctcgatctggacggaggcgtcgccgaggttgccggagagccggcccagttcgcggatgtcctgcttgaggggggcgcggccgtcctggaggagtccggcggtgacggtggtcaggtcgcccatcgcggcgaccgcccggccgagcggtttgcggtcgtcgttgaagccgctgacgagcttgcggagggtgtcgaccagggtgtcgaagccggcctcgcggtcgttgagggtggtcaggacggtgttgaggttcttcaccaccgcgccgatgacctggtccttggcggcgacggtggtgctgagcgagccgatgtgccggatcaggctgtcgacggtgccgccctcaccctgcaggacctgcacgatcgatccggcgagttcgttgacgtccttcggggagagcccctcgaacagcggcttgaagccgttgaagagcagggtgagatcgagggcgggcgccgtgcggtcgagcgggatggtgtcgccggaggcgagggtgccgccgatgtccccgctgccccggtccagggcgatgtagcgctggccgaccatgttgaggtacttcacggcggcggtcgtcgagcggggcagggtgcggtcgtcgcggacgctgaaggtgacctgggcggtgcggtggttcacgacgcgtacgtcggtgacctcgccgaccttcactccggagacacgcacgctgtcgccgtcgacgagtccggtgacgtcggtgaacagggccttgtaggagcgggtgccgtcgccgacgccgcggttggcgacgctcagtccgagcacggtcgtggccagcgcggtgacgatcacgaacacgagggacttcagcagggggccggtcagcgggcggcggcgggtgtgcgtgctgcgcggggtggtcacttgagggtcacctccgtgccgcgcagggcgggaccggccagcaggctgctccagtccggcaggtcaccgggctgtttgccggcggccggggcgaggagttcgttgacgaggtcgttctcctggggggagttggcgggcccgaggtcctggctcgcggcggccgggacctgcgcggcgggctgtacgggtacgccgaggtagggcaccgggtagcagtgcgggccgccggaggcgtcgtaggagggggtgtcgcggccggggacgtaggcgccgcgcgagggcacgctggtgacgtcgacgtgcagtccgggctggtcggtgcccttgccgaggaccttgtccatccggggcacgaagtcggcgagggtgcgcagggtgcacgggaaggcggaggagtactcggacagcagccgcagcgtgggtttcgaggtggcgctgagccggatgatgttgtccttgttctgccgcaggaaggcggtcaggtcctcggcggtgcgggtggtggcgccgaaggtggcggccagccggccgtccttctcggccagggtgcccgtggtggtggtgaggtcggtgagcgcggtgacgatgtcgggcgcggcgtcggcgtagacctggctgaccttcacgagttctttcaggtcctcattgagggtgggcagctcggggttgaacttccgcaggtgcgcgtcgagtcgggcgagggtgtcacccagcttggcgccgcgtccttcgagtgcctgggagacggctgagagggtggcggagagtttctgcggctgtacggcggtgagcatgggcagcacgttgtcgagcacctgctggagttcgacggcgttcgcggaacggtcctgcgggatccgcgccctggcgtgcagcggggtgccggaggggtgcgggggcgggacgagggcgacgaaccgggcgccgaacagggtggtcgggagcatctgggcgcgcacgtcggaggggatgtcggccagtgcgccgggatgcagggcgagggtgagccgggcgccgtgctcggtggcgtcgatggagcggacctctccgacgacgacgccgcgcagcttcacctcggcgcccacgtgcatctcgttgccgacgctgccggtctccacgaccaccgagtcggagtcggtgaactgcttgtcgtagacggcgacggcgagccagatcagcagcgcgggcaccaccaggaacaccacgccggccagccggcggcgcaccagttcgcctgtgtgtctgctcatctcaccccgccaccttcacggtcgtggtggctccccacagggcgagcgagaggaagaagtcggtgaggccgatcagcacgatggcgttgcgcaccgagcggcccacggcgacaccgaccccggccggcccgccggtggcgcggtagccgtagtagcagtgggcgacgatcaccatcacgctgaagatgagcaccttcagtacggagagcaggacgtccgtgggcgagagaaacagcccgaagtagtggtcgtaggtgcctcgggactggcccttgaacaggacggtgacgtagcgggaggccaggtaggaggagagcagcccgatcgcgtagagcgggatgatcgcgacgacgccggcgatgatgcgggtggtgaccaggtacggcagggagcggatgcccatgccttcgagggcgtccacctcctcgttgatgcgcatggcgccgagctgggcggtgaagccggcgccgacggtcgcggacagggcgagtccggcgaccagcggggcgatctcgcgggtgttgaagtaggcggagacgaacccggtgaacgcggcggtgccgatctggtcgagggcggcgtagccctggagtccgacgacggtgccggtgaacagggtcatcgcgatcatcacgccgatggtgccgccgatgacgccgaggccgccggtgccgaaggcgacctcggcaagcagccgctgcacctctttcagatagcggtgcagggtgcgcggcacccacagcagggagcgcaggtagaacaggagctggtcgccggagcggtccagccagacgagcggggaggccacggcctcagcctcccttcggcgggacgatctggaggtagacgcccgtcatcaccatgttgacgaagaagagcaggaggaaggtgatgacgacggactggttgactgcgtcgcccacgcccttgggtccgccgcgcgggttgagtccgcggtaggcggcgacgatgcccgcgatgaacccgaagacgagcgccttgagttcgctgacgtacaggtcgggcagctgggcgagggaggagaagctggacaggtaggcgccgggggtgccgtcctggaggtacacgttgaagaagtagccgccgaggatgccgaccacggagaccagtccgttgagcaggacggccacgcccatggcggccaggacgcgcgggacgaccaggcgctgcaccggggagacgcccatgacctccatggcgtccagttcctcgcggatggtgcgcgagccgaggtcggcgcagatcgccgagccgccggcaccggagatcagcagggcgacgatgagcgggctggcctgctggacgacggcgagcacgctggccccgccggtgaaggactgggcgccgagctgctgggtgagcgagccgacctggagggcgatcaccgcgccgaaggggatggagacgagtgcggcgggcaggatggtgacgctggccaggaaccagaactgctcgacgaactcccggaactggaagggccgtctgaagatggcccggccgacctccgcgcccagtgcgaagagccgtccggtctgccgcagcgcgccggtgatcactggccgctcccgtgcgtgggcagcgtcagcgtgggcgcgccggactcggcgtgggtgcgctcgatggcggtacgtgcggcgggcggcagccggtcgagcatgcccatgacccgctcgcggcgccggtcgacggcgcggcgcggcggcaggcccggcgacggctccagttgcgggacgatctcgcggggcccggacggcaccggcacggactcggcggcgagggtggcggcgtccttctcctccgacatgccgatgggtccctcgcgccgggcggccaggaactgggacacgaccggttcgtcgctggtgagcagcacctcgcgcggcccgaaggtgaccagttcgcggcggaagagcatgccgatgttgtcggggacggtggcggcgatgtcgaggttgtgggtgacgatcagcatcgtcgcgtcgatctgcgcgttcaggtcgatcagcagctgggagatgtaggcggtgcggaccgggtcgagtccggagtccggctcgtcgcacaggatgatctgcgggtcgaggacgagggcgcgggccaggccggcccgtttgcgcatgccgccgctgatctcgccgggcagcttgccctcggcgcccagcaggccgacgacctcgatccgctccatgacgatgcggcggatctcggactccttcttgcgggtgtgctcgcgcagcggaaaggcgatgttgtcgaaaagggacatggagccgaagagggcgccgtcctggaacatgagcccgaagagtttccgggtctcgtagatgtcgtgttccggcccgttcaccatgtccaccccgttgatgaggacacggccgcgctcgggcttgaggagcccgatgagcgacttcaggaacacggtcttcccggtcccggacgggccgagcatcacactgacttcaccggccggaagggtgagggtcacatcctgccagatgttctgcttgccgaaggacttggtcagaccctcgaccaccacttcgattcccatatcacctccgacaagggtgggtcaggtgtgcaccgaggagcgcacgttaagtcggtgcacggctcactgacaataggcgggcaccgggttcctggtgcgctttccggctttgtcaccgcgcagacaaaaagcgttgcggcacttgtctccgggagacaggacagggccgcgcgcctccggggggagtggatccgcgggccctgcctgcgggcgaccggccctgaaggagggcaagggccggaaatcgcccgtcgcgtctccggccggcggggtgccaccgacctggagatcagcgccgtacccggcacgttacggccgagtaacctcggcgggcaagagcaggtccacggttttcgacgacattctcttcggccatccgaagtctgtcagggcggatataaaagggcggctccgatgtgtcatcgcactgcgtgtcgagcggcttggaacgtcatccggtcggcacattccggacttcccgcccgcactgacgggagaagtccggccccgtccgccttagcagcggatgactaagccggtacatcgactgctcaccgactggacagacggcggcccttttcaaagaatcatggtcggcggcattgttcggccaagtttcccgcaagtaacgtcggtgctcgcgatcgaggaattccgatcccccgggccgcacgactcccgctccatccgttccgtggcggcccgtctctgccggtcaatccccaaggagagtcccagagccatgaagaagtccatcagaaggatcgccgtcgtggcgggtgcgggcgcggcagcgttcggcatcgccgtcgcccccgcctccgcgaacgcctccacggtctggaccgtcaacccgacgccggccaacttcacggcgaccaacagcggcaacatcatgctgaccgccaacatccccatgacatgtacgtcctcgggcgcgtcgggcaccatggcgagcagcaccggcaacccgtcgcaggtcgccacgatcagcgcgatcaacttcggcaccgccacctcgccgtgcaccagcctgctgggcaacgtgacgacggtgccgaccacgccgtggaagatcatggcgaaggactacaacgccacgaccggtgtcaccaccggctacgtcgacaacatcagcgccaaggtgagcgccggcgcctgtgtcttcacggtgaccggcaaggcgtcgggcacctacaccaactcgaccggcatcctggccgtcaacagcgtctccggtgaactggtcgtcacctccgccaccaactgcggcacggtcgtcacgacgtccaccaagcccaccttcaagggcaactacgccgtcaaggtgagcggcaccagcaccattccgacgatcaagggctccaacccgtgagccctgcccgtccgctcgcgaccgcctgaccgggccacccccggccaggcggtcgccgcctggccggggcgcagcgcccaaggtggggccccggccggcgcggcctggcagaacgcccggaagaacgtcgggaagaacgggaagaaggagagtcacgcagtcatgaagaggtccctcggcaggatcaccctggtggtgggtgcgggcgcggcagcggccggcatggcggtcgccccggcgtccgccaacgcttccacggtgtggaccgtcagtccgtcaccggccgcgttcacggcggtcaacagcgggaacgtcatgttggtcgtcaacatccccatgacgtgtaccggatccagcgcgtcgggcaccctgtccggcggcaacggcaacccggcgaaggtcggcagcatcggcgccgtgaccatcggtaccggcacctctccttgcagcagcctcctgggcaacttcaccatcaggcccagcactccttggtcagtcgtcgcccagggctacgctccctcgaccggtgtcaccaccggctacgtcaacgacgtcaacgcccgcgtgtccatgggcgcctgtgtcttcaccatgaccggcagggcgtcgagttcgtacaccaactccaccggcatcctggccgtcgacagcgtccccggtgaactggccgtcacctccgccaccaactgcggcactctcgtcaccacctccacccagcccgtcttcaagggcgactacgccgtcaaggtgaccggaaccagcaccatccccacgatcaccggctccaacccgtgaggcagacacagatgacaggcccccaggcagaccgccgggcaacgcgccggatccgcgccaggaccgcgtcgaccgccgcgctgatcgtggtcgccgccatggtcccggtcgccgtcgccaccgcgggcccccagcaggtcgacaccgcgctcccctatgtgtgcgcgtttccctccggtcagcagcaggcgacggtccacgtctcggcgaccctcccggaccgcgtggaaccccgtgagccgatccggcccacggaggtcaccaccacggtggaactgccggccgcggcagcggccgacctgggcgtggcgaagggcggcgaggtgagcgccgccacccgcctgagcgtcgcggtcgcc

SEQ ID NO: 578 - DNA, 1960 bp, Unknown
  Kingdom: Bacteria, Phylum: Actinobacteria, Class: Actinobacteria, Order: Streptomycetales, Family: Streptomycetaceae, Genus: Streptomyces
cggtaccggccacggtgcggccggcccgtgccggcccgtctgtcgcgtgtgatcccgtcgacgcccacgcgcgtaccggcggccgggccggcatcggcgccccgccttcgccgtctaccgcagggcgatgccctcgacccagtcgtcgacggtgacgacgtccgcccactgcgggaacagcttctccgtgaggaaccggtggacctcggcgtcgaggtccaggcaggcgtcggacaggacggtgaggccgaagtcgaggtcgttggcctggcacagggtgtgcagcaccacagcgctggtggcgatgccggtgaggacgaggctgtcgatgccgcgcgccctgagcaccacgtcgaggtcgctgcccgagaacgcgctcgcccgcctcttggtgaccaccacctcgcccggcaggggcgcgacatcggggtggatggcggtgccggggtcgccctcgacatggagcccggcccgcgcgacggcggtgagcgccctgttgcgcgtaccgacttccggaaagcccgggcgcaaggcgatgaccacgtggatgacggggatgccggcggcccgcgcggcgtcgatggcccggcgcaggcgcggcaggtagccggagccgtcgtcggcgatgtccacgacggcccgttggacgtccatcaccagcagggcgctgctcgtacggtcgccagtagtcatacggtctccaggaacgcggtcagttcggcgtcgaagcgggccgggcgctccatgttcgggtagtgcgcggcgcccggcaccgtggcggtacgtccgtcggggacgagcttcgtcaggcggccggccgccgccaggtggtccggggcgtccaggccgccgttgatcgcgcacacgggcaccgcgatcccgggcgcacgctcccaggtggccgtgaccggcacccggtggtccggctcaccgagtgtgtgcttgccgagcgtgccgagcaccatctcccgtaccctgcgcagtgtttcggcatcgacgtcggccaggtcgcggtacgggccgacggtgaaccgctggaaggcgtcggcccagccggccacgtcgccttcggccagcgcccgctcctgggccgcgaagacgtccagcgcccacgggtcctcgaagacgggttcgctggtgccgacgccgctgacgacgaccgcgcggaccagatccgggtgttccagtgcgcagtcgacggcggtggccccgcccatcgagaggccgacgagtacggccggggccgcgtccagggcgcgcagcagtccggcgacgtcgtcggcgggccggaacgggccggtcgcgttgtccgagccgccgtgtccgcgggcgtcgaacgcgatgacccggtggcgcgcggcgaagtgcgggatctggtcctgccacatgcggtggtcgacgaagccgccgtgcaggaacacgaggggtggccctgaaccggcctcacggtaggcgagacggccgccggtggtctgcagtgaacggatcgggatggatgcgagatcgtcactcatgacaaccaaggtgtcatcacatcgccacgtcggcaacccagttggcaactcaggtgtcatgatggtcgcatggcggatgaacgcaccgcgcgacgccggctgactgccctcgccgcgccctccccggacgagctgggcgaacgcctcacggaggtcctcgacctggtcggcccgctctaccggcgggtccaccggaaggtggagcaggcagcaccggcggaaggactgccggtcggggtgcgcgcggtgctggacctgctgcgtacccgcggtcccatgacggtgccgcagatggggcgggcgcaggcgctcagccggcagttcgtgcagcgcatggtgaacgacgcggcgcgggacggcctggtgcggagcgtcgccaaccccgcgcaccgccgctcgtcactcatcaccctcaccgacgcgggccgcgccgcgatcggcgcggt

SEQ ID NO: 579 - DNA, 10378 bp, Unknown
  Kingdom: Bacteria, Phylum: Actinobacteria, Class: Actinobacteria, Order: Streptomycetales, Family: Streptomycetaceae, Genus: Streptomyces
  misc_feature (4046)..(4047): n is a, c, g, or t
tcgacgtgggcgccaaggcggaggtgcaggcactcgtcgacgaactcgccgaacagggactcgcggtgctgctgatctcctccgacctggaggaactgatcgagggctccgaccgcatcgtcgtcctcaaggacggccggaacgtgggccatctgcgcggcgaggacgtgagcgagcaggccgtgctcgacaccctggcgtccgcgtccggctccgcgtccggctccgcggacaccgaggtggcggacccgccaccggacgccggcgcagcaggccccggcccggcaccgcagcagcccgagggccggccggccacgacgaaggaggagccccgatgaccccgaccacctgggcagggcccgtcctgccggaccgcgccagactgctgcgcctgctgcaggcctacggcgtctacgcggcgctgctcgtgctgttcgccgtggccgccgccctggacacctcgttcctgtccgcgggcaacgtccgcatccagctcttccaggtcgccccgaccctgatggtcgcgctcggcatggccctcgtcatcggcacggaaggcgtcgacctctccgtcggcgccgtcatcgccctggccgcctcggtcgtccccctctacctcggctacggcgcaccgctcgcgatcctcctcgccctgctggccggagcggtctccggcgcgatcggcggcaccatggtggccttcgcgcgcatccagccgatcgtcgccaccctctccctcatgatcggcctgcgcggcgtcgccgaactgatcaacggcaactcggcgaaaccggtcaccgagtccgggctgctcggcctcggctcggacggtttcgcgggcgtcccggtcatggcgtggatcgccgcgctgtgcgccgtgctcaccgcgctgctggtccgccgcaccacgttcggccggcaactggtcgccatcggcgacaaccggcaggcgagcaaactcgccggcctgccggtacgccgcgtcctcgtcaccgtctacgtcctgtccggcgtcctcgccgccttcgcgggagcgatgatcgtcggccacggcgccgaggccgacccggccaaccagggcctcaacatggaactcaacgccatcaccgccgtcgtggtcggcgggaccccgctgaccggcggccgggtccgcgtcctcggcaccgtggccggcgccctgttcatgcagctcatcaccgccgtcctcacccagcacaacgtgcactcgtcctacacacaactcgtcgaggccgccatcatctgcttcgcggtctacgcctcccaggagcgtggtacacgatgagcaccgccgccccccgaccggccatgctgccaccgcggtccacgccccgggcggaacagccctccctgcgcgaacgcgcggcctcccacatccagcgccggggcgccctggccgtcctggtgctcatggtcgccatcgcctcggcgacctcctccaccttcccgacctggtccaacatcagcagcatcctcggcagcaacgccttcgtgtggctgctggccctcggaatgaccttcgtcatcctcaccggcggcatcgacctctccgtcggctccctgtacgcgctcggcggcgtggtcgccgcctacggcgcgcacaccggcggcacctggctggccatcgtccttccgctggcgaccggcgcgctgtggggcaccgtccagggactgctcgtgtcccgggcacggatggcgccgttcatcgtcaccctcgccggactcctgggcgcccgcggcctgctgcaggccctgacgaacgaaggcgccacgacctacctcgtcccggccgactccgccttccggcgtctgggcgaaggcacctgggtgccggtgatcaccgtcgccgtgctcttcgccctgggcgcgctcctgctcacccgcacccgcttcggcgccacggtcaccgcgatgggcggcaacgagaacgcgtccctgctgatgggactccccgtggcccgcaccaaggtcctcgtctacgtcctgtccgccaccctcgcctcggcggccggcgcactcggcagcgcgcgcctgggctccggcgtcaccaccatcggcgtcggctacgaactcaccgccatcgcctccgtggtgatcggcggcacgctcctgaccggcggcagcggctcgatcggcggcacggccagcggcgtgctggtgctcgccgtcatccacaacctgatcgaccactacttctcccagtacggatccgccttcaccgacacggtcaacggagccttcctggccctggtggtcctggcccagaccctgctcagccgcgcccggcagacggactgacccggcgcgcccgccggtgacgccgccctcgacagaaggagcccagtgggcgtcagcctgaaagacgtcgcacagcgcgccggggtatccgtcaagactgtgtcgaacgtcgtgaacaactatgtccatgtggcaccccggacccgcgcgcgcgtccagcgggccatcgacgaactggggtaccggcccaacctcgtcgcccgccacctgcgcaacggccgcaccggcgtcatcgcgctggccgtgccggagctgggcaacccctacttctccgaggtggccggagccgtcatcgacgcggccgcactgcacgactacaccgtcctgctggaccacacggcggggctgcgcgagaaggaggccctggtctgccagggctttcgcacccagatcatcgacggtctcatcctcagcccgatccggatcgagacggaggacctgctctcgcgcgccgacacctcacctctggtgctcctcggggaacgcgagtacgacgcacccttcgaccacatcgccatcgacaacgtcgcggcggcccgggccggcgtccagcacctgctcgacacgggacgccgccgcatcgcgttcctcggcgcccgccacgagagcgggcgcgaacccgcccacctgaggctgcgcggctggcgggaggcctaccggtcggcgggcctgaacccgcccgagtcgctcgtcgtcgccaccggcggttacgcccgccaggacggcgcggtcgccgtggccggcctgctcgaccgcggcgagcggcccgacgccgtgttcgccttcaacgacctgatcgccctgggcgcgatgcgggtcctcgccgaacggggcctgcgcgtcccgcaggacatcgcggtcgtcggcttcgacgacatcgaggaggcccgctacgcggccgtggccctgaccaccatcgcacccgacaaacaggccatcgcccggatcgccgtcgactgcctcgtggaacgcatcgcgggcagtaccgcgcccataccccggcgcatcctcccgggcttcgagctcgtggtcagggagtccaccctggaacgccgcccctgagcgggcacctcaccggccgccgctcagcgccgcgcgccggccagccggtcgcagaggtcgtccagcgttccgtacgccatccgcagctgcttggacccgtccgcggcgatggtcaactcgtagacgccgtcgacgcggtacagaccccgcgcgacgccgggggtgcccgccgcgaagccggtcacgaccggccccagcaccgaccaccgctgtgagccgtcggcgcggtagtccaccacggccgtgcccgaggcgtcggtgtcgtagctcgcacccgtgtcggtgtcggtgagccgcaccgtcagctctcccgcgtagacgacggtccgggccgaaccgtccgcggaggtgcgcagttcgcgctgcatcacatggtcgacgagcggggcgacatggaccgggaagtcacagcgcgcgcccgccggcacgtcgtacggggcctgcggcgcgggcgtccagccgtgggccgggaggggactcgcggccgagccgggagcggcggcgagtcccgccgtcaggagggacccgagcaggacgcagacgcctgccgttcgtgacgcacggttcactgttgcctccgactctccgggacaggacgagtcccagcatcccggcccgctcacggccggagcaacgctcgcgcaccacaagggcctgccgcgaccganntcggtcgcggcaggcccttgtcggggagttacggccggtcggccggcgggtagcccgtgggcgggtcgaccacggtcccgtacacgcgcatctcggcggctgccgcgaacggctggccgttgagggcgttcagcgcggtgaagcgcacataggaggcgcgcaccgacgggaaggagatccgctgcatctcgggcgagtcgaccagcgagcccttggccaccgtcgtccaggtgctgccgtcgtcggagacggccacctcgtacccggccacacgcccgttctgcccgccgctctgccggtccaggtagccgaagccgttcacgtcggccggaccgcccagcttcagcgtcacccagtgcgggtagggcgcggcggaggcggtgtagtcggtgtgccagatggtgcccggatcgccgtcgagcacgttggagaccggcccctcagccggccccgaggagaggttctccgagtcggcgctcgcccgcatcgagccgggggacagcagtggcacgctcgccaccgtggccttggcctgcgtcgacaccgtcttgccgactccggaaccggtgtagagggccgtggccttccacgtcgccgacgtgccggccgcgccggccggcggggtcaggatccaggtcgtgctgacgctctcgcccggcttcacccgcccgaaggcgttgccgtcacggtccttgaccatggcggtccagccggcgggcagcccgtccagccgtacgaggacgtccgtggcgtcggtctcctcgttgttggtgaacgtcgtgacgtactcgccgggcacgcccgggctcaggtcggtgccggcgggggtggtcacgctcgcgcaggcggcgcctccgtcgaccgggccgaggtcggtcacccggaagtcgtccagcaccatgtccgtaccgcccgcgccgccgagcttgcgcaggcccacccaggtgtcgccgcagcctgcgacgatctccttggagtacgtcgccgtctccagtgccggtgcgagcgcgtcacgggtgatgtccttggcgacggccttgccgtccccgacccggtccgcacccgtcacccaggcccactgcccgtcgacgttggtctggtacttgaacgagaccgcgtacttgtgaccggcgacgaacggcaccgtcgccggaaccgtgcggtacaccagcccggtgttctcctcgtgcgccttgagggagtggtcgccgtcgatgacgtcgtcgaccgcctgccccttcagcgcaccggagttgtacggcgcgtaggtgttcttccagctcttctggctgtacggcgcgtgcaggcggctcacgctggtgcgcgggtcggtcacgcctcccgcgtcgcccttcacgaacggcccccagcccggctggttgccctcgaagtcgtcctgggcgatcacggagccgcccggcgccggcgcggaggtgtccgccatgatccggacgtcgtcgacggtgaccgccgcgtccccggcggccgccccgatcgacacggtgacctgaccgtcggccggcgcggtgaaggcgacggaggcgcgttgcgcgtaggtgccctgcttggcatcggccgccaccgtgttgcgcagcggtgtggtgtcgaaaccgttgcgctcctgcacgccgtggccctgcgcaccgagggtgacggcgcggcgctgcccggcggcgacctcggtgtcggcgctcagcgtgtaccgccggccgggcgtgaggcccttgacgcgctgggagacgccggacgccccggcaccgagccgcagcacgttgtcgccggtgtccgtacgggcgagggccgccgtgccccgcgggttccagtccttgaggttcccggcgttgaagccggggtcggccacagcggtgccctcaccgtagtgggcgttttggtgcggtgcccggtcaccgttcggcgcgaggacgtagggctggtccttgtcgccggtgagcgtcaccttcccgtcctgggcgctgacctgcccgaccttcacgcggccctggtcggtgagcttgtagagggtgaagctccgggtggaggcgaactgctgcgtcagggcgaaggtgtgggtgccgcccgaaccgctgtagtagtacatcttgtcggcccggctcggcgaggaggttccgtttccgcccttcgcctcgccccagggcagcagatacgtgtcgccgtcgagcacgaccgcgccgtccatcgacacctgacgcctgccgtcgtccatggcgacgcggacgccgccggtgagcgtggcggacttcccgtagtcccagttcatgacctggtagtgctggaggaacttggtcggcaggttgtcggtccagatgttgcggtagaaggcgttgtagtcgtcgtggccggtccagccctcgaactccttgatgctgctgccgccgagcagcgggtccacgttccacacgtcgcggtcggagttggcgatgaaccgcacgatgcgggaattgatgcccttgttggtggcgccgccgtagttcttgtcgttggcccagtgcgaccacaccgagctgccctcgaacttgtacgaccactcggtggcgacctcgaagcccatcttccgcagctgcgcggccagtccgtcggccagccagccgctggagtagtaggcgtcgatgtagacggtcctgatcccgggcgcctccttgcggagctgcctgaaccggtcgaggatcgcaccgctgccgagatcggcgcgctggtcgatgtggtacgactggttcagccagtcccagccgcctggctggcccttgaccagcgcctcggtgaagttcttggcctgcgggtaggcctcggtggcgttcacgtgcacggcgaagtcggagttgtagccggcaccggccgcggtgagcttgttcaggtcggtgagcccgcccgcccgggtgttgtagttgccgccgtagtcgggatgggccgagtcgtggccctcgtcggcgtagcccttctccagcacccactggccgaggtcgtccgtggccatcgagatccgcttgacgttgtcgagcgtcttcaggaacggattggtggcctggctggcgaagttgaacgggatgtgctgcacgacgcgttcgggcacccggtccgcgccgagcgggtgggtcatacgggcccggtaggcgatcgcgccgtcctgccagtccgccgtcccgtcgccgttggcgtccccggagagcacgacggtggcctggggcagcgcgtacgtccgcacccgccggtcggtggcgccccggggcgcgtacgtgtacgagccgacggacagctccgcgcggcgcgcgccgttgccggcgtccacgatcctcgactgcaggcgggtgttccagttgtcgttgttgtcctgtgccgagtcgtcggtcgcgttggtgatgatgccggcggccagaccgccgtcgctcacgaacccgtagggcgtgccgacggcggccttgtccggtgccgtcgccgcggtgatcgcgacgaaccggtccgcggtggtggtcgagtccgccgatatcctcgtccgcgccagggtcgcctgcgcggcggaggagtcgaccgagacgagcgactggtcggggatggccagttggtcgacggtcgaggcggcggcgccctcgatgctcttgaccgcgaagacgaccgtctgctgctcggtcaccgtgatcgtcgaggtgatcgtcaggtccggcaggtcggcgaaggtggacgtgtagacggcctggttgccgcgcgccttcatggtcgtggtggcggtgtacgccttgccgttgacggtgaaggtgtccagtgcccgcgcctggccgccgagcgtcctgccgcccatcgtgtacgagatgacctgcgggaactccttggccacccggaccgtcagaccccgagcggtcagggtgaccggggtcgcggggtggtccggaggcgcgggaacggccggcggggaggcttcggccgggcccgcatgggccggcagggcaccggccgacagcgtgcccagggcgatgagcacggcggtcgcggcggcggcaccaggtcttgtccggccggtgcgccgggagcgccgggaatggtgcaggggcatgggttccacctgggggcttcctcgtgactctgaacgggtgagtgaggaagacagtaagggaaggttatcgataacagtaggggctgacgcctcttctttcgcggctcggtcccgggttgcggctgcaacccgggacctcatggcatcgataacagcggtacggcgcggcgaggggcggacggtcctggacggccgtccgcccctcgcgctgcgctcagctcaccgcgggagtgccgtacacacccatctcgtagatcgagtaaccccaggtggtgcggcgcttgacgccctgcatgcggatgtagccgacgggctgatcgccggtgagacggacgacgtcggtaccgcaggaggcgggagtctcggtggcggcggtggtccagttcacgccgtccatggaggtctcgacgcggtactcgctcgcgcaggcgctctcccaggcgagggtcaccgcggcgaccttcgcgggtgcggcgagcttgacctgcacccactcgtcgtcgctgtagcccgaggcccaccgggtcccggtgtcgtcgtcgttgacgtagcgggcggccagccggtcgaggttctgctccacgctggaggcgctcgcggtccccgccggggccaggttcccggcaccctgggcggagtcccacagctgcagcatcgtgtcggcctggacgaggaaggcgtcgaggacaccgtcgccgaccttcaccggggccttcccccaggcgttgcgcggcgggtcgacgagcaccgcccgggcctgctgctgaagcgtgcgggactcggtgagcagggcctgcgagcggtccgcgtcgccctggacgcgggcggtgagggcgtccaccatggacaccgccgacctgccccacagcgcggtggcgtccagccatggacgggcgtcgtctacgaagccctgctgcacggatccgccgcggatctccgcgggtgcctgttcgacggcggtggcgtacgcccgcagggccgccagcgcctcggtccgctttccggccttccactgcgaccagaacgccttgaggcgggcgctcagttcgggggcctgcggctgccacggcgtcgtcccgaaggtcggggcgaggtgctccaggtcggcgaagacccgcagggcggcggccgccctggcgtcgccgcccgcgaggtgggcgagggcctgcgtccaggtggtgtccgcgtcgtaggcgcggtcgttccagccgaaggaggccgagccgaagacggcgatctcgctggcgtagggctggttcatcgggttggcgacgatgccgctcaggtggtcggagaggccggcctcgcgtttgtcgtagggcgcgagcaggagccggccgctggtgttgccgtagtcgttgaccgggtagttgtcccagacgaagaccttgcggccgaacagccgggaggcggcgtccgcctgcgcgtcggtgatggcgggcggcacgacgtcggtgccggtccacatgacgaccaccgcggggtcgagtgcggcccgcagggcctgcttgtacgacgtgtcggtgaggtcgccgtactcggtgggcaccatctgcagcggctgggtgccggggtgggtggcgacgaaggtgcgctggacgtcgttcagcaggtccacctgggccttcgcggcggcggtgcgtccgggcgcaccgaaggccgcctggtccccggcgcagttccacttcgtgtagctgatgtcgtccagcgggagggagaacgcgcgtccgcccaggtcgtagaccgcctgcagcttcgccttcagcgcggcccggtcggcggggtcggagtagcagatggagccgcccggggagacggcgaaggtgaaccggacgtggttggcgtccgcccgttggatcagctgcccgagttcggcgagcttgtcggccgggtacggctggcgccacttgtcgcggtggtacgggtcgtccttgggcgcgtagacgtaggtgttggccttgacgtcgccgtagaagtccatctggtcgaggcgttcggcctgggtccagggccggccgtagaagccctcgatggtgccgcgcagcggcatggcgggacggtcgctgacctgggcgcccgcgatgcgccagccgtgaccggcccggacgaacaactgccgcagcgtctgcacggcgtagaactgcccggaggcgtccgtgccgccgagggcgacctccttgcgcgggccctgggagccgactcgcagggcgtagccctcggcctggctcgggacggccgtgccgtcgaggtccgcggcgatgtcgggcc

SEQ ID NO: 580 - DNA, 4532 bp, Unknown
  Kingdom: Bacteria, Phylum: Actinobacteria, Class: Actinobacteria, Order: Streptomycetales, Family: Streptomycetaceae, Genus: Streptomyces
gcgaagaccgcgaagaccgcgaagaccgcgaaggctgcgaagaccgctgcgacggccgagtccgcgaatccgtccaagaccgcccagcccgccaggacggcgaagtcggccaagtccgccaagccggccaagtccgccaagcccgcggtctcgaaggaaacgggcggcacggacgcggacgacgccgagcgtcaggagtcagcggagcgtcaggagtcgaccgacgactgagccatgacgacttggcaaagtcatgtacatgttcgaacgggtgagcgcagagtcgtccctgtccgtgtgatccaccgatccacgcgcgaagggatgactcatggcactctcccgttcggcacgtctgggggccgtcgcgaccgcggcggcctccttcctcgcggtcgccgcctcctcggcccccatccacggcgcccccggcatcggcgactcctacttccccgacctgggcaacggcggcttcgacgcccaccactacgccctcgacatcgcctacgacccaggaaccggccgcctcgacgggcgcaccaccctcaccgcccgcgccaccgagaacctgtcctccttcgacctggacctgcagaaactggaggtcacccgggtcgaggtgaacggcagacccgcgcacttcacacgcgacggcgacgaactgcgcatcaccccgcgcggcgtcctgcgcgagaaccgcaccttcacggtcaccgtcacctacggcggcataccccagccgctcagcggccccatcgtcttcggctcccagtacggctggatgaagaccgacgacggcgtcttcgtcgcctgcgagcccaacgccgcctccacctggttcccctccagcgaccacccctccgacaaggccacctatgacatccggatcaaggcgcccaagggcctgaccggcgtctccaacggccggctggtctcgacgtacgaccgcggcggttcgacgtacacgcactggcgtgagagccggccgatggcgacctacctggcgaccgccaccatcgggaagttcgacgtgcgcaccggcaggacgccgggcggcatcccgatgtacgtggccatcgacccgaagctgaaggacagcaacaaggtcgacgtgtatgcggtgaccgccgccgccaccgactactggtcgcaggtcttcgggccgtacccgttcgaggagaccggcgcgatcgtcgacgacatgccgcaggccgacttctcgctggaggtgcagagcaagcccgcctactcggcggtgcgcagcgaggggaccatcgtgcacgaactggcccaccagtggttcggcgactcggtgtcggtcaagcactggaaggacgtctggctcaacgagggcttcgccacctacgcccagtggctgtgggccgagcacaagggcacccgctcggcgcacgactccttccgcgccacgtacgacgccatcccggccggcgactccttctggcagaccaggccggccgacccgcagcacgacaccatgttcgccgacgcggtctacgaccggggcgccatgaccctgcaggcgctgcgcgaacgcatcggcgaccaggcgttcttccggctgctgcccgcctggacgagcctgcaccgctacggcaacgcgcagaccgccgacttcgtccggctcgcggagcaggtctccgggcagcggctcggcgacttcttccagaaatggctgtacaccccgggcaagcccacggtgtgagcgcgggcgggacgccgccgcgccctgagtaagaatgtggcgtgtcccagcaactgttcagcccctccgtccagcacacggtcgacgtcgtcggcatcttcgtgttcgccatctccggcgcgctgctggccgtccgcaagaacttcgacgtcttcggcatcgccgtgctcgccgaggtcaccgcgctgggcggaggactgttccgcgacatcatcatcggggccgtgccaccggccgccttctccgacctggggtacttcctcaccccgctgctcgccacgctggtggtcttcttcctgcacccgcacgtggagcgcatccagcgggccgtctacgtcttcgacgcggcgggtctcggcctgttctgcgtctccggcacgaccaaggcgtacgactacgggctcagcctcaccgcgtcggcgacgctggggctggccaccgccgtcggcggcggtgtgctgcgcgacgtgctcgccaacgaggtgccctcgctgctgcgctgggaccgcgacctgtacgcggtcccggcgatcgtcggcgccaccatggtcgtgctgtgcatccactacgccgcgctgaccccgctgaccagcgcgctcgcggcggtcacggctttcgtgctccgcctgctcgcgatgcggtaccactggcgagctccgcgggcgtggaaccggcgttcgaccgtccgtgaggagtaggcggctgcgcggtgtgcccgccgtggccgcccttgtggctcatctcgagggtcagccagcggaacacggtgggcacctggggccgccacagggccatgctgtggccgcccgcgctgcgcggcaggaagaccacgcgcacggtcgtcggcggcttcgcgatctgctccagcgccactccggcctggtagccgtcgccggcctcgccggagaggtagagcgcgatgcgcggcggcttgcggtccttcttcagcagcaggtaggggttgttggcccggcgcagggcggggttctgcgcggccagcgacgcgctctcgccgatcgggtcgttgtagccggacaggctcaccgcggcccggtagcggtcggggtgggcgacggcgagcttggtcgcgcagtgggcgccggccgagtagcccgcggcggcccagccgtcgggcgcggcctgggcgcggaagttgtcggtgatcatcttcggcacgtcgatgctcagccaggtgtccgcgttcacggtgcccgggatgttggcgcagcccgtgtccgccttcgcgatcacgttggtgcgcggggagaccaggatgaacggggcgacctgtccgctgcgcatcagcggttcgagctgctcgtgcaccctcatcgagccgaaccaggccttcgccgagccggggtagccggacagcagctccaccacggggaacttcttgtcgcggtaggcggggtcgtcgtactggggcggcagccagacgtagacctcggcgtccaccccggagacccggcccttcagctgggtgaccctgaccccgcccgccgcgtgcatacgggggccgtcggcctgcgagaacttctgctcgaccttgggcagcttgcggtaggcgatgccgccggtgccgtcggcgccgaggtcggcggcctgctgcacgtggttgcccgtgccgagcaggtcggaccagttgtcgtacaggttgttggcgttgttcaccaggacgaagaccagggtgatggcggtggcctgggcgaacagcagcatcagtgcccgcagggcggtgcgcagcaccttggggcccttggtgcgcgtccacagggcgaacggcaggaccagggccaccacggccagcgcgatggtggtgtacaggaacggagtcccggtgaggctcatatccccgtagagggaaaacaggggctccgggtttacggacgagtacggacacttaccgagaaattgccgacgttcacgcagtgcgggagccctgtcacgcaggcgacacaagagaaagctaccgcttagtagtttgctgttgtacggttcccgtatgccagatgcagcttccgccccggccgtacgggccacgatcggcgacagcgagttcgaccgggacaccgccgtcgtccggcgcgcccccggcgtctacgacaccggcctctcggccggctggaccatcatcaacgccgtcaacggcggctacctgctggccgtcctcggccgcgcgctcgcggacgccctgccgcacccggatcccttcacgatctcggcgcactacctgaccgcctcgcagcccggtcccgccgtcgtgcgcaccgaggtcgtccgcaccggccgcaccctctccaccgggcaggcctcgctcttccagcagggcgaggacggcaccgaggtggaacgcatccgggtcctcgcctcctacggcgacctcgacgcgctccccgacgacgtgcgcaccaccgccgagccgcccgcgatcccgcccctcgaacagtgcttcggcgccgacgacgggccggccccggtcgagggcagctccgccatcgccgaccggctgatgctcaagctggacccggccaccctcggctgggcgctcggcgcgccgtccggcaagggtgagatgcgcgcctggttcgggctggccgacggccgcgacgccgacccgctctcgctgctcctcgcggtggacgcgctgccgccgaccgccttcgagctgggcctgaagggctgggtcccgaccgtcgagctgaccgtccacgtccgctgccgtcccgcccccggcccgctgcgggtctcgatcaccacccgcaacctggccggcggcttcctggaggaggacgcggaggtctgggac

SEQ ID NO: 581 - DNA, 7945 bp, Unknown
  Kingdom: Bacteria, Phylum: Actinobacteria, Class: Actinobacteria, Order: Streptomycetales, Family: Streptomycetaceae, Genus: Streptomyces
tgcacgcccctgacaccccgccccgtcccgtccggcgcggggtgtcaggggcgtgcacggccggtccgggttacggcggcgcgccgtaaggtgagacacatgaacgatcgcatggtgtggatcgactgcgagatgaccggcctctcgctgtccgacgacgctctcatcgaggtggccgccctcgtcaccgactccgagctgaacgtactcggcgagggagtcgacatcgtcatccgcccgccggacgcggcgctggagacgatgccggaggtggtgcgtcagatgcacaccgcgtccggcctgctcgcggtgctggccggcggcacgacgctgaaggacgccgaggaggaggtcctcgcctacgtccgcgagcacgtgaaggagcccggcaaggcgccgctgtgcgggaactcggtcggcaccgaccgcggcttcctgctgcgcgacatgccggacctggaggcctacctccactaccgcatcgtcgacgtctcctccatcaaggaactggcccgccgctggtacccgagggcgtacttcaacagcccggagaagaacggcaaccaccgcgcgctcgccgacatccgcgagtccatcgcggagctgcgctactaccgcgaggccgtcttcgtcccccagccgggccccgactccgacaccgccaaggcgatcgccgccaagtacgtcctgcctgctcagcacggttagaagggtcccgggaaggggcgccgcgaaacacgtgcgcgagcaccccttcggaccctgtacactttttctcggccggtcggggaaacgacagattccaccgccaccggtcatggtgggtgtagctcagctggtagagcacctggttgtggtccaggatgccgcgggttcgagtcccgtcactcaccctgtgtggtcggccggtgaccgcgacgcaagtcgtgatcaccggccgatttccgtctccggtaccgggagtccagggggtccttgtgcgtgccgagccgttccctgcccagctcttccgtaccgctcgcctcgatctcgtgccgctgcgggtcgggcatgcccaggagatggcggcggtgctgtccgatccggccctgcacaccttcatcggcggtgcgccgctcggcggggccgagctgcgggcgcggtacgagcggctcgtggccggatccggcgacccggacgtctcctggtgcaactgggtgctgcggctgcgcgcggacgggcaggcgggcgggccgctggtggggaccgtacaggccacggtgcgcggccgggagctggccgagatcgcctgggtggtggggacggcctggcagggacgcgggttcgcctcggaggcggcgcgcgggctggtcgggctgctgcggcagggcggcatcggcgcgttcgtcgcgcacatccaccccggacaccacgcctccgccgccgtcgccagggccgccgggctcatcccgaccgccgaggagcgggacggcgagaccgtatggcggctgcgcctcaccgggtgaccgacgggggcacgccgccggctcccccgcgacatcacccgccagggcgctgccccggacggtccccggccggcaccgctcccggctcggcccgacgaccccgcgccccggacggcggccggctcagcctgacttccgcaccaccagctccgtcgggagtaccgcgtggcggggctgccagccgcgggtggccgcggggcggcggtcggcgatctcggtgaggaggaggtcgatcatggcgcggcccatctcctggatgggctggcggacactggtcagcggcgggtccatgtggcgggcgatgaccgagtcgtcgtagccgaccagagccacgtcctcgggtgtggtgcggccccgctcgcgcagtacctggcgggcgccggccgcggtgacgtccgagcccgcgaagaccgcgtccaggtcgggctctcgcgccagcagccgcgtcattgcgcggcgtccgccctcctcggtgaagtcgccctcctcgatgaggagttcaccgacgggcagacccacgtcgcacagggcgtcgcggtagccgtcgacgcgccgctgggcgccgtagacgtccatgcggccggtgatgtgggcgatgcggcgccggccgcccgccagcaggtggtccaccgccgagcgggcgccgccgtagttgtccgagtccaccgaggtcagcgtctccgcctcggagcgcgggccgctgatcaccgccgggatctccagctgggccacgaggtcgggcagcgggtcgtccgcgtgcacggacaccaacaacaccccgtccacccggtgtgcggccagatactgggcgagccggcgccgctcacgggcaccccccgcgaagatcagcagcaactgccagtgagtgtcggacagcccggcgccgataccgcgcagtatgtccgagaagtacggctccgcgaagaaccgggtctccggctcggggacgaccagcgcgatcgcatccgtgcggttggcggccagggcgcgcgcggcggtgttggggacgtagccgagttcagcgaccgccgcctcgacggccgcgcgggtggcggcgctgaccctgggtgagccgttgatcacccgtgagacggtgccgcgaccgacaccggctagcgcggcaacctcctcgagcgtcggccgaccgccgccgcggccccgcactccgtggcttgccatgggctccgccttcccaccgttgtcatcaccctggcctggaatctaacagtcccgccggggacccgaccgccccccgccgcccttgccgggagccgagcgcggccggttttcccgaagcggccgagaaccgccgatcgaccgagaaccgctggtcggcggagagccggctaacaggctgataactgaacgcatttctcgccgccggcgctcttgacaccctctcccgaaccggcgagtcttcacgacatcactcatgggagcgctcccatggtacgtcacacatacacaacccgtacgttccccgcccgagccgcagcgacacggggcccacacacagttggccgggggcaggcacgtcagggcaacaggaggacgcaatgcgagtacgtttccgcatcgcccgcaaggcggtggttctggcggcagccgcgtcgctgggcgccgggctgctggccggctgcgccagtgacgacggggacaagtccggctcgtcggacggcggcggcagcggcagcggcagcggcaagaccacgctcacgatgggtctcttcggcacccagggcttcaaggaggccggcctctacgccgagtacgagaagctccaccccgacatcaagatccaggaaaccgtcatcgagcggaacgagaactactacccggcgctggtcaaccacctcaccaccaacagcggcctgatggacgtccaggccgtcgaggtcggcaacatcaacgaggtggcgaccacccaggcgagcaagctcgtggacttctccaaggtctcgggcgtggacaagagcaagtggctcgactggaagtggcagcaggccaccaacaaggacggccagacggtcggcctgggcaccgacatcggcccgctggcgatctgctaccgcaaggacctcttccagcaggcggggctgcccacggaccgcgtggcggtcggcaagctgtgggccggtgactggaacaagcttgtcgacgccggcgagcagtacaagaagaaggccccgtcgggcacctacttcatggactcccccggcggcctgatcaacgcgatcatgagcagcgagaaggagaagtactacgactcctccggcaaggtcatctacaagacgaacccggtcatcaaggcggacttcatgctggccgcgaaggccgccaaggacggactggtccagtcgcagacgcagttccagccggcctgggaccagaccgtggccaacagcaagttcgcgacggtcgcctgcccgccctggatgctcggctacctcaagggcaagtcgaagccggagtcggccggcaagtgggacgttgcgcccgcgccgaaggccggcaactggggcggcaccttcctggccgtgcccaaggccggaaagcacgtgaaggaggcgcaggcgctcgtcgagtggctgaccgccccgcagcagcaggccaagctgttcgccgcgcagggcagcttcccgagctcgccggccgcgtactcgctgcccgaggtgaagaacgcgaagaacaccatgacgggcgacaccccgatcggtgagatcttcgccgaggccgccaaatccatcccgctgcagccgatcggtccgaaagaccagatcatcggcgccggtctgggtgacaacggtgtcgtcctggtgacgaagggcaagtcgcccgaggacgcctggaacacggccaccaagacgatcgacaacaacctggagaagtgaccggcatgtccccccggcacgacaccgccgcgctccccgtcgaggacgggggcgcggccccggcccgcgctcaggcggcgcccctgtcggaggccgagacgaagcgcagggcacggctctcccgtcgctggcagcgggacatccgctggagcccgtacgccttcgtctcgcccttcttcctgctcttcgtcgcgttcggcctgttcccgctgatctacaccggctgggcctcgctgcacacggtggagctgaccgccccgaccgacatggagtgggcgggcctgcgcaactacacccggatcttcgacgacgacttcttctggaacgcggcgaagaacaccctgaccatcggcatcatctccaccgtcccccagctggcgatggcgatgggcctcgcacacatcctcaactacaagctacgggcgtcgaccttctaccgggtcgtgatgctcacgccgtacgccacatcgatcgccgccgcctccctggtcttcgtgctgctgttcggccgcgactacggcgtgatcaactgggcgctgcaccacatcggcatcgggcccgtcgactggcagaacgacaagtggccgtcgcagatcgcggtctcatcggtcgtggtctggcggtggaccggctacaacgccctgatctacctggcggcgatgcaggcgatcccgaacgacctgtacgagtcggcggcgctggacggcgccaaccgctggcggcagttcttccacgtgacgctgccgcagctgcgcccgacgatcctgttcaccaccgtggtgtcgacgatcggcgcgagccagctgttcggcgagccgctgctgttcgactccatcaagggagcctccggaggcagcgaccaccagttccagacgctgggcctctacctgtacgagcagggctgggtcaaccagcacctgggccgggcctccgcgatcgcctggaccatgttcctgatcctgatcctgatcgggctcgtcaactacgtcatctcgcgccggctgcgtgccagcagttaggagaaaccgccgtgacgacgactatgacgaaacctgacgccgaagcgcagccccggaccaggcgggtggggcgcccgaagtcggcccgcgccggcgggcagatgcacgccggtcccgtggcgtacgtggtccttgtgctgttcaccatcggctcgctcttccctctggtgtggagcgccgtcgccgcgtcccgcgacaacgcacggctcgcgcagacgccgccgccgttctggttcggcgcgaacctcggccacaatctccaggtggcctggaccgaggccaatctgggcaccgcgttcctcaacaccacgatcgtggcgggggtgtcggcggccacgatcgtcttcctgtcgacgatcgccgggttcgccttcgccaagctgcgcttcaagggccgcggagccctgatgctcgtcgtggtcggcacgatgatggtcccgccgcagctcagcatcatcccgctgtacatgatggtggcgaagctggactggaccgaccagctccaggcggtgatcctgccgtcgctggtcagcgcgttcggtgtgttcttcatgcggcagtacctgatccaggccctgccggacgagatcatcgaggccgcccgggtggacggcgcgagcagctggcgcgtggtgtggcacgtggtgttcccggcggcccggccggcgatggccgtgctgggcatgctgacgttcgtgcagacctggaacgacttcctgtggccgttcctggtgctgacccagaacggcagcccgaccgtgcaggtcgcgatcgccggactgggccgcggctacacccccgaccagtccctgatcatggcgggcgcgctgctcggcactctgccgctgctgctggtcttcgcactgttcggcaagcagatcgtgggcggcatcatgcagggcgcggtcaagggctgaccgccagtcctccgggcagcggcaggccctcgggcgccccgtggggcattccggggcccgccgcgacccgtccgtttcctgccttcctcgcccttcccccttttctctttgcttccttccttccgaccgttcgttttcccgatctcccttgggagcgcttccatgcctgagtcagcacagccggcgaacccggtgacctttcctcccgccttcctctggggcacggcgacctccgcctaccagatcgaaggcgcggtgcgggaggacggccgtacgccctcgatctgggacaccttcagccatacaccgggcaaaacagcgggcggcgacaccggtgacatcgctgtcgaccactaccaccgctaccgcgacgacgtggccctcatggcggacctgggcctgaacgcctaccgcttctccgtctcctggccgcgtgtgcagcccaccggccggggccccgccgtgcagctgggcctcgacttctaccgccggctggtcgacgaactgctgtcgcggggcatcaagcccgcggtcaccctctaccactgggacctcccgcaggaactggaggacgcgggcggctggccggagcgcgagaccgcgctgcgcttcgccgagtacgcccagatcgtgggcgaggcgctgggcgaccgggtggagcagtggatcaccctcaacgagccctggtgcagtgccttcctgggctacggctccggtgtgcacgcgcccggccgtaccgatgctccgtcctcgctgcgcgccgcgcaccatctgaacctggcgcacggtctgggcacgcaggcgctgcggtcggtgatgccgagccgcaactcggtcgccgtcagcctcaactcgtcggtgatccgcaccgtgtcgcaggaccccgcggacctggcggcagcccggaagatcgacgacctggccaacggcgtcttccacggcccgatcctgcacggggcgtatccggcgtcgctgctggaggcgacgtcggcgatcaccgactgggcgttcgtccaagacggggacctgcagaccatcaggcagccgctggacgcgctcggcctcaactactacacgccgacgctcgtgtcctcggcagcgtcggcgcccgagggcccccgggccgacggtcacgggacgagcgagcactcgccgtggccgggagcggacgacgtggccttccaccagacgccgggcgagcgcaccgagatgggatggtcgatcgacccgagcggcctgcacgagctgatcatgcgctatacccgcgaggtcccggggctgccggtgtacatcacggagaacggcgcggcctacgaggacaaggtcgacgctgacggccgtgtgcacgatccggagcgcatcgcgtacctgcacagccacctgtccgcggtgcagcgggccatcaccgacggggcggacgtccgcgggtactacctctggtccctgatggacaacttcgagtggtcctacggctacgccaagcggttcggtgcggtccacgtcgactacacgaccctggagcggacgctgaagtcgagcgggcagtggtacggccaggcggcccggacgggcgtgcttccccaggtgcccgcggtctgatcccgccggttcgg

SEQ ID NO: 582 - DNA, 2874 bp, Unknown
  Kingdom: Bacteria, Phylum: Actinobacteria, Class: Actinobacteria, Order: Streptomycetales, Family: Streptomycetaceae, Genus: Streptomyces
gggtacgcggcgctgctgcgacggctgcgcgaggagtacgcggccggcagcgcggagacggtctacgcacccggcttcgaacgtgtcctcgaacagccgctggcgggcgcggtcccggtgccgccgccgacccggctggtcgtgacggagggcaactacctgctgctggacacgggggcgtgggcgcgggtgcgcccgcaactggacgaggtgtggttctgcgacctcgccgaggaggaacgcgtacgccgtctcgtcgcccggcacgaggagttcggcaagcaccacgaggaggccgtcgcctgggtcctgggcaccgaccagcgcaacgcggacctggtggcggggacccgccggcgcgcggatctgatcgtcccggagaccgtccttcccggcgcctgccggctcctgccgccgccgtccgccgggccgtccgtccggccggcctgcggaggtcccgccgcgtccggagggcccgcgacgtccggagccccggcgacgcccggatcccctcgcgcgagcaccgcccatgacagtgagtgagctatgttgaaacgctgtgggagacaaaggaggcgcctcggtgccatcgccgcagcaggctcgcgcgcaggcgtccgccatcacctcgggcaagccggtcacgcggaccgaggccgctccggcgtcgcagctcagggcgctcttcgaccgtccgcagctgtctcccgggcagcgccgcatcgcccagtacctgatcgagaacatcgcggaggcggccttcctgccgatcaccgagctggcggaccgggtgggggtcagccagccctcggtgacgcggttcgccgccgcggtcggcttcagcgggtacccggcgctgcgtgagaagctccagtccatcgcgctgaggaccctcgccggcggccccggcgcggtcgaggaggaccggggcaacgaactccaggcggcggtcgacgccgagatcgagaacctggagaacctgcgccgcgacctggccgatccggagcgggtgatcgccgtcggccgcgagctgtcgcgctcggcgccgctgaccgtgctcggactgcgcatctcggtctcgctcgccgagtacttcgcctacgccgcccggcgcatccatccggacgtgcggctggtgaccctcggcggcaccgtcgcctacgacacgctcctgcagtcccgtgaggccggcgggacgtgggtgctggccttctccatgccccggcacgcgcaggagaccctgacggccgtccgggtggcccgcggcgccgggctcaaggtagccctgatcaccgacctggcgctggggccggtggccgacgaggccgacgtcaccttcgccaccggcaccggctcccggctggtcttcgactcctacgccgcgcccggcatcgtgtgcgccgcgctgctgcaggccatgacggacgccgatcccgagcggacccaggcccgcctggaggcgtacgagcagatcgccgaccagcaccagttcttcctcaaggagtgacctggtccttcggcgaggagagaccaggagtgaccgggcggtcacctgcgcgccacgcgccggaagtggtcggaacgcaaggggaccaggcaccgcattccgggcatgaatgttttcatacgccttgccaagcggacggcatatataaatactgctcacggatcgcggcccggcggccccgcgccgcccgccctccacgacgccgcacacccggaagcgatgatcatgcctgtgacgaccacgcgcgtcagcccggactggccctgccaggtcaagccacccggcagctacgactgggagcgctcggcgaccaggtggctgcgcgaactggtgcccgcccgctacgccagttaccccgtgctgctgcgccatcccgtgctgctcgcccggcacgcgcagatccaggtccagcaggaggtccgggtggcccgcaccgccctgcagaccgcacgcgccgacctgccccgcctcggtctgcccgagtcggtgatcgagcacacgatcaagctgtacgccgctgagctgctgcagctccagcacatcgcgcgcagcgtacgggccgtgaccgacgctctgatggagcgcggcgccggccgctgagaccagctgcagcgcggcggagccgccgccgtgagcaggccgcggaccagggagtgcgtcaagtttgtgatcaggccgagagcggactgggccatatgtgcgatgctcgtcgcgtgaccggcgaatccgtttcccccatggagcccggcgccgtacccgacgcagcggcgccggccggcggggtgccctggcgacgtgcggaacccgaccgacagcggacgcgcccggaccggccgcagaccgacccggaccggacgcaggaggcggcggaggtctcggtcgtcgtcgagcgggccaagggcgccctgatggcgctgaccggctgttcacccgaggccgcgcacgaggacctgctgcggcgcgccaaggccgcgcaccgcacactggtggaggagtgccggatcacgctgggcaccctggtgcccccgctgagccatgccacgggcaccggggagaccgacggcgtcgccgttctcgccgggctcggccgggccctcgtcgcggtggagacaccgcaggacctcgccgtgtgcctgcgggagcacctcgcgacgcccgtcggcgcggacgccgtggtcatctaccggccgctgcccgcgggcgggctcacgctgatcgggtacgccggggcggacgagacaccggccggcctgtggcggcacgtgccaccgggcagcccgagcgcggcactggacgccctcgcggccggggaaccccgctggctggaggacctcgccgaggacgggaagcgctccctgccggccggt

SEQ ID NO: 583 - DNA, 3588 bp, Unknown
  Kingdom: Bacteria, Phylum: Actinobacteria, Class: Actinobacteria, Order: Streptomycetales, Family: Streptomycetaceae, Genus: Streptomyces
tccccgaggtcctcggcgcgcagcgcctgcaccagggccgtcacctgctcggcgaggcgcgccgagacctcggggagccggcggcgcacgatggccagttctcgggcgaagccgggatggtcgaaccagtggtacaggcagcgccgcttgagcgcgtcgtgcacctcacgggtgcggttggacgtcagcacgaccaccggcggcacctccgcccgcagcgtgcccagctccgggatcgtcacctggaactcggacagcacctccagcaggaacgcctcgaactcgtcgtccgcccggtcgatctcgtcgaccagcagcaccgacggctgggtctgcaacgcccgcagcagcggccgggcgaccaggaaccgccggtcgtacagctcgcgttccagccggtcggcgtccttgaccccggccgcctcggccgcccgcaggtgcagcagctggcgcgggaagtcccagtcgtacagggcctgcgaggcgtcgatgccctcgtggcactgcaaccggatcagcggcgcgtcgagcgcttcggcgagggcggtggcgagcgccgtcttgccgacgcccgcgtcgccctcgcagaagaccggccggtgcaggcgcagcgccaggaagcaggcgacggcgagcccgtcgtcgacgaggtagccggtctgctccaggcgggcccgcgcctgctcggggctgtcgatgggggtgatcggcgctcaccccgtcccggtggcggccaggaccgcccgctcggtgagcacccgggccaggtgcgcccggtactcgggcgaggcggaggcgtcccgcgagggccgggtgccgtcggccgccgaccgggccgcccgcgccacggcgtcggcgtccccggcacccgtcagcgcctcctcggtggccgtggcccgcagcggggtcgctcccatgttggtcagggcgatccgcgcctcggtgatctgcccgccctcgcgccggacgagcgcggccacgccgaccatcgcccaggactgggcgacccggtggaacttctcgtaccggaagtcccagccgccgcgcttgggcacccgtacctccgcgagcacctcgtcgggcgcgagcgcggtctgcaggtagtcggcgaagaagtcccgcaccgggatcgcgcgccgcccgcccggcccgacggcgaccagctcggcgtccagcgccagcgccaccgcgggcaggtcaccggccgggtcggcgtgggcgagggagccgccgagggtgccccggtggcgtacggcggggtcggcgaccgtctcggtggcctgggccagcagccccgcgtggcggcgcaccagcggatcgtggaccacctcgtggtgggtggtcagcgcgccgatgacgaggctgtcgccgtcctcgcggatcccgcgcagcccggggatccggccgacgtcgacgaccagttcgggaaaggccaggcgcagccggagcagcggcagcaggctctgcccgcccgccaggaccttggcgtcctcgcccgcgtcggcgagggcgcgcacggcctcgtcgagggtggcgggccggacgtagtcgaacgcggggggaatcatgccgaggcctcctcgtccgcggcccgggacgaccgtgcgtcccgcaccgcctcccagacccgctccggtgtgcagggcatcgccacgtcgtgcacgcccagcgggcgcagcgcgtccacgaccgcgttgacgacggccggggtggaggcgatcgtgcccgcctcgccgacgcccttgacgcccagcgggttggagaccgccggcgtctccgtgcggtcggtcacgaaatcgggcaggtccgccgccgaggggaccaggtagtcggccatggtgccggagaccaggttgccctcggtgtcgtagaccgcctcctcgtacagcgcctgcgcgatgccctgggcgaggccgccgtgcacctgcccctcgacgatcatcgggttgatcacccggccgacgtcgtcgacgcagacgtaggaccggatgcgggtctgcccggtctccgtgtcgacctcgaccgcgcacaggtgggtgccgtgcgggtaggagaagttctccgggtcgagcacgtgttcggcgttcagggtgggttccatgccctcgggcacgtcgtgcgaggtgaacgtctcgaaggcgacctcctggatggtcttccgggcgtccggcgagcccttcacggcgaacacgccgcccttgaactccaggtcgtcctcgctggcctccagcagatgggctgcgaccctgcgcgccttgtccaccaccttctccgccgcccggtgcacggccgccccgcccacgaccagcgaccgcgagccgtaggtgtccatgccctgcggggccaccagtgtgtcgccgtgcaccacctcgacgtcctcgaacggcacgccgagcacgtccgcggcgatctggctccagcaggtcacgtgcccctgcccgtgcgggctggtcccggtgaccacctcgaccttgccggtgggcagcatccggatgctcgccgcctcccagccgcctgccgagtaccgcaggtcgcgcagcacccggctcggcgccaggccgcacatctcggtgtacgtcgacacgccgatgcccaggcgtacggtgtcgccgcgctcgttccgcttggcctgctcggcgcgcaggtcgtcgtaaccgaacagggcgagcgccttctcggtcgccgcctcgtagtcgccgctgtcgtaggtcaggcccgcgatcgaggtgtacgggaactcctcgtgccggatccagttgcgccgccgcacctcgatcgggtcgaggccgacctcggcggcgagttcgtccatggcccgctcgatggcgtacgtggcctccggacgtccggcgccgcggtaggcgtcggtcggggtgcgggtggtgaacacgcccgtgcagtcgaactcgtaggagtccatcttgtagatcgccgggtacatgaacgcacccaggatcgggatgccgggcgtgaccagcatcaggtacgcgcccatgtcggcgagcaggccgaccttcaggccgagcagctttccctcacgggtcgcggcgatctcgacgtcctggatcatgccgcggccgtggtgggtggccaggtagccctcggagcgcgactcggtccacttcaccggccggccgagcttgcgggcgacggccagcgcgacggcctcctcgccgtacacctggagcttggacccgaagccgccgcccacgtccggtgcgaccacccgcagtttgtgctccgggacgccggtgaccacggagagcatgatccgcaggatgtgcgggatctgggtcgcggagtacaccgtgtactcgccggtggcggcgagcggggtgacgacgacggcgcgcggttccatggcgttggggatcagccgctgctgccggtagcggcgcttgaggaccacctccgcgcgctcgcggaccgacccgaagtcgtcgccggcgcgcagcggccagtcgtaggcgcggttggtgcccttgtccgcgtggaccagcggggagccttcggcgagcgcggcctccaggtccaggacgggcggcagcggctcgtagtcgacctcgatcgcctccagcgcgtcggcgg

SEQ ID NO: 584 - DNA, 1554 bp, Unknown
  Kingdom: Bacteria, Phylum: Actinobacteria, Class: Actinobacteria, Order: Streptomycetales, Family: Streptomycetaceae, Genus: Streptomyces
gggtgaggccgccgaggccgccgcaccggccgcgcgggcgacccctccggcggcggtggcggcgcaaccggaagcacgagagcacggcgcgggggctgcgggtacggggcctgcggttgctggagcgggtgcgaggcctgcggcgggtcctgcgggtgcggggcccgcgagtgcgggtgcgggtcctgcgggtgcgggacggtcagggccgccggacccggacggtgaccggtcgcgggacccggcccgctcctggcggcagcgcctggtgccgacccgggccggtgtggtcctcggctgtctgctgaccgcggcgctgctgctgtactgggtgcccgcggcccggctcgacgacgccgacctggaccggatgggcggactggggctggtctccgtactgccgctgcccacgctggtcggcgccgcgctgctggtcacggtgttcgccgtactgctgtggctgcgccgcgagcaccgcgcgctgctgctggtcaccctgctcgcgaccgtcgtctcgctgcacgcgctgcccgcggtgatcgagagcgagccgcggttcgcgacggcctggcagcacctcggcttcatcgactacatcgaccgcaccgggtcggccgtaccggacctggacgcccgctggagctggccgggcttcttcgcggtggccgcgttcgtcgcccggacctgcggcctgagcgacttcaccgaggtcatccgctggtggccgctgacgctccaactgctctgtctcgcccctgtgttcctgctcacccgctcgatgcgggccggctggcgggccaggtggaccggcgtgtggatcttcgtgctcggcggctgggtcggccaggactacttctcaccgcagggcttcacctacctgctctacctggcgttcgtggcgatcctcctggtctggttccgggcaccgcgcatgatctggaccaaggcgcggccgggtgaggcggaggtcgaaccggcgaaccgtcggcagcgggccgtgctgctcacggtggtgatcggcctgttcgccgccagcgtcccggcccaccagctcacgccgttcgtcatggtcggcgtgctggccgtcctcgtcctggtgggtcgctgcgaactgcgcggtctgcccgtcctgtgcgcggtcctggtcgtgttctggctgggcttcatggccgagccgtactggtcgggccacttcgacgagctgttcggcggggtcggcggcgtcggcagcaacgtgtccacctccgtgtcgggccgcatccagggcggcgactccacgcacaaactggtgctgtacacgcgggtgctgctggccggcacggtgctcgccctcgcctgctggggctggtggcggcggcgcgagcacaagtaccgcgagcggtcgctgctggtgctgacgttcgtaccgttcctcggcttcggcatgcagtcctacggcggtgagatggcactgcgggtcttcatgttcgccctgccgggcgcgggcctgctggcggcgctcgcgctgttcccgcgcgcgggcgtcaccgccgacgagcgccgcaaggaccgggg

SEQ ID NO: 585 - DNA, 3709 bp, Unknown
  Kingdom: Bacteria, Phylum: Actinobacteria, Class: Actinobacteria, Order: Streptomycetales, Family: Streptomycetaceae, Genus: Streptomyces
tccggaggccagcgccagcggctggcactggcccgtgcgctgctcgccgacttccccgtcctcgtcctcgacgagccggccgagcatctcgacctgccgaccgccgacgcgctcaccgccgatctgctgagggcgaccgagggccgtacgacactgctcatcacgcaccgtctggccgggctggaggctgtggacgaggtgatcgtgctggacgagggccgggtggtccagcgcggcccgtacgcggagctggccgtgctgccgggaccgctgcggcggatggccgagcgggagacggcggcggaactgctggtaggggcacgtcaggtctcgcgggcagcctgaggaccccggggcacgcccggggccttgggcatgccggaagtcccgcgccgccggcctgcaccgagggccgccccggcatgccccggcatgtcacggtcgcgccccggtgcggcctcgggcgctgcgggcgccgtccttaccgccgctcccccaggatccgttcgatcacgaccgcgacgccgtcctcgttgttggccgtggtccggccggatgccgcggcgacggcgtccgggtgcgcgttgcccatggcgtacgactggccggcccaggtgagcatctcgatgtcgttcggcatgtcgccgaaggcgacgacctcctcgtgcgagatgccccgttcggcgcagcacagggcgagcgtgctggccttggagacgcccggaccactgatctccaggagggcgctggggctggagcgggtgatggtggcgcgctcgccgaccgcgagccgggccacggtgaggaagccgtcggggtccagcgtggggtgggcggcgaggaccttgaggatgggctgtcctgcggcggcgcccccgggcgccagcaggtcctcgacgggagccagtgtgtccggggcctccatgtgcagcttgggatagtccggctcctggtggaagccgtacgtctgctcgatggcgtacaccgtcccgggcgccgcctcgcgcagcagccgtacggcgtccagggcgttctgcggggcgaggtcgcgcaccttgacgaaccggtggacgccgggcccgccgtgcaggtcgaccacggccgctccgttgccgcagatcgccagcccgtgaccgtgcacgtggtcgctgacgacgtccatccagcgggccgggcgaccggtgacgaagaagacctcgatgcctgcctcctcggcggcggcgagcgcggcgaccgtgcgcggggagacggacttgtcgtcgtgcagcaacgttccgtcaagatcggtggcgatcagccgcgggcggacggcgggtacacctccccgcgcgagcgaggtcgagagcggggtggaggccggaggctcgggctgtcgcgtcgctgaggtcaccggcccattgttccgcatatgcccgcacgcccgtgcggtactgcgcacatctgaggcgtcgcctcggtcacgccagctgggccggcgcctccaaggcgatccgctcgaacaccttctcgtccgccgcgaagtccgagccggggatcggccagtggaccacgatctccgtgaagcccagttcccggtggcggcccgcgaagtcgacgaaggcgtcgagggactccagagggcgcccgcggtcgggggtgaatccggtgagcaggatcttgtcgagcgcaccgacgtcacggcccagcgcgtcacacgcggcaccgagcttctcgatctgcccgcgcagggcctggacggactgttccggcgtaccgttctcgaacagcctggggtcgccggtcgtcacccacgcctgcccgtaccgcgccgcgagtcgcagcccgcgcggaccggtggcggcgacggcgaacggcagccggggcctttgcacacacccgggaatgttgcgtgcctcgtgcgccgagtagaagtcaccctcgtacgacaccgagtcctcggtcagcaggcggtccagcagcggtacgaactcggccaggcggtcggcgcgctcccgcggtgcccagggctcctgcccgagtgcggtggcgtcgaagccggtaccgcccgcgccgatgcccagcgtgagccggccgccggagatgtcgtcgagcgagatcagctccttggcgagcgtgacggggtgccggaagttcggcgaggtcaccagggtgcccagacgcaggtgttcggtcgcggtcgcggcggcggtgagcgtcggcagggcaccgaaccacgggccgtcgcggaaagtgcgccaggacaggtggtcgtaggtgtagccggtgtggaagccgagctgttcggcacgggtccacgccgagcggccgccctcgtgccagcggcggtacgggaggatcacggtgctcaggcgcagactcatgggcccgagcctaagcgtgcccgggcgtttcacgtgaaacagtcaccgcacgcggctgctcagccacgaggtgagaccgatcatcgggaccggctccttgtacgtccggtcgccgggcaggggaacgaccaggcggtagccgggcgggaagcgccgcgccgcgacgaacgccgtgccgtcccagaccgcgcggagaaaggcggggacgtcatcgcggggcaggtcgtggaactccacgccctcgacggtgatcagggcgtccgcctccgggtagagccgtacggtcgtacggggcagaccgccgaactcgacgaacgcctcgtgcgggagcgagccgtccgggtcggtggtgacaccgatgcccgcggcgctgcgacgagaggtctggtcggcgccgatgtcgtgggtcacctcgatctcacgcgcatgggcggcggcgagggcgcggcaggcggcgacggcggcttcggtcgtggcgagctggcgatccatggcgccgatcatgccggaccggtcagtggctggagctgaagcgcaggtactggggcggtacagccttcgtcagccatacgccgttggcgctgacctggaagaggtgtccgtcgcggtgcatggcggcggcgtccacggcgagcacgaccggccggccgcggcgggcacccacgcgggacgcggtctcccggtcgggcgagagatgcacgtcgtgccggttcatgggccgcaggccctcggcgcggatggcgtcgagggcgcgggccaccgtcccgtggaagagatacggcggcggggtcgccggcggcaggccgaggtcgacgtcgaaactgtgcccctggctcgcccggatgcggtcgccccggatctcgaagcgccgcttgtcgttggtggcgaccacgtggtcgagttcctcgcgggtgatccggaaatggtgagcggtcgccgcggcgagcagggcgtcgatcccggcccatccggcctcgtcgagcgtgagcccgatccttccgggctggtggcgcaggtgcttggagaggtacttcgacaccttcacggtgcgtctttcgtccatgccaccagcctgacgggagagaccagcctcacgcagaacttttttgccgagaaggtttgatccacagcgaagtgaggttatccacaggcccagggagaaaactgtggacaactcactgctgtcgccggtgtttttgcccgtacctgccggatgggcaggcctcacaggcgtggccgcacctgtgccagcctgcgcagggcccgcggggtgaagcgggacatcgcgtgcaggaggcgggcctccggcgtcaccggtacgaccgcggcgtcgcggacgaccgcgcgca

SEQ ID NO: 586 - DNA, 3319 bp, Unknown
  Kingdom: Bacteria, Phylum: Actinobacteria, Class: Actinobacteria, Order: Streptomycetales, Family: Streptomycetaceae, Genus: Streptomyces
cgaccaggtcgagctggtcgacgtggataccgcgggcggcgacgttggtggccaccaggaccgtcaccaggccgtccttgaaccgggacagggtccgggtgcgctgcggctgggacttgccgccgtgcagggcggccgcgcggacgccgctcttcagcaggtgcttggtcagccggtccacggcgtgcttggtgtccaggaacatgatcacctggccgtcccgggccgcgatctcggtggtggtccggtgcttgtccgcgtcgtgcacgtggagcacgtggtgctccatggtgctgacggtgccggccgaagggtcgaccgagtggaccaccgggtcggacaggtaacggcgcaccagcaggtcgacgttgcggtccagggtggccgagaacagcagtcgctgcccgtcggggcgtacctggtcgagcagtgcggtgacctggggcatgaagcccatgtcggtcatctggtcggcctcgtcgagaaccgtggtcccgacgtcggtgagccggcagtccccccggtcgatgaggtccttgagccgaccgggcgtcgcgacgacgacctccgcgcccgagcgcagcgcacccgcctgcctgccgatcgacatcccgccgaccacggtggcgagccgcaggctcacggagcgcgcgtagggagcgagcgcgtcggtgacctgctgggccagctcacgggtggggacgaggaccagggccagtggccggcgtggctcggcacgctgtccggccgtacgggccaggacggcgaggccgaaggcgagggtcttgcccgagccggtacggccgcggccgaggacgtcccgcccggccagggagttcggcagggtcgccgcctggatcgggaacggtacggtcacgccttccttgcccagggtggccagcagcggcaccggcatggcgaggtcggcgaacgacccgacagcgggcagggcgggcgtgaccgtctccggcatcgcgaactcaccccgtgcgggctgtcggtttccgtgaccgctggagcggcgccgagcgccggagcggtccgagtcggcacttccacttcctgcgaagcggtcatatgcgcgagtggtgcgtgtgcgagtggaacgggtgcggttcatacggaaccttcctcgatgcgggcgcgtatcaaggaatttccgcagcatgacgagcggcgcagagaatcgcgagaacgggccgaaaaaacagggtcgaaagaccctgggaacaaagcgagctggggcccgcaccccaaggtgcgggccccagctgcgaaagtacgcgtcagcgccggtgcgtcaggcgggaacgatgttctcggccgtcgggcccttctggccctgcgcgatgtcgaacgacaccttctggccctccagcagctcacggaagccctgggtggcgatgttcgagtagtgggcgaagacgtcggggccgccgccgtcctgctcgatgaagccgaagcccttttccgagttgaaccacttcacggtgccggtagccattttttttctccttcgggacggtgcacggagcccaccctgtgtggactccggtcgccgcgatgatcaccccgacggaaaaatcccaggcaaccacaactgcaactgacgtcgaccctagcacgccgggatcggacccgcgggacgaatgatttccgcccggggcccggcgcgggaatattcccgccacgtcgcacagattttcccggccgggcccccggaattcggccgggaggcaggcgggcagacgggccggccggcccgtgcggaacacgggtggaacggcggcggcaggccctaggatcaggcccatggccctgaccatgaaggacgtggaacggttcgaggcgtccaggccccgtctggaggccatcgcctaccgcctcctcggctccgcgagcgaggccgaggacgccgtacaggacacgttcctgcgctggcaggcggccgacgtcggtcagatcgaggttcccgaggcctggttgacgaaggtcctcaccaacctgtgcctgaaccagctcacttcggcccgcgcgcggcgcgagacctacgtcggccagtggctccccgagccgctgctcgccggcgacccgatgctcggcccggccgacaccgccgaacagcgcgaatccgtctcgtacgcggtcctcgtcgtgctggagcggctcgccccggccgaacgggcggtgtacgtcctgcgcgaggccttcggctatccgcaccgggagatcgcctcgatcctcggcatcagcgaggccgcgggccagcagctccaccaccgcgccaagaagcacgtcgcggacggcagggcccgtacggaggtcgacgaggccgccgcgcggcgggtcgtcgaggagttcctcgccgccgccaccagcggccgtaccgagcctttggtgcggctgctcacccaggacgccgtcgcggtcggcgacggcggcggcaaggtcccggcccgcaccaggccgttcgagggcgccctcgcggtcgcgacgttcatgcgggggctgttcaaacccggcaaggccaagcgtgccctggtcggcggctcgcccgggatctacgcggcgaccgcgaacggcggacccgccgtcgtggcggtcctcgacggccgggtggtcggcatcctgtgcctggaggtcacggccgagggcatcgccgcgttccgcagccaggccaatcccgacaagctcgtccgtgcgagccggcggtgggcgtccgccgaccacggcgaaccactgctccacgccttctgagacgaggcggggcgcggggcgggcgcgtaagtgtgaggtgcttcacatccgggtcctgtcaggaaaccgcgggctgcccggttcaaggggcgaccccgctcacgacaggagccaggagatgcagatgcagcaccgcgtcatcgtcctcggagccggatactccggagccatcgccgccgggcgcctcgccaagcggctgcaccgcgacgacgtcgccatcaccctcgtcgacgccgagcccgacttcgtcgagcgcgtccgcctgcaccagctcgcgaccggcggtgacctcgcgccccgcccctacagcgagatgttcgcgggcaccggtgtcgcggtgaagcgcgcacgggtgaccggcgtggacgccgaccgccgcaccgtcaccgtccagccggccgacggcacggaccgtaccgacggcgtcgaggagctggcgtacgacaccctcgtctacgccctcggcagcggctgggacgaccagggcgtccccggggccgccgagcacgcccacgagatcgcgggccgcaccggagcgctccggctgcgggagcgcctggca

SEQ ID NO: 587 - DNA, 4995 bp, Unknown
  Kingdom: Bacteria, Phylum: Actinobacteria, Class: Actinobacteria, Order: Streptomycetales, Family: Streptomycetaceae, Genus: Streptomyces
ggcgcggaacttccactccgcgccgttgcggtacagctcgccgaagaccatggcggtctcggtcgaggcgtcctcgctcaggtcgtaccgggcgatctccgcgccgccggcctggttcaccacgcggatgtaggcgttgcggacctggccgaaggactgctggcggttctcggcgtcgtagatggagaccgggaagacgatcttgtcgacgtcggcggggacgcccgcgaggttgaccttgatcacctcgtcgtcgccctcgccctcaccggtgaggttgtcaccggtgtgctcgaccgagccgtcggggctcttgaggttgttgaagaagacgaagttctggtcgttgccgaccttgcccgagttgttcagcagcagggcgctggcgtcgaggtcgaagtcggtgccggtcgtcgtccgggcgtcccagcccagaccgacgaggaccgcggtcaggcccggggcctccttcgaaagcgaaacgttgccgcccttactgaggctgactcccacgagtcctccattggtgtccgggggcggggagccccgtcgtgcatcggatatgggatcaacgtctcgatcctagtgacgggttcccgccccacgcaggccctgtggccgaagattcccaggtgtcgggtcccccgaaccccgggtcggcgcacaggggcggctcacagggtgtcgagcgccttcacgtactcgttcaggtcgcgcgcgtccggcagtccgttgatcacggtccaccgcacgacgccctccttgtcgatgatgaaggtcccgcgcacggcgcagcccttgtcctcgtcgaagacgccgtaggcgcgcgaagtgttgccgtgcggccagaagtcgctcagcagcgggtactccaggccctcctgctcggcgaagacgcgcagggtgtggatggagtcgttggagacggcgagcagctgggtgtcgtcgttgacgaacgtcggcaggttgtcgcgcagcgcgcacagctcgcccgtgcacacgccggtgaaagcgaacgggtagaagagcagcacgacgttcttctcgccgcggaagtcggacagccgcacggtgcggccgtggttgtccttcagctcgaagtcgggtgccttgtcgccgacctggatcgccatcgtgctgcttcccttcggtggggctgttcgggtgggaccaccctacgcagcgatcaccgcgggcccgcggacgggccgacacgcggccgtccggagctgcggacgggccgacacgcggtcggcccgtccggttggcgcgcccgggccccggaggcttcccgggacagtgcgcccatggttacttcttgggcttggcggccttgggcgtcagcagcctggtgccgttccagtccttgcccgcgctgacgctcttggtctgcgacaggccggccgtcgtcgcggcctcaccgatgtcactgggctcgacgtatccgggcctgccggtcttcggcgtcaggagcaggatcacgccgccttcgtcgaggaactggagggcgtcgaccagcgcgtccgtcaggtcgccgtcctcgtcgcggaaccacagcaccgcggcatcggccacgtcgtcgtagtcctcgtcgacgagttcgctgccgattacttcctcgatggactcgcggagctcctggtcgacgtcgtcgtcgaagccgatctcctggaccacctgcccgggctggaatcccagcctggcggctgggttagtccgctcctccgcgtggtccgcggtcgcgctcacgggttgcctcctgatggtgttgcgattgggtcttcagccacgcgcgtgcgcgaagcattggccgtagtccacacgggcgggccggatcgcgcaagtacccggcggtacggaccgccgaaacggtgacgttcccggctgtgtcgccgcaactcctgacacggtatcgcgatcagtagtgacacacaccacacccttctgcccgcttttgcgcgtttgagaaccccccatcggcaggagatcgagaagaggaccccccgatcttcgtccgccggcatccactgcccccgttaccggtgagtaaagatgacgtttgcctcacacgaggtacacgatggggagcggcccaggcacacaccgacagaccgacggaaatcccagggaaacagcagaaaaagcccagaaacgcccgagacatgtcagccctctgacaggtaaggaacagcgtggcttccggatccgatcgaaacccgatcatcattggcggccttccgagtcaggttcctgacttcgatcccgaggagacccaggagtggctcgactcgctcgacgccgccgtcgacgagcggggccgggaacgggcccgctacctcatgctccggctgatcgaacgcgcgcgggagcggcgcgtggccgtgccggagatgcgcagcacggactacgtcaacacgatccccaccaagagcgagccgttcttcccgggcaacgaggagatcgagcgcaagatcctcaacgcgacccgctggaacgccgcggtgatggtctcccgcgcccagcgccccggcatcggcgtcggcggccacatcgccaccttcgcctcctccgcctcgctctacgacgtcggcttcaaccacttcttccgcggcaaggacgacggccgcggcggcgaccaggtcttcttccaggggcacgcctcgccgggcatctacgcgcgcgcctacctgctggaccggctcagcgaacagcacctggacggcttccggcaggagaagtccaaggcgccctacgccctctccagctatccgcacccgcgctccatgccggacttctgggagttcccgacggtctccatgggcctcggcccgatcggcgcgatcttccaggcccggatgaaccggtacatgcaggcgcgcggcatcgcggacacctccgactcgcacgtgtgggcgttcctcggcgacggcgagatggacgagcccgagtcgctcggccagctctccatcgccgcccgtgagggcctggacaacctgacgttcgtggtcaactgcaacctgcagcgcctggacggcccggtgcgcggcaacggcaagatcatccaggagctggagtcggtcttccgcggcgccggctggaacgtgatcaagctgatctgggaccgctcctgggacccgctgctcgcccaggaccgcgacggcgtgctggtcaacaagatgaacaccacgccggacggccagttccagacctacgccaccgagtccggcgcctacatccgcgagcacttcttcggcgacgaccaccggctgcgcgccatggtcgagaacatgaccgaccaccagatcatgatgctgggccgcggcggtcacgaccaccgcaagatctacgcggcgttcaaggcggccgtggagcacaaggggcagcccaccgtcatcctggccaagacggtcaagggctggacgctgggccccaacttcgagggacgcaacgccacgcaccagatgaagaagctgacggtcgacgacctcaagcgcttccgggaccgcctgcacctgccgatctccgacaaggagctggagtccggcccgccgccgtactaccacccgggtcgcggctcggacgagatccagtacatgcacgaccgccgcaagggctgcggcggctacgtcccgacccggatcgtgcgcgccaagccgctcgtgctgcccgacgacaagacgtacgcgtccgtgaagaagggctctggccagcaggccatcgcgaccaccatggcctttgtgcggctcctgaaggacctcatgcgggacaaggaactgggcaggcggttcgtgctgatcgcgccggacgagtaccgcacgttcggcatggactcgttcttcccgagcgcgaagatctacaacccgctcggccagcagtacgagtccgtcgaccgcgatctgctgctcgcctacaaggagtcgccgaccgggcagatgctgcacgacggcatctccgaggcgggctgcacggcctccgcgatcgcggcgggctcggcgtacgccacgcacggcgaaccgctgatcccggtctacgtcttctactcgatgttcggtttccagcgcaccggcgaccagttctggcagatggccgaccagttggcgcgcggtttcgtgctgggcgcgaccgccgggcgcacgaccctgaccggtgagggcctgcagcacgcggacggccactcgcagctgctcgcctcgaccaacccggcgtgcgtggcctacgacccggcgtacgggtacgagatcgcgcacatcgtgcaggacggcctgcgccggatgtacggcggcgaggacgtgaaccccggccacccgcacggcgaggacgtcttctactacctgaccgtctacaacgagccgatccgccagcccgccgaaccggcggacgtggacgtggagggcatcctcaagggcgtccaccggatcagcgagggcaccggcggcgagatcccggcgcagatcatggcgtcgggcgtggcggtgccgtgggcgctcgaggcgcagcggatcctcgccgaggagtggaacgtcaaggcggacgtctggtcggccacctcctggaacgagctgcggcgcgaggccgtggcctgcgaggagcacaacctgctgcacccggaggaggagcagcgggtgccatgggtgacgcggaagctgagcggcgcccaggggccgttcgtggccgtctccgactggatgcggtcggtgccggaccagatcgcgcgctgggtgccgggcccgtaccagtcgctgggggccgacggcttcggcttcgccgacacccgcggggcggcccggcggttcttccacatcgacgcgcagtcggtcgtggtgggcgtgctgaccgaactggcgcgcgcgggcaaggtggaccgttcggcgctcaagcaggccatcgaccgctaccagctgctcgatgtcacggcggcgcatccggggacggccgggggcgacgcgtagcggcaccggacggatggacggtggaacgccgaaggggcggtggagc

SEQ ID NO: 588 - DNA, 4632 bp, Unknown
  Kingdom: Bacteria, Phylum: Actinobacteria, Class: Actinobacteria, Order: Streptomycetales, Family: Streptomycetaceae, Genus: Streptomyces
gtgtggggcccgctggaccgcctccgcgatctgacgacgcgccgcggccggcggtgagccgccctccgggccccggcgacggggggcgccggcctccgcgggccggtgccgggttcggcgcgtcggggctcgccgggaggggtactgcggagctacggaccgcgtcgtccccgcaccgcggggaccgggtcgtcccgtcgtacgcccgccgggccggggggccgggcggcacgccggaggccaccgccgtatccgccgcagcgccggatccgaaggagtccgcccgtgaacgtcgatcgcgaactcgcgcggatagagaagcagctggtgacgcaggacccgctcctggcgtcgaagctcgagacgttcgagcagatcaccgccccgcggccgagagcgccgggccggcggcacgtgtacctgttcgccgccgtcctcctggtgctgctcgccctgacgaccgcgctcgccgccggcacggccaccgagcatcccaggcaacccagcccgtcgcaggtggtccgggagcatccgcaggggcccggataggagcgcggtgaccggtgacggtgccgccgggtggcggcccgcgcgttgcggcggggcctgcgcgcgtgcagagtggcggtcgtgaagcgcctcgtgccgtgggtccggcaggcggtgctcgtcgtggagcaccgcctcggcgcgtacgctctggtccggcgcggccgcgacctcgagctgatgcaccgggccatggggttcgccaccctctccctcgtcacgctggcgccgctgctcatcgtcgtggccgcgatcgacccgctgggcgagggcgggttcgcgtcctggctggtcgacggcatggggctgtccgggcggtccgcgcacgtcctgaccgacatcatcagcccgccggtcaaggtgatcagcaccaccagcgtgtggggcggtgtcctggtcgccgtcttcggcgtgtccttcgcgggcagtgtgcagaacggctacgaacgcgtgtgggcgctgccgcccggcccctggcaccacgtgtggcggcaggcggcctggctcgcggtgctgaccgcgtacctgtaccaggaggtgctcaacgggcaccagttccacggctgggagcgggtggcggtgtccggggtcaccggcgcgctgttcttctggtggggccagcacttcctgctggggggccagctgcactggcggaccctgctgcccggcgccctggccaccatgatcggcctgggcggcctgcgcgtcttctcctacctggtcttcaccccgctcatcgtcgacaacgcgatcagctacggcaccgtcggcatcgtcctcgtcgtggagtcgtggctcaccggggtcggtttcgtcgtctacggcggcgccctgttcggccgctggttctgcgagcaccactggagcccgcaccggagcaagagcccgcacgggaaggagtaggagcgcccgggcgccaggtttggtgacgcgggcgacgggatactccgtgtccgccagcccgtccgaaccgcgggggcgcccgcagcccggctgcgccgcctccggtgttcccgtcgcagccgaggtcggtcgccgtgtcccacgctcctgcccggtcccgctccgccgccggggtgccccggaccgcccacggacggcctgcagctccgggcgaggcccggtgagcgctctgacgatcgtgctcgccctgtgcgcggcgctgtccaacgcctcggcctcggtgctccagcggcgggccgcgacggacgagtccgcgggttccggggcgcggcaggcgctgcgctggctcataggggtgctgcggcggccctactggctcgcgggctgtggactgctggggctgtccaccgtgctgcaggcggcggcgctggccgtgggcagtctctcgctggtccagccgctgatggccagcgagctgctgttcacgctggccgtgggcagcgtcgtcttccgccgtctgcctgatcggcggacctggctggcgttcgccgcgctcgccgtgggtctgtccctcttcctcggcgcggcctcgccgtcggagggccggtccaccgccgagccgcgcctgtggctcccggtgggtgtcgcggtgctcggcgtggtggccgctgtcgtggccgcgtcccgtctggtgcggggtgccgcgcgggccgcgctgctggggctggcgtccgcggtgtcgttcgccgcgacggcagcgctgctcaaggaggtcacgggacggctcgggcaggacggtctcggcgccgtcctgacgcagtggccgccgtacgcgaccctcgtcgtcggcgggctcagtttcctgctgctgcagagcgcgttccgcgccgggagcctgaccgcgtcccagcccgcgctcaccctcggggacgccctgaccagcgtcgccctgggctgggtgctgttccaggagtacatcgggctcggggtgcgggtgctgccggaggcgatcggggtcgccctgatcggggcgggcagcgtgggactggcacgtgccacggccaccgacggcggctgggacaccacgccggacgagcgggacaggtcgggccccgaggcccggcggtccgcctcgcgacggtcctgaccgggccctcggctgctctcctctccgcccgtttcccgacatccggccgaccgcctccgccgggctcactcctgcatcagcaggtcctgtaccgccgcgtccagttcggcgggtgtggtgccgccgaccgtgcgcacgatgccccggccgtcgacgagcacattggtgggcacgccgcggatgcccaggcgggcggcgtactcgcccgtgccgtcgagcagcaccgtggcaccgatgtcccagacggcggcgaagttcgccgcctcctgccgggggtcggtgttctcccatacattgatcaagatgacgtccagcccggaccgggccgtacggcggcgcagcctctccaggaccggcgcctccgcattgcacgggcctcaccagctggcgaagaagttgatcacatacttgcgctcggcccactcccgcgacgtacggatccggccgccgcgcaggtcgggcagctcgaaggcgggcagcggccggcccaccagaggatgcacggccggctgcacgggtcccggcagccaggggcggtgcacgacgctgagggtcccgctgcccgcgttggacaccagcagggtgtcggagaccgggtccagggcgcagtcgccgggcgcgttgcccacggtgatgcggtgcgcctcccggccgctcgcggtgtccaggacgctcaccgtgcctgcgccccggttgcagacgtagagccgctccccggccgcgtccacgcacatgccgaccggtgcccgctcgacgggcatctcgtcgaggacggcgccggtgccgagcgcgaccctggtgaccgtgccgtgcagggagctggccacgtagaggtgtccggcggccgggttggtcaccgccttgcacgggccctcgcgcacggcgatccgctccagcggccgcagcgaggcggcgtcgaagacggtcacggaaccggccatgaagttcgcgcagtagccccggccgcgctcggtgtcgacggcgatgctgcccgcgccgagttccgccggcaccgtgcccaccacttccaggcggtcggcgtcgatggcggtgaccgtgccgtcggcggtgttgccggagtagacccggcgcagccccgggtggtggccgagcccggcggggtaggcgccgaccgggagctgcgcgaggcggtcgccggtcgcggcgtcgagcaccgtcaccgtgtcggagcgtgcgtccgccgagaagatccgcccggtcggccggtccaggatgatcgggatcggctcccggccgacctcggcccgccacaggggaccgtcccgctccgcgtccaggtccagggcgaccaccgcgttgctgcgggagcacgccacgtagacgcgccgcccgtcggggtcgacgacgaccgcctcgggccctttcccgacggggcggtgggcccgtacgcggtgcgagaggtctacggagcaggcgggcccctgctccggccggtcgcggtcctccatgttggagggatgcacggatgggggcgggttcaaacaggggggtcgccgccccgggtgcgtgtccctaggccaggtgcacctccagtgccgctcgcacgccggattcgacggcaccctcgatccaggacggcttgaccgaggtgtggtcgccggcgaagcgcagcggaccctccggggcgcggatgtgcccgaggagttcggtgtgctggccgggcagcaacacggacgcctcgccgtacgcgtacgggtcgcgcagccagctctgggtgcggccggcgccggtgtagaacacctccaggcgctgtccgtagacctgctgcaggccgcgcagggcgtacgggtagcgggccgcgtcgtcgaaggagtcccagcgggaggcgtcgtcggcccagctgtaggaggccaggacgactccgcccttgctgccgggcaccggatgcgaggggttgatcatgaagcggttggagttgtcggagacggacccgccgccggtgatgtgcgcggcctccggctggtcgcgcccggcccagcgggtggcggcgtagtgcgcgcgctgcgccgggc

SEQ ID NO: 589 - DNA, 1600 bp, Unknown
  Kingdom: Bacteria, Phylum: Actinobacteria, Class: Actinobacteria, Order: Streptomycetales, Family: Streptomycetaceae, Genus: Streptomyces
gtccccggcggtgcgggcgtcttcgccaccggcaccatgcgctgggtggaggcgctgatggcgggaaccggcgaactgggccgcgaccacggcatggacgcccgcaccgccggggaccgtgtagtacgccgagtcgctgtggctgcgggcaccggcatgcaccagcggcgagtgtgcggtgacctccagcgcaaaggggacggatgcgcccggcgtgaccctgtcgtactccaccccgaccaggtgtgcgaagctctcgccggcccggactccggtgccctcgtgcagccagtggtccgccgcgtgcacgacgtacggggcgtccaccgggtagccctcgtagaggacgccggtgagggacgactcgggatcggcggccggggcctgccggaagtcggtggtgacctgggccggacgggacgggtagtacgggtcgtcgcggtaggaggacttgtagcagacgacggtgcgcacctcgcccgccgcgccggcctccagacggacccggcggaagcaggtgttggcgccgaggaaggccacgttggtgcccgcgtcccgggcggcggtgacatgccggcgctgctcgggcgtccagtactcgtcgtgtcccaggcagatcacggcggtggctccgcgcaggactccggggtcgcggtgcaggtcggtgcccgtggtgtacgccaggggtatgccgagccgctcggccaggacgacggccgcccactcgtacgtcaggaacttctcggcgccgtccttgtcgtagggccggtcgaagctgacggcgagggaccgggtcgcgtaggcacccgaggcgccgtcgtagaggctgtagccgccccatttgttgtacgcctgccaggtggccggcgcgtgcagcaggacggtgcgtccggcaccgtgggcggagcgcacgatcagcgggaggtagcgctggtggccgttgtccgcgtccaggcgcagcaggtaggcgccctcgggccagccgtccgtgccgacggtgagcgtccgcggccactcggcccgcacggtccgggtggcggacagcacgcgaccgggcgggcgggcgcgcccgcgcaccggctccgagcgccacacgagccgggcgtacgtgcccgcgtaccagccgacacggaacgccgagacacgcagcgacccggccgtggtcgacacgtgcagaccgcactcctcgcccggggcgacgctgacccggtcggtgtagccggccaccgcgtcgggcgggccggtcgaggtgatccgccagtcgcggcttcccggcctctcccgctcggcctcgggccggtgagggtccgcggcgggcggcgttcggtgggcggcccggtggtcgtcgcaggcggccgaggcgccgaggccgaccgccccggcacacgcccccaggaagctcctgcgcgccagccgagggctacggtcccccgcgtcgccctgtgggtcgatgaggcccactggatccgtttccgccgttggctccgcggagttctggtgccggtgggtgggccgcgggcgcggctttccggggtcggggctcacctgtcctcccaggttcgggcccgcgcacgtcgtgcgcgggcccgaacctgggagg

SEQ ID NO: 590 - DNA, 2514 bp, Unknown
  Kingdom: Bacteria, Phylum: Actinobacteria, Class: Actinobacteria, Order: Streptomycetales, Family: Streptomycetaceae, Genus: Streptomyces
ggatcggtgcccgcggtgccggaggaggacaagaaggacgccctcggcaccgcgggcaccgatccggacggcatcctccaggtcgcgctgcgggacgtacgggccgaggtcggcgacgacctgctcgtcatgtccgacctgtgcctggacgagttcaccgaccacggccactgcggcgtcctcgacgccgagggccgcgtcgacaacgacgccacgctggagcggtacgccgagatggcgcaggtccaggccgacgcgggcgcccacatcgtggggccgagcgggatgatggacggccagatcggtgtcgtccgcgacgcgctggaccagatcggccgcgaggacgtggcgatcctcgcctacaccgtgaagtactcctccgccttctacgggcccttccgcgaggccgtcggttcctcgctccagggtgaccgcaagacctaccagcaggaccccgccaacctgcgggagtcgctgcgcgagctggccctcgacctggaggagggcgccgacatggtcatggtcaagccggccggcccttacctggacatcctggcccgggtcgccgacgccgtggacgtgccggtggccgcgtaccagatctcgggcgagtactcgatgatcgaggccgccgccgagaagggctggctggaccgggaccgggccatcctggagacgctgaccggcatcaagcgggccggtgcgcggaacatcctcacctactgggccgtcgaggccgcgcagaagctgcgctgaggtccctgcggtcctggctgcacgccggccgtcgcacacggccggcccagcgacgccgagtccgtggaggggccttcgtcgcggacgccctcaccgtcgtcgcagcccgtgagggcggtggaggcggtgagtacgagcagtgtggcggcgagcagccggacacggagactacgggcacggtcagggcgtgcgggcatggaagatccccctgggaacgggcacgagcggtctggcggtgagggagcggcggcggggcgcgggcgggctggtggtctggatggtctggtccagtggccgggtccagcttgatccccgaggccggacccgcgccacagtcggccgccgatgcgggacgccggaacaccgcaacaccctgtgacctgcggaaacgacgtccctttgggatgcggcacgggacgcgggaccccgcgtccacggccggttcgtcagaagtccatggccgggcccatggtgctctcccagtacgacaccatcagcttgtcgtcgacgtagacgctcttggcgggcagcgccaccgtggcgatggagccgtcgtcgaacgggatcgtcagggtgctcacggtgtgtccgtggtcgccgtcgccggacaggagcacgcccgcgtatccggactggcccggctccagcgtggtcagcgcctgcggcttggtctcctcggccaccggcggcaccgactgggcctcgccgaaccgggcggccgggtacatcggcagcatgcaggtcttcgaaccggtgttggtcgcggtcagcagcatgtggttgatgggccgggagaccatggcggccttgaagcggaggctcttggcaccgcacttcgcgagcctcccggaggacgcgtcggaaccgccggaaccgccggacgcctgcgagcccttgccggaaccgctggttccgccgtccttcgaggtgccgccgccggtggaggagcccttgccggccgcggaaccggagcccgaaccggagtcggagcccgaacccgtgccggtgctcgtgccggtgccggccggggacttcgcgtcggcggaggcggcgcccgagggctgctcggtctgtacggaccccgcgggggcggcggaggacgcggcgcccgcgccgttgtcggcgccgccggtctggcaggcggtcagggacagcgcggcggcggcgatggccgcggcggtgaacaggcgggtgcgacggggacggcgggtgcgggtggacacggacatgggaactccttggtacgtggtggtggaggaggacggcgcccgaccggccgcccggaggcggtcgcccagagcgccgtgttcggctgatccacagcttgtgggaggatccgtcccaggtgccacaggtgcgggcgcaacggggacgctggaacgggaaaaccggctctgacctgcgggaacgacacccgtctgggacgccgtacggggatgtgaggagagggagagagggtggcgggggacgatttcgcggggctgctgcgggagctgaaggagcggtcgggactcagctacggggccctcggcaagcgcctgcacatgagcgcgtcgaccgtgcaccggtacgtcagcggcgacgtcgtaccgaccgactacgcgcccgtcgagcggctcgcccgcctctgccgggcgacccccgacgaactcctcgaactgcaccgccgctgggtccgcgctgacgcgctgcgcggcacgaagagcgcgggcgcggcggacgcggcgacggcggagccgacacaggaaccgaccgagg

SEQ ID NO: 591 - DNA, 2505 bp, Unknown
  Kingdom: Bacteria, Phylum: Actinobacteria, Class: Actinobacteria, Order: Streptomycetales, Family: Streptomycetaceae, Genus: Streptomyces
gtcccaccgccgcccgcagccgttcgcgccagccgggctcgttcgtccggatcacggcccgccaccgggacggatcggccacctcccgccccggcgtaccccgtacgaccgccaccggcaggacaccgcggtcggcgagcagttcggccaggtgcccgccgatggccgacgtggccgctgtgaccacgacgttcgccgtccccgggccgcagaaccgctcgaccatcagcgtggccgtcagcgggttgacgtaggcgaagcaggcgatctcgtcggggaggtcgtcgggcaccgggacgcaccaggagtggccgagcagcttgtactgctgccagttcccggccgacccgagcggcagcacacgccggcccaccactccgggagcaacgcccggccccaccgcgtcgatcacaccgacgccctcgaacccgggcaccagcgggaacgaggtccgtgacccgtacgctcccgagacggtgacctcgtcggaggggttcacggtcgacgcgagcatacgcaccacgatctctcccgcgccgggggccgccggggcgtccacctcccgcacggtcagtacgtccgcgagccgcccgggcgcatcggcaacggcagccagcatcaccagtctccctacgtgtgcgcacacatcagaacgccccatcctacgaacgcgcggcacttcctgtcgggcgcctgtagccaccgcgtcggcgggtagcacttcctgccgggtggtgcggccgccgccgacgggaagggcgacgccgacgccgaagctcgcgccggggccgcacagccacaggatggcctggggaaacaggggggtgccggcagccacttcttgatggcgggtgtctttgggtggcgtagtcgtcctggatcagatgcacgtcgaggtctgcgggtgcctccttgccgagcttggtcaggaactgcttgaactcggtggcggcccggtgtcggcggtgcagtgacccggtgacccgctcactttgccgccggccccttccagggccgcgaagagggtggtggcgccgacacggacgtagtcatggctgcggcgctcggggaccccgggcatcatcggcagcaccggctgtgaacggcccagggcgtggatctgcgacatgcctgtcaccgcggccatcgagcgggtggaccagtgcgtggcgttcggtggtttctccgcaagcacggctcgctgggcgtccgttacggtcccagctccacgaaccgtgctcgccctcgtgccaccaaacagcgggaggaccgcttgccatcgcaagatcccaagcggtcttggctcactggctgcctcagcagaccatctgaccagccccgcagcacacgactgacatcccgtcaggacgagcgtcaagatacctctgagagcgtcatttcagcgcagatcagcgtcccttttcgacaggctcaagaatcgccacgcactccacatgatgcgtcatcggaaaaagatcgaaagcccgaagcatccgcacccggtacgccccctcccggaagtaccccagatcccgtgccagggccgccgggtcgcaggccacgtaggcgatgcggcgggcgttcagggaggcgaggtgggcgaccgtcttgcggccggcgcctgctcggggcgggtcgaggacgatgaggtcgacctcggtgatgccggtgtgcgggaggacggagtcgaccttgccctgttcgatgcggacgcgggggaagtcggcgaggttgtggcgggcgtcctcgacggcgcgtttgccggactcgatgccgaggacggcgcccttgtcgccgatgcggtcggccagtgcgccggcgaagaggccgacgccgcagtacaggtccagggccatgtcgcccttgcgcggcagcaggccctgcatgacggcggtgaccagggtgtcggccgccttcgggtggacctgccagaagccggcgccgccgacgcggtgggtgcggccgtcggcgcgttcgcggacgaaggggcggccgtggacgcggtggaccccgccggtcttctcgtcgacgcggaggacggagaccggcttgtccagctcgaccagcgggaggcgggcgcccgggcggggggtgaggacgacctggcggtcctgggagcccgtcgccgcgatcgcctcgaccgactccatgccggtccagtcgcgctgctcgatgcccagctcgctgacgccctccgccgcgatcatgcagtgctcgatcggctcgacctcgtgcgagcggtggcggcgcaggcccgccctgcccgtggccgggtcgacggcgtactggacgcgggtgcgccactgcgggacctcgcccgcgggcagcttgtcgccctcggcgggcatcaccgtgccgtcccagccggcctcttccggggtgaggcccgcgagccgcttcagctgctcggcgatgacctcgcccttgaggcggcgctgggcgcccggcttggcgtgctgccagtcgcagccgccgcagcggccggggccggcgtaggggcagggg

SEQ ID NO: 592 - DNA, 6192 bp, Unknown
  Kingdom: Bacteria, Phylum: Actinobacteria, Class: Actinobacteria, Order: Streptomycetales, Family: Streptomycetaceae, Genus: Streptomyces
taggggcccgtcgggggcggtggtgggttcagccggtgtggacgtgggggcgcttggtgcggtccggttccgcctcgcgcaggacctcgcgggtgaccggggcgacctcgccctgtccgaagaggaagaagcgcaggaagttgtggaacgggttgccctcggtccattcgaagtagatgtgcggggtgtggcccgtcacgtcgcggacgtgcaggagcagggccgccagggcgttcgggacggaggaggactccaggctcaggacccggtagcggtcgtgcaggacctcgccgcgcactttcaggccggcctcgaactcggaggggtcggtgaccgtcacctccgtgaagacgaagtcctccgtttccgggatgtcgttgtcggagcggatctgctcgagcttgtcgcggtactcggccttgtcccgccggtcgggttcgttggcgatgaaccggatcttgcggctggcgatgtccctgacgaaacgttccgccatggggtccaacgtcacgctggtcacgcgcagctcgaaggcgcgggccagccgggacagcagcgagaccaggatgatcccggcgatgaagcacgcgccgatcttcacaccgtcgggccgctcgatgacgttcacgacggtcgtgtacaggaacacggcagagatcaccgcgaaccccacggtccacttgcgctgcccggccttgtgggcggcgatggtcaccgcgatcgccgccgagctgatcagcacgagcacgccggtggcgtacgcgccgccctgcttgtcgacgttggcgtcgaagatccaggtgaccaggaaggcgatcagggtgaagacgatgaccatcgggcgcaccgcacgggcccagtgcggggccatgccgtagcgcgggaggtagcgcggcatcaggttgagcagccccgccatcgcggaggcgcccgcgaaccacaggatcgcgatggtcgagatgtcgtagaccgtgccgaaggtgttcccgatgtagtggtgcgccaggtaggccagggcacggccgttggccttgccgccgggctggaactccggtgccgggatcagcagggtggtgatgaagctcgtggcgatcaggaagcagctcatgatcagcgcggccgtggtgagcagcttcttggcgtcgcggatccggccggtgggccgctcctcggtgtcggtcgcgtctcccctgacgtgcggcatcacggcgacgccggtctcgaagccggacaggccgagcgccagcttggggaagaccagcagggcgacgccgaccatggcgaagacgctgctgtgctggacggtcagggcgctggtccagtcggtcaccagatggccggcggtgatgacgcgccacaggcccatgaccaccaccacgacgttcagaacgaggtagacgccgaccagcacgaccgcgacgccgatcgcctccaggaagcctttcaggaagaccgcgccgagcagcgccagcaggatcagcgtgatcagcatctgatggctgtgcagggcgttcgtcaggtgcgggttctccacgaggtgggtcgaggcgtcggccgccgaaagggtgatggtgatgaggaagtccgtggcggcgaagccgagcagggtcaggacgaacagcttgccctgccagaacgacagcagccgctccagcatcgcgatcgagccctggccgtgcgggctctcctcggccaccctgcggtacaccgggagtgcgcccacgagggtgacgaggaccaggacgagggtggcgacgggcgacagcaggccggccgccagtgccgcgatgcccggctggtagccgagggtggagaagtagtcgacaccggtcaggcacatgacccgccaccagcgctgccccttgtgcgggggctcgggtaccgcgtgcggcgcctgctgtatgcccttgcccatgtcggacaggccctccagcatccaggcgcgcagacgaccgggagggtgttcggtggtggccatgggccctgctcctgaagtacggctcagcccggcgtgcggctcagcgtggggatccggccgaccggcggacggggcaccagcgtatgcggagagtgacgtacgggccgcgcgcaccggggtcggtacgcgtcaatcttccgttaagaacgaccagggtgccgcgctgatccagctgcgcggctcatggctccagtcccgagatccggaagacggtgagcgccgtctcgcggtccatctgctccgccaggtcgcgcagcgcgctcccaccgcaccgcaggcagccgctcaccgccgatttccgtgcgtcctcgcctaggcggcaccacagggccgggttgtccaccaggatcccgggatcgatctcgacgcgggcgccgggcgcgtcccgcaggaccagccgccgcgagacgccgtccacgacccgcaccgacaccagcagatccgtacgcacccgtcggtggcgcagcggcgcacgcgtggcgagccatccctcgccggcactcacgcgggtcggccagagtacgccgaggaggccgaccgacagcgcgagccagagcaccgcgcgccaccaggtcaggccgcccgtgcccccgtcgatcaccagcagcaggccgagcagtgcgaccgcgcaccggacggcggtgtgcagatcccgtgcccactggcggtcgccggccaccggagcggagcgccgcgcgggcgggccggccgtccgtcgcgtgtccgagcagtacctcatggctcgacgctagaacgcgtccgtgccgggcgcgatgccccttgacgcacctctgacgcggcaccgtccgttcttgacgccacgacagcgccgactccttaccgtcccgcccgcgccgccccggaccggaccgacgtggaccgggtcccggccccgggttgccgaaccctcgtccgggcgatggagcagccggtggcgcagatgcgtcggggccggttcgcacggagtgtgcgggccggcccctcggggtgtgcaggcggcggtccggtgcacggcgccgtccgtcgtgctcaggcggcggtcatcacccggtcgctgcccagcgggcggtgcggggcgatgatctggccgtccggcaggagctcaccggtgtcctcgaagagcaggacgccgttgcacagcaggctccagccctgctccgggtggtgcgccacgagacgggcggattcccggtcggcggagtcggctgacggacacggtggctggtgctggcacatgggtgggatctctcgctgtgtcgtgtggtccgggatggctgtcgtgtgcgtcctgcggctggtggctttctccatggccgcccccccgtttgatgatgagtcggactgaaaccagtgttgccccgcggacgtgattccgcaggaatatcgcggcaccgcctctcacagattcaagacgcgtcacccgcgcgagcggttcacctcctccgcacggccccttcgggtggttcgagggggccggatggggctagtcaggtcgggtcaccaggtctttccgcgcaccctccgctcatgggagcgcacggcacctcctgcgagcgggcaagcgccgcgctgtgcggcctggcccgccgggcgacgacgtaccccgcttccgggggcgtccggcagcggggtacggggcggtggacaggtctcaggcgggtgaacccatgagccgtatcggagtcacccggtgggtgaggaggggcagcaggtcggcgacccggtgcggcacgtgggccgggatcccgggcggggccggtgccagcggcacgagcaggtcggtggcggccgggtggccggcggcgccgtcgtcggagaggtcgccgtgcagccagagggtgagcgtgtacaggctgggaatcgacagcaggcgcggctggtagggctgtgtcatggtctcggcctggcgcagggcgcgctcggtcgaggtgacgtacgggccctcgaagaagtgcgagaaggcccagccgtcgggggtgagcctggtctccgccgcggccaccgcgtggtcaccggaccggatcaggaagcgccaccctgccagccgggtcgcggagaccccctcgggagtgatccggtccaggacgtgcacgggcagcggcagttcgggggtcgcggggtcctgcgcggaacggagggcggagatccgggcctcgcgcaccgcggtcggggaaccgagtgccgtgaggacggagcggagtgcgggcgcgggggccggggggacatgcagcggcatggtgggtcgccttcattcggcaggcacggtggcgcgagggcggggcgggggcggacggcactgtctgctctcggggcagggtggcggagccggggtccggtgaacgagtgagacggagcgcggcctgccgcttgacccttgacggcacaggtccagggtcatggacgccgaccttctgccgtggtgcagagtttatacgacaaatgttcagatgttgtttcgtctacctgtttccggcgcggacggcaagggttcattcggccggagatatgcgggaatcatcccggttccgcgcgggccgcaccgcgatgacctcgggttctgcccgcgcggcggacggctcgttgtcgtcggcgtttttcacgagttctcctgggcacccgaaactgctgggtgttccatgccccgtgaatgtgcctccggacacttgagaccagcgtagtcggtgctcggccgccgcgggacgttatcgatcgcgttggcggggcatcatcccacctgacccggaccccggcggcccgatcctcaggcccgcccgagtgaggaaggacgctgcgatgggggagaaggtcgtggcaggacggttcgacctgtccgatcgcaaccgctaccgcgacaagctcaggcggtgcctgacagggctggagcggctgctggaggagaagcggttcgaccgccccaagaacctcatggggctggagatcgaattgaatctcgtgggctccgacgggatgccgaaaatgctgaatgcgcaagtactcgagcgcatcgccagccgggacttccaaacagaactcgccatgttcaacctggaagtcaacatagccccacacccactgggcggccgcgtattcgaccggctcgccgaggaactgaggacgtcgttggcatatgccgaccgaaaagccggtgaggtcgacgcctccatagcgatgatcggtattcttccgacgctcgaccgggacgacctggtctcctcgaacctttccgacgtcgaccgctacacgctgctcaacgaccagatcgtcgcggcccgcggtgaggacttcacgttggacatcgacggggtggagcacctcgtctgcacctcgaagtccatcgttccggaggccgcctgcacctccgtccaactccacctccaggtgacccccgggcgcttcgcggacgtgtggaacgcggcgcaggcggccagtgcggcgcagatcgccgtcggcgccaactcgccgttcctcttcggccgcgagctgtggcgcgagtcgcgcccgcccctgttccagcagtccacggacacccgcccgcccgaactccaggcgcagggcgtgcggccgcgcacctggttcggcgagcgctgggtcacctcggcgtacgacctgttcgaggagaacctgcgctacttcccggcgctgctgccgatctgcgacgacgaggaccccctggacgtgctcgacgccggcggcgtcccgaaactcgccgaactggtcctgcacaacggcaccgtctaccgctggaacaggccggtctacgacatcgcggacggcgtaccgcacctgcgtgtggagaaccgcgtcctgcccgccggaccgaccgtcacggacgtggtcgccaacgccgtcttctactacggactcgtccgcgccctcgccgaggagtcgcggccggtgtggacgcggctgccgttcgaggccgcggcggccaacttcgaggccgcctgccggcacgggatcgatgcccggttcacctggccccggcgcggccgttcctcgggcacggccgagatcgacgcggtcacgctggtccgcgacgagctgctgccgctggccgagtccggactgaacgcctggggcgtggagccggtggaccgcgaccggtacctcggtgtgatcgaggagcggtgccggctgcgggccaacggcgcgcagtggcaggccgccaccttccaccgggcccggcaccagcagggcccggtggaaggtggcgg

SEQ ID NO: 593 - DNA, 5856 bp, Unknown
  Kingdom: Bacteria, Phylum: Actinobacteria, Class: Actinobacteria, Order: Streptomycetales, Family: Streptomycetaceae, Genus: Streptomyces
ctctcgtcgtccgggtgtggcctggcctgctcggggatgccgtcgatgccctcgatgccgcccgcgggccgcgaaggccccgccggaccggccggtccggctccggaaggactcccggccgcctcggcgcggggcgcgatggcgccctcggccggcagctcccgtgtgccgcgctcttcgtcccgcaccggcccgtccccgttcctcacgccggcccgggtcccgcgccgcgctgtttgtagaggctgatcgaaacggtcttgtcctcgtccacggcggaggagaccttgcccgccagggccgacaggacggtccaggcgaaggtgtcccgcgagggggcgtgaccgtccgtggtcggggccgagacggtgacctccagggagtcgtcgaccagccggaagacgcagctgagcaccgaaccgggcacggcctgctggagcaggatcgcgcaggcctcgtccaccgcgatgcgcaggtcctcgatctcgtcgagggtgaagtccaaacgggccgccaggccggccgtggccgtccgcagcaccgacaggtaggcacccgcagccggcagccggacttccacgaagtcctggttcgccgcgggctcgcctgcgatctgggacaccctcacctccaaggtggtacaagctttacaagctctctcgggccgagggtcgccccccggggcacacgattcatggtccagcggtgacgctaccgcgctcccgacattcctgtcccgggaccccaacccctttctgtcactcatagtaaacctacggatacgctccgtggctaggggtttggcggatccaaatgggagcaacgcgcgccgggttgacgtacccacacgtcaggcggtcgaaccgtccgaagacccggtcacaccaggacgtgatccacgaagcaccaacgccagtcttccccgggttcgaaggtccgcatcaccgggtggccggtggccttgtggtggttcgtggcgtgctgtccgggcgacgagtcgcagcatcccacgtggccacaggtcaggcacagccgcagctgcaccgggtgcgtaccgtcccgcaggcactccgggcacgtctcgctgcgcggaccgggctccggacgaggcagcgcgtcggtgtgcgtgcactgtttcatgattgccagattacgacgtccgcgcggatgaccgcgcgggacgaagcgggcgggacgagacgatgggtgggcgaggacgatggacgtgatgccgctgctgttgctggtggcgggcagtgccgcggtggccggggccgcccggcgcaccccggtaccggcaccgctgctgctggtcgccgcggggctggcggtctcctacgttcccggggtgccggactacaccctcgaccccgaggtggtcctgccgctgctgctgcccccgctgctgtacacgtccgccgcggacagctcctacctggacctgcgcgcgcagctgagacccgtggcgctgctctcggtcggatacgcgctgttcgcgaccttcgtggtcggctgggccgcgtacctgatcgtgccggggctgccgctgacggcggcgctggtgctgggcgcggtggtggccccgccggacgcggtcgcggcgacggcggtggcccgccgcgtcgggctgccctcccgcatcaccacgatcctgcagggcgagtccctgctcaacgacgccaccgcgatcaccgcctacaaggtggccctcgccgcggccgtgggcgagggtgcgacctgggccgggggcgtggaggagttcctcgtcgcggcggtcggcggtgtcggcgtcggactgctgctgatggcaccgctgcactggctgcgcacccacctcaaggaggcgctgctgcagaacacgctctccctgctgatcccgttcgtcgcctacggtgtcgccgagcaggtgcacgcctccggcgtcctcgcggtcgtcaccgtcgccctctacctcggtcaccgcgcgtgggaggtcgacttcgccacccgcctccaggaggaggcggtctggaagatggtcgcgttcatcctggagtcggcggtgttcgccctcatcggcctccagctgccggtcgtcctcaggggcctcgaggagtacgccggcgcgacggcggcctggtacgcgatcgccgtcttcctggtggtcgtggccacccggttcgtgtgggtgtacccggcgacgttcctgccgcgcaagctgctgcggcgggtgcgcgaacgcgaggagaaccccacctggagaggcgcgatggtcacctcgtgggccgggatgcggggcgtggtgtccctggccatcgccttctcgatcccgctcacggtgcacggcggaggtcccttcccgcagcgcaacctgatcctcttcctgaccttcacgacggtcatcggaacgctggtcgtgcagggcctgaccctgccgccgctgatccgcctgctgaagctccccggccatgacgcgcaggccgccacgctcgccgaggcgaacgcccaggcgcaggcctccctggtcgccgaacagcgtctcgaggaactgctcgacgacgagcgcaacgctctcccgccacccctggccgaccgcctccgctcggtcctggaacgccgccgcaacgccgtgtgggagcgcctcggccagaccaacccggtcaccggcgaatcggtcgacgacacctaccgcaggctctcccgggacatgatcggtgccgaacgcgcggtgttcgtacgcctgcgggacggccgctacatcgacgacgagatgctgcgcacgctgctgcgcaggctggacctggaggaggcggccgcctaccgggaagccgcgtagtttcctcgccggttcgcggttccgggcggcgcggctacgacgggaacggccggcccgtcaccacggcggcgatcgtcgtcccgcgcgcgaaggcgccctcctcggccagggcgaccagcccgtacagcagcttggcgacgtacagccgctcgacggggacgccgtgccgcgcggtgaagtcctccgcgaaggcgtcgagttcgggggtgacgcgggcgtagccgccgaagtggaagcggtcgtcgagggaccacgtgccgcggcggccaccgaacgcctcgtcctgcaacgcctgtacggcggcgcccaggaagccgcccttgagcaccggtatgccgagggcccgccggccctgcggcaacccggcggccagtcctgcgagggtgccgccggtcccgcaggcgacggcgacgacatcggccacatcgcccagctccgcaccgagcgccgtgcagccgtggacggccagggagttgctgccgccctcgggcaccacatgggcctccgcggccccggccgcgcgcaggagggccgccagtgtctccggttcggccttgcgccggtacgtcgaccggtcgacgaagtgcagacgcatcccgtcggccgcgcaccgggccagggaggggttgaggggacggccggccagctcctggccgcggaccacaccgaccgtgggcactgcgaggaggcggcccgccgccgcggtcgcccgcagatggttggagtaggcgccgccgaaggtgacgacggtccgcccggcggcggcccgaaggttcggggccagtttgcgccacttgttgccggtcagctccggatggatcagatcgtcgcgcttgagcagcagccgcagtccgcgccggccgaaccggtcgtcgctcagctcctgcacgggagaggggagcctcggtgcgagcccggcgggatcggggacggcggaactggtcatccgcccattgtcctggaggcggcggaggaggcggaggcggtcggcgcctggccgaaaacccacgtccgggccgaacgggatcggcacgcctgcccgtgccggtggtgatccattcccgctctttcgtgtaatagcacggacacgttgcgtgatggaaggctggtacttgcaaatcgatgcccggcgccgatcgcggcgggcatgagcgggagggcaattctctatgtcggtaggcgatgaggtccgcacggagcaggaccggccgcagcagagcctcggcaccgcggccgcgcggaacctggccaccaccaccaagtccgtaccccagatgcaggagatcagctcgcgctggctgctgcgcatgctgccctgggtcgacgtgcagggcggcacgtaccgggtcaaccggcggctcacctacgccgtcggcgacggccggatcaccttcgtgaagaccggcgaccgcgtcgaggtgatcccggccgagctcggcgaactgccggcgctgcgggggtacgaggacgacgacgtgctctccgaactggcccagcgctgccggcagcgggagatcgccgcgggccaggtgatcgcctccttcggcaaccagtccgaggaggtctacctgctcgcgcacggcagggccgagaaggtcggcaccggcccgtacggcgacgaccaggtcctcggagtccttgccgacggcgcctacttcggcgaacaggcgctgctggacccggacgccatctgggaccacacggtccgcgccgccaccgcgtgcaccgtgctcgtcctgtcccggcacgacttcgagcaggtcgccgagcgcgccgactcgctgagcgcccacctggggcaactgcgctcgatccccgggcagcgcaccaacaagtacggcgagaaggcggtcgacctcgccgccgggcacagcggcgagccggacattccgcacaccttcgtcgactacgagggcaggccccgcgagtacgagctgagcatcgcccagaccgtcctgcggatccactcgcgcgtggccgacctctacaaccagcccatgaaccagacggagcagcagctccggctcaccgtcgaggcgttgaaggagcgccaggagcacgaactgatcaacaaccgcgacttcggcctcctcaacaactgtgagtacgaccagcggatccagccgcacgacggcgtgccgagccccgacgacatggacgagctgctcagccgccgccgcagcaccaaactgttcctcgcccacccgcgcgccatcgccgcgttcggccgcgagctgaacaagcgggggctggttcccgagacgatcgacatgggcggcaaccggattcccacctggcgtggtgtgccgatcttcccgtgcaacaagatcccggtcaccgaggcccggaccacctcgatcatcgcgctgcgcaccggagaggaggaccagggcgtcatcgggctgcgcgccaagggcatcccggacgagatcgagccgagcctgtccgtgcggttcatgggcatcaacgaacaggccatcatcaagtacctggtgacggcctactactcggcggcggtcctggtgccggacgcgctgggcgtactggagaacgtcgaggtcgggcgttggcgctgaggcccttcgccggctcccggtggctccgctcccgggcccgggcagggcaccccggcggtgcgcgcccggtgcggtacgcgcagacgccactgttcgcggactctccgagggggagcggatggccgagttcatgacggggacgacaccacgcccggccggtgcgcggcgcaccacggcggcggcgcggcagaaagaggcggtgcccatggagtcgctgccccggcccgccggcaccggccggctcgacgggccggagggtgccgcgggcggctgttccggacaggagggggcgtccgacgggcaggacgcggcggcgatcctcgaacgggcgcggatgtcgttcgatccggagctgcgctccgcggtcgcctcgctgcccgcctcgatgcgccgcgcaccggccgggcgtggtgtcgtccccgtcatgaactcggccatccgctccccctcggagagtccgcgaac

SEQ ID NO: 594 - DNA, 2809 bp, Unknown
  Kingdom: Bacteria, Phylum: Actinobacteria, Class: Actinobacteria, Order: Streptomycetales, Family: Streptomycetaceae, Genus: Streptomyces
ggcttcccggcaggctgccgccgcctgccgggaagccgacgccgacggcggtaccgcctcgcccggagcgccgagtggatcccccggtaccggaacggacggcgtcagggtcgtcgtcgtggacggctgtcccgccttcgaggtcaccaacgacgccgcgcaggccttcacctacacgatcacctaccagttgctgccgacttctgacatggcgcgggcgagcgacgagctgactgtgccatccgtcggcgcgggccggaccgtgcggcgcatggtcgccccggacgcgtcggccgccgccacggacggaggcggccgtgtgaagatcgtcaaggtccgcagcgtgcccaccgcggaggcgccggccgaatcggggccctgtccacgctccggggtgcgggtgtacgccgatgacggcgacgccgccatggggctgcgggtcgtcgggctgcacctggcgaactgcggcacgcgcgcctaccgcctgaacggctatccggcggtgcggctcttcgacgagcggcacgcaccggtcgacggcgtacggatcctgcacggcggcgcgtcgatcgccaccggcaccggagccgacgccgcgcccgcgccactggtcctcgaacccggccagagcgcgcacgccggactggtctggcgcaacaccaccggcctggcgagcgatcccgtcaacgcgccctacgtgcgggtggtggcgaagcccggtgccgccgcggtgacggtgacaccggaactggacctgggcacgaccgggaagctgggcgtcggcgcctggcagaaggacgacacggccgacggcgcgaggtgagagcggcaggtcgcgcgacgcgaggtgcggacggagggtcgcgcggcgcgaagtgagacacgatcccgggcacgcgccgcgaagtgagacacggtcccgggcggcgcgccctccaccgacgtgaggcgcggtgccgggcgcgccgtccatcggcgtgaggccggttccggcgcgcgccgcacggggcacgtgaggcagtcgtagggcgtgtggcgccgtgatcgtgcgccgccccgcctccacgtcgaggtttgtgcatccctggcgcgagcgcgccctcttcacgccgtaccggtggcttcttccggctgtttggctggttgctgcgcacggccgtcccgttgaccgtctcgttcaccaccggccgtcgcgcacacctctcgtcaccttacggagggaatgtgtcagcaccggacagcgtcaccggttccgccggcggggagccgcccaccgatccgcccgcggacagcgcgctcaccagtctcggtacgcgcgccgcgcgccaactggcgaccaccaccaagtccgaaccccagatgcaggccatcacgtcccggtggctgctgaagatgctgccgtgggtcgacgtcaagggcggcacctaccgggtcaaccggcgcctgcacctgcgggtcggccgcggccgcgtccagttcgagcacaacggcgcggacgacgtccgggtgatcccccggaccctcaccgaactgccggccctgcgcggctactccgaccacgacgtcctcgaggagatcgccgggcgcttccgcgtgcgggaggtccgggccggccaggtgctggtcgaggcgggccgtcccgtcacggaggcgtacctcgtcgtgcacggccgcttcacccggttcgccgtcggcaagtacggcgaggaggagatcatcggtgtcgtcacggacggcgaccagatgggggacgaggccatcggacaggccgacccgctctggctgacctccgtgcgggccgagacggccggagtgctgctggtgctgccctgggaggcggtccgggagttcacggaccgggtgccgtcgctcgccgagcacctgagcgcgtacgcggaacgccagcggctgccgatgaaccgcaagggcgaggcggacgtgccggtgcaggccggccacaccggagaacccacgctcaccggcggtttcgtcgactacgacctcgcgccgcgcgagtacgaactgtccctgacgcagaccgtactgcgggtgcacacccgggtctccgacctctacaacgatccgatggaccagacccagcagcagctccggctcaccgtggaggagatccgcgaacgccaggagtgggagctggtcaacaaccgggagttcgggctgctgcacaacgccgaccacgggcagcggatcagcacgttcaccggcccgccgacccccgacgacatggacgagctgctgtccatgcgccgcaagacccggatgttcatcgcccatccgaaggcgatcgccgcgttcttccggcagtgcaacaagcgcggcctggtgccgggctccgcggacgtggacggccatcaggtccccgcctggcgcggcgtgccgatcttcccgtgcggcaagatcccgatcagcgccacgcacaccaccagcatcctcgcgctgcgcaccggcgaggcggaccagggagtcgtcgggctctaccagaccggcatcccagaggagttccagccgggtctgaacgtccggttcatgggcatcgacaaggccgccatcatcaactacctcgtcaccgcctactactcgctggccgtgctggtgccggacgcggccggagtcctggagaacgtccagatcggcaggaccgccgactgaccgcgtggagcccaccatcatgagcacgcccgcacagagcacgcccgcacagaaggccgcgttcccgctgcccggcccgccgagccccgcccgcgccctgcggtcccgccgtggcggggccgttcccgggctgaagcaccgc

SEQ ID NO: 595 - DNA, 2059 bp, Unknown
  Kingdom: Bacteria, Phylum: Actinobacteria, Class: Actinobacteria, Order: Streptomycetales, Family: Streptomycetaceae, Genus: Streptomyces
gggcggcgggtgccgcgcaggccaacgccaaccaggccgcgacggcggcacggcagtcgcgcgatgcggccaacgccgccgccgcgcacgcagaggccgcggcgacggccgcggacaaggccgccgacgaggcgggcaaggcggtggacgccgccaaggcgtcgacggacgcggcgaacgaggcgagcaaggcggccgacgacgcgcagaccgcggccgaccaggcggcgaccgtggccggcctggcccgcaaggcggacgccgagcggctggccgagcagcaggacgaggacgtcctcgccgcccaggaggcgaaccaggagcacgaggcgcaggtcgcccaggccgagtgggaggcgggccgggtccagagactggacgccgagacccggcagctcgtgcaggacgccgccgcctccaccgatccgcaggtcacggccgtcaagggccggcaggccgcggtcaacctgctgagcaacggcggcagctgggtcgaggacgcggccgagaccgcgctggtgggcacggacgcggacgtggccgagttcgtgcgcaccgggctgaacatcgccctggagcaggacgaccgggcgagcgtggcgcacatcgccgagaccagcgacaagccggcgcagcggcaggccgcgctggacgtgctggacaagccggtcgaccaggtgcgggagtggctgcgcacccgcgcctacccgggcaaggaggacgacgaccggatcgccgtcgggcaggtcatggcccagggcgggccgggagtgaaggccgccggcagcaaggcgctggacggcaccgccgccgacctccaggagttcctggagaccggccagtacaaggcgcgtgaggacgacgaccgggtcgccgtctccgaggcgctggcgaccggcgggccggaggtccaggccgccgcgcaggcagcgctgtccgggccgccggccgggctgcggtccttcctccaggtgggcctgtaccgggcgaagcagcgcgacgccaatgccgcgtcccacatcgcagagatcaacacgctgctgagtgccgcctacaagtcggccgccctcgcccacgcggacgccgccgaggcacagcgcgtggccgccaacgcccgcaaggacgccaccaaggcggtggaatgggccgacaaggcgaaggactccgccaagctggcgtccgactacgccgcgcaggccgacaagtcggccgacgacgcggcggcctccgccgaccgcgccgccgagtccgcgaagaccgccaggaacgcggcggcctcggcccagaaggacgcgcagtcggccgcccactccgcccagcaggcggagcactccgcgaccctcgccggtggctacgcctatcaggcgagcatctccgcctatcaggccggggtctcggcggaagccgcgggcaaggacgccgccgcggcggccaaggcctcgtcggaggcgatgaagatcgccgcggacaagctcgtggcggagctgaaggcgcaggtccaggaggagtccaaggacccgagcaagccgctctcggacgcggagatgaggaagaccctcgaaaagcggatgttcgagttccggagggagcacgcgttcaacggcgacatcaagccgggcgacaccgagctggtctgcgccggcgacggtgccggtggcatgagctgcatcaccagcacctatctggaccgcctgatcgcctggtacgtgggcctggacgagatcgagaagtgcttcgacaagttcgactcgtcgtgcctcaaggacctcgccctgagcgccctcaagctcaagctgctcaagaaggtcccgtgcgcgaagaacagcttcgtgccgggcacccgcgtcctgatggccggccgccggaccaagcccatcgaggacgtccgcgtcggcgaccgcgtggtggccaccgacccgctgaccggacgcacccaggacgaacccgtccaggccctcatcgtcggccagggcagcaagaagctggtcgacatcggcgtcgcggcgccgggcacggggctgaccggctcgctgaccgccaccgccggacacccgttctg

SEQ ID NO: 596 - DNA, 7071 bp, Unknown
  Kingdom: Bacteria, Phylum: Actinobacteria, Class: Actinobacteria, Order: Streptomycetales, Family: Streptomycetaceae, Genus: Streptomyces
  misc_feature (248)..(269): n is a, c, g, or t
ctggggcgcgctcggcgtcccgtgctccgcgaagtgctcgacgagcgccctggcgtccggcttggcgccctgcagcagatagagggcgaccaggccggtggcgaacaggtcggcgggaaagtccggctccgcgcccagcagctgctcgggggccaggtaacccggcgtccccacgaccaggtcggtcccggtgagccgtggttcgcccagccgcatcgcgatgccgaagtcggacagccgcagccggnnnnnnnnnnnnnnnnnnnnnnggcgggcttgatgtcccggtgcacgacctcctcggcgtgcaccgcggccagccccgccagcaactggtccagcagggtgcagacgaaggccgagggcagcggtccgtagtccccgaccagatggaccagcgagccgccggccaccaggtccatggtgaacaggaccttgtcgtcgtcggcggcccagctggccggggcgagcacatgggggtggtcgatgcgcagcgcctgttcccgcacgaaacggagcagggagtgcgcgtcgctctgctggaggacctttgccgccacgtaccggcggcggcggtggtcccaggcgcgccagaccgcgccgaccccaccgcgtccgatcgggtcggccagctcgtaccggccggcgaagacctcacccatggctgcgcgtcgctcctcccccaggggtcacccccgttgcttcccccgcgacgcgcggtacgacccctgccggcggggtcagttctggtgggactgatagtgcgccacggcgtcggaggtgcggccggcgccgtacacccggaggaactcggcgagttcgggatgggtgggtgcgaggttgtccgcggcgtcgatgatgtcgcccgcggcggcgaccgagcggagcagcgactggatctcgcggaccacgcgcttgacggtcggcgcccctgaaccgcccgtcgtctgtgtggtgttgctgagcaccgagcccccctgcgacctcttgatctcttccatgcgttcggtcgcctcggccgcgctgacactgccgtcggccacctgtcccgccaggtcctgcagcagttgcacccgctggaccaccgccgggttgccgatcttcgcccgctggccgctcatcagctgcgacagcatcggtgcggacagccccagtacccccgccagacgcgcctggttgagccccagatcgtctatgagcttacggaagagcgcccccaacggctccccgtaccagttccgctgcagttcccgcgctctcgcggtggcttcctgctgtgcggcgtccatgtgcgtctccccatcgcttccccaagtaccgcggttcgctgtagcgaaccacgcgggagcatcttacggagagtggtcggcgacggggacccccctctttttgcgagatccggggggtgacccggtactctggtctgcggcagccgaccggtgggcggttcctccgggcggatgctcctctttcggggccttagctcagttggtagagcgctgtctttgcatggcagatgtcaggggttcgactcccctaggctccacggacaaagaagaagctccctctcgatccggaacgtgcggaccgggagggagcttcgtcgtgtgtcacccgcgctgcgccgtgtgccacccgtaagaggtcggcgggagtcagcccttgtcgtcgccgtccgtctgctcctcggcctccttcgcctggacctcggggtccagcacgctctggccgctgccgtcgacggaggtcaggcggccggcctccgggacctcggtggcggcgggcggctccaccagccagtccgggttggcctgcttgtcccaccacttccaggcggcgaaggcaccgcccgcgacgaccccggcgatcaggaacaccttcgcgatgcggccggcccgcgcccgccggcaccgcttgcgggccagcttctggatcttctgtgccggtacctggccgcgcagcgcgaccagtgcggcggcgccgcgtgcggcggcctcgtcggcgaccctccaggccgcggccatcgcctgctcgatccgcggcctggagtactcggccgcctgccgtgcggccctgcgggtccgctccgcggcgtcctgggcggcctggtcgatcttcggcggcacacgggtcatggcctgcgtgcgggcctgctcgagccggggcgcgacgtaggcgccgtactggacgcgggcctggtcggcggcgagggacaccttcggcgcgagccgtacgcgtgcctcgtgcgcgtagtgcgcggccctgtctctggcggtgtcggcgtagggcgccaccacttccgcggcgtgcagcacgctgtccttcgccgagccggtcgcggcgcgcacgctgtcgatgcgggtcacgggttcctcctcctcggtggcgtacggtaattcgactttccacccttttacggatcatgcctgtcaacgggcccggaggcatgtgaggacacgcatccgggtcatgcgcgccgcctcggacccggggccgctcttccggcccggcggcgccgagaggcgaacaaatacacgaattgcctgcaacgatggatgaaacggaagcaggtggtggataaggggcgacgggagcttcccgacgacaatgccacggatcaccgcaccgcgctcccgtcccgtgacgactcaccccgttttccgcaaccgattccggcggatcgccgcgcggaagaggccgctgggcgacgcacggcgcgcgccgtgcgaggatcggggggtcacaggaggacaacggaaggcagatcgtggctgagcagctctacgccaccctgaagaccaatcacggcgacatccaggtgcggcttctgccggaccacgccccggagacggtccgcaacttcgtggaactcgccacgggccagcgcgagtggacgaaccccgccaccggccagaagaccacggagaagctctacgacggcacggtcttccaccgggtgatcagcggcttcatgatccagggcggcgacccgctgggcaacggcaccggcggccccggctaccagttcaaggacgagttccacccggacctctccttcaacaagccctacctgctggcgatggccaacgcgggcccgggcaccaacggctcgcagttcttcatcaccgtctccccgacggcgtggctgacccgcaagcacaccatcttcggcgaggtcacggacgaggccagccagaaggtcgtcgacgccatcgcgggcacgcagaccaacccgcgcaacgaccgtcccgtcaaggacgtcgtcatcgagtcggtcgtcgtcgagacccggcagggctgagcccagggccacgcccggcagcgccgcccccgggagcaaccacgcccggggaaccaaacgccccgctcgtccgtagggatgagcggggcggagtgctgcccgcggtgagccgtactgtgcgggaccgagccgtacaccgtccgcgacgaacgtgaggggacccgatggaccaggcaccaggcagcccgcagatcgggcagggcggccccggcgtgcccacctgctaccggcacccggaccgggagaccggcatccgctgcacgcgctgcgaacggccgatctgccccgagtgcatggtcagcgcctccgtcggtttccagtgccccgactgcgtccgcagcggctcgggcacgggccacgcacccaccgcgtcccggccgcgcacggtggcgggcggcacggtcacggccgacccgcgcctgttcacgaagatcctcatcgggctcaacctggccttctacctggtccagttgtccctcggggattccttcaccgagcgcttcgagatgctgggccaagcctatattccctcgctcggctcggtcggcggcgtcgcgcagggcgagtggtaccggctgctgaccgcgatgttcctgcacagcggctacctccacatcgccttcaacatgctcagcctctggtgggtcggcggaccgctggaggcggccctgggccgcgcccggtacctgacgctctacttcgccgccggccttgcgggcagcgccctcagctacctggtcgccgctccgaaccagccgtccgtgggcgcctccggcgcgatcttcggcctcttcggcgcgatggccgtgctgatgcgcaggctccgctacgacatgcgccctgtgatcgcgctgctcgtgatcaacctggtcctcaccttccggggcggtatcgcatggcaggcccacatcggtggcctcgtcgccggggtggtggccgggtacgcgatggtgcacgcgccgcgcgagcggcggaacctggtgcagtacgggacctgtgcgctggtgctggtggccgtcgtcgtgatgacggtgatcagaacgggccagctcacctgagggccgtccggggccgggaagcggccctggaagcgggccccgaaacgttcttccgcacggttgtccacagtgcgtgccgagttctgtgcacagtgtgcgggaacagctgtgccccctgtcgctcacctgagtctgtgcaggtcaggcagggggcgggtggggctgtgcggggtggtgcgacagtcttaccggtgtcaaccggggatgggttatccacagatcgtcgggttttccccaggggtggtgtggaaatttctgccaggctgtggataactcagcggatacccgtgggcagaactgggtccaccacgggactcaccccgtgacggcccttacttccactgcgtggagacgccgaatccggcggcgatgaagccgaagcccaccacgatgttccagttgtcgagcgcgtcgatgggcagcgagccgtcggtcacgtagaagacgacgatccaggccaggccgatgacgaacatggccagcatgaccggggccacccagccgcggctctccagtttgatggccgtgccctgcttggcggcgggcggcggcgtgtagtcggccttcttgcggatacgtgacttcggcacgagggtctctcctgtcgatgcgctgcgtggccgcgcagggaactggactggctccggggcagcgtacaaggggactgccaggggagaacgaatgctcccccgggcgtccgttagcgtagtgcttccgcggtgccgaaggagataagggtacgttgagcaattccgccgactccccggggacgggtgccgacccgggccgctcacgccgtttcccgccggtgcggatcctcaccgtggccgtgttcgccctcgccggtctcctcttcatcaccagcttcaacacggccaagggcaccaacatccgcacggacacctcgctgctcaagctctccgacctcgtccaggaacgcagccgcaagaacaagggcctggacgagtccaacgcggccctgcgcggtgacgtcgagtccctggccaagagcgacggcggcggcaccaaggcgcaggacgagaagctgtcaggcctggaggccggcgcgggcacccggccgctcaagggcaaggccgtcaccgtcaccctcaacgacgccccgcccaacgccaccgccaagctccccggctaccccgagccgcagcccgactacctggtcatccaccagcaggacctgcaggccgtggtcaatgcgctgtggaacggcggcgccaagggcatcaaggtcatggaccagcggctgatctccaccagcgcggtgcgctgcgtgggcaacaccctgatcctccagggccgcgtctactcaccgccgtacaagatcacggcgatcggggacccggacaggctgcagaaggccctcgccgacgccccggcgatccagaactacatggtgtacgtcaacgtctacggcctcggctggaaggtcaccgaggacgggacgaccaccctgcccggctacaccggcacggtggacctgcactacgcccggcccgcggcgtagcgctgcgccggcctgtcgtgaccggccgcgccgtacctgccgcgtgaccggccgtgccggaccttcgcgtcaccggccggggtgatccggtccaagaaggccggaaacccggggcatcgcgccgttagtctggtgccgtacggcgtgaatccggtgccgtggggagacggaagggacggcatgtacggctggatctggcggcatctgccgggcaacgcgtggctgaaggccctgatctcactggtgctggtcctggccgtggtctacgtcctgttccagtacgtcttcccgtgggcggagccgctgcttcccttcaacgatgtgacggtggacaaccagtgagtgcgcggattctcgtcgtcgacaactacgacagcttcgtcttcaacctggtccagtacctctaccagctgggcgccgagtgcgaggtgctgcgcaacgacgaggtgtcgacggcgcacgtccgtgggagcacctcccggtcgagcgaagccgagactgggggaggtttcgacggcgtgctgctctcgcccgggcccggtacgcccgagcaggccggggtgtgcgtggagatggtccggcactgcgccgccaccggcgtgcccgtcttcggggtctgcctgggcatgcagtccatgcaggtggcgtacggcggtgtggtggaccgggcgcccgagctgctgcacggcaagacctcgccggtcgagcacaccggcaagggcgtcttcgccgggctgccctcccccttcaccgcgacccgctaccactcgctggccgccgagcccgcgaccgtcccggccgagctggaggtcaccgcccgtacgcccgacggcatcgtcatggggctgcggcaccgggaactcccggtggagggcgtgcagttccatcccgagtcggtgctgaccgagcacggacaccggatgctggccaactggctggcggagtgcggcgacacgggtgccgtggcgaggtcggcggggctcgccccggtggtgggcagggccacggcgtgaccgcgctgcgccccgagcgcgagtccggcgccggccgctacggcacggaggcgtacgccgcctccggagacccgtacgcggcggcgtcgtacgacccgcacggctcggcggcgccgtacgacacgcacggaccctcggccctcgcgtacccgcctgtcgccgacgacgagacggtgg

SEQ ID NO: 597 - DNA, 1594 bp, Unknown
  Kingdom: Bacteria, Phylum: Actinobacteria, Class: Actinobacteria, Order: Streptomycetales, Family: Streptomycetaceae, Genus: Streptomyces
gtccacgccctccggcacgctcggcgggctcggagcgtcggtccgcgcggcatcccgtgcgcggagctcgccgaacagggtccgctcgtcgcggccgcgcatcagcagcagcacgaagggatcctcgtccaggagccgcgccacgaggtgacacagcgcgctcgtgtgcccgcagtggtcccaggtgccgcagtcgcactgcggttccaggtcgccgatccccggcagcagctcgatgccggcggcccaggcgtcctcgacgaggtgaggcggcaggtcgtggtcgagcagggccgcgaggtacccggaccgttccacggccaggtcgaggaaccgggcccactggtcgtcggacaaccgctccagcaggacgtccgcacggtgtcccgtacggtcccgctcgtgcacgaccgcggtgatacggcccggccgtaccgacacggcgcccaccgctcccgagcgggcgaggcgtcgtccggtccgtacctgctgaccgtccagcgccgtgtcctccagcgccttcagccaggcgtgaccccaccacgtctgtgcgaatccgcgtccccgcgccggcggcagcgccgcgaaggtccgctccgggtcggtgtcgtggtcgttcacctggattctcctcgcaactccaccagcgcggtcagttcggcgtcgctcagttcggtgagcgcggactcaccggatccgagaaccgcctcggccaggtcacgcttgcggtgcagcagctcggcgatacggtcctcgatcgtgccctccgctatcagccggtgcacctgcacgggccggcgctgacctatgcggtaggcccggtcggtggcctgcgcctcgaccgccgggttccaccagcggtcgtagtgcacgacgtgctccgcgcgcgtgaggttcagtcccgtgcccgcggccttcaacgacagcaggaacaccgggacctcgccgtcctggaaacggcggaccgacctctcccgctccgtgaccggcgtgccgccgtgcaggaacagcgaccgtacgccgcgcgccgccaggtgccgctctatcagacgccccatctgcacgtactgcgtgaagaccagcgtgctcgcgtcctcggagaggatggtgtcgagcagttcgtccagcagctccagctttcccgaccgccccgggagcacgggccgttgctccttgaggaactgcgccgggtggttgcagatctgcttcagaccggtcagcagcttcacgatcagtccgcgccgggccatgccgtcggcgccggagatctcggcgagcgtctcgcgcaccagcgcctcgtagagcccggtctgttccccggtgagcgcgacggcgtgatcggtctccgtcttcggcggcagttcgggcgcgatccccgggtccgacttgcgacggcgcagcaggaacggtccgacgagccgggcgaggcgctcggcggcggccgggtcccggccgctctcgacggcctgcgcgtagcgtgtgcggaaggtgcccagccggcccagcaggcccggagtcgcccagtcgaggatcgcccacagctcggacaggttgttctccacgggcgtgccggtgagcgccacgcgcgcgcgtg

SEQ ID NO: 598 - DNA, 5054 bp, Unknown
  Kingdom: Bacteria, Phylum: Actinobacteria, Class: Actinobacteria, Order: Streptomycetales, Family: Streptomycetaceae, Genus: Streptomyces
cggccgtgagcgtctccaggctggtaccggcaaccgaaggctgggctcggcgcggccggctgatgcgggccctaccggtcggacgtccaggccgctcaggacagggcgagccgctcagggcggggcgagccgctcaggacagggcgagccgctcagggcggggcgagccgttcaggacgtccgcagtgcctgcgccatcttcgtcagctgggcgaaggaggctgtgcccgccaccaccgtcgtctcgcccttggcgccctgagacacgagggcgtcgtaacggccgccgctgtaccgggtccaggtgcggccgccgatctcctgggtgaccttggtggcgtgggcaccctggctggcgtcgtcgatgaagtccttgcgcctctgcgtggactgctcgatggccacgtactggccctccgggtcctggaagcccaggtgccagtagtcgccctggtcgccctggtagcggaccgaggtgggcttccaggccgcgggcaggccctcgggcgccgccaccgggtaggaggcggcacggcgtgcccccagcagtgcgacgcgatagtcgaccggcttgatgtccggagcgtgatcgtcgtgcggtacgaagaggtagacgactccggccgtcgccatgatcacgatcagggagaggatcgtgccccgcactgtcttctgcttgccgttcgaacctgccacgcccccatggtcgcaggtgtccgatccgctcatccgtggggtcccctgctcatcctgcccacccggcgatagagtcatggccagaaccctcatccggccgtcgtcgtatcagaaaggtgcgctccgatgaccgagcatcatcacttgccgtccgagctcgatgtcccctccgaggctcccgaccgcaacctcgccctggaactggtccgggtgaccgaagccgccgcgatggccgcgggccgctgggtcgggcgcggcgacaagaacggcgccgacggcgccgcggtccgcgccatgcggaccctcgtctccaccgtctcgatgaacggcgtcgtcgtcatcggcgagggcgagaaggacgaggccccgatgctcttcaacggggagcgcgtgggcgacgggaccgggcccgaggtcgacatcgccgtcgacccgatcgacggcacgaccctgaccgccaagggcatgcccaacgccatcgccgtgctggccgccaccgagcgcggcgcgatgttcgacccgtccgccgtgttctacatggacaagctggtcaccgggccggacgccgccgacttcgtcgacatcaacgcgccggtgtcggtgaacatcaagcgggtcgccaaggccaagcgggccacgcccgaggacgtgaccgtggtcgtcctcgaccggccgcggcacgagggcatcatcaaggagatccgggagaccggcgcccggatcaagctgatctccgacggtgacgtggccggctccatcctggcgctgcgcgacggcaccggcatcgacctgctgctcggcatcggcggcacgcccgagggcatcatctcggcctgcgccgtgaagtgcctgggcggcacgatccagggcaagctgtggcccaaggacgacgcggagcggcagcgggccatcgacgccgggcacgacctcgaccgggtgctgaccaccgaggacctggtcaggggcgagaacgtcttcttcgtcgccaccggcatcaccgacggcgagctgctgcgcggggtgcgctaccgctcggagacggcgacgaccgactcgatcgtcatgcgctccaagtccggcacggtccgccggatcgactccgagcaccggctgagcaagctgcgtgcctacagcgcgatcgacttcgaccgcgcgaagtagccggcaggccgccggctgacggcaggtggccaggctcgtccgggcccggcatgacgtggggcgctccctgtgcggaggggcgccccatcgtcgtacggtccgcttccggtcaggccctgccgggctagcccgccgccgctatgcggcccgtcgtgcgggccacctggttcagttccaggtcgcggcgcctgcggcgggccaggaccacgcggcgctcggcggcggtcaggccgccccagacgccgtacggctccggctggagcagcgcgtgttcgcggcactcgaccatcaccgggcagcgggcgcagacccgcttggccgcctcctcgcgcgacagccgcgccgccgtgggttctttcgagggtgcgaagaacagtccggcctcgtcgcgccggcacaccgcctcggtgtgccacggtgcgtcttggtccctgtctcgcaccggcacccgctgggccggtacggcagcgacctgcagggacgaatgcggcggttgcagcacggtctactcctgacgacggcttcgcgagcgagagacgatgcagcaaggcctacccgctgtacgcgggcctatgcactcagtggtgaaccggccgtttgctcaaccgatggttgctcacaggtgcttgcgcacgtgcttgtcgaccttgcgctgcacccggtcgaggatgtccgcgacgagcttgccgcgcttgggccgcgcctccacgttgccgaggacggcccagccgtcgacgtagacgacgggcgcgtcggggtcggccgcgtccagcgtgtccacctcgaagttgccgaggacgccgccgccggtgccgcgcagcgtcacgttctccgggacgcggatctggacgtcgccgaagacggagacggccttgatcacgacctgctggtactcgaaggtcgcctcgctgaggtcgatctcgacgctgccgaagaccgagtacgcgtgcagccgccgcccggcgcgccagcggcccttgcgggtggccgagctgaacaccgccaccacgttctcgtcggcctgctggggtatctcgtcgtcggccgggcgcctcggcgcgtacgaggcggaggcgcggttctggtgggcggcgggcaggtcctggatgaagacctccagctcgccgaccgtcttggcgttcagcgccccctcgacgcgctcggcgtgctcgtcggcggtcaggcggccctcggccagggcgtcgcgcagcaggtcggcgatgcggtcgcggtcggcgtccgaggcgcgcagctgcgtggcagggggcgcggtctgcttctgaaggtccacggcagcagcctacccaaacacgatagatcgcgacacctctacggcggaggaaccggagcgtactgagcgggacctcacagacccgctgccggcggcaggttctacgctggtcggtgcccgccaacggaggcgggcagccgtctgtcgagtgaggaatgggctgagatgccgcgtaattccccccctgcccaccctgcgttcgcgtacaccgatctgctcccccaaggcgaggacaccactccgtaccggctggtgacgtccgagggcgtctccaccgccgaggggcccgacgggcgtacgttcctcaaggtcgagcccgaggcgctgcgcaagctggccgaggaggcgatccacgacatccagcactacctgcgcccggcccacctcgcccagctccgccgcatcatcgacgacccggaggccagcgcgaacgacaagttcgtcgccctggacctgctgaagaacgcgaacatcgccgccgccggtgtcctgcccatgtgccaggacacgggcaccgcgatcgtgatgggcaagcgcggccagaacgtgctgaccgagggcggcgacgaggaggccctctcgcgcggcatctacgacgcgtacacgaggctcaacctgcgctactcgcagatggccccgctgaccatgtgggaggagaagaacaccggctccaacctccccgcccagatcgagctgtacgccaccgacggcggcgcctacaagttcctgttcatggccaagggcggcggcagcgccaacaagagcttcctctaccaggagacgaaggccgtcctgaacgagtcctccatgatgaagttcctggaggagaagatccgttcgctgggcacggccgcctgcccgccgtaccacctggcgatcgtcgtcggcggtacgagcgcggagtacgcgctgaagaccgcgaagtacgcctccgcgcactatctggacaacctgcccgccgagggctccccgctcggccacggcttccgggacacggagctggaggagaaggtcttcgagctgacgcagaagatcggcatcggcgcgcagttcggcggcaagtacttctgccacgacgtgcgcgtggtgcgcctgccgcggcacggcgcgtcctgcccggtcgccatcgccgtctcctgctccgcggaccgccaggcggtcgccaagatcaccgcggagggcgtcttcctggagcagctggagacggacccggcgcggttcctgccggagacgacggacgagcacctcgacgactccggtgatgtggtcaagatcgacctgaaccagccgatggagtcgatcctctccgagctgaccaagtacccggtcaagacccgcctctccctcaccggcccgctggtcgtcgcccgcgacatcgcgcacgcgaagatcaaggagcgcctcgacgcgggcgagggcatgccgcagtacctcaaggaccacccggtgtactacgccggtccggccaagacgcccgagggctacgcctccgggtccttcggcccgaccacggccgggcggatggactcctacgtcgagcagttccaggcggccggcggctccaaggtgatgctcgccaagggcaaccgcagcaagcaggtcaccgacgcgtgcgacgcgcacggcggcttctacctgggctccatcggcggcccggcggcccgcctcgcccaggactgcatcaagaaggtcgaggtcctggagtacgaggagctgggcatggaggccgtctggaagatcgaggtcgaggacttccctgcgttcatcgtcgtcgacgacaagggcaacgacttcttccaggacccggccccgcagccgacgttcacgagcattccggtccggggccccggcctcggctgaccccgcggcacaggcccggagcccccggcggtcgccgagggctccg

SEQ ID NO: 599 - DNA, 3447 bp, Unknown
  Kingdom: Bacteria, Phylum: Actinobacteria, Class: Actinobacteria, Order: Streptomycetales, Family: Streptomycetaceae, Genus: Streptomyces
ccagggcggcgtacgcctgcgcgcgcgggagccccggtacccgcaggcgtacgccgccctggaggacatcgtggcgggccgggccaccgacgtgcgctgggaggcgatcgccccgttcctgcacggccgctgggacgacaccgcacgggcgctggacgccgccgacgccgaggagaagaacagcgaggccgccgcggtgtacgggtccgacggcgcgtacgaccccgaggccacccgggccgcgctcggcgagctgtccgcacccgtgctggtcctggccggcgaggtcgacctgaactccccgccgcccgcgatggccgagtacgccggactgttcccgcacgccgaactcgccgtcctgcccggcgccggccacttcccgtggctcgacgacccggcacggttcgccacggccaccgccgcgttcttccagtgacccggcggtccgcgaccgcggggcagctgagtagggtgggggacatgccagaccagacagccgagcggcgcgaggaaagcgagcggcccgaactgcgcggcgactgcgcgagctgcttcgggctgtgctgcgtcgccctgccgttcaccgcgtcccgggacttcgcgcgcgacaagcccgccggaaagccctgcccgaacctccaggacgaccaccgctgcggcatccacgcacggctgcgggacgagggctacaccggctgcacggtctacgactgcttcggcgccggccagaaggtctcccaggtcaccttcggcgggcgcgactggcgcacggggcccgccgacgaggcccggcggatgttcgacgtcttcccggtcgtacggcagctgcacgaactgctctggtacctgaccgaggccctcaccctgcccgccgcccggcccgtccacgccgatctgcgccgggccctggagcggaccgagcagctcaccctgctgccgcccgacggcctcgccgcgctggatgtcgctgcccaccgccaggaggtcaacgtgctgctgctgcgcaccagcgaactggcccgggccaccgtgcggggcaagaagaaggaccggcggggcgcggacctgatgggcgcccggctcaagggcgccgacctgcgcggggcaagcctgcgcggcgcctacctgatcgccgccgacctcaccggggccgacctgcgcggcgcggacctcatcggggccgacctgcgcgacgccgacctcacggacgccgatctgaccggcgcgttcttcctgacccagccgcagctcaacgcggcccggggcagcgccggcacccggctgccggggtcagtcggccgcccggtgcactggacagcgcgcgcctgacccgccgctccccgtctccgcccccgtctccgtttccggtacggcttcggtggcggcccgtgcgggtgccgtccgccgctcgagccgcagccgcaggccctccggcatgagcgtgagccgttcggtcaccttcagccggtactccggctgaggcaccagctcgtagcggcgcagcagcaggccgaggaccagggtggcctcgtgcagggcgaactggcggccgatgcaggcgcgcgccccggtgccgaacggcttgaagacgtgcggcggacggctgcgtaccgcccgcgcgtcgaaccggtccgggtcgaaccgctccgcgtccgcgccccacacctcgggatcgcggtgcagcatcggcgtcagcaccagcgtccacgccccccgccgcatggggtgctccccggccagaaccgtgtcctgcagggcctcgcgggcgaaggcgggcgcggtcggccacagccgcagcgactcgtcgaggacccggcgcacgtaccgcagcttggcgacctgctcgtagccgggcgccgcggtctcgccccacacccggtccacctccgcccgggcgcgggcggctgtctcggggtgccgggcgaggtagtacagcgcgaaggacagcgcgcccgaggtggtctcgtgaccggcgaccaggaacgtgatcacctgacggcgcacgttctccgcggacagtcgctcgccggtctcggggtgggccgtctccagcatccggtccagcaggtccccgctcccggcggcaccgcccgagcggcgggcgcgcacgagatcgtcgacggtgcggttgaggtagctgatgtcggcggcgttgcggcgggtcgcgccgcgcagcagcaagggggcgagcggcgcggggacggagttgaggcgctgcgcgtaggagagcgtgccgaccatggcggtgacgaacgggtgcggacgcggccgttcgaaggaaccgaagtcgtgcccgaagccggtcctggctatggtctccagggtcagcttggtcatgtcaccgggcacgtccacggtgcggcccgcggccccggcgcggtcccagtggtcggtcagccgcccggccacctccagcatcatcaggtggtagcccgccatcgcctcacggctgaagccgggggcgaggacgtcgtgcgccagctgccagttcggttcgtggttgtacgcggtgaacagcccgtccccggcgaccgggcgcaggttggccacgcccaggcccacgtgcttggcgaagcgcgtctcgtcggcgaggtcggcggccagccgcgcgccccaggtgaagacgaactcgttgccgaacgccttgcggcggaagatcggaccgagcgagcgggcgtagcgcatcgagtcctgcaccggcgtgctccggtcgacgcccagcacatcgccgaggaagggcacccggcgcggggggtggggcagccggtgcagttcgggccagcccagctccgcgctgcggaatcctttcggcagtccggctccggctccggtcgttgtctccgccatgccgcgcgctcccgggtctccctggatccaccggaccgccgagcgggcgctgtgccggtccggcggcacgtgttggatgtgggttcaatagcggttcccagtctgagcccgttgttgaaccggcgtcaagtagagtgcgagcatggccgctaaccagggggagcagcgcacgcgccgccggctcagcaccgaggagcgcagggaacaactgctgtccgtcggagcacggctgttctcggagagcccctacgacgacgtgtggatcgagcaggtggccgagatcgccggcgtctcgcgcggactgctgtaccactacttccccacgaaacgggacttcttcgcggcggtcgtggagcgcgagagcgagcgcatgctgcggctgaccgccgccgtccccgggatcccgctgcgcgagcagctcacggccgggctggacgcctacctggagtacgtcagcgcccacgcgcacggctaccgggccttccaccgcgccgacgcggcgggcgaccaggcggtgcgccgggtctaccagcgggcgctggccgcacaggagcggcagatcctggacgcgctcgacgccgacccggagttcggcccgct

SEQ ID NO: 600 - DNA, 1452 bp, Unknown
  Kingdom: Bacteria, Phylum: Actinobacteria, Class: Actinobacteria, Order: Streptomycetales, Family: Streptomycetaceae, Genus: Streptomyces
ctggagcggatcgagcgggacatcttccgcggccggtcccgctccgccgtggtaccccgcgtcttcggcgggcaggtcgccgcgcaggccctggtcgccgccgggcgcacggtgcccgccgagcggcacgcgcattcgctgcacgcctacttcctgcgccccggcgaccccggcgcgcccatcgtctacacggtggaccgcatccgcgacggccgctccttcaccacccggcgggtcgtcgccgtccagcacggacagccgatcttccacctctcggcgtccttccagacgtacgaggagggcctggaccaccaggtgccgatgccgtccgcccccgacccggagaccctgcccacctccgtcgaacggctgcgcggttacagccacctggcgcccgaggtggtcgaacggttcctcgaaacccgggaggcagtcgacctgcggtacgtcgacgagcccccgtacggcgagttcggcgcgccccgcgagccgcactcccaggtgtggttccgcaccaacggcaagctcgacggggacgtcgacacaccgctcctgcacgtcgtcctcgccacctacgtctccgacatgacgctgctcgactcggtgctgctcgcgcacgggcgcggcggctgggcggtcggcgacgtcgtcggcgcctccctggaccacgcgatgtggttccaccggcccttccgcgccgacgagtggctgctgtacgaccaggagtcgccctccgcgtccggcgggcgcggcctcggacaggcccgcatccacacgcgggacggccggctggcgatcacggtgatccaggagggcgtggtccgcgttccccgggaacactgaagggcatggcggacaccgcaggagagtcggcagcacggcaggcggcacagcaggcaggcggcggcgagagcaccttcacggtggtcgtcgccgccctcgccaacctcggcatcgcgctggccaaggcggtggccggggtgctcagcggatccagcgcgatgctctcggaggccgcgcactcggtggccgacaccgtcaccgaggtcctgctgctcaccgcgctcaaacgcagcgagcgccccgccgacgaggaccacccgctcggctacggccccgagcgctacatctgggcgctgctcgccgccgtcgccacgttcgtcggcggcgcggtcttctccctctacgacggcgtccacaccctcctcgccggcgaggaactcggcgacccgctggtctcgtacatcgtcctcgccgtggccttcctgctggagggcttctcgctgcgcaccggcctgcgccaggcacgcggtgaggccgcgcgcctcagggtgcccttccgccgctacttccggcgtaccgccgacaccgccgtcaaggccgtggtcatggaggactccgccgccctggtcggcctgctgctcgcggccggcggcctgctcggcgggcagc

SEQ ID NO: 601 - DNA, 4154 bp, Unknown
  Kingdom: Bacteria, Phylum: Actinobacteria, Class: Actinobacteria, Order: Streptomycetales, Family: Streptomycetaceae, Genus: Streptomyces
ggatgtgcccggccttggtgcgcagcgcggaggccaggtcgcggcgggactgcggggagcgcgggttgaaggacttcgggatccgcatccgctccagcggctcgacgggcaccgggaagtcgatggccgccagccgcttgacctgccgctccgcggtcagcacgagggggcgcggaccgtcctggtactcgaagccgcgagggccgcccgcccggccggccggcaggcccgggtcgaggaccagagccaggcccgcgaacttgccggtggggacgtggatgacgtcgccgggcttgagcttctccagggcgacggcggcctcggcccgccgctgggcgacgccctgcctggccagctcgttctcccggtccttcagctcgcggcgcagccgcgcgtactccgtgaagtcaccgaggtggcaggtcatcgactccttgtagccggccaggccctcctcgttgcgctgcacctgccgggagatgccgacgaccgacttgtcggcctggaactgcgcgaaggaggtctccagcagctcccgcgagcggtgccggccgaactgctcgaccaggttgaccgccatgttgtacgacggccgaaagctggagcgcagcggataggtacgggtgccggcgagacccgccaggtgctcggggttcatggcgcgctgccacagcaccaccgcgtgcccctcgacatcgatgccacggcggccggcccggccggtcagctgggtgtactcgccgggggtgatgtcggcgtgctgctcgccgttccacttgacgagcttctccaggaccaccgaacgggcgggcatgttgatgccgagggcgagcgtctcggtggcgaagaccgccttgacgagaccgcgcacgaagagttcctcgacgacctccttgaaggtcgggagcatgccggcgtggtgggcggcgatgccgcgctccaggccctccagccactcgtagtagccgaggacgtgcaggtcctcgcgcgggatggcggcggtgcgctcctcgacgagcgcgcggacccggccccgcgcctcctcgtcgttgagcctcaggcccgcgtacaggcactgctggacggcggcctcgcaggcggcgcggctgaagatgaaggtgatggcgggcagcaggccctcggcgtccagccgctcgatgacctcggggcggctcggcgtccagatccgggagcgctggcggcgctcgcgctcgcggtcggcctcgcgcatgttccggccgcgtctgcggtcctggtacgacgggcggctggcctccatgcgggccatgcgcgtgaggtcggggttgacggcccgcttgcggccctcgccctcctcgaacaggtcgtacatccggcgcccggccagcacgtgctggaacagcgggacgggccggtgctcggagacgatcacctcggtgtcaccgcgcacggtgtccagccagtcgccgaactcctcggcgttggacaccgtcgccgacagtgacacgagcgtcaccgactccggcaggtggatgatcacttcctcccagacggcgccgcggaagcggtcggagaggtagtgcacctcgtccatgaccacgtagccgaggccgcgcagcgtctgcgagcccgcgtacagcatgttccgcagcacctcggtggtcatcacgaccaccggggcgtcggagttcacgctgttgtcgccggtgaggaggccgaccttggcgctgccgtaacggcggcacaggtcggagtacttctggttggacagcgccttgatgggcgtcgtgtagaagcacttcttgccctgctggagggcgaggtggacggcgaactcgcccacgatcgtcttgccggagccggtgggcgcggcgaccagcacgcccttgcccgcctccagggcccggcatgcctcgatctggaacgggtcgaggccgaagtcgtacatctcgcggaaacccgcgagcgcggtggcctgctcggcagctcgcctgcgcgctgccgcgtaccgctcggccggtgagaggtcctgagtcatcgtgctttcgagcgtaccgggccgcactgacaacaggacgatcattatcccgatcggccaggcaaccggtgagccgtcccgtggcccgggacacggcagagccggccgctcgcggggcgaacggccggcccggtgcgcgcgccagtggctcaggtcacgtcgtcgtagccgttgacccgttccgtaccggactgctcgggcagggcccggggggcggggacgggctcgacctcgccgatgtcctcgggagtgaggtcgaggtcggaggcctcgtcgtcggacggacccgccccttcgcgccgcagcttgcggcggtcgttgagcagggagaagcccacggcgatgaagaacagaccccagatcggcgccgccagcgacagcatcgtccccggatcggggctgggcgtggccacggcggcgaaggcggcgatgcccacgatcatgccgcgccaccagccgagcatgcgccgcccggacaggacgccggtgaggttgagcatgatcagcagcagcggcatctcgaaggcgagaccgaagacgacgaccatgcggatgctcaggtcgagcaggtcgtccaggggcagcaggttctccgcgccgctgggcgtcagatcgatcaggaacttcgcggtcgtcggcagcacgttgtacgcgaggtagccgccggcgaggaagagcgggaaaccgaacgtgacgaacgcgtaggcgtacttcttctcgtgccggtgcaggcccggcgcgacgaacgcccacaactggtacagccacaccggtgccgccagcacgatgcccgtggtgagcgcgaccttcagggccagggtgaagggtgccagcagaccgctgacggtgaggtgcgcgcagtggttgtccttggccttggccagttgcccgaaggactcctggcagccgatggagtccagcaccggccgcgtgatgaagttggtgatgtccttgtagtagaaggccgccaccaccgtcacgacgaggatcgccaggacgcccttcgcgagccggttgcgcagctcacgcaagtggtccgcgagcggcatacgcccctcgggatccctctccttcttctgggccggcttgagcaacccacatcctcatctcgtgcagtggaccgctgaggtcccggtcctcgcgtcagcgctgggtcgtcgtgtccgtcggctcggcgaccgggcgggagctggtcacgtcaccgggggccgcctggatcgtgcgctgggcctgcggggtctgctcgtcctccgcgggctgggcggacgtcgaggaggccttgccctcgcccttcatcgccttggcctcgctcttgaggatgcgcgcggacttgccgagcgagcgcgccatgtccgggagcttcttcgagccgaacacgaggacgatcacgagaatcaacagcaccaggtgccacggctcgagtgcgttgcggaacatctgtcttcaccttctcactgaggcggggcggcgggtcctgaccgacggacggacaggggtctgaccatcgtgctgacagcgatcgtatcgcccggggatgaacgcggaaccatccccacgtgtactcgtgccgtgcggaccgcgcctcgttctccggaccgcgcgtagagcgtacccagccgcaggagcattgggtacaggccgcagcactccacggggcgtgacgttcagaaactcacaaaagttcccgggaccacccatcagttcccgggccgctcaccggtcgccggtaccgctcaccggtcgccgcgaccgctcacctggtgccggccgcccgcgtcacccggggtcggccgcccgtgccgcgctcacggccgcccgctccagatcctcggccgccctgttgatacgccgcgccgagtccgagacctgcctgccgaggcgttgcgcctccaggaagacccggaccgccagcacaccgaggacggcaagtcccagaaatcccgcagctaccgcgaacatcggccacaccatggccctgagcctagacggtccgggagggcgctccgtgcaggccgtcggccggcagcgggacatcgcggctgcgaagggcctcggcaggccccggccggactgcccggcccggcgcctcgggtcacgcaccgaggtgccgtccgccgaaggcaccacgccgctgccc

SEQ ID NO: 602 - DNA, 7899 bp, Unknown
  Kingdom: Bacteria, Phylum: Actinobacteria, Class: Actinobacteria, Order: Streptomycetales, Family: Streptomycetaceae, Genus: Streptomyces
atcgtgctgcgcgtcggccgccggcgcgcagcacgatcgtcgctctcccgtcatgagccgaagtccccggccgtcggcgctggttccggccgcggcgccggttccgggtcggccgcccggtaggtggactcgtcgaggccgctcagggtcgggtcgtgtcccacctcgcccacgtcgtacatcgacgtcatccagtggtagaagttgtcgccgcgctcccgcagcacgtcgtagaggcggcgcagcatgcgggcgcggacctcggcccgctcggggtggtcgtagacgttctgcagctcgtcggggtcggtgcgcaggtcgtagagctcgttgaccgagtcggggttgacgacgagtttgtaccggtcctcgcgcagcatgcgctgcggataggggaagtggtggccgtggaactcgcagacgatgtcctcggcccagtcgacgctctcgccgtggacgagcggcagcagactgcgcgagtcgacggcgggcttcgggtcgatccccgccagttcgaggatggtcgcggtgcagtcgagcaggctgacgaactcggagcgcacgacgccggccggcgcgcccgggacgcggagcagaccgggtgtgcggtagatgtcctcgtacatcgccgggcccttgtcgtgcagccggtgtgagccggtgaactcgccgtggtcgcaggtgaagaagacggcggtgtcctccaccaggccgagccgctccatggcgtccatgacccggccgatctgccggtcgatcagcgccacgtagccccagtagaccgcgatgagtttgcgggtcgtctcgatcggcatcgtgtcgaaggtccagtgcgcgctgtagttgcgctgcaccggtggtttgccgtggaaggtctccgagacggacagcggcagctccacgtcgctcgggtcgaccaggtcgaagtactcgtcggggaggatgtagggcaggtgcggtccgaagaagtgcagggcgaggaagaacggccggtccctctcgcgggagtccgcggcgtaccgttcgagcttctctatggctcgggtggccaggtagtgctcgaaggtggcctcgaccggctggtgcagccgggcggcgagcaggttgccggggccgccgttgggcagtgtgccgcggatccggtcgctgatcgcgtagggcgggagcccgtgttcggcgaggtaggccaggtagtcggggtggtccaccgggttgtgccagcccgccaggtcggggccgtcgaagccgtggtcggccgccgtccggaggttgccggcgtgccacttgccgatgagaccgcagttgtagccgtgttcccgcagggcctgggagaaggtgaaccggtcctcgggcaggtcctccaggtatccgacgttgcgttcgtggttggcgagcaccttgtgccggaagggcgcctgaccggtcagcaggctggcccgggcgggggtgcagatggcggtgggggtgtaccagcggtcgaaacgggttcccgtggcggcgagttcgtcgaggaccggggtgtgcgccgaagggttgccgtaggcgccgagggtgtccacccggtgctggtcggtcatgaggaagaggatgttcttcctggacgtgccggaggttccggccgggccggcgggggtcacttgcccgctccggtgaagaggtcgccggtgtagtaggtcttcgggtccgcgggcttcttgagcttgcccgccccgacgaagtagtcgttcatgcccttcagccacttgtcgatggtgccgtccttcgtcagcttgtcgagttcgtcgacgctgagcagcttgttgttcgcggcgtccgccttgacctggtcggccgggatgccgagcttgccggcggtgagggcgatggcctcgtcggtgtgctcggagcggaactggatcgcgtcgcgcaggacggcgaggaccttcttgaccttctcggggtggtcggccaccagcttgttgccggccacgaacgcggtggggaaggagacgctgtcctcgaagtcgctgttcttggcgagttcgaccaggtcggggacctgcttcttgatggtggccgtcgccgggtaccagaaacccgccgcgtcgaccttcttggaggagaaggcggacacgatggtggacgggtccatggggacggccttgatgtcgctcttggtcatgcccgccttcttcagggcgagcgtgaggatcatgtcgcccgaggtgccctcgggaacggccacggtcttccccttgagctgctgcatcgaggtgatgcccggctgggcgatgacccggtcggagtcgccgagcgtgttgatcgcgacgaccttggcctggcccgaggccgggagccacatggcgcccgggcctatgtagccgaagtcgaggttgtccgtgcccagcgcctggatctgcagcgggccgttggtgaagaccttgctctgcgctgtcagtccgtgcttcttccacaggcccttggcgtcggcgatggcgatcaggctggcgccgttgaagtcgccgatgtagccgaagcgcaccttgtcgccggagcccccggaggacgagccgctgccgcatccggtcagcagtgccgccgtggtgagcccggcgagggcgacggagaggtgtctgtggaaacggtgggtggtcatgacggtggggtcccttctggtcacggcgtcggagcgggggcggcggaagggacggcggtgcggccttcctggtggtagacggagtgccacacgcggttgcgcagggcggcgaactcggggctgaggcggaagtcctcgtcgcgcacgatcgtgggatccacgtcgatcacgtcgtagacgcggccggggcgagcggccatgacgatcacccggttggccaggaacaccgcctcgtcgacgtcgtgggtgatgaacagcacggtgcgcttgtcctggctccaggtcttcagcagttgttcctggagcttgacccgggtgagcgcgtcgagggcgccgaacggctcgtccatcagcaggatggaggggttgacggcgtaggcgcgggcgatggcgcagcgctggcgcatgccgccggacagggtcttggggagtgcgtcggcgaaccgttcgagtccgaccagctggatgaagtgctcggccctggcccggcgttccttcttcggcactccggtggtccgcaggccgaactcgacgttctgacgtaccgtcagccaggggaagagggcgtactgctggaagatcacgcctcgttcggggcccggtccgttcaccggccggccgtccaccagggcacggccggcggtgggtgtctccagcccggccaggatgttcatgagggtgctcttgccgcagcccgaggggccgacgacggtgacgaactcgtggtcctcgatgtcgagcgagacgtcgtccagggcggtgaacgtctcgcggcccagggcgaaggtcttggtgacgtgctggacggagatcttggccggcttgctggtcatcggcgttcctgccatccggtgagcttgcgttccgcgagaaggaggacgcggtccatgagcagaccgaggaccccgatggtgatgagcccgacgaagatggtcgggaggtcgtagtagagctgggcgttctgcatgcggtagccgagtccctgctgggcggcgatgagttccgcggcgaccagggtggcccaggccgagccgaggccgacccgcatgccgacgaggatgaagggcgtggaggcgggcaccaccacgcgggcgaagatgacgagatccccggcccccaggacccgcgcggcgtcgatcagcgtgcggtcgacgttcaccacgccctggaaggtggagatcacgcacgccaggaacgcggcgaggaagatgacgaatatcttcggcgtctcgtcgatccccatgaccaccacggccagcggaatgatcgccagcggcgggatggtgcggaagaactggatccagggttcgatgagcccgcgcaggatcccgtaccagcccatcaggaatccgaccgggacggcggccgcggtgccgagggcgaagccgatcagcacccgggtgaggctggcggtgatgtcgtcctcgagcgttccgttgccgagcagcgtcccggcccgggagacgacctcgggcggtgtcggcagctggaagccggaggcggcgaggacccaccacagcgcgatacccagcgcgacggacacggcgttgaggagcagggggagccggcgccgccccgacggctcacgccgtggcgcggtcctggcggcggtctccgcgtcggtgccggccgacgcctcgtgcgctgttggcggtaccgagtcctgaggctcggtgtcctgcttgtcaaggacggacatgggcggctctttctgtggtggcgtcgggtgcatccaagcggcccttcacatcggtggtttcggggtaccgcgccaggaggggggagttgtggaacacggcggccagggcgcccagggcgccgtcctcgtccgagagccgcgcggcctccacgacgggaccggccgacgcggtcgggaagagctccgcggcgagcgtggcggcggcctgctccacgatgacgggggccagccgggtgatctcgccgccgatgacgaccttggacgggttcagggccatcgtcgccgcgccgatgacccgccccagcaccgccgcggcttcccggagcacccggtcggcgacagggtgcgaacgggccacggcggcggccagctcgtcgaggctctccaggcgcaggccgaactcccagcaggcggcgaggatcccgggcaccgaggcgacggtctccagacagccgcgctttccgcaccggcacgggcggcccgccggagcgacggtcacgtgccccagctcaccggccagcccggacgagccggtcaccagctggccgccgacgacgagcccgccgccgacgccgtccgagagccgtacgtagaccaggtcggacacgctgtcggcgccgctgatggcctcggcgagcgcggccaggcgggtgttgttgtcgacgatcaccggcgcgccgaaacgttccgcgaacgccacgtccacgccttccggcgccggacgcagcaccgtcggtccccggcgggcacggggccacgcggctccctccggcgccgggtagggccccggtacgccgatgccgatgccctgaagcgcgccgtagtggacgccggccccggaactcagccgctcgacgagcccgagggccagctccgtgcgcgtctgccaggacgccgtgtcgtcgtacctcaccgcgcccgagacgagaatcttgtgcgaggcgtcggcgacggctacgtggaccctgcggtgtccgaagtccacgcccatgaactgcgccgacgccgggtccagcgcgagccgttcggccggccggccgctgcccgcgcgcagggaggcgtcggtgtccacgacgacgatcgcgccgcgttgcaagaggtggccggtgatctcggagagggtcgtgcgggacaggccgacgacccgggcgatctcgccgcggctcatggcgccgttctcctgcagcgcacgcagcacgcgatcttcatgggtacgcctgaccagtgcgtgcactcccgtgggcttctgcatgtcggtcaaggtagggaggccggggtttttccgtcaacactccggcggaaagaagtggggagattggtcgcccgtcgggagaaagccatgccgttattcgatcgtgaccactcggtgggagtggggtgttgacccttgtgagctgcaactacctgctcgtgcacgtagggttggcgccagcgcctcctccggattattcatccggcctgttgacccaattgaccggccgttcccatgctgtgcgccatgccaaccaaggacggccctccggcccgccgcgggcggaggcgtcaagaactcgtcctcgaactgctgaacagacacggtccgctcagccggggtgaactcctcgagcgcacaggcctgtccaggacgaccctgtacgacaccgtcgcggcgctcgtcgacgacggcgcgatcggtgatgtccgcaccgtgcaggccgacttcggactggccgggcccttcccgcccgcgcaccggctgcgcgacccggaactcggcggcggggcgctgctcgacctcggcgtctacccggtgtcgttcgcgcagttgctgctcggcgagccgtcggacatcgcggcgaaggcggtgctctcggccgagggcgtcgacctccagaccggggcgctgctctcctgggacggcggcgcgctggcccagctgcactgctccatcaccggcggtacggggacgaccgcgtcggtcaccggctcgcggggccgcatcgacgtgccgtccgggttcttccacccggagcggttcgtgctgcaccgcgtcggccgcgagcccgaggagttcacggccgacccggccgacggcccgcgcagcagcctgcggcacgaggcgctggaggtgatgcgcgcgctgcgggcgggcgaaaccgagtccccgctggtgccgctggacggcacgctcgcggtgatgcggacgctggacgcggtacgggagcggatcggggtgcgctatccgggggaggcggcggaacccgggtccgagcccgaggccgaggccgcgctcgtgtgacgagcacactcgtagggcgacggcaggcgtgaacaccgcgcacgcttgacgaccgcacacgcctgacacgggcgcccggcatccgtatggcggacacggaattccgcatgacggagcgtgctcgtacgctccggtgccatgactgccattactgccacgactggcaccccatcgaagatcgccgtggtgacgggcgcgggctccggcatcggccgggccgtcgccgcggagctgctcggcgcgggctggtccgtggtcctggccgggcggcgcccggagaccctggaggagacggcggccctcgttcccggggccgccggggcctccctcgccgtacgcgcggacgtgacccggcccgaggacgtggccgcgctgttcgccgcggccgtggaacggttcggccgggtggacctgctgttcaacaacgcgggcaccttcggccccggcgccgtgcccgtcgaggacctgtcgtacgaggcgtggcggcacgtggtggacaccaacctcaacggggcgttcctgtgcgcgcaggcggcgtaccggcagatgaaggagcaggacccgcagggcggccggatcatcaacaacggctccatctcggcgcacacgccccggccgcactcggcgccctacaccaccaccaagcacgcgctgaccggcctgaccaaggcgctgtcgctggacggacggccgtaccgcatcgcggtcgggcagatcgacatcggcaacgcggccaccgacatgacggtcgggatgcggaccggcgccctgcagcccaacggagaggtggtcccggagccggtgatggacgtcgccgacgtggcacgcacggtgcggcacatggcggaactgccgctggaggccaacgtgcagttcgcgacggtactcgcgacgacgatgccgtacgtgggccgcggctgagcccgccgccgccccacgctcaccgcgtgcacgacagccgttccacggaccggtgtgcatcccgcgcgccccgcgcgaggtccacccccagccggtgccgtggaacggctgccgaccccctcccctggatgtggccgacgggagcgacggacggccgacgcgacggacgctcgacgctccaactgtgaagctgcggtgaaggagatgtcgagcatatgccgtccaccggccaggacggcgcggaattgtcgattccccttgtgcagatcgcgttccttccgagggctccggctcctcaacggcggtggcggcccccggtgtccgcggcccgcgccgccgcccggcgcctgcgcaacgcccacacac

SEQ ID NO: 603 - DNA, 3920 bp, Unknown
  Kingdom: Bacteria, Phylum: Actinobacteria, Class: Actinobacteria, Order: Streptomycetales, Family: Streptomycetaceae, Genus: Streptomyces
cccgggccggccgcgccgccacgccggagcaatcccatcatgcccgccgcccccacctacccctgctcaaccccgctatcgtcgagccgaatgctcaactgggcgcctaactcctgaaatccgagtgcgtgagcaacccgtcgggacggttccggccgagctctccattgaggcatgaggcccgcgtcgagagcgtgtgcgactgctgcggaggccaccgtctttgccaacccacgactgcgatgctccggcaccgtcaggacggacagatgcgctgcccctcctggccaagcccgatatcccgctgcggccacgacctcgacaccgtcaaagacgacgaaggcaggcgacgagatctcatccagaccgctttcgccagcgtcttcttgccccgccctcgtcagcaaagccagcaagcccgggtgccccacagccacgcgcgtcaccgtccggtctgtggacatgggacggaaatcctggctggacaagtaagcgagagcggccggacccagtacatcgacgacggacagtttggcccggagcacatccgtctcgaccagggctgcagggggcacctcagcaacgactttgcgcagctggacggcaatctcggccgtcggcaccgtgacgatccctgttccgcccaggaccacgaccccgcaccacgcgggcggacacagttgcgatctgggcgagacgatcacgccggcggcggagcgtccgaactccacgggcgcgccagccacgtcctgccacagcgcatgagcacgagctatcagcggatccagcgtcatgcctggatcctgccattcgaagatcaccggggaaatgactttccccggctgccgcacttcagtcgaacgtggacgacaacacgaactcgctggatgccgccgctagcggtagttcggaaaaacaggttcaagcagatcaacgacaccgtcggccatgcggccggggatgctgtgctcgccgcgttcggtgcacggctcaccgtgtgggcaggcccgcacgccgcgatcggctgcctcggcggcgacgagttcgccgtggtcctggagctgccctccgacgtccgcgagcagcgactcgcgcacctggtgacgatgctccacaccccggtcgtcctcgacgacggccgcaccatcgacgtcgccgcgtcggtcggggccgccaccccggacgtgattggcacccgcgacctcaccgtccttcaacgggccgccgacgccggactgtacgacggcaagcaccccggccgcgcccacttcgccacagccgcgcacaccacggcgctgtccatcaaaggccgccgcgccgggcgcccggggacggctgtatggggcgggcaggatgaccgcgacgcggcgactccatgggccacacaggctgcggcgtcgccgcgtccggccggtcaacgcggtctgtcggaagaccggttgtgatctctaggctctgcccatgtcgaagcagcagcgaggcaagaagcaccggacaccgcagaagcgggtcgcccgtccctccgtaccgcgtccgcgcagggcggctccggcactgccggggagcatggatcacttggcgcggatgctggagcacgccaagccggaccagatcgtggagctggtgctgccctacctatgggcggccctctccgacggccgcgcgccggcgaacatctgcgtcgatgcgtgcatgacgctgcggaacgcctacggccagctgggattgcgggccgaactgctgccggtcaccgtggccatccggaagaagaacggcaccggaaccctctacggctcgctcacaccgagctggacgggaacctcatggaacgggcactgcgccctggtgctccccgactccgagcggttcgtggacccgacgatcgagcagttcgacgaggtccggaagatcggcatgggcccgatggtcggtaaggtggccatgtcgacccgcgaggacggctcgctggagccgggtgcgcaggtgatgctgcagcgcggtgacctggtgctgacgtacaccgtcgccggcccagaggccctggcctccatcgtggaacacccggaggcgatcgctcacgccgatggtcaccggcgtaccggagtgaacaccgcgtccctcatgctggccgccctgcgcgctaagggcgtacgcgaccgggcgatgcaagcccctcaccagaggctgcgcgccctgctgcaggcggtcggagacgccccgtacgagtcggacgatgcgcaggacgtgcggttccacctgccggatcagagcggccaggaacagtggctgcggctggacgagattccgctgccgcataacactccggccgcctggccacgctgaggatcgagcagcacgaagccccgggaccatgacgacccggggcttctctgtgcgcgggtacgccaggctcaacgagccgggcctggcccggtcaccggctccgggtagcccgccggcggtcgggctgtcggtgccgaggcgcacccacttgtcacggcgctgtagtgcgaatgagctctccttcggcatggtcgcgggggctggcgcgctcgtcgcctaccgccgccaacgcgtcgatgagatcggcgccggccgggaagccagccggctccacaccgagcgcttctcccaggccgtcgaacagctcggctccgactccccagccgtccggctcggcggcgtccccgccctggccggtctcgccgacgacgcctccgacgacagcctgcgtcggacctgcatcgacgtcctgtgggcctgcctctaactccccttcactcctgactctggcgacgaccccggccgccaggaggaggagcaccgctacctggcttttcggaaggctcggcacacgatcctgcgcctcgtcggcaccactaccgacgtccccagggggcgccccgctcctggcagggctgcgacctcgacctcactggggtcgccatcgacggcgacatgggcttcagcggcgccacgttctccaggggcacggtggccttcaacggcgccgcgttctccggcggcgcggtgaacttcgacagcaccaggggtccagcgcccgacggactcccagaacagaagccccgtactccccagcaggggagtacggggcttttctgtgtttctggagctgtccggcggaggccggctcagccggtctactcgtgctcggagagctgttgcaccagtgcggtgtactcggtggggaactgctcacggaggacgctcatgaggacttgggcacactgcacgaagacgggcggctccatcttgcggcgcaggtggtgaacgatgaacggggcatcgtcatagggcagatgacggggctggccgtgctcatcctggtcacacgcgttctccgggaaatcggccgaggcggcgggtgccggagaggtattaacggcgttaacggtgccgggagagggcgagtcctgccccgctgagccctctgggccgttaacgccgttaacggccgggggcctgctgcgctcgtctgagagcttccgacgctgccgctggcgtggaggcttaacggcgttaatagccatctcggcctcgtcggcctgctgctcttgcgggagtcggccgatgcggcgggctggctcgaccttcaactcaccagtctcgaccttttcctggaggtcaggggtgagttgaaggagcgccatgcgctgcgatacccaggccgccgtctttcccagcctcttggccacctgcccttgcgagccgtggaccttcaccagcccctggatggcgcgcgcctggtccatgggtgccacgtccacgcggtggatgttggcgatgagggcggcttccaggaggtctgcggcgctggctgcgagatcgtcgttgacgtcgatgcgcagctcatcgagccctgccagcgccgcagcggccaggcgccggttgccgtcgat

SEQ ID NO: 604 - DNA, 6325 bp, Unknown
  Kingdom: Bacteria, Phylum: Actinobacteria, Class: Actinobacteria, Order: Streptomycetales, Family: Streptomycetaceae, Genus: Streptomyces
gcccaggcgccccggccgcgcaccgcgcggaaggtctccccgcgcatcggggcggccacgacgcccaccacggtctcgccgtcctgctcggccgcgatggagacggcccaggtgggcagcccgtagaggtagttcaccgtgccgtcgagcgggtcgatgacccagcggatgccgctggtgccctccgtggcggccccctcctcgccgaggaagccgtcgtcggggcgccggtcggcgatcaggtcggtgatcagtttctcggccgcgatgtccatctcggtgacgacgtcgatgggactcgacttggtggcggccaccccgaggtcggccgggcggccgtccctgagcaggtccgaggcgcgggctgcggcctggagggcgagctggagcagttccgtgtacagggcgtcggtcacggtggtcctcacgcgtaggggctgtcggcgcccgcggcggcgggacgcggggcgcgggccgggcagcagcccaccgggcagaggttgtggccggcgccgagcgcgcccagggcgcagggcgtgacctggcggccgctctcggtggctgcgcgctccaggaccaggtcgcgcacggcggcggcgaagcggcggtcggcgccgacggtggccgagcgccgcaccggcaggcccagctccccggccttggccgtggcctccgtgtcgaggtcgtagaggacctccatgtggtcggagacgaagccgatgggcgccatgacgacggcggggactccggccgcgtgccgctcctcgaggtggtcgcagatgtcgggttcgagccacgggatgtgcggggcgccggagcgcgactggtagacgagctgccaggggtggtcgacgccggtgcgctcgcggaccgcgtcggcgatcagccgcgccacgtccaggtgctcgcggacgtacgcgcctccgtcgccgtgctcctcgaccgggccggaggtgtcggcggccgaggtggggatggagtgggtggtgaaggcgatgtgggcgccgtcgcggacgtcctcggggaggtcggcgagggactcgagcacgccgtcgatcatgggttcgacgaagccggggtggttgaagtagtgccgcagcttgtcgatcctcggaagttccaggccctcggccttgagcgccgccagggactcggcgaggttctcccggtactggcggcagcccgagtaggaggcgtaggcgctggtggcgaggacgaggatgcggcggcggccgtcgcggaccatgtcccgcagggtgtcggtcaggtagggcgcccagttgcggttgccccagtagaccggcaggtccaggccgtgctcggcgaagtccttgcgcagggcgtccagcagggcgcggttctgggcgttgatggggctgaccccgccgaagaggaagtagtgctgcccgacttccttcaggcgttcggtggggatgccgcgcccgcgcgtcacgttctccaggaacgggaccacgtcgtccggcccctccgggccgccgaaggagagcaggagcagggcgtcgtacggagtggcatcgagcacgtctgacatgtctcgatcctgccaccccgtgctgacagccgggattgcgacccgcatgagcgggtgcgccgggggccggcggggccgtaagctgtatcagctcctttcacgccttaccggatacccggagatcctgtgcccagcccgtaccgtgccctgttcgccgctcccggctccaagggcttctccgccgcgggtttcctcggccggatgccgctgtcgatgatgggcatcggcgtcgtcacgatgatctcccagctcacgggccgctacgggctcgcgggcgcgctgtcggccaccatcgcgctggccgccgccgcgctcggtccccagatatcccgtctggtcgaccggcacggacagcgccgggtgctgcgcccggcgacgctcgtctcgctcgccgccgcggccgggctgctgctggccgcgtacttccgctggccggactgggtgctgttcgtgtgcgcggccgggatcggttcggtgccgtcgctgggcgcgatggtccgcgcacgctgggcggcgctgtaccgggggaccccgcagctgcacaccgcctactcgttcgagtcggtggtggacgaggtctgcttcatcttcgggccgatcgtctccatcgggctctcgacggcctggttcccggaggcgggaccgctgctggccgcctgtttcctggcggtgggcgtcttctggctcacctcgcagcgggccaccgaacccgtgccgcacccgcgcgagcagcacagcggccattcggcgctcagggcgcgcgggctgcaggtgctggtggccaccttcgtggcgaccgggtcgatcttcggtgcggtggacgtggtcaccgtggccttcgccgacgagcgggggcacaagggcgcggcgagtgtcgtgctcgcgctgtacgcggccggttcgtgcgcggcgggcgtgctgttcgggctgctgcggccgtcgggagcgcccgcccgtcgctggctgctgggcatatgcacgatggccgtgagtatgatccccctcctactggtcggaaacttgccgtttctggccgtggcgctgttcgttgcgggcctgtccgtcgctcccacgatgatcacgacgatggccctcgtcgaagagcacgtaccacgcgcgcacctgaccgagggcatgacctgggtgagtaccgggctcgcggtgggggtggcgctgggttcgtcggtggccggctgggtgatcgacgcggccggcgcgcgctccgggtacggggtgccggcggtggccggggccgtcgcggtcgcggtcggtttcctcgggtaccgccggctcagcaggccggctccgggtcggggaggcaccgttgggcagcacagcgagcgcgaagaacggcatatggcgtaactggggcgggaacgtccgctcccgtcccgcgcgggaggtgacacccgcgtcggtggaggaactggccgcggccgtgcggcgggccgcggaggacggtcttccggtgaaggcggtgggcaccgggcactccttcacctccatcgccgccaccgacggtgtcctggtccgcccgcagttgctgaccggcatccgcggcatcgaccgcgaggcgatgacggtcaccgtggaggcgggcaccccgctcaagcggctcaacgcggctctcgcgcgggaggggctgtccctgaccaacatgggcgacatcatggagcagacggtgtcgggcgcgaccagcaccggcacgcacggcaccggccgcgagtcggcctccatctccgcccagatcacgggactcgaactggtcacggcggacggttcggtgctcacctgctcaaaggaggagaaccccgaggtcttcgcggccgcccggatcggcctgggcgcgctcggcatcgtcaccgcgatcaccttcgccgtcgagccggtcttcctgctcaccgcccgcgaggaaccgatgcccctggaccgggtgctggcggagttcgaccagctctgggcggagaacgagcacttcgagttctactggttcccgcacaccggcagcaccaacaccaagcgcaacaaccgcagcgcgggccccgaggcaccggtggcgccgctggccggctggatcgaggacgagttcctctccaacggtgtcttccaggtcgccaactggatcggccgcgcggtacccgcgaccgtcccggcgatcgcccgcctctccagccgggcgctctcggcacggacgtacacggacatcccgtacaaggtcttcacctcaccgcgccgggtgcggttcgtggagatggagtacgccgttccgcgggcggccctcgcggacacgctgcgcgagctgaaggcgatggtggaccgctccggcctgcgcgtgagcttcccggtggaggtgcgcaccgcgcccgccgacgacatcaccctgtccaccgcgtcgggccgggacagcgcctacgtcgcggtgcacatgttccgcggcacgccctaccagcggtacttcaccgccgccgagcggatcttcaccgcgcacgagggccggccgcactgggggaagatccacaccagggacgcggagtacttcgcgcgggtgtatccgcgcttcggcgagttcacggcgctgcgcgaccggctggatcctgaacgcctgttccggaacgactacttgcggagggtgctggggcagtagccgaggcgccgggtgcgggggccgtgccgtcggtgcccggcgagccgtccgtgcccgagcccgacgccgagcccgcgggcgtcctgcccccggaccccgtgcccgttccggtccctgagccgcccgtggcgccggtgcccgtgtgcgtaccggtgtccggagccggcgtcgcggtcccggtcgtgtcccggccggggccgccggaggcgccggtgcccggcgacaccccgtcacccgccccggtgcccgcgctcggcgaggtggacggctccggcgtgtcgccgccggagggtgcctgcttcccgcggtgaccggtcacggcgtcgccgaccgtggttccgccgcggccgctgaagctgctgcccgacaccagttcgtaggcggtgatgccggccatggtgacgccgaacaccagggccgccgcgatcaccggccgcttccagctcttgacgcgggcccggtagacggtgccctcggagaactcgccgtgggccggtgccccgctgctgccggccatcgctttcccgccgccgggcgacgcgaccgcgaccggccgggaggtgacggtgaccgtgcggatctgctcgccggtgcgccggaagaagtgctggaagaccgagccgccgcaggtggcgaccacactgacgacgccggccccgaggatcgtgccgtacacgccgaagtacgaggcgagtttcgcggccaccacggcggccaccgcactgcccgcgacctggggcaggctcaggtcgatccgccgcttcctcacctcctttcccgcactcacctcttcccccgcactcaccccgtcaccgctctcgggcttttcgcgcatacccggaccttgcctacctctccggcacatgaccgaccttcgggatctgatcggccgactgcacgagaaagggacgtacggacgaaaccgttagttccgtttctggtgattacgtgaagtacgccacgttcatgatcgagaaaacgggtcagggacggccaagtcccaccccttgccagaagttgggcggcgcgccgatccacgcacgtggtccgaatggagtactgttgcgagccctgggtccggcctcccgccggggtgtccgagacctgctggaccgccgggagggggctggttgcacagggtgacgcatttggtcactgagcgttgtgaacaggtaaccgtgccataacggcgttccagggcccgcgcccgacacgccgggcaactcggcaaggttgtggcaggctgcacccgggcaggccacactcgactagcggaagcagcgacgcacgtgacgtcggcaggcaccacccgggaggtccccatgcccgaactgcgtgtcgtggccgtctccaatgacggcacacggctggtgctgaaggctgcggacagcacggagtacacgcttcccatcgacgaacggctccgcgccgccgtgcgcggcgaccgtccccgcctcggccagatcgagatcgaggtggagagccatctccgcccccgcgacatccaggcgcggataagagcaggtgcgaccgcggaagaggtcgcccagctcgccggcatccccgtggaccgcgtacggcgcttcgagggccccgtgctcgccgagcgcgccttcatggccgagcgggcccgcaagaccccggtccgccgccccggcgagaactccggcccgctgctcggcgaggccgtccaggagcggctgctgctgcgcggcgccgagaaggacaccgtgcagtgggactcctggcgccgcgacgacggcacctgggaggtcctgctggtctacctggtcgcgggcgaaccgcactcggcgagctggacgtacgacccgccgcggcgcctggtgcaggccgtcgacgcggaggcgcgcgccctgatcggcgagtcggacgacctcggcacaccggaacccagcttcccgttcgtgccccgcatcgcccggctgccccgcgaccgccccctcgaccgcgaccgtcccctcgaccgggaccgtgaccgtcccccactgccggcgcagacgctcgaaccggccgcggagagcacgggtgagcgcgactccctgaccagcctgctggaggcggtgccgagcttccgcggcgacctggtggtgcccgagcgcacaccaggt

SEQ ID NO: 605 - DNA, 8859 bp, Unknown
  Kingdom: Bacteria, Phylum: Actinobacteria, Class: Actinobacteria, Order: Streptomycetales, Family: Streptomycetaceae, Genus: Streptomyces
gcttgccggccgcggccggcagcgcgccccgcgtcagcaggaagccgccgtgctccatgcccgtggggtcggtgatggcgcggaccttcttcaggtcccgcggcaccgtccagcgcacctcgtgcgaggtctccatcccctgggacgtgtccaggtacagcttcttgccgggcttggccagcgccggggtgtcggtgtcgaacttggcgccctggacggcgaagacgtcaccgtcacggcaggacggcagggccgccacctcgcgcagcgccgcgcagtcgccgacggtcacctcggaactcagctcgggcccgtcgggcgagtcgtgggtcgtgctgccgacgtgggcgttcgccagcgcgacggccttgcgcacgccccgggtcgccctgaacttagcgacggccgggtcggccgcgaccccgtgcgagagctgcacctggatctgcgcccggtcgacgtcgttcttcgacgccttggtgtagtcgctctccactcccgcgaagagcatctgcagcgcgatggcgccggccaccgcgacggagatgccgttcaccgtccgggcggcggtgccgctgctcaactggagccgtctgacggccagttgccaggagaccgagccacggcccagccgggccacgaccgcctccacgatccacggcagcagcgcggtcaccccgatcagcaggaggatgacaccgccggacaccaggtactggttgaaggcgccgtcgccgcggccctggccgatcatcggcgcgagcatcgccaggccggccaccggcagcagcagccgccaccacaggcggcgccgcgcgggcttggccgtacggatcacgccgagcggctcgatgaccaccccgcgcagcgcgagcagggtcaccagcaccgccgccgccgggacggcgaccgcgaccagcgcggccagcgcgggcgacgggttgaggtagctggggaacacgctgatgtccatgacctccagcgtccccgcggcctcgcggccgagcaggaagaagaccgcgccgaagaccagaccgagcagcgagcccgccagggcctcgcccgccgcgatccggcgggtcatccggctgtcggagccgaccagccgcagtgcggccagcctgcggtcgcgccgctcgccgccgaaccgcacggccgccgtgatgaacacggccaccggcatcagcagcaccacgaagacgaccagcaccagcaggatcaggaccgggtcctggcgctcgggcacccggttcggggagccgtactcgctgatccgggccgtctgccagccgttgatgtgcgatgccaggcccgtggcgcccgcgtagtaggccagttcctgcgagccgatgagcccgctctcgccgatggtcccggtcacccggtagggcagccgcgcgcgcagcagtttgccgtcgtcggagtcgagcagcttcttcagcgcgggcgagaccaccatgtcacccggcgccgggtacgcgctcagaccgggcgcgatcggcgcgcgcgggccctcgggctccacgagccgcccgcggatgtccttctccccgtacgtcgagttgatgtcggagatgaccagggtgttgtcggccttgggcttgaccgtctggctgtacgtgtagtcggagcgggcctggtcgcgctcgtgccgcacggacagcgcggtggggatcgcggtcgtcagcagcagcagcgcgacgccgagtccgacaccgacggccgtcagcagcacccgcgtccagccctcgcgtccgccggtgaaggcgaacttggcgcccatgcgcaggtcgcgggcccactggcgggcattcatacgatgcgctccatgtcccgggacttgccgtcgcggacgacgatctcgcggtcggagtacgcggccacccgcgcctcgtgcgtgacgagcacgacggcggcgttggtggaccgggcggcctcggtgagcagttccatcacgcgctcgccgttgagcgagtcgagcgcgccggtcggctcgtcggcgaacagcacgcgcgggccggtgaccagcgagcgggcgaccgcgacgcgctgcccctgaccgccggagacctcgccggggcgcttcctgccgaggtcgtcgacctccagccggctcatccagctgagtgcggtgcgctcggcctccttgcgcggggtgccgttcagccgcagcggaagggccacgttctccacgcaggtcagctcgggcacgagctggccgaactggaagacgaagccgaactccgagcgccgcagggcgctgcgctgggcgtcggacatggtggacagctcacggccgtcgtagaggatcgagcccgagtccggggtgacgatcccggcgaggcagtgcagcagcgtggacttgccggagccggagggccccatcacggcgacgacctcgccggggtggatggagaactcggcgccgtccagcgcggtggtggggccgtagtccttgcgcaggttctcggccgacaacagggagccggggggaggagtcaccgggtcaccgcctcacggagtttttcgaggcgcgcggcggtgagttcgagccaccgcaggtcggcctccagatggaacagggcgtggtcgcagatcagctggtcggccaggtcgcccttgcgtttgcggtcggtgaggatccgcatgctgcgcaggtgctcggcgcgctgggtgtccaggacgtcggccgcgtcgcgctcggtgagcagggccaggacgaccttggtgtagagggtcgactggaggtacggctcgggcttctcgggcgtggccagccactgctcgacatccgtgatgccggcttcggtgatggcgtagcgcttgcgttcggggccgccgccggcctcgatgccgtcgacttcgacgagaccgttcttcagcagccgcgacatcgtcgagtagacctggccgtagtgcagcggccggtcgtgaccgaacgtctcgtcgaaggcccgcttcaggtcgtagccgtggcgcggcccggactccaggagccccaggagggtgtgaccgatggacatgcggagcactctacacaccgtgtatacgcacgatgtatacgcccggtgtgtagagggtggcccgaggtcaggtggaagggtgaacgcgcaggtgggaggcgattgtcacggttccgctacgggcggcggaccgctccggcgtcatcccggcgggggcttgcgcggtggccggccccggcgcggcagggggcccgccccgcccggcaggcggcccgcgtccgcgagggcccggcgcagcaggaactcgatctgggcgttggccgagcgcagttcgtccgacgcccagcgcgcgagcgcgtcgtacaccgacggatccagccgcagcagcacctgcttgcgctgctgcggccggcgccggggagcggcgcccttggaaccctcggatccctcggcctgctcggccgggtccggtgcgggggtcactggtagagcgtcccggtgttgaggaccggctgcggtgcccggtccccgcacagcaccaccatcaggttcgacaccatcgccgccttccgttcctcgtcgagttccacgatgtcctgctcggcgatccgggcgagcgccgcctcgaccatgccgaccgcgccgtccacgatctcccgccgggccgcgacgaccgcgccggcctgctgccgctggagcatcgccgaggcgatctcgggtgcgtacgcgaggtgggtgaagcgggactcgatgatccgcaccccggccgcctccacgcgcgcgtgcagttcgacggcgagcttctcggtgatctcctcggcgttgccccgcagcgacaggccgccctcgtcgtgcgcgtcgtaggggtactcgatggcgatgtgccgcacggccgcctcggtctgcgtggacacgaactccaggtagttgtccacctcgaaggacgcctgcgcggtgtcctggaccttccacaccacgaccgcggccagttcgatcgggttgccgtaggcgtcgttgaccttcaggacggcggtctcgtggttgcggacgcgggtggagatcttctcgcgcgaggtgaacgggttcacccagcgcagaccgtcctcgcggatcgtgccccggtagcggccgaagagctggacgacccgggcctcgcccggcgccaccatgttcagcccgcacatggccagcagcgacgcgatgcccaccaggacgccgacgactatcagcgcggccttggcgccggtggcggtgacggtcgcggcggtcgcgaccagggccacggctatcagcagcccgagcagtccgagcagcagcgcgagcccgcccttgatgctgggcgccgcgaactcccgtacccgcggtgcgggcatctcgggcgcgtcggccgcggtcaccgcgggcggagtgggtgcggacatgggaggtcccccgttcctcatggtcggtgcgcgcagaagccgtactagcttctgcctatccaagtgatatcactttatcggcgtgcggcaacccccgaaccttcccgggtgtcggttcacttggcggcgggtgctgattctcacgtccccaaaagcccggatcgcgggccctttgtcacagagagcggtgttagttttctgagctgacctgaccgaagacgtacccgagtggcacccgagacacccgagacatccgagacggaagcggagcgaacggacgcatgggacgagcggaagacagacgtgcgcgacagcgcggtggccgccgcgcggcgcccaggcgctcgtccgggacgccgacgacgggcatcggggacgggagcggcggcggccgggccgcggcacggcgcgcggccaggcccgccaaggcgaagaagagcggcatacgccgcctgttcacctggaagaagatcctcggcaccgtcctcggcgtctgcctgctcggcatcggcgccttcatcgtgctctacatgatggtggacatacccaagggcaacgccgccgccgaacgccagagcaacgtctacaagtacagcgacggcaccatcctggcccgggacggcgaggtgaaccgcgagagcgtgtccctggacaaggtgcccaaggacgtccagcacaccttcgtcgccgccgagaacaagaccttctaccacgactccggcgtcgacctgaggggcacggcccgcggtctgctcaacaccctgaccggcaagggcacccagggcggctcgacgatcacccagcagtacgtcaagaactactacctcacccaggaccagaccgtcacgcgcaagctgaaggaactggtcatctccctgaaggtggaccggcgcgagaccaaggaccagatcctcgccggctacatcaacaccagctactacggccgcggcgcctacggcatccaggccgcggcccaggcctactaccgcgtcgacgcgcagcacctgaccgtcgaacagggcgcctacctcgccgcgctgctccaggcgccgagccagtacgactgggcggtcgccggacccaacggcaagcggctggtgcaggcccgctggaactacgtcctcgacaacatggtcaagcagcactggctggacgccggcaagcgccaggccatgaagttcccggtgcccaagagccccaagggcgcgcccggccgcgagggccagaagggctacctgatcgagctggccaacaagcagctggaacagcagctgatgcaggaacagggcatcagccagtcccaggcggaggccgcggtcgtggaccggggatggaccatcaccctgaacgtcgaccgcaagaagcaggccgcgctggaggactcggtcaagaagcagctcaccagcaagctcgacccgaagaagcgcaaggtcgacgccgacgtccaggccggcgcggtctccgtcgacccgaagaccggcaagatcgtcgccctgtacggcggccaggactacttcaagcactacatcagcaacgcgacccggcgggacttccagccggcctccacgttcaagccggtcatcctggccgccgcgatggacgagggcgccaagacgcaggacggcctgccgatcgacgccaacaccatctacgacggcaccagcgagcgcccggtcgtcgaccacggcaccaaggtcggcttcgccccgcccaacgaggacgacgccagctacgggaacatcaccgtccagtccgccatgaacaagtccgtcaactccgtcttcgcgcagatgggtatcgacgtgggcatggagaaggtcatggcgaccgcgaagaagctcggcatggacacccagggcatgcaggccgtgcccgcccagacgctgggttccatgggcgcgagcccgctggagatggccgggatctacgccaccctcgacaaccacggcaagaaggtcaccccgggcatcatcgcctccgccgagaaccgcacccgcagcgtcacgatcagcaacccgatcggcgaccaggtcatcagccgcgaggccgccgacacggtcacctcggtgctgaccggcgtggtcgacgacggtacggcgaaggcgtcggtggccgacaacccgctgcgcgggggccagcaggtggcgggcaagaccggtacgtccgacaacaactggtcggcctggttcaccggttacacgccggacctggtcacctcggtcgggctgttcggtgaggaccccaagaccagcaagcacaccacgatgaccggcgccacgggcctcctcccgggcaagggccggatcaacggcggtggctacccggcggagatctgggccgggtacaccttcggcgtcatgggcgacaccagcaagttcgacctggacaccacgcagggcgcggccatgcagacgccgagccagaccccgtccatgtcccagtcgccgagccactcgccgtcgatgtcgccgagccactcgccgacgcagccgtcccactccgcgagccagccgccgccgagccactcggcgacccagtcgcccagccactcgccgagccagccgccgccgagcgactcgccgagcgcgcccgacccgtcgaccagcagctcgtccgacaacccgctgaacccgaacgaccagcagcaccgcaacgaccgactgcccgtgcagtagccggccgggaacgccgggagcacgacggaaaaggccgggagggccaaggcaacgccttggccctcccggccttctcacatccgtacgatcactggcggtgcagctcgaaccacaccaccttgccggtgctcagccgggtcgcgccccagcgccgcgccagccggttcaccaggtacaggccccggccgccctcgtcggtggcccgcgcctgccgcagccgcggcaactgcggcacgtcgtcgccgacctcgcagcgcagcacgtccgtgcgcagcagccgcagcgtcaccggacgggaggcgtagcgcaccgcgttggtgacgacctcgctgaccagcagctccaccgagtccgtcagctcctcaagaccccagcgggccagcgcccggcgggccagcctgcgggcccgcgaaggcgcggagtcctccggctccaggaaccagtacgccacgtcgctcggcgcgatcccgtcgaagcgggcggcgagcagcgcgatgtcgtcgtcccggtcgcccgggccgagcatgtccagcacgtcgtcgcacagggcttccagcggcggcggatggtcggggccggtgagctgcgcggtcgccgccagcttctcccgcaactgctctatgccggtccacacgtcccgcagccgcgactccaccaggccgtcggtgtacagcagcagcgtgccgccggccggcgcgtccagctccaccgcctcgaagtcgacgccgccgaccccgatcggcgcgcccggcggcacccgcagcacctcggcccggccgcccaggtgcagcagcacgggcggcgggtgaccggcgttggcgatggtgatgcggtgcgagaccgggtcgtagaccgcgtacaggcaggtcgccatgcggtcggtgcccaggcgctgcgcctgctcgtccaggtggtgcagcacctcctgcggcggcaggtccaggcccgcgagcgtctgcgcggtcgtccgcagctggcccatgatcgccgccgacgtcatggagtgccccatcacgtcgccgacgacgagcgcgacccggctgccgggcaacgggatcgcgtcgtaccagtcgccgcccacccgcgcggtctcggcggcgggcagatagcgcgacgccagccgtacgcccgtgggacgcggcagggtctccggcagcatggtgcgctgcagctcgtcggcgatgtacgcctcccgcccgtacagcaccgccttgtcgacgccgagcgcgctgtgcgtcgccaactgggcggccaccagcaggtcgtcggcctcgaaggcggggcggtcggggcggcgcaggaagagcgcggcgccgatgacacggcgccgcccgcgcagcggcgcgaggatcgtacgctggccgccaggcactgccagctccgagtcctcgccgaggagttcggccagcgcggcccccgcggacggggagtcggtgaacaccgggcgtaccccgcgcagcacttcgccgagcgcgctgccgggccgtacctcgcacagctcgttggtgaccacggacagctccgccggctgctcgggcggcggcacgggcagggtcccggcctccaggtcccgctcggccgggatccggtcggtgcggcgcagccgcagcaccagcgggcccaccggccgctcgtcgcccaccggcagcggctcgcgcaggtagaccaggatcgcgtcggagaacgtcggcacggtcgcccggcacagccccatgacgatctcgtccaggtccatgccgcgcgcgatgcgccgcgtcgccgcgcccacgaaccgcagccggtcgccgtcgcggcgcatcg

SEQ ID NO: 606 - DNA, 3119 bp, Unknown
  Kingdom: Bacteria, Phylum: Actinobacteria, Class: Actinobacteria, Order: Streptomycetales, Family: Streptomycetaceae, Genus: Streptomyces
cccggcggagccgatcgtgattcacactccgctgggcgagcccgccggccgggccgcgccccgggccggtgggcgcccgagatgccggaacggccaggtcacgccccgcgcccgacgcacccggacggtcaggtcacgccccgcgcccgacgcgcgcggacggcgaggtcacgccccgcgcccgacgcgcgcggacgggcagcgcacgccccgcgcacgccgtgccgggacggacaggacccgcccgcgcccgacatgcccgaacgcgcagaacatgcaacggtgggcatgggccccgctcacccggttacccggcgggagccacccgtcagcgaaggaacggaaagcgatgaccagcggcttcgtcggcccggagggcgatcgcgaccccttcggcgaattcttcgcccggttcttcggcggcacccgccccggtccccggcacgtcgacatcggcaggctcctcagccagcccgcccgggaactcgtcaagggcgcggcccagtacgccgccgatcacggcagccgggacctggacaccgagcacctgctgcgcgcggcgctcgccacggaacccacccgctccctgctcagcaggtcgggtgcggaccccgactcgctcgccacgcagatcgacgagcggtccgggcccgtgcagagcccaccgggcgaggcgccaccgcccaccgcgctctccctcaccccggccgtcaagcgagccctgctggacgcacacgacatggcgcgggccagcggcgccgggtacatcggcccggagcacgtgctcagcgcgctggcgatgaacccggactcggcggccgggcacatcctgaacgcggcccggttcgccgcctccggtctgccgcccgagtccccggacaccaccaccgcgccgggcaccgagcggcagcgcgccaccggcacgcccaccctggacaagtacgggcgcgacctcacggagctggcccgccagggccgtatcgacccggtgatcgggcgggacgaggagatcgaacagaccatcgaggtgctctcccggcgcgggaagaacaacccggtgctgatcggtgacgcgggcgtcggcaagacggccatcgtcgaagggctcgcgcagcgcatcgccgacggcgacgtgcccgacatcctgctcgaccgccgggtggtggccctggacctgaccggcgtcgtcgccggcacccgctaccggggcgacttcgaggagcggctgaacaacatcgtcaccgagatccgcacccactccgaacgcctgatcgtcttcatcgacgagctgcacaccgtggtcggcgcgggcggcggcggtgagggcggctccatggacgccggcaacatcctcaagcccgctctggcccgcggcgaactgcacatcgtgggcgccaccaccctggaggagtaccggcggatcgagaaggacgcggcactggcccgccgcttccagcccatcctggtgcccgagccgaccgtcgccgacgccatcgagatcctgcgcgggctgcgcgaccgctacgaggcccaccaccaggtccgctacaccgacgaggcactcgtcgcggccgtggagctgtccgaccggtacctgaccgaccggcggctgccggacaaggcgatcgacctgatcgaccaggcgggcgcccgggtacggctgcgggcccgcaccaagggcacggacgtgcgggccatggagcgcgaggtcgaacagctcgcctgcgacaaggaccaggcggtcgcggacgagcagtacgagcaggccacgcagttgcgcgaccgcatcggcgagctgaagcagcgcatcgccgaggcgggcggcagcgaggaggccgacgaggggcagcacctggaggtgaccgccgaggccatcgccgaggtggtgtcccggcagaccggcatccccgtcagcagcctcacccaggaggagaaggagcgcctgctcggcctggaggagcacctgcaccggcgggtcgtcggccaagaggaggccgtcgccgtggtcgccgacgcggtgctgcgctcacgtgccggcctggccagccccgaccggccgatcggcagcttcctcttcctcggcccgaccggcgtcggcaagaccgagctggcccgggcactggcggaggcgctgttcggcagcgaggaccggatggtccgcctggacatgagcgagtaccaggaacggcacaccgtcagccgcctggtgggcgccccgcccggctacgtcggccacgaggaggccggccagctcaccgaggtcgtccgccgccacccgtactcgctgctcctgctggacgaggtggagaaggcgcacccggacgtcttcaacatcctgctccaggtcctcgacgacgggcggctgaccgactcccagggccgcacggtggacttcaccaacaccgtcatcgtgatgaccagcaacctcggttccgaggcgatcacccggcgcggtgcgggcatcgggttcggtgcgggcggcgccgacgcggacgacgaggcgcggcgcgagcagatcctgcgcccgctgcgcgagcacttccgccccgagtttctcaaccgcatcgacgagatcgtcgtcttccgccagctcacccccgagcagttgcggcagatcaccgacctgctcctggagaagacacggcgactgctgcacgcgcagggcgtggccgtcgagttcaccgacgcggccgtggactggctggcgcaacgcggctaccagcccgagtacggcgcccgtccgctgcgccgcaccatccagcgcgaggtcgacaaccagctgtcccggctgctcctggacggacggatcggcgagggcagccgggtcacggtggacgtgggcgacggcgggctggcgttcctgcctgaggacccgggggcccggggcgaggagcccgcgcccgctgccaccgagtgaccgccgccgagtgaccgtccccacgacggcctccgcccctccgaagtgagggcggaggccgtcgtgttccacggtcccgggtgggcggtacttgctacggctgcggttgcgggtggacgaccatcgccgagccgccgccccggcgcaccttctccgccgccgccagccaccggggtccagaggctgccggacggccggtggc

SEQ ID NO: 607 - DNA, 5524 bp, Unknown
  Kingdom: Bacteria, Phylum: Actinobacteria, Class: Actinobacteria, Order: Streptomycetales, Family: Streptomycetaceae, Genus: Streptomyces
gcacggccgtgctggtgcaggcgcacgactggctggtgtggcaactgctgggccgtccggtgcggcgcaccaccgaccgcggcggcgcctccgggaccgggtactggtccgcggccaccggctcctggcggcccgatctggtcgagttggcgctcggccaccaggcggtgctgcccgaggtgatcggcccggccgaggcggccggtacgacgccggagggactgctgatctcggccgggaccggcgagaccatggccgccgccttcgggctgggcctggggctgggggacgcggtggtgtcgctgggcgcctccgggtcggtgatggccgtgcatcccgaggcgctggtggaccagagcgggatgatcacctcgctggccgacgcgaccggcatgcacctgccggtggtcaccacgctgaacgccgtacgggccctgcgcggcaccgccgaactgctgggtctgcccgacccggaggccctgtccgagctggcgatgaagtcgacgccgggcgcccacgggctcgtactcctgccgtatctggagggcgagcggacgcctgcgctgccgcacacggccgggacgctggcgggtctgcggcgcgagtcgatgaagccggagcacctggcgcgggccgcgttcgaaggcatgctgtgcggtctcgcggacgcgctggacgtgctgcgcggccggggggtggaggtgcggcgcgtcttcctgctcgggccggccgccgaactgcccgcggtgcaggcggcggcgccctcgctgttcggcgcgcaggtcgtcgtgccgcagcccgccgactacgcggcgatcggcgccgcccggcaggcggcctgggcgctcggcgtctcgcagggcacgctcgatccgcgtaccccgccggcctggcagggagcggccgcccaggtgctggagcccggcgaggacctggcggtgggccaggcggtccgtcagcagtacgtggcggtgcgcgaccagacccatccgggtgctttcggcgcgcaaccgaatgcattcaccacacaggacgcatagtcacataagggacaaagagggtgtattgcggggcggtggggtccggctgacggcgcgtcggccgggaaacccgtgggaaaacccgccccgcacctgccttccgttcgtccccccgcggtcctgttcgggttaatcagttgaggtaacgcgggtggagtgtccgacgataggtgccaggggacaccgaccgcccccaccgccgactccgagagacccagcgtgctcatacgacttctgcggacctatctcaggccctacaggaaacccatcgctctcctggtgctgctgcagttcctgcagacctgcgccaccctctatctgcccaccttgaacgcccacatcatcgacaagggtgtggtgaagggcgacaccggctacatcctgacgttcggcgccgtgatgatcgccatctcgctggcgcaggtggggtgcaacatcggtgccgtgtactacggcgccaagaccgcctcctcgctcggccgggacgtgcgggccgccgtcttcgaccgcgtgcagtccttctcggcgcgtgaggtcggccagttcggcgcgccctcgctcatcacgcgtacgaccaatgacgtccagcaggtacagacgctggccctgatgacgttcaccctgctggtgtcggcgcccatcatgtgtgtgggcggtgtcgtcctggccctcggtctggacgtgccgctgtcgggtgtactggtcgctgtcgtaccggtgctggccatctgcgtgacgctgatcgtgcgccggctgcgcccgctgttccggtccatgcagacacgactggacacggtgaaccgggtgctgcgcgagcagatcagcggcaaccgtgtcatccgcgcctttgtccgcgacgagtacgagaacgaccgcttccgcagggccaacggcgacctgaccgagatgtcgctggccaccggccggatgctcgcgctgatgttcccgatggtgatgacggtggtcaacctgtcgtccatcgcggtggtgtggttcggcgcacaccgcatcgacagcggcgggatgcagatcggtgacctcaccgcgttcctggcctacctgatgcagatcgtgatgtccgtgatgatggccaccttcatgttcatgatggtgccgcgcgcggaggtctgcgccgagcgcatccaggaggtcctctccaccgagtccagcgtcgtgccgccgctcgcgcccgtgcgcgaactgcgccgccacggccacctggagctgcgcggggccggcttccgctacccgggtgccgaggagcccgtgctgaaggccgtcgagctggcggcccgtcccggcgaggtgaccgccgtcatcggctcgaccggcagcggcaagtcgaccctgctgggcctggtcgcccgtctgttcgacgcgaccgagggcgaggtgctggtcgacggggtggacgtgcggaccgtggacgcgaagctgctggcgaagaccgtcggcatggtgccgcagaagccgtacctgttcgccggcaccgtcgccaccaacctgcgctacggcaacccggacgccaccgacgaggaactgtggcacgcccttgaggtggcgcaggccaaggagttcgtcggcaagctggagggcggactggacgctcccatcgcacagggcggcaccaacgtgtccggcggccagcgccagcgcctggccatcgcccgcaccctcgtgcagcgcccggagatctacctcttcgacgactccttctccgcgctcgactacgccaccgacgcggccctgcgcgccgccctgggccgcgagaccgccgaggcgaccgtcgtcatcgtcgcccagcgggtggcgaccatccgggacgccgaccggatcatcgtcctggacgagggacgggtcgtcggcaccggccgccaccacgagctgatggcgggcaacgagacctaccgggagatcgtgctctcccagctgacggaagcggaggctgcctgatggcagggccgatggggcggatgatggccgggggctcaccggacagccgctcgatggacttcaagaactcgagcaagcggctcatcacccagttccgtcccgaacgggccacgatcggcatcctgctggcgtgcgtggtggtgagcgtcacactcagcgtgatcgggccgaagatcctcggcaaggccaccgacctggtcttcgccggcatcatcggccgccagttcccggccggcgcgaccaaggaccagaccctcgcctccctgcgggcgcacggccagggctcgatcgccgacatgctcaggagcacggacttcacgcccggccagggcatcgacttcggcgccgtcggcgagatcctgctgttcgcgctgggcacgttcctcgtcgccggtctgctgatggcggtggcgacccggctggtgaaccggtcggtcaaccgcaccatgttccggatgcgcgaggacgtgcagacgaagctgtcgcggctgccgctgtcgtacttcgacaagcgccagcgcggcgaggtgctctcccgcgccaccaacgacatcgacaacatcgggcagaccctgaaccagtcgatgggccagctcatcaactcgctgctgaccatcgtcggcgtgctcatcgtgatgttctgggtgtcctggctgctggcgctggtcgcgctggtgaccgtgccgctgtcgttcgtcgtggccacccgcgtgggcaagcgctcccagccgcacttcgtgcagcagtggcgctccaccggcaagctgaacgcgcacatcgaggagatgtacaccggccacgccctggtgaaggtgttcgggcggcaggaggagtcggcgcagcagttcgccgagcagaacgaggcgctgtacgaggccggtttcaaggcgcagttcaacagcggcatcatgcagccgctgatgatgttcgtctcgaacctgaactacgtgctcgtcgcggtcgtcggcggcctgcgggtcgcctcgggcacgctgtccatcggtgacgtgcaggcgttcatccagtactcgcggcagttctcgatgccgctgacgcaggtcgcgtcgatggcgaacctggtgcagtcgggcgtcgcctcggccgagcgggtcttcgaactcctggacgcggaggagcaggaggcggacccggtgccgggcgtgcggccggaagaactgcgcggacgggtcgcgctggagcacgtctcgttccgctacgacccggacaagccgctcatcgaggacctgtcgctgaaggtcgagccgggccacacggtcgcgatcgtcggcccgaccggcgcgggaaagaccacgctggtcaacctgctcatgcggttctacgacgtcaccggcgggcggatcaccctggacggcgtggacatcgcccgcatgtcccgcgacgagttgcgctccgccatcggcatggtgctccaggacacctggctgttcggcggcaccatcgcggagaacatcgcctacggcgcctcccgcgaggtgacgcgcggcgagatcgaggaggcggcgcgggccgcgcacgcggaccggttcgtgcggacgctgcccgacggctacgacaccgtgatcgacgacgagggcagcggggtcagcgccggtgagaagcagctcatcaccatcgcgcgggcgttcctgtccgacccggtgatcctcgtcctggacgaggcgaccagttcggtcgacacccgtaccgaggtgctgatccagaaggccatggccaaactccagcacggcaggacgtcgttcgtcatcgcgcaccggctgtccaccatccgggacgcggacaccatcctcgtcatggagaacggcgccatcgtcgaacagggcggccacagtgagctgctggccgccgacggggcctacgcgcggctgtacaaggcgcagttcgcgcaggcggtcgcggaggtggactgagcggagccggaggactcaggcgggggccgttgcccgggttcgcccggggcggcccccggtcagtccaggtagccgcgcaactggtcggcgaaggtgtggtcgcgcagcttggtgagggtcttggactcgatctggcggatccgctcccgggtcacgccgaacagccgccctatctcctccagggtgcgcgggcggccgtccacgaggccgtagcggagctggacgaccttgcgctcgcgctcgcccagcgtggagaggacggcctccaggtgctggcgcagcagcaggaacgccgccgactccacgggggaggcggcgtcgccgtcctcgatgaggtcaccgagggcgacgtcctcctcctcgccgaccggggcgtgcagcgagaccggctcctgcgctaggcgcagcacctcgctcacgcgctcgggcggcagttccagctcggcggcgacctcggccgcggtgggctcgtagccgcgctcctggagcatgcggcgctgcacccgcacgacccggttgatcagttccacgacgtggacgggcacgcggatggtgcgggcctggtcggccagcgcgcgggacatcgcctggcggatccaccag

SEQ ID NO: 608 - DNA, 2186 bp, Unknown
  Kingdom: Bacteria, Phylum: Actinobacteria, Class: Actinobacteria, Order: Streptomycetales, Family: Streptomycetaceae, Genus: Streptomyces
cctctggaccgcggcgccgggcaccatcgcgcgccgccgcgccgcggtccagaggcggaaacagtcggcgaccggtcgatgacggtcggtcgtcgaaccgtcatgaccaggaagtggaatgcatgcttcagcaaatctgcacagcgaatgcccagtgaggtcaccgggcggcgcggatctgcacaaccgcacgccccccctggcgcgtttggcgcggagtgccggattccgcggcggctcggcaaggtccggggcgaaccgatgccgtgcaccttgtgaagaagtggccgacaagccgtgcccgggcgtgcacggatgagccccatgcggcgggaagtgccctggtgggaggcctgcttgagtggaggagccggttcgtgccgtgctttgatccatcgcaccgcggggccacgccggacgcttgcgacagcgacggccggctgtcccgcccgcggccttccgtctgtcccagaggaagccgctccccctagtgagaacccatacgaagggaagttccagcatgaactccaccccccaggtcgagaccgccgagatctccgacgccgacctcgacaacgtctccggcggtctgtcgctgaacgccgtcggcaccgtgaccggcctggtggacggcgtcgccccggtgtccggcgtggtcgacacggccgtcggcaccgtcgagggtgtgaccggcctgagcaccgccccggtcaccaacctggtcgccggtctctgagcgcatcgcgccccgaggcgtcccggagccgtacagcggttccgggacgcccggatgcccgcacttccccgcgggcccggccccgactcacgagggaagttccgtgcagttccgccaacaggccctcgccaagctccagtcgcccgaggaactcgatcttccggtgcgtctcgcccgcccccggggctggctcgtgctgtccgtcacgctcgtcgcgacggccgccgcctgcgtgtgggcggtgaccggttccgtggcctccacggtcaccgcgcaggccgtcctcacccacggacagggcagttacgtcctgcagagcccggtcgccggacaggtcaccgcggtcctcgcccggcagggcgagcggctcgccgccgacacgcccgtgctcaaggtccgcaccggccagggcacgacgacggtcgtacgggccgtcgccgcaggccggatcaccacgctggccgccgccctcggccagatcgtctccaccggcacggacgtcgccgccgtcgagaaggccgcccacgcctccgacccgctgtacgcgaccgtctacgtccccgcgcagaacgccgccgccgttcccgccggggcccccgtcgacctgaccgtctcctccgtgcccgccgagcggtacggcgtgctgcgcgggcgggtggcggcggtggaccgctcggcgcagtccgcccagcagatcggcgcgttcctcggggacggccggctcggtgagcaactcgccgggaaggggcggccggtggccgtccgcgtacggctcgacgccgcgcccggcacagcgagcggctaccgctggtcgtccgcggacggcccgccgttccggctcgactccatgaccctggccacggcctccatccacgtggccgaccagcgccccgtcgattggctgctgccgtgagcaccgcacagaagacccgcggccggcgccgcgccgcaccgaccgggcgcccggtgcccaaaggccgcgcccgcacggtccgtacgcccaccgtcctgcagatggaggccgtggagtgcggcgccgcctcgctcgccatggtcctcggccactacggccgccacgtcccgctggaggaactgcgcatcgcctgcggggtgtcccgggacggctcgcgcgccagcaacctgctgaaggcggcgcgcagttacggcctgacggccaagggcatgcagatggacaccgccgccctcgccgaggtggccacgccggccatcctgttctgggagttcaaccactacgtcgtctacgacggcatgggccgccgcctcggccggcgcggggtgtacgtcaacgaccccggcaagggccgccgtttcgtgcccatggaggacttcgacagcagcttcaccggtgtcgtgctggtgctggagccgggtgagggattcacacgcggcgggcgcaggccgggcgtgctgggcgccctgccggcccggc

SEQ ID NO: 609 - DNA, 535 bp, Unknown
  Kingdom: Bacteria, Phylum: Actinobacteria, Class: Actinobacteria, Order: Streptomycetales, Family: Streptomycetaceae, Genus: Streptomyces
tgctcctggaggccgccgcccaggagatcgaggagctcggcggccggcccctcgcccaggtcaccgacaccgccgacgcccggcaggtcgaggccgccgccgacgccgccgaagcggccttcggacccatcgacgtatggatcaactgcgcgttcagcagcgtcttcgcccccttcgacgagatcaccgccgaggagtacgaccgggtgacccaggtgacctacctcggcttcgtcaacggcacccgcaccgccctcaaacgcatgctgccccgcgaccgcgggaccatcgtgcaggtcggctccgcgctgggggagcgggcgatcccgctgcagtccgcgtactgcggggccaagcacgccatcaacggcttcacctcctcgctgcgcaccgaactcctgcaccgcggcagcaaggtcagggtcaccgtcgcccagatgccggccgtcaacaccccgcagttctcctgggtccgctcccggctgcccaagcacccccagcccgtgccgccgatctaccagcccgaggtcgccgc

SEQ ID NO: 610 - DNA, 14134 bp, Unknown
  Kingdom: Bacteria, Phylum: Actinobacteria, Class: Actinobacteria, Order: Streptomycetales, Family: Streptomycetaceae, Genus: Streptomyces
gtggccaggaaggagttcgcggccgtcttcaccagttccgcggtggcgaagtcggtgacgaccagcggcgtcccggcggcgaggacgggcccgtacaccgtccgcagcagccgctcggcgcgcgccgtgcgcaccccgaacaccagccggttcggccgcagcgtgtcctcgacggcgaagccctcccgcaggaactcggggttccacgcgatctccaccccaccgtgccgcgcggccagccccgccgccgtaccgaccggcaccgtcgacttccccaccagcagcgcacccttgcgcgcgtggagcgcgatcgcgtcgaaggcgctctcgacgcacgtcaggtcggcgccgtcgccgtccctgcgctgcggggtgcccacacacacgaagtgcacctgcccgaacgcaccggcctcctcgtacgaggacgtgaaccgcagccgcccgcccgccgtgtgccgggcgaccatctcggccagccgaggctcgtggaacggcacccgccccgcccgcagcgcggcgaccttgccggcgtccacatcgaccccgaccacctcatgccccagctccgccatgcaggcggcgtgcgtggcacccaggtaaccggtgccgatgacggtgagccgcatgggtccgccctcctcgccgtacgccccctgccgctgccgtacggcgagcaggccgtccctgcgagttcccgcccggcaccgaccgtaccgtcacacagagtgactggacggctcagcagcagccggcggccggcagcgaccgcttgttgcgcgcctcccggctgcgcgcggccagcagctcgtcggccgggtacccgacctcctccagggtcagcccgtgcggccgtacgacgtgcaccgcggagtcccgtacgcccgcggccagcaccttcccgggccagtgcggcggacggtggccgtcgccgacgaagagcagcgccccgatcagcgagcgcaccatgttgtggcagaaggcgtccgcgcggacggtggccgtgatgatcccgtcgtcaccgcgcaccaggctcagctcctgcagcgtccggatggtggtggccccctcgcgcttcttgcagtaggcggcgaagtcgtgctccccgaggagcggccgggcggcctcgttcatggcgtccacatcgagcggccagtcgtgccacagcacgtgcccccgcagcagcgggtcgacaccgccggggttgtcggtgacccggtaggcgtaccggcgccagacggcggcgaaccgggcgttgaaaccgctgggcgcctcacgcagcgcccagacccgcacgtccttgggcagccgcccggcgagccgcttgagcagcttctcgtggtgctcgcgccagacctcctccggcaggtcgacgtgcgccacctgtccgcgcgcgtgcaccccggcgtcggtccgcccggccacggtcagctcgtacgtctgacgggaccgcgtgaccgtgcgcagcgcgtcctcgatctccccctgcacggtccgccgtcccccggcctgcttggcccagccggagaactcggtcccgtcgtaggacagatccagccgcacccgcacgaacccgggctctacttcgtcactcacccagagatcctctcagccgaaaagaaagcgggcccgcccctcgaaaggaacggacccgcaacgcccccgaggggcgcgggactgtgctcgacatgcggctccgccgcgcgggcgcgaccagccacggccaaagccccactcgccgacgcacagctcccggcagaacgcttacgcgtccttggactcctcggccggagcctcggtggcctcggtctgctcggccttggcctcctcggcctccttgaccgcacgcttcgtcgcggcctcggcctcgccggtggcctgctgctgcaccgtcagcgcctcgaccagctcgatgacggccatgggcgcgttgtcgccacgacggttaccgatcttggtgatgcgggtgtagccaccgggacggttctcgtaccgcgggccgatctcggtgaagagcgtgtggacgatgctcttgtccgtgatgacctggagcacctgacggcggttgtgaaggtcgcccttcttcgccttggtgaccagacgctcggcgtacggccgcaggcggcgggccttcgcctcggtggtggtgatgcggccgtgctcgaagaggctcttcgcgaggttcgcgaggagcagcttctcgtgcgcggcgctgccgcccagacgggcacccttggtgggcctcggcatgatgtttctcctaggtgtctgccccggccgtatcaggtaccggagtcagtatccgagcaggcggtcgcctgtcggagatccgggggcgcgccccggaggagtcgggagcggccccgcaggggcactcccgacaggggcgcggggaactgcgcgatcaagcacagcgcacccgcacccgaaaacggaccgcaggtcccgagctcagtactgctcggtctccacgaagcccgcgtccgcgtcgtcgtccgcgccgaacgcgtccgcagcggcggtcgggtcgaatccgggcgggctgtccttgagggccaggcccatgccggccagcttcgccttgacctcgtcgatggacttcgcaccgaagttgcggatgtccagcaggtccgcctcggagcgagcgaccagctcacccacggagtggatgccctctcgcttgaggcagttgtacgaccgaacggtgagctccagctcctcgatcggcagcgccaggtcagcggcgagggcggcgtccgtcggggacgggcccatgtcgatgccctcggcgtcgatattaagttcacgcgccagaccgaacagctcgaccagggtcttgccggcggaggccatggcgtcacgcggacgcatcgcctgcttggtctcgacgtcgacgatcagcttgtcgaagtcggtgcgctgctcgacacgggtggcctcgaccttgtacgtgaccttgagcaccggcgagtagatggagtcgaccgggatacggccgatctcctggcccacctgcttgttctgcacggcggagacgtagccgcgaccgcgctcgacggtcagctccatctccagcttgcccttgccgttgagcgtggcgaggacgaggtcggggttgtggacctcgacaccggccgggggcgcgatgtcggcggcggtgaccagacccgggccctgcttgcgcaggtacatcacgaccggctcgtcgtgctccgaggagacgaccagctgcttgatgttgaggatcaggtcggtgacgtcctccttgacgcccggcacggtggtgaactcgtgcaggacaccgtcgatgcggatgctggtgacagcagcgccggggatcgacgacaggagggtgcggcggagggagttgccgagggtgtagccgaagcccggctccagcggctcgatcacgaaccgggagcggaactcgtcgacgacctcttcggtcaacgaaggtcgctgagcgatcagcatctgtggatcagatccttctttcgtggacgcccgctatttgacgtccgacggaaaccgcacccatgagaagtgcgggtactgcaagggtacgggcggcacggcccgaaggagccgtaccgcccggcaagcctggtgaagcgaggtcagacgcgacggcgcttcggcgggcggcagccgtactgcgagattgcgggggacgacccccacacccccagccggacgccggaccaccgaggccgtgcgtcagacgcggcggcgcttcggcgggcggcagccgttgtgcggggtcggggtgacgtcctggatggagccgacctcgaggcccgtggcctgcagcgaacggatcgcggtctcacgaccggaacccgggcccttgacgaacacgtcgaccttgcgcatgccgtgctcctgggcgcggcgggcagccgactcggcggccatctgcgcggcgaacggcgtggacttccgggagcccttgaagccgacgtggccggcggaggcccaggagatcacgttgccggacgggtccgtgatcgagacgatcgtgttgttgaacgtgctcttgatgtgcgcgtggccgtgagcgacgttcttcttttccttgcggcgcaccttcttggcagcgccctgacgtcccttggggggcatgtcttctcctacgggaggtggtcggtcctacagcgaagaccgctggacggcgagtccgctgcggactacttcttgcccggcttcttcttgccggcgatggcgcgacgcgggcccttgcgggtacgggcgttcgtgctggtgcgctgaccgcggacgggcagaccgcggcggtgccgcagaccctggtagcagccgatctcgaccttgcggcggatgtcggcctggatctcgcgacggaggtcaccctcggtcttgatgttgttgtcgacgtactcgcggatcgcgacgagctgctcctcggagaggtcgcgaacgcgggtgttcgggtcgacgccggtggcggccagcgtctgctgagacagggtccggccgatgccgaacacgtaggtgagggcgacctccacgcgcttttcgcgcgggatgtcaacaccggaaacgcgtgccattcaatggctccagttgatcttcggaggtcttccacaggaccggctcccggccgccgtacgaggtacgaaccgggtccccggcctccgaaccgggggtgtcgaacggacgcttacgccgctcgggacctgcgtatgaacatattcagctcgcgtcgcgcgaaactctgcgatagcggtgcagagggtgcggtcggtcgtgcgtcagccctggcgctgcttgtggcgcgggttctcgcagatgaccatgacccggccgtgacggcggatcaccctgcacttgtcgcagatcttcttgacgctcggcttgaccttcatgggatgtgaggttctccgggtcagttgccggcggacccgcggcctgacggccacgggacgtgggcaagatctacttgtaccggtagacgatccggccacgcgtcaggtcgtacggagaaagctccaccacgacccggtcgtcagggaggatgcggatgtagtgcatgcgcatcttgccgctgatgtgtgccaggacctggtggccgttctggagctcgaccttgaacatggcgttcggaagagactcgacgacagtgccctcgatctcgatggcaccttgcttcttggccacgcttcgcccttcgaatcgactaccttgatcgactctctctgcttcccttgcgggcgcatgcggacatgcgggtgcacgagagccgacgagtcagtctacgtcagcgcacccggaaacacgaatcgggaaagtctgccccgcccgggagatcgttacgccgggagccttggggatgctcaagcctgctcaggcgagcgcgtccggagcggcccatgccgtactccgccgcctccgccttgccgccggcccactcccgacgcgcgggaccggcgccggggcgcctcacaggcttcgagcggctgcgccggcctccggccgacgggcctcgcaacggccgatgatcagcctagtgggtccggagcggccgtgatgccgtactccgccagcttcgccttgccgccgtcaggcgccgtcaggaccagcggaccctgctcggtcagggccaccgagtgctcccagtgggaggaccaggtgccgtccgtcgtgatgaccgtccactcgtcgtccaggacgcgggtcctcggggtgcccagggagaccatgggctcgatggccaggcagaagccggggaccagcttggggcccttgccgcggcggcggtcgacgtagttcagcaggtgcgggtccatgtgcatctcggtgccgatgccgtggccgccgtagtcctcgatgatgccgtagcgcccgccgcccggcttgggctggcggcggatgtacgtctcgacggcgcgggagatgtcgaccaggcggttgccctgcttcatggccgcgatgccggcccacatcgactcctcggtcacccgggacagctcgaccagctccggggcgtgaccggagccgacgaacgccgtgtaggccgcgtcgccgtgccagccgtcgacgatcgcgccgcagtcgatggagatgatgtcgccgtccttgaggacgacctcgtcggaggggatgccgtggaccacgacctcgttgaccgaggtgcagatcgtggccgggaagccgccgtagccgaggaagttcggcttggcgttgtgctcggccagcaccttgcgggccacctggtccaggtccttggtgctcgcgcccggcacggccgcctcccgggtggccgcgtggatcgcggcgacgaccagccccgccgcacgcatcgtggcgatctgctcgggggtcttgatctgcaccatggggacgggcctttctgggaccgggggccgacgggccgacttcttcaaccatacgggcgacggtgcgcccacagcgcagccgcggcccccgacagaaggaaccgcggctgcgaccggcgtgatgactactgggtgacgtcctcacgcttcagcgcctggagggcgcgccgcgtgatctcgtcgaccgggccgagcgacgagatcgtcacgaccaggccctgcttgcggtagtagtcgatgatcggctcggtctgcgtgtgatagacctcaagccggttgcggacggtgtcctcgtggtcgtcgtcccgctggtacagctcgccgccgcagacgtcgcagacgccttccttcttcggcttgctgtacgacacgtggaagacgtggctggagtcgttgcggcagatgcgccggccggcgatccgcttgacgacctcctcctccgggacctcgaggtcgagcaccgcgtcgagcttgatgccctcgccctcgagggtctcgtccagcgcctgggcctgcgacacgttgcgcgggaagccgtcgagcaggaagccgccctcggcgtccggctgctccatgcggtccttcgccatggcgatggtgacctcgtcggggaccaggttgccggcgtccatgtaggacttcgccagcttgcccagctccgtctgcctgctgatgttggcgcggaacaggtcgcccgtggagatgtgcgggatcgacagcttctcggccaggcgcgttgcctgcgtacccttgcctgcgccaggcggcccgacgaggacgattcgcatcagcggaggaacccttcgtaattgcgctgctggagctggctctcgatctgcttcaccgtctcgagaccgacacccacgatgatcaggatgctggtgccgccgaacgggaagttctggcttgccccgaagcccaccaacgccactgttggcacgagagcgatcagacccagatacagcgaacccggccaggtgatccggttgagcacgtacgagaggtactcagcggtcggtcggccagcccggatgcccgggatgaagccaccatacttcttcatgttgtcggcgacttcctcggggttgaaggagatcgccacgtagaagaacgcgaagaacacgatgagcaggaagtacgcggtgatgtaggccgggtggtcgcccttggtcaggttctgctggatccacgtcttccagcccgagttgcccccggagaactgggcgatcagggccgggatgtagagcagcgacgaggcgaagatcacggggatcacgcccgcctggttcaccttgagcgggatgtacgtcgacgtaccgccgtaggaacggcggccgatcatgcgcttcgcgtactgcaccgggatgcggcgctgggcctgctcgacgaagacgaccaggccgaccatgatcaggccgaccagcagcacggtgccgaactcgatccagccgccggccagcttgcccgacgtcttgatcgaccacagcgcggacgggaacgtcgcggcgatcgagatgaacatcaggatcgacatgccgttgccgatgccgcggtcggtgaccagctcgccgagccacatcacgaggaccgtaccggcggtcatgcagacgaccatcacgatggtgttgaagatcgcctggtccgggacgatgtccgcggccgccgtgcacccggagaacagggcgccgctgcgggcggtggccaccaggccggtgccctgcaggatggcgagcgccaccgtcaggtaacgggtgtactgggtgatcttcgccgtgccggactggccctccttcttgagggcctccagacgcgggatgaccacggtcagcagctgcaggatgatgctcgccgtgatgtacggcaggatcccgagggcgaagatcgtgatctgcagcagcgcgccgccgctgaacatgttgaccagtccgaagaggccctggctgccggaggcctccgtcacgcacgtctggacggccttgtagttgacgcccgggatcgggatgtgggtaccgacgcggtacgccacgatgatgccgagtgtgaagagcagcttcttgcgcaggtcgggcgtcctgaacgcccgggcgaagccggtgagcacggtgcctcctgcgacccccgcgcacgtgcgtcagggtgacggttgtgaggttccaactgagaacgacgaatggacaacggacgactgccgctccgagtgcccatgatgcggcatccggtggaagtggacagtgcaggccaccttaccggcgacaccgcccccctaggaacgaccaaccggggataccccatttgtgggtatccccggtcgggacgttcaggtcatcgagacgtccgacggtgtcagacgagctcggtgacgctaccgccggcggcggcgatcttctccttggcggagccggagacggcgtcgaccgtcacctgcagcgccacggagacctcgccctggccgaggaccttgacgaggctgttcttgcgaacggcacccttggccacgaggtcctcgacggtgacctcgccaccctcggggtacagcgcggccagcttgtcgaggttcacgacctggtactcggtcttgaacgggttcttgaagcccttcagcttcggaagacgcatgtggaggggcatctggccaccctcgaagcgctccggaacctggtagcgggccttcgtgcccttggtaccacgaccggccgtcttacccttcgacgcctcaccacgacccacacgggtcttggcggtcttggcgcccggggcgggacggaggttgtggatcttgagcgggttctgctccgccatgatcagtcgacctcctcgaccgtcacgaggtggcggacggtgtgcaccatgccgcggaactcgggacgatcctccttgacgaccacgtcacccaggcgcttgaggcccagggaacgcagggtgtcgcggtggttctgcttgctgccgatgtaggacttcgtctgcgtgatcttgagctgcgccacgattacgcacccgccccggcacgcgcacgcaggagagccgcgggagcgacgtcctccagaggcagaccacggcgggccgcgacctcctccggacgctgcaggcccttgagggccgccacggtggcgtgcacgatgttgatcgcgttgtcggagccgagcgacttcgacaggatgtcgtggataccggcgcactcgagcacggcacgcaccggaccaccggcgataacaccggtacccggggacgcgggcttgagcagcacgacgccggcagccttctcaccctggatcgggtgcgggatggtgccctggatgcgggggaccttgaagaagtgcttcttggcctcctcaacgcccttggcgatggcggccggcacctccttggccttgccgtatccgacacccacggtgccgtcaccgtcgcccaccacgaccagcgcggtgaagctgaagcgacgaccacccttcacaaccttggcgacgcggttgatcgcgacgacgcgctcaacgtacgcggtcttctcggcggcagctgcgccgccgtcacggcccttccggtcccgccgctcgccgccaccggcaccgccaccgcggcgctggggtccagccattggaattacctctctctgtttccgctagctcggaaccggctcagaacttcaggccggcttcgcgggcggcgtccgccagggcggcgatgcgcccggcgtactggttgccaccacggtcgaacacgacagcctcgacaccggcggccttggcacgctcggcgaccagggcgccgacctgcttggcctgcgcggacttgtcgccctcgccgccgcggatcgacgtgtccagcgtggacgccgatgccacggtgtggcccttgaggtcgtcgatcacctgcgccacgatgtggcggttggagcgggtcacgaccagacggggacgctccgccgtaccggcgatccgcttgcggatccggatgtgacggcgcttgatcgcggcgcgcttgtaggcgtcgcccttgaggatcttctgcccgtatgccatggcttacttacccgcctttccgaccttgcggcggatgacttcgccctcgtacttgacgcccttggccttgtacgggtcgggcttgcgcagcttgcggatgttggccgcaacctcgccgaccttctgcttgtcgatgccctcgaccgagaagcgggtgggggcctccaccttgaaggtgatgccctcgggtgcctcgacggtgatcgggtggctgtagccgagcgcgaactcgaggttcgaacccttggccgtcacgcggtaaccgacaccgctgatctcgagcttcttcacgtaaccctgggtcacgccggtgatcatgttcgccaccagcgtgcgggacaggccgtgcagggccttgttctgacgctcgtcgttggggcgggtgacgttcagaacgccgtcctcagccttgacgatctcgatcggcgcggcgacggtgtgggtcagttcgcccttggggcccttgaccttgaccgtacggccgtcgatggtgacgtccacgccggcgggaaccgcgatggggagcttgccgatgcgcgacatagctgtttcctccgttcccttccgttaccagacgtaggcgaggacttccccacccacgcccttcttgccggcctgcttgtcggtgaggagcccgtgggacgtggagatgatcgccacgccgaggccgccgagcaccttcggcaggttggtggacttcgcgtagacccggagaccgggcttcgagatccgcttgatgcccgcgatggagcgctcacggttcgggccgtacttcagctcgaggacgaggttcttgccgacctcggcgtcctcggtcttccagcccgtgatgaagccctcctgctggaggatctccgcgatgtgcgacttgatcttcgatgccggcatcgtcacggagtcgtggtatgccgagttcgcgttccgcagacgcgtgagcatgtctgcgatcggatcagtcatggtcatgaattggccttcggcctctctcgccggggtttcctggtgcgccatccctctccccgatccgagacgggacgggtgcggcgcggtggacctacggcgtagtaagtcgtttagggcgcggcaggcgcccaaccccacaagcctaaggcatggggggtgggcctcctgccgaccccggttgcttaccgagagtcctgattcaacccaagtgggtttttaccaggagctcttggtcacgcccggcagctcgccacggtgagccatctcacgaaggcacacgcggcacaggccgaacttgcggtacacggagtgcggacgaccgcagcgctggcagcgggtgtagccgcgcactccgaacttgggcttgcgagcagccttcgcgatgagagccttcttcgccatctcgctcacgcctccttgaacgggaagccgaggtgacggagaagggcacggccctcttcgtcgttggtcgccgtggtgaccacggtgatgtccataccccggacacggtcgatcttgtcctggtcgatctcgtggaacatgacctgctccgtgagaccgaaggtgtagttgccacggccgtcgaactgcttgggggacagaccacggaagtcgcggatgcgcggcagcgcgagcgacagggtgcggtccaggaactcccacatgcggtcgccacggagcgtgacgtgggcaccgatcggctggccctcacgcagcttgaactgcgcgatggacttgcgggccttggtgaccgcgggcttctggccggtgatcgtggtgaggtcgcggatggcgccctcgatcagcttggagtcgcgggcggcgtcgcccacacccatgttgaccacgatcttgacgaggcccgggatctgcatgacgttctcgtacttgaactcgtcacgcagcttgggggcgatctcgccgcggtacttctgcttcagacgcggggcagtggtggtagccatcagatgtcctcacccgtccgcttggcaacgcggatcttgttgccttcgtcgtcgaagcggtaaccgacgcgcgtgacgaccttgttgccgtccttctccacgaccagctggacgttggagacgtggatcggggcctcggtggtcacgatgccgccggcctgggaaccgctggcggtcgggccggccttggtgtgcttcttgacccggttgacaccctcgaccaggacgcgctcctcgcgcgggtaagcggcaatgaccttgccctgcttgcccttgtccttgccggtgatgacctggaccaggtcgcccttcttgatcttcatgctcacagcacctccggcgcgagggagatgatcttcatgaacttcttctcgcgcagctcacggccgaccgggccgaagatacgggtgccgcgagggtcgccgtcgttcttcagaatgacggcggcgttctcgtcgaagcggatgtacgagccgtccggacggcggcgctccttgacggtgcgaacgatgaccgccttgacgacgtcacccttcttcacgttgccaccggggatcgcgtccttgacggtggcgacgatgacgtcaccgatgcccgcgtagcggcgaccggagccaccgagcacacggatgcaaaggatctccttcgcaccagtgttgtcggcgacacgcagccgcgactcctgctggatcacgtctatctcctgtttgtctgccggttccccgggggccgctcagcgagcgggcccccggagcctggcggaactgtcctgcggatggtccccgcaggaattacttggccttctcgaggatctcgacgacgcgccagcgcttcgtcgcggacagcggccgggtctccatcaggaggacgcggtcgccgacacccgcggcgttctgctcgtcgtgcgccttgagcttgttcgtacggcggatgaccttgccgtacagcgcgtgcttgacgcggtcctcgacggcgacgacgacggtcttgtccatcttgtcgctgacgacgagaccctcacgggtcttgcggaagccgcgcgcctctgcgttctcagtcacgttgttctcgctcatgcgttctccaccgtttcgatgcccagctcacgctcgcgcatcagggtgtagatccgcgcgatgtccttgcggaccgccttcagacggccgtggttttcgagctgacccgtcgccgcctggaaacggaggttgaacagctcttccttggcctcgcggagcttacccagaagctcctcgttgcccagctcgcgcagctcggacgccttggtaccggccgacatcacgcttcacctgcctcgcgcttgacgatccggcacttcatcggcagcttgtgggccgcacgggtcagcgcctcacgggcgatcttctcgttggggtacgacagctcgaacatcacccgaccggggtgaacgttcgcgatccaccactccggagaacccttaccggaacccatgcgggtctcggcgggcttcttcgtgagcggacggtccgggtagatgttgatccagaccttgccgccacgcttgatgtggcgggtcatcgcgatacgggccgcctcgatctggcggttggtcacgtacgccggcgtgagggcctggatgccgtactcgccgaacgcgaccgtcgtaccgcccttggcctgaccacggcgcttcgggtggtgctgcttgcggtgcttgaccctacgggggatcagcatgtcggtcaggcctccgttccggtgctctcagccggagcggcagcggccggagcctcggccttgggggcctcggcggccggagcctgctgctgctgcggcttgcgaccgcgccgctcgccac

SEQ ID NO: 611 - DNA, 2591 bp, Unknown
  Kingdom: Bacteria, Phylum: Actinobacteria, Class: Actinobacteria, Order: Streptomycetales, Family: Streptomycetaceae, Genus: Streptomyces
ccccgagaaggccgcggagatcgaccgcaggctggaggcgtgggcgcgcgggctcgacctgttcccgccgcggtggacgggggacttcgcccagttccagttcggccgggccgtgaccctgcagcatcccggcgcggccgacctggaacggctcacggccgccgggaagctgctgctggccgagaacatcgtcgacagctgttactgcgaggaggacgagggcaggggcggggcgcggcgcggtctcggcggccggctgatcatcgcccagtcggccctcgaccccttccacagcacgcccggcctcgaggagcagtggcgtcacggcgtgcaggccgacggtccgctgcgctcctaccactgggccctgaaggactacgcggccctcgccactcccagccagtgcgaccggctcgtgcacgacctggcccggctgcacctgggctatctcgcggaggcgtcctgggccgagacgcgccaccggccgcgggtctgggagtacctggtcatgcggcagttcaacaacttccggccctgcctgtccatcgtcgacgccgtggacggctacgaactgcccgatgcggtctacgcccgcccggagatccagcggatcacggccctcgcctgcaacgccacgaccatcgtcaacgacctgtactccttcaccaaggaactggccagtgaccccgagcacctgaatctgcctcaggtggtcgccgccaacgaccggtgcggcttgaaggccgcgtacctcaggagcgtcgacatccacaacgaggtcatggacgcgttcgagcatgagtccgccgtggcgtccgccctctcgcccctggtcgaacgctacgcccgcggcctgtcggactgggtgtcgggcaaccacgagtggcacgccaccaacagccaccgctaccacctgcccgactactggtgagccgcgccgtccggcccggcggccttccacaagtaccagagcaaggagccacgttgaccatcgctcattccagcaccacgtccgcctcgctgccggcccagtcccggtaccagagccgcatcgcggagtactggaacgccgaggagaacccggtcaacctcgaactcggaaagatcgacgacctctaccaccaccactacggcgtcggcgaggccgaccggacggtgctggacgagccggaccccgagcggcgccgggagcggatcaccggcgaactgcaccgcctggagcacgctcaggccgaactcctcgcctcccacctcggtgccctctcccccaccgaccgcgtcttcgacgccggatgcggtcgcggcggcggcagcgtggtggcgcacctgcggtccggctgccacgccgacggggtcacgctctccgccaaacaggccgacttcgccaacgagcaggcacgcaagcgcggcatcgacggcaaggtgcgctaccaccaccgcgacatgctcgacacgggcctcgactccggtgcgtacgccgcgtcgtggaacaacgagtccaccatgtacgtggagctggacctgctgttcgccgagcacgcccggctgctgcgccgcggcggacgctatgtggtgatcaccggctgctacaacgacgcctacgggcgcgcctcgcgtgaggtgtccctcatcaacgcgcactacatctgcgacattcatccccgctcggcctatttccgcgccatggcccgcaaccggctggtccccgtgcacgccgaggacctcactcaggcggcgctcccgtactgggagctgcgcagtgaggccgaccacctcgccaccggcatcgaggagaccttcctgagcgcctaccgcaacggcagtttccagtacctgctcatcgcggccgaccgggtgtgaggtgaccgtcgtgacggcggtggcgctgcccgcgccaccgccgttcggtccgtctccgcgcgcctcgggtgacccccgagccgcccccgattccctcccacgctttggttgatttttccccccgaaaagaccaagggcgtgccaaggttttgaattcgaaaggcaagaaatccgcaaatcgcggtcaccgctcggccccactcaccagcaaagataccgtgcggtaagcagttcgtcacaattcgcgagtgagcgttctccgccatgtccaggcgtagccttcaacaagttgttgatcacgcagacatctcgtcgcgcatcagcggttgtcggtgcctcgaggtgttcccggacaaggagaaggcatgcctgcagaagggcgggtggtacagcgaagaagctgggttcccgccgatctgggaccgatacagctgcggggcatcgcccaggtcgccctcagcccgagtccctggaccggtctgctgttcgccgtcgcactgttcgccggcagctggcgggtcggcttgtacggagtgctgggcgcggcggcctccaccgcggccgcggccgtcctcggcgccgaccgggacggtctgtccaaaggccttgaagggtactgcggttgcctgaccgcgatcgccgtcgtcgtccggctcggcgcctcgtggcgcaccgcggtgctcgccgtgctggccgccgccgtgtgcgcggtggtgtccgcggcggccgtc

SEQ ID NO: 612 - DNA, 753 bp, Unknown
  Kingdom: Bacteria, Phylum: Actinobacteria, Class: Actinobacteria, Order: Streptomycetales, Family: Streptomycetaceae, Genus: Streptomyces
  misc_feature (403)..(461): n is a, c, g, or t
gcgctgggcaggcgcgcccgcgtgaacgccgcgtgaggagagtgccatgaccgtgaccgaccgcccgcaccgcctcctggaggaggcgaccgacatcgtggccatcgtgggcggggtgacccgcgaccgggcccgtgccgtgctgcgcgcgatgtccgcgcacacccgcatcaaggaacagcacgtggccgaactcgtcgtcgaatgggcgacgtcgggacggctgcccgccgaactgctgcgcgaactcagacaccagctcgacaccggacgcggcacccccgccaccggagccaccggatgacaggacggcggcgcacgaggctacgggaccttcggacaatgcctgtcgggcgccgttgtcctctgcaatgatgctccgcgcctgatcgtttccgcccgnnnnnnnnnnnnnnnnnnnnnnnnnnnnnnnnnnnnnnnnnnnnnnnnnnnnnnnnnnntcgtcgtgctggacacctgcggaccggtcaaactggtcgtgctcgccgccaccctcggtgtcaacccgtccaccgcgctgcgcatggtcgaacgcctcgaagcgctcgacctcgtcgaccgcaggaccaacccggacaaccggcgcgaggtcgtgctgagcctcacccccgtcggccacgaactggtcacccgggtcctcacccagcgccgcgcggagatccgccgcctggtgcaacgcctgcccgcgcaggaacgcgccgcgctgatcccggccctgcacgccctgaccga

SEQ ID NO: 613 - DNA, 3633 bp, Unknown
  Kingdom: Bacteria, Phylum: Actinobacteria, Class: Actinobacteria, Order: Streptomycetales, Family: Streptomycetaceae, Genus: Streptomyces
ccgtccctcgctgcgccgacccccggaaacgcggcccggactcggccgtcgacgcgcccctgacctgcgagttcaccgctgccggaaaattcctcccggcgaggtgtgacgtttttggccgccctgacgcagtactgagtgagccgactggtcatcggccctcgcacgacgccggggttccccccgtacctacggctcgtgcatctggcgcgggcgggacacgttcccccggtcccgcccgcgccccgtttcttctcctctcttctcctcggtcctcagggcccgcttctctccagcccctcggggccgggtgtccgcgtcaccagtggacgacgaccttgtcgcccaccttcacctgcgcgaacaactgcgcgatggccgcctcgtcccgtacgttgacgcagccgtgcgagccgccggcgtagccgcgggcggcgaagtccgaggagtagtggacggcctgtccgccgctgaagaacatcgcgtacggcatcgcggagtggtagatcgtcgacacatggtggcgtgacttccagtagacctggaacacaccttcacgggtcggtgtggcttccgtgccgaaccgcaccgccatcgtcgagacggtccgcccggcgaccatccagcgcagggtgcgggtcgtcttgtcgatgcagagcacccggcccgtcagacagcgcgggtccggcgcgccggcgggctggccgcccatgaggtacagctcccactggcccggctcgtgcgtcatgccgcgcagccgctgccaggtgacggtgtcggtgcgtcccgtccggggaaggccgcgcttgccctggaagccccgcaccgcctgctccgtggctccgccgtaggtccccgtcggtccctcggccagccagccgatctgccgcaggcgggcctggagttcccggacggcacggccgctgtcgccgcgcgaccacaggacgggggcgtcggccgcgtgcggagcggccggtgccgtgcgcgcgtcgctgtccttgccgtcgccgcggcccttgccgtcgccgcccgccggccgcgtggccggcacctcgatgtgcacgggggagcggtgccgtccgcccgcgccggaaccggacgacggaccggaagccggaccggaagccggaccggagcccgcgccggaaccccgaccggcgacgcccgagccgtccggctgcaccgtgcagccgcacacccccgtcagcgccaccgccgcggccacgccgacgaccgctctcctcatgcccccgatgcccatgcggccccccgccgtctcaacggtgcctgacccggaaagtctttccatccgtgaccggtggcgaaccacggggcatggtgggaaacagagacagaaacagaagcaggaacagaagcaggaacagaagcaggaacagaagcaggaacatgaaacagagacgtgtctgtgagcaaggtcccagcgtgggccactccacccggcgcacggccgccgctacagtccgtcgcgagggtcggccgtaccagcgagtaaccggcaagtaaccacagaacgcggaggcacacaccatggcgcgcgagtcggagtccgggctgcccatcgagccggtgtacgggccggacgccctggagggctgggacccggcccagaagctgggcgacccgggcgcctacccgttcacacggggcgtgtatccgtcgatgtacacgggccgaccgtggacgatgcgccagtacgcgggcttcggtacggcgacggagtccaacgcccgctacaagcagctcatcgccaacggcaccatgggcctgtcggtcgccttcgacctgccgacgcagatgggtcacgactccgacgccccgatcgcgcacggcgaggtcggcaaggtcggtgtcgccatcgactccgtcgacgacatgcgggtgctgttcggcgggatcccgctggacaaggtctccacgtccatgacgatcaacgcgcccgccgcgctgctgctcctgctctaccaactggtggccgaggagcagggcgtcccggcggagaagctgacgggcaccatccagaacgacgtgctcaaggagtacatcgcgcgcggcacgtacatcttcccgcccaagccctccctccgactgatcgccgacatcttcaagtactgcaaggccgagatcccgaagtggaacacgatctcgatctccggctaccacatggccgaggcaggtgcctcgcccgcgcaggagatcgcgttcacgctggcggacggcatcgagtacgtgcgcacggcggtcgcggccggcatggacgtggacgacttcgcgccccgcctctccttcttcttcgtcgcccgtacgacgatcctggaggaggtcgccaagttccgtgccgcgcgccggatctgggcccgggtgatgaaggaggagttcggcgcgaagaaccccaagtcgctgatgctgcgcttccacacccagacggccggggtccagctgaccgcgcagcagcccgaggtgaacctggtccgcgtcgccgtacagggcctcgcggccgtcctcggcggcacccagtcgctgcacacgaactccttcgacgaggcgatcgcgctgcccaccgacaagagcgcgcggctggccctgcgcacgcagcaggtcctcgcctacgagaccgacgtgaccgcgaccgtcgaccccttcgccggctcctacgtcgtcgagaagatgaccgacgacgtcgaggcggccgtcctggagctgatgcgcaaggtcgaggacctcggcggcgcggtatccgcgatcgagcacggcttccagaagaacgagatcgagcgcagcgcctaccgcatcgcccaggagaccgactccggcgagcgggtcgtcgtcggcgtcaaccgcttccagctcgacgaggaggagccgtacgagccgctgcgcgtcgaccccgccatcgaggcccagcaggcggaacgcctggccaagctgcgcgccgaacgcgaccagggcgccgtcgacaccgccctgaccgccctgaagaaggccgccgagggcgaggacaacgtcctgtacccgatgaaggacgcgctgcgcgcgcgggcgacggtgggcgaggtgtgcaacgcgctgcgggaggtgtgggggaactacgtgcccagcgacgccttctgagcagggctctcccctcggatgagtgatcgggggcgggaaacccctcgacggcgacgactgagccgcccgtctcggtacccgaaacacctccccgggtgtcgtacccccgtgcgacactccagccatgttcggcgtcatcgatctccccacctacctggcaggactcgccctcatcgtcctgcttcccggccccaactcgctctacgtgctgtccgtcgccgcccggcgcggcatccgggccgggtactccgcggcagcgggcgtctggtgcggggacaccgtgctgatgacgctctcggcggcaggggtcgcctccctgctcaaggggaacgccgtgctgttcggcatcgtgaagtacgcgggcgccggatacctcacctggctggcgatcgggatgctgagggccgcgtggagcatgtggcgcacccggcgcgagcgcaccgcggaagccgcggagaccgcgcccgccgcggccggacccgccgacgagcggcccttccgccg

SEQ ID NO: 614 - DNA, 7352 bp, Unknown
  Kingdom: Bacteria, Phylum: Actinobacteria, Class: Actinobacteria, Order: Streptomycetales, Family: Streptomycetaceae, Genus: Streptomyces
cagcccgcggccggcacgggcaggacgatctcgaccgctgcggcgaggcgctgcggcgtcacaccggccggatcgacgaagtacaggaacacgtccagcgcggcggtcagcacgaccgccaccaccgtcgccaccgacttgtcccgcaccgtccagcgcggcgagatccagagcagcaccagggccgccacccgcgccaccacgcccagcggcagccacagcacggccagcagcccgaccagcgccagcagcagcaccggaaccagcgccggcacgccaccgccccgcgcaccctcggtgttcgcggccccgggacgggcgccggcctgtgcgtcgtgcgaagtactcaattcccactctctcgtcgtgaacggacgggtacggaccgtgtgaccacggcaccttcatgatcatcatgccggtcggtccgccgccggaggcggagagtgcgcgcagatgcggcggaggtgtcgcgaaagcccctccagacgcaccggcggcggtccgctcaggagctgagcgccaccacggcctcgtcggtgtagaccaggaacgtcagcgtctgccggaagtacagctcgaccgcctgcgcgtcgtgcgcggtgtagccgacggcgaggtcctcgcccagccgcagttcgaagtcaccgccgcgggtggacacgaggaaggcaccgtcgagcgcgggcgcccagatcggcggcccgtccaggagccggctcaggtgtgcggcgatcgggtagccgtggtcggacgtctcgttcaccgcggtgtacgggtccgcgcccagcaccagcgcgtacggaccggcgacgcctgccagccgcagcgtcgtcagcgcccggctgacggcgtccgggtagtcgcgcggctccgccggcaggccggccaccggatgcgaggaacgctggcgcaggccgtcgatgcccgccgcggcgtacccctcgaagacggcacggtcctccgcgaacgccatggcccgcaccgcgtccttcacgggctgccagtcggagtcctgcgcgccccgctccacgtcgtcgaccgcctcgcgggtgaccttgaaggggacgcgcagctcgaccaggggccgcacctggcgcagccgcgcggtgacaccctgcgcgggcgcctcgatgccggtgaggtggccggtgcccaccgccgccagcgccggcccttcgggcccggtcacgtccacgacgcgccggccgccgacgttgcgctggaaggtgcggcgcgcctcctcctcgatctgcgcccacgcctgggccgtgatcggggcgagttcgcggtggaggttgctcgtcggggagggcgtggacatgtgcatcaggctcctttgagactgccgatgcccagggagccctccggcacggaggcgaccgcgggcgcgggcggcggatcgtcgaggaagtcggcggtgggcacgtggaagaggcagccggtgaccgcggtggagaagtcgaggatccggtcgtgcacgccgggccggtcgccgaggaacatgttccgcagcatctgctcggtcaccgcgggcgtccgcgcgtatccgatgaagtaggtgccgaactcgtccgcgccgatgttcccgaagggcatgttgtcccggacgatcttgcgttcggtgccgtcctcgtcggtgatcgtgttgagcgcgacgtgcgagtcgacgggtttgacgtcgtcgggcatctccacgttgtccagcttggagcggccgatgaccctctcctgctcctcgacgggcagcgccttccaggccgtgaggtcgtgcaggtacttctgcacgatgacgtaactgccgcccgcgaagtccgggtcctcaccgccgacgtggacggcgtcgacggccggccggccctccgggttctcgctgccgtcgacgaaaccgagcaggtcgcgttcgtcgaaggacttgaagccgtgcacctcgtccaccacggtgacggcaccgcgcaggcgctcgccgatcagctgggccatctcgaagcagaggtccatgcgccgggcccgcaggtggaagagcaggtcacccggggtggacggcgcgtggtggcggacgccggtcagcggcacgaacggatgcaggtcgcgcgggcgcggtccgtcgaagaggcggtcccatgcggtggagccgatgccgacgacgcaggtgagtgcgtcgtccggcgcccggaaacccaccgaccgcttcagaccggccaggtcggggagcaggtcgcggacgacggcctcaccgccggaggtgatggtgcagacgaggaacagggcggagcgggcgggcggggcgatcacggactgtgactcgaccacgaggcatgcctccaggctcgttgcgcacggtgacgcgtgatgcacacgttcgcggcggactctacgggttcacctcaaagggttcgccgcaaggcggacccggatcttccgggccttgccgtagggctcgtcgggtcgtgccgtacggatcgccgtcacgggccccggtgatccacgccgttcagccggctccgtcacattctatcggcggaccccgcgttcatcctgggcgacggtcttcccgggtgacgcggtgcccacacggtggcctgcggcttcaccgccggcttcgggccgtccggcgtcgccctcgacgaggcggcgcagggaagggagcagggcgtcgatgtcctgcccggtccggaacgcgacgacggtcgtgccgccgccgggctccgcggccgaaccgggtgccgggaagagcgcgagcacctcgcgcatcgcgtcctcgacctcctcgacgggatcggacgactcgccccgcagccagcggcgcagcacatggttgtgggcggacaccaccgcggcggccatgagttcggcccgcagcgacgccgactgcgtcggatcacccatccagtccgcgatgaactccctgaacagccgctggtagcgggccacactggcgatctcgcggtccctgagggcggccaccttgctggtgagccggtaccgccggcgcgccaggtccccctcctcgacgtagtgcagcagcaccaggcggaccgcgtccgagaccgcgaccagcgcggtgctgtggctggaggtcgccaaccggtcccggatcagcgcgagcagccggtcgtggtcggggaagatgacctcttccttggaccggtaatgccggaagaacgtcgtacgcccgagccccgctcgctcggcgatgtcgtcgacggtcgtctgctcgtacccgcgttcgtcgaagagggcgaacgcggcgtccgcgagccggatccgtgcaggtggcttgctcatgggcgttcatccttccctgtcccggccgtcggcgaccacttgccactgcgaatggtactgagtaccgtcgggagtacattcagtaccagagtcgagtacgagagtcagtgccgactccggtagggagccaccacgggaaccggtaccaggtcccgtggcgaaggaggtccaggtggattccgtggcgaggagcgagtccggcctgccggtgcggccggtctacgacggccggtcgctgacgggcttcgacgcggacgccgcactgggcgcgccgggccgtttcccgttcacgcggggcccgtacccgtcgatgtacacaggccggccgtggacgatgcggcagtacgcggggttcggcacggcgaaggagtccaacgagcgctaccacgaactggtcggcgccggaaccggcggcctgagcgtcgccttcgacctcccgacgcagatgggctacgactccgacgaggccatcgcccgcggtgaggtcggcaaggtcggcgtggcgatcgactccatcgaggacatgcgcacgctcttccagggcctgccgctggacaaggtgtcgacgtccatgacgatcaacgcccccgcctccacgctgctcctgctctaccagctggtcgcggccgaacagggcctcaccggcgaccagttgaccggcaccatccagaacgacgtgctcaaggagtacatcgcccgcggcacctacatcttcccgccgaagcagtccctgcgcctgaccagcgacatcttcgcctactgccaccgtgagctgccgcgctggaacaccatctccatctccggctaccacatggccgaggccggggccacgcccgtgcaggagatcgcgttcaccctggccaacgccaaggagtacgtacgcgccgctctcgccgccggcctggacgtcgacgacttcgcgccgcgcctgtcgttcttcttcgtcgcccggaccacgctcctcgaggagatcgccaagttccgcgcggcccggcggatctgggcgcgcgtcatgcgcgacgagttcggcgcgaagaaccccaagtcgcagatgctgcgcttccacacgcagaccgcaggtgtgcagctgaccgcgcagcagcccgaggtcaatctggtccgggtggcgctgcagggcctgggcgcggtcctcggcgggacgcagtcgctgcacaccaactcctacgacgaggccatcgccctgcccacgcagaaggcggcacggctggccctgcgcacccagcaggtcatcgcgtacgagaccgacgtgaccaagaccgtcgacccgttcgccggctcctacgtcatggagtcgatgaccgacgacctggaaggcgcggtactggaactcatgcgggccgtcgaggaccgcggcggagcggtcgcggcgatcgagcagggcttccagaagtcggagatcgagaagtccgcctaccggatcgccctggagatcgaccaccaggagcggaccgtggtcggcgtcaacaagtacgtcctggacgaggaagaaccctacgaaccgctgcgcgtggacccgcggatcgagaccgaccagtgcgagcgcctcgccgtcctgcgcaccgaacgggacaacggcgcggtcgaacgcgccctcgacgccctgcggaccgccgcgaagggcaccgacaacgtcctgcccccgatgcgcgaggccctgcggcagcgcgccaccgtgggcgaggtctcccacgccctgcgcgacgtctggggcgtgcacgtcccccacgacaccttctgatcacggaataccgggtggagcaagcagtgaccgacatcgacatccacacgaccgcgggcaagctcgcggatctgcagcggcgtatcgaggaggcgacgcacgcgggttcggagcgggcggtggccaagcagcatgccaagggcaagctgacggctcgtgagcggatcggactcctcctggacgaggattcgttcgtggagctggacgagttcgcccggcaccgttcgacggacttcggtctggaggcgaaccgcccttacggggacggtgtggtgaccggttacggcacggtcgacggccgtccggtggcggtcttctcgcaggacttcacggtcttcggtggtgcgctgggcgaggtctacgggcagaagatcgtcaaggtgatggacttcgcgctgaagacgggctgtccggtgatcggcatcaacgactccggcggggcccgcatccaggagggtgtggcatcgctgggtgcgtacggtgagatcttccgccgtaacacgcatgcctcgggtgtgatcccgcagatcagtctggtcgtgggtccgtgtgcgggtggggcggtgtactcgccggcgatcaccgatttcacggtcatggtcgaccggacctcgcacatgttcatcaccgggccggacgtcatcaagacggtgacgggtgaggacgtggggttcgaggagctgggcggtgcccgtacccacaactcggcctcgggcgtggcgcaccacatggccggtgacgagaaggacgccgtcgagtacgtcaagcagctgctgtcctacctgccgtcgaacaacctctccgagccgccggtgttcgagcaggtagcggatctggcggtgagcgaggaggaccgcgagctggacgtgatcgtccccgactcggcgaaccagccctacgacatgcacacggtgatcgagcatgtcctggacgacggtgagttcttcgagacgcagccgctgttcgcgccgaacatcctcaccggttacgggcgtgtggagggccgtccggtcggtgtggtcgccaaccagccgttgcagctggcgggctgtctggacatcgacgcttccgagaaggcggcgcggttcgtgcgcacgtgcgacgcgttcaacgtgccggtgctgacgttcgtggacgtgccgggtttcctgccgggtgtgggccaggaacacgaggggatcatccgccgcggcgcgaagctgatcttcgcgtatgcggaggcgacggtcccgctgatcacggtcatcacccgcaaggcgttcggcggcgcctacgacgtgatgggttccaagcacctgggcgcggatctgaacctggcgtggcccaccgcgcagatcgcggtgatgggtgcgcagggcgcggtcaacatcctgcaccggcgcaccatcgcggacgccggtgacccggaggcggcgcgggcccgtctgatccaggagtacgaggacaccctcctcaacccgtacgtcgcggccgagcgcggttatgtcgacgcggtgatcatgccgtgcgacacccgcgcgcacatcgtccggggcctgcgtcaactgcggaccaagcgggaatccctgcccccgaagaagcacggcaacatccccctgtgagcacccgcccctgaacaaccgcccctgagcaaccgaggagccgctgtgaccatcaaggtcgtacgaggcaaccccaccccggaggagctggccgccgtggtctccgtactgtccgccgcccggacaccggccccgcccgccggcccgccacgccccagcgcctggaccgcgcgccgctttctgccgcgcacctcgcacacgtacggcacgaccggctggctcacgcccgtcctgccttgctgaacacctgatcggagacaccatgaatgtcctggagcagcgcgccaggaatgtcctggagcagtgcgccgtcgaaaccgccgaccgcctcggcgcggccctgatggacgggacggggccggcatgctgacgaaggtgctcatcgccaaccgtggcgaaatcgctgtccgcgtggcccgggcctgccgggacgccgggatcgcgagcgtggccgtctacgcggacccggaccgggacgctctgcatgtccgcgccgctgacgaggcgttcgctctgggcggtgacacccccgccaccagctacctggacttcgacaaggtcctcaaggcagccgcggagtccggcgcggacgccgtccaccccggctacggcttcctctcggagaacgccgagttcgcccaggccgtcctggacgccggcctgatctggatcggccccccgccgcacgccatccgcgacctggg

SEQ ID NO: 615 - DNA, 3116 bp, Unknown
  Kingdom: Bacteria, Phylum: Actinobacteria, Class: Actinobacteria, Order: Streptomycetales, Family: Streptomycetaceae, Genus: Streptomyces
gagtgggggtcggcgacggtgtgggggtcggggtctccttcgggatgtacacgccggcgtcgatggtgtgatcgaccccgccgggcttgtccggagcggtgacaggtgcgtagccgttgcacaactcgccggtggtcggcggggtcacattggagtcgtgcgcacggtcggcaccggctcgtggaagtgtgaacctcagctcgctcgcgggcggttgctcgggcacctggctggtgtccgcggtgcacacgtcgaactggaccgtgtatttcgcgcccggtgtgagctggtactcggcgccgacgccaccgaagtagtactcgccgtcggcgtcggtcttggtcgtggcgacctgtttgccgtccgcgtccagcaggttgatcgtcgcacccggcagcagtacgtgccccgggtcctggatcccgttgtggtcgccgtcgaaccacacgacgttgccgatctggatcggcgcgttcgcggcggcgtacgcgatgtcaccgaggccgccggccttgccaaacccgccctgttcctggctgacgaactggaaaccgttggctttcgggttgttgcccgggccctcaccggtcgtgatgtcgtggtacccggtcccggaggtcgcgacgttgacgaccgggtcgaactccgtgctgacgacccactgctgctgcgggatgtaggccaccgaccccagcgcggtctcctggtgggcgccggcgaagaagtcgcccgggaagtactcgacgacgtcggctgcctcgccgccgttgttggcgggggtggcgtggttggggcagctcccggtgccttcccactggtattcaccggtgggagtggcgcacaccatgttgatgtcgccaccggacatgccgttctccgccgtgtcgttccccgggcgcgggtcaagccctccccagctgagcacgtccatgaaccggtcgcggaaaccgaggaccatggagccgtcgcgggcgaaggcgagggaggccagctccggctgcgggtcgatgaagacgttgccggccttccggtcgtcccacgtctgcgggctggtgttccacgggttccagtgggtggccctgtcgccggaaccgaagacgctgccgcgtacgtccgtgagcgggtggctgaacaccgtggtgaaccgcttgccgtcgtaggtggagacgaaggctttcaggtccgcgcgctgctgcgtgctctccgcgctgcacacaccgccgacgtacagcgtgttgtcgtggacctggagaccgaacggccgccagtcgccggggctcgcgcatcccgggtccgggatcggtaccgtcgacttgggtgccgcggcggtggccccggtcgcgtcgaagctcaccagggtgcgggagagcaggttcaccgcgtagagcgtggagccgtcctccgagagggccaggccgccgatgctctccttgcccggcgcgtcggtgaacccggggtccttgatcatgttcgcggtgtcgtgtcccgtcaccgtggcgtccggcacccgcgcgaacagctccggcgcggccgagccgtcgaccggcaccgtgtagacggcgcccccgccctgcggcccgtacggggcgtaccggcgtgcgaacgcgctctggaacagccgggtccggtccttgtcgtacgccagcccgaacgtcgtgcccacctggtcctgcgttgccagtgtggtcgggcacgccacatcggtggggcacgtgccccggaccttcgtcccgaacgccaccaacgcccggttgtccgtcccgttggcgccgttgtggacgggcacgaagtaccgcgagtccggcagggcgtagtcggccggatcccacacgcccgtcaccaccgacgcgtccttcccgtccgacaggtcgacgaacgacgtgaagctgtcgaagtggttctccgccgtcgacgcgggcgccgcccgcagatggccgctgtacggtgccgggacgctgacgtcgacgcggtaccggccgccgctcagcacggtcgagcccgacaccacgacctttccggtggcgtccgtgacgccggtgacctcgtgcccggccgggtcggagacctccaccttcatgccccgctggggcacgtccatcgccgcgttcaccacgccggtgccgaagaagtcacgcagcacctcgaccgtcagcgtgccgtcggtggccgaagccgcggccggcccgaccgtcgctcccacggcgccgcctgccagtaagagaacggataagcctgttcgcgcgagtggatccgccagtctccaggccgatcggcgcgagtctctgccgactcgtttcatggcatcacactccacagttctcttgtctcgacttctcttgtcccgaaaacgaagcacccgctgcgcgtcgtacgtccgcgtgcgtcgtacgtccgctgcgcggcccggctcggggccggaccggagggcaccacggaaaagaaaaagcgcccaccgctgcttgcggggaccgctttggggtgatcgtctgggatattgcgggccggccgtaaacaccgcgggcaaggaaaagcgaacacgtgttcaaaacctcgggcgggaccgccctgaatcgtctgctctcgcagctcaatcacggcgcccccacccccgcccgccaccgacctcaccgaccgccatcgcggacagcgcgcgatattcttgcactggagtctcgccgccaccagcagaatccctgaattcagatcgggacccacgctcgtcccgagctccgggaatgaaaccggaagaatgtgcggcagcggcgtgatggccggattcgatcccatcgagtgcgcaacggcggggtggcaggtctgggaaatgccgccgttgaggggctttgcccaggaggcggatcggatcgtctgaggtgatgtggtgtcgtgacggcgttgaccgccgaacacatgaccggtcatcgcgggtccgcggcgtaccagcgggggcgcaccggtttcacgccgcgcgcccccgttccggcgtccggcgatcggctctttttgcatggctgatgtgcgtacctatgctgcggggtcgaaagccaggacggagtgacggtgcgcgccgccgccgaagcgttgccgatgaagcccaacgacgtcagtgcgccctgagg

SEQ ID NO: 616 - DNA, 8229 bp, Unknown
  Kingdom: Bacteria, Phylum: Actinobacteria, Class: Actinobacteria, Order: Streptomycetales, Family: Streptomycetaceae, Genus: Streptomyces
gcctcgaccagcgctcgcgcgccgccgacgcgcgagcgctggtcgaggccgccgtggaccgcttcggctcgctcgacgtcgccgtcaacaacgccggtgtcttccggggcggacagccgctcgccgagctgccggaggaggactggcacacccagctcgccgtcaacgtcaccggcgtccacctggccctgcaggcgcagatccggcggatgcggacccagccgtccggcggcgcgatcgtcaacgtctcctccaacatcggcgcccacgccacctcgcccggcgccgccgcctacgccgcgaccaaggccgccgtgaccgcgctgagccgcggggcggccctggaccacgtccgcgacggcgtccgcgtcaacgtcgtcagccccggcgccaccgccaccacgatgtcgctgcggcccggcgagacggacgcggaccgcgccggccgcgtccgggacaccctcccgctcggccgggtctccgccaccgaggaggtcgccgccgcgatcctgtacctggcctcggacgacgccgcatccctggtcggcaccgacctggtggtggacagcggcggctccctgtgaacgccctcagtcgatccccgaccgctccacccccgccacgatccaccgctggaagcacaggaacaccaccagcagcggcaggatcgagacggccgccgcgacgaacagctcgtgcagacgcaccacttgtgcggtggtgaacgaggacagggcgacctggaccgtccaggcgctctggtcctggccgatcaccagcggccacaggaaggcgttccaggcgccgatgaagacgatggtgccgaccgcggcgaacaccggccgcgcgttcggcacgacgacgagccagtacgtccgccagggaccgagcccgtcgacctgggcggcgtcctccagctcgcgcgggaagccgaggaagtactgccggaagacgaagcaggcgaacgcggagaacagcgtcgggatgatcaggccgcgcagcgtggagatccagcccagggacgacaccagcacgaagctcggcacgaaggtgacggcggccgggaccatgagggtgccgaggatggcgtagaagaccttgttcgcgtgccggtaggggatgcgggcgaggccgtagccggcgagcgaggccagcagcaccgtgccgagggtggtggcgacggcgatcagcgcggagttgagcagcgagcgggcgaacgggacggaggtgtcgtcgaagagttcgcggacgttgccccagcgcacgtgggaggggaagaacgtccactcgggcgaggtgatgtcctgttcgccggccaggccgttgcgcaccaggaggtagaaggggaccaggaagagcagggcgagcgcgatcagcagggcgagccgcagcgcgcggcccacccgcaccagggcgtcatccatcggcgtccgtccttcccagtccgaaccagcgggcctggcccagggtgacgacggcgatgatcagcgcgaggatcaccgcgcccgcgctgcccaggcccaggttctgcccctggccgagcgcggtgtagtagaggtagaccagcggcgggcgggcgtagggcgggtaaccgcgtgcgtcggagagcaggttgtagaactcgtcgaaggcctggaaggcgttgatgacgaggagcaggaccaccgcgacggaggtggcgcgcagttgcggcagggtgatgtgccgcagcacctgccagccggggcgggcgccgtcgacggcggcggcctcgtagagcacggggttgatccgctggagcccggccaggaagaggatcatgtagaaaccggcctgcagccacagccgtacggtgacgatgaccagccagtaccagggcgggttcgtggtggacagccaggccaccgggtcggcgccgaagaggtccaggacggtgttggcgagaccgaaccggacgccgttgaagatcgacatcttccagatgagagcggcgacgacgtaactgcacgcggccggcaggaagaacaccgaccggaagaacgcctgcgcccgccgcacccggttgaccatgagggcgagcgcgagggagaggacgtaggtggccgggacgatgaacgcggtgaagaggaggaaggtgcgcaggctgtcgaggaaggcgtcgtccgacagcatcgccgtgtagttggcgaggccggtgaagtgggtgggcgtgacggtgttgtgcgcgtcgaagaagctgagcgccacgctccacagcagcgggacgtaggtgaacagggcgagaccggcggcgaaggggccgacgaagatccagaaccagagggtgcgccgccggttcgcggaccgccgggtcccgccctcgcggagcccggcccgccgcgtcaccggcggccgggtcacggcggtgcggctcatgaggacttcttcacgcggtcgagttcggccgacaccttccgcagcaccgtcttcagctcactgtccggattcgctccgtccttgatgatccggctcagcgcgtcctggtaggcggtctgggcggccggggtccacagcaggggctgggcgtagccgtggtcggtggtgaagcgcacggcgtcggccgcggcaccggtgcgcagcttggcggccttcttcgcgagcgagatccgggcggggatgtggaagccgtaggagagcgcgaagtcctcctggtcgtcggtgcgctccacccacagccacttcacgaactccttggccgcgtcccggttccggctgcgggcgctgacggcggcggcgtacgcgccgacgggcacggccgggcggccggacgggccgtccttcgggaagggcagtacgccgaagtcgtcgccgagttccttctgcacctgcggcagcgcccacagcccggaccactgcatggcggtcagcccctggaggaacgcggacgggtcggaccagtcggcgggtgcgcccaggagcagggacttgtcggcgtacagctggtggaccttggcgagggtgcgggcggcggcggggtcgtcgaagccgggcttgccgtcctcggtgacgagctggagtccggccgcgtacaggggggttccgccgaggacgcccgcgccgccgtcgttgccgaggaagaggcccttggtcttcctggtggtgagcttcttcgcggcgtcgacgagggcgtcgagggtgtccggcggccggagcccggcgtccttcagcaggctcttgcggtagtagagcatctgcatgtcgatgacctgcgggatgccccagatcttcccgccgtacgtcttcggcgtgagcaccgccgggttgaagtcgtccttgacgcccgcgaggaggtcggtgaggtcggcgacctggccgccctggatctggtccagagtcggcccgttgacctcgaagacgtcgggccccgagtcggtgaggagggcggcggcggtctgctggtcgtagttgcccggccgccactggacggtgacgcgggccttgccgtacgcggcggcgtaccgcttcaccgcctgctcggtgccgctctcgccgtactggtggtaccactgcgtcagcgccggccccgatccgccgccgccgtcgccgtcgccgcgcccggtgttgctcccgcaggcggcgaggagcccgccgcccgcgaccgctccggcgccgagcagtgctctgcggctgatggtcatgtacgcccccaaacactcgtgttccctgcccgcccgcacggcggtacccgcaccgtgcccggcccaacgatcaaccatgcgccgtgatgacgacaggagcgtcgcagcggcgcgtacgcgtcaagagcgccactttcggccaggggcggagccgtgcgtgatcgggtgcgtgggtcgtgcctgatcgggtgcgtgggccgtgcgtgatcgggtgcgtgggccgttggggtggttgcggcggcgggtccgtgtcgccttcctgcgcaacggttacccacagtggtatgacaaccgcgctccgtattccgcccctgcgctcgatcgtcgcgatctgtgctctgggcggctccgctctgctgatgaccgcctgctcgaacggctcgaccgggtcgagtgtcgccgaggcggccgaggccagtcccacgtcggccaccgccaccgcaccgtcccccatgtccccctccccctccgcctcgctgaccaaggaccaggccgagcgccgggacctgctcgccaagacgcacgtgagctgggacaaggccgcgaacaccgccgtgaaggaggtgtccgggggcaagctcgtctcgatcgagctgaagaaggccaagaacaactcggcgtcgccgggcacggccgcctcctccccgaacaccgcgtcccccggcgccgcctcaccgacctccggctcgccgagcccgtccgcgtccgcgggcgccgcccagtggcaggcgaaggtcgccgccgccgacggcacgatccgcaagatcgacgtcgacgcggccgacggcaaggtgacccgcagcacgaccgagtcgggccagaaggccgacgacaagcgcaaggtcgccgaccggctcaagaaggccacccagacgcccgcgcaggccgtgaagacggccaccggcaagaccaagggcaccgtgaccggtgtcgacctcgacgagcacgacaacaagctcgtctggagcgtcgacgtcgtctcgaccaaggactggaccaagaccacctacgacatcgacgcggccaagggcagcgtcgtgcgcgagcacgtcgaccacgactgagcccgcccggcccggccggcttccgcgcacacgacaggggcggcatccccgcacaaggatgccgccccttctccgtgatccggagtccccgccgtgatcggtagtgagggtcggggaccacgacgaggactccggggtctttcacaccggcgacaccggtgtcagcgcatcaccggcctcaccggtggtcgctgccctccgaaccggaggccgcacggccggcctccaggcgagcgaccgggatgcggaacggcgagcaggagacgtagtccaggcccacctcgtggaagaagtggacggactccgggtcgccgccgtgctcgccgcagacgccgagcttcagatcggggcgggtggcgcggccggccttcgcggcggcggcgaccagcgagccgacgccgtccttgtcgatcgtctcgaacgggctgacgccgaagatgcccttctccaggtacgccgtgaagaagctcgcctccacgtcgtcgcggctgaagccccacaccgtctgggtgaggtcgttggtgccgaaggagaagaactccgccgcctcggcgatctgcccggcggtgagcgcggcgcgcggcagctcgatcatcgtgccgatcgccagcttcaggtgcgtgcccgtcgcggcctcgacctccgcgatgacctggtcggcctcctcgcggacgatctccagctcctgcacggtgccgacgagcgggatcatgatctcggcgcgcgggtcgcccttggcgttcttgcgctcggccgccgcttcggcgatcgcgcggacctgcatggtgaacaggccggggatggcgaggccgagacggacaccgcgcagacccagcatcgggttctgctcgtgcagccggtgcacggcctgcagcaggcgcagctcgttctcgtgcggctcctggcgggactcggcgagcgcgacgcggaccgacagctcggtgatgtcgggcaggaactcgtgcagcggcgggtcgagcaggcgcacggtgacgggcaggccgtccatcgcctcgaacagctcgacgaagtccttcttctgcagcggcaggagctgcttgagcgactcgtcgcgctcggcctcggtgtcggcgaggatcagccgctccaccagctcgcggcggtcgccgaggaacatgtgctcggtgcggcacaggccgatgccctgggcgccgaagcggcgggcgcgcagcgcgtcctcggcgttgtcggcgttggcgcgcacccgcagccggcgcttgcggtccgcgaacgccatgatccggtgcacggcctcgaccagctcgtcggcgtcgtcggcaccggcgtgcatccggccctcgaagtactccacgaccggcgagggcacgaccgggacctcgccgaggtagaccttgccggaggagccgtcgatggagatgacgtcgccctcctcgacgacgtgcccgccgggcaccgtcatccggcgccgcttggtgtcgacctcgagctcctccgcgccgcagacacaggtcttgcccatgccgcgcgccacgacggccgcgtgggaggtcttgccgccgcgcgaggtcaggatgccctcggcggcgatcatcccgtccaggtcgtcggggttggtctcgcggcggaccaggatgaccttctcgcccgagcgggaccacttgacggcggtgtacgagtcgaagacggccttgccgaccgccgcgcccggcgaggcggcgatgccccggccgacctgctcgaccttcgccttgtcgtcgaagcgggggaacatcagctgggcgagctgggcgccggtgacgcgctggagcgcctcggcctcgtcgatcaggccctggtcgacgagctgggtggcgatgcggaaggcggcaccggcggtgcgcttgccgacgcgggtctgcagcatccacagccggccgcgctcgatggtgaactcgatgtcgcagagatccttgtagtggttctccagggtctccatgatctgcatgagctggtcgtacgacttcttgtcgatctgctccagctcggcgagcggcacggtgttgcggatgcccgcgaccacgtcctcgccctgcgcgttctgcaggtagtcgccgtagacgccctggtggccggaggcggggtcgcgggtgaaggcgacgccggtgccggagtccgggccgaggttgccgaagaccatcgagcagacgttgacggcggtgcccaggtcgtgcgggatgcgctcctggcggcggtagagcttggcgcgctcgccgttccaggactcgaagaccgccttgatcgcgaggtccatctgctcgcgcgggtcctgcgggaagtcccggccggcctcggtcttgacgatcttcttgaacttggtgaccagcttcttcaggtcggccgcgtccagttcggtgtcgaccgtgaccttcttggtctccttggccttgtcgagggcctcctcgaagaggtcgccgtcgacgccgaggacggtcttgccgaacatctggatgagccggcggtaggagtcccacgcgaaccgctcgtcgccggcctgctgcgccaggccctggacagacttgtcggacaggccgatgttcaggacggtgtccatcatgccgggcatggagaacttcgcaccggagcggacggagacgagcagggggctgtcgggctggccgagcttcttgcccatccgctgctccagcgcgtcgaggtgcgcactcacctcgtcacgcagtgccgccggttcctcgccgctgtccaggtagaccttgcaggcctcggtggtgatcgtgaagcccggcgggacggggaggcccaggttggtcatctcggcgaggttggcacccttgccgccgaggaggtccttgaggtccttgttgccctcggtgaagtcgtagacgaacttcacgccctcaacgctctggccgcgctcggctacctggggatctttgttttccgacacgggtctcgactcctcgaggacgcggtggctgccctgacggcgaggaacatacccagatcgaaggcttgtgggtacgtccacttgtgcgtcatgcgcctgtaaccagcggtccgccagcggatcgaaagtcaaggcttggcaagtcgtcagggccggatgttttcacttcttgaacgaatcaatgcccgtaaacccgttctggcgctcatatgagcggctacaggcacgggtgatttcgatcggtgaacggtcgatgcatggcactgagtgccactctttggagaagtgcaggcgccgataatccgctcatgtgagcgcaccccttatcaagggtggcgagaatcacgctgccatacgcgcccggattccaccatgcggacctcctcggccaccctttcggatggccccgcaggaccggtgccgcgtggttcccggagccctgttcgcccgggtgtttgccgaccgcccctgaacgccgccgacgggccggccgtacggatctccggcgggcccctccccttcccgggcggcccgccgctcctcgccaccgcatacggaaggacccggggccccagccggcccg

SEQ ID NO: 617 - DNA, 5282 bp, Unknown
  Kingdom: Bacteria, Phylum: Actinobacteria, Class: Actinobacteria, Order: Streptomycetales, Family: Streptomycetaceae, Genus: Streptomyces
tcgacgcgggcaccggcactcagctcgtccggagtgccggtgcccgcgtcgaccagcgcggcctcgcccgtaccgtcgaggttgacggagccggtgctcgccgtccgcgggtgcagttcggcgccgccgacgaccgacagcttctggagctgcggggcgtaggcacgccagaagctgtcgaactcgaagtcgccgtcgcgtgccttgccctgcacgtccgccaggtaggtgcggatgccgccggtggcggtgagggagccggagtgcagccaggtcccgccccagctgcggccgaaggccagcgtcgtggaacggttctcggaggtgcggtccgcggtcttgacccggagccggtgcgccttgcgggcgtccagcaccaaggtggtgtccttggtgaggtcgagctggggccgggcgaggtaggcgacggactcggccatgctgcccgtggtgtccgcggcgtccggtgtgatgacgaacccggagacgaagtacgcgccggggcgcagccggtagacctggtcggcggcgccctcgttgaagcggcgctcaccgccggcggtgtcggtgccgatgacgtcgagcgaggaggagcccgtggcgggctcgccggtgcggtcgatcagcttgacgcgcagggtgacggtctgcggctcgacgtacagggagaacggcgtggagacctgcgtaccgccgggcgcggtggccaggacccgtccggtgacgtcgccgtactgggcggccgtgaggtgcgcggccgggtcgatgcgcagcgggaccttcacggtggccccggccggcacggtgacgctcttcgcgtcgagcccggcgaccgaggagcggaccgcggagccgtcgttgccggtgacgccctggatgctcagcgacagcttcaccggctcggtacccgagttggtgtagggcagggtgacggtggtgcggtcgctgctgtcctgcggccaggcgaaggtgccggcctggacggccggggcgccggtgacggtggtgtcgacggcggccttcacgtcgagccggcctgcgccggtcacgcgcacgtcgcccgcgatgtcgctcttcgcggacgacaccagggcggccttgacctgctgggcggtccagtccgggtggcgctgcttgacgagggcggcggcgcccgcgacgtgcggggtggccatcgacgtaccggacatcgaccggtaggcgtagatgccccggccgcccgcggcggcggccaggatgtcgacgcccggggcggcgatctccggtttgagggtgtgcgagccggtcactggtccgcggctggagaaccgggcggcggagtcgtcgtggtcgacggcgccgacggtcagcacgccgggggcgcacccgggcgaggagacggtgttgagcgccgggccggtgttgccggccgcgacgacgaacagcgtgtccctgctctgggcgagtctctcggcggcgacgcccatcgggtcggtgcagtcggtcggctcctggctgccgaggctcatggagacgacgtcggccttctggtcgacggcccactgcatgccggcgatgatccaggactcggcgccggagccggaatcgttgagcaccttgccgttgagcagttcggcgccgggggcgacgcccttctccttgccgccgctcgcggcaccggagccgccgacggtggagatggtgtgggtgccgtggccctgaaagtcgtcggtggtgtcggagtcggtgaagttctccgagacggagatccggcccttgaggtcggggtgttccgcgtcggcgccggtgtcgaggaccgcgaccttggtgcccttgccggtgtatccggcggcccaggcgcggtcggcgccgatctgctcggtcgactgggcgagggtcgcccggaccttgcggtcgagccagagcttcttcagaccggacgcggcgaacgaacgggtgctggtgacgtccgtccagaagtcggcggccttcgccttgtccgccttgagcgcgacgccgtcgatggcgtccagggcgaggcccggctcggcgccgcggagggtggcggtcgcggtacgggcggtggcccggccgtagacggcgatcagcggcagcgcggtggtgtgcgcgtcgtcgtagccctgccggatgagtccggtgacgttgaagagttcctcgtcgaccttgcccgtggccagcgcccgcgcggcggtggcggggtagacgtagaggtccttgcccgactgccgggtctgcaggaggggcacggagccgtcctggcggggcagcgcggtgaccgaggcggtgcccgaactgtccgtggtcaccaggattttgtcgccggtgaccagggtgagggtgaccggtttccctgccgtggtggtggcggccgtgctgccggtcagtggtctcttcgcgctcggaccgtcctgcggcgctgccgcggacggtgcgatcgcggtgacggccaggacggcggctgtggccgcccccagcgccgtacgcgatatcggacgcatcgctctccctgagtgaggaccggacacctgtgaacgggcagaggtgtgccggaagttgtcggtgcggtgggtgcagtcggtgctgtcgggctgccgtggcgtcaccttggcagaacgaggcgcggcgaggtgatgtgatgcgcggcgggtttacgccgtggccgcttctcgccgcggcccggacacccgggcagaccacgggacggggaccgcccagggccgcggtcccgcccgccgactcgcgccggccgtttcagctctcagctctcagcggcgccagccgtaacggcgttcgggccggccggcgacgccgtagcgcagcgtcacctcggcgctgccggtggtgtggaagtgctccaggtagcggcgggcgctcacccgggagacgccggtcagggccgcgcactcggcggcggacagggtgccgtcggcttgccgcagggcccgttcgacgagttcggcggtctcgacgctcatgcccttgggcagcgcgcccgccggtgcggtggccgtccctccggccaggacgcggtccacgtccgcctggctgcgcacgacggtggccagcagacggtcgcgtcgcgtggcgtaccgctccaggcggggacggagatcgtcgaagtcgaacggtttgagcaggtagtcgacgacgccccggcgcgcggcacggcgcaccgtctcggcctcctgggcggcgctgatcaccatcacgtcgcagtcgtggcccgcggagcgcagccggggtatgacgtcgaggccgaacatgtccggcaggtacaggtcgagcaggaccaggtccggccgcagttcgtccaccgcgtcgatggcctgccggccggtgtgggccgtgccgaccaccttgaacggctcgacactctcgacgaacctgcggtgcacccgggccaccatgaagtcgtcgtcgacgacgaggacgtcgatcggcgcgcacgctgcggacgtgccgtgcgtggccgtcatcgggatgctccttccgccaccgcgccggcggggtggctgactgtcatgcgtgcggtgaacaccgcgccgtcaggggtgctggtcacggctatctcaccgccgtggcgttcgcacaccagcttggtcagtgccagtccgatgccgcgccggccctcgggatcggccttggtggtgaaaccgtggacgaagacttcccgtgcgagttccgcggtgaggcccggtccggagtcacggaccacgatctcgacgctggaggcgtcctgccgcagttccacctcgacccatgcctcgtcgtcgtcgccgcggtgcacggcggcggcgtccaccgcgttgtcgacgaggttgccgaccaccgtggcgacatcggccgcgtcctccgccgcgagccggtcgagtgcggtgtcggcggagatgcgcagggtgactctgcgctcggcggccagcgaggacttcgccatcagcagcgcggcgatcgcgctgtcgcgtacgcgcctggcgagggtcatatccagggactggcggcgctggttcaacgcgcggatgtgccgcaccacttcgtcgtgctcgccgatctggatcagcccggagatggtgtgcagctggttggcgaactcgtgggcctgcgcgcgcagcagttcggaggagctgcggaaggagccgatcttccgttccagttcggccagttcggtgcggtcgcgcagggtggtgacggagcccagggtgcggccgtccttgacgacggtcatccggttcatgacgagcatgcgtgcgcggcggatgacgacctggtcgggctggtcggcgccgccccgggtcccgatgagcacgtcccgcagccgtccgtcgatgccgagtgcgtccaggctctgccccacgcagtcctcgggcaggtccagcaggcgccggcccacgtcgttgacgagggtgaggcggtgttgcgggtcgagtgcgacgacgccctcggcgatcccgtacagcatggcctcgcggtgctcggcgaggccggtgatctcgcgtggctccagaccgtgggtctggcgcttgacgcgtcgcgcgaggagccacgagcccgtcgcgccgagtccgctggcgatgcccaggtaggcgaggaggtacgaggaggccccgctgagccgctgccacgtggtcggggacgcctcgccgatcatcacggtgccgagcgtgcggccgaggtcgctctgttccgctccgagcaccgccacctgggccaccagttcgcggctgccgtcgagtgtcagttgtccggaccagccgcgtcccgcggcggcgccctgcccgagcggcagcggctcgccgaccacggtggggttggtggaggagacgatgcggcccttcgcgtcggccaccgtcacggaggtgacgccggactgggccagcgtggagtgcacgagcggtgccagtgtctcttcgggcgcgggccgcaccaactggctgcggaccagggggttggcggccagttgctccgccagcgcgtcgatgcgacggccttcgacgcgtttgaaggtggcctcggactgggcgagggagaagccggcgaccgccagcagtacgaccacgatgatgaccagctggagggcgagcatctctcccgccagcgtatggcggcggaagacagcgaccacaatgaactcaatctttcatgctgacacaacgtgggcagcgcatgtgccggatcgcataatcatgacgtccgccaggtgaaatcggaagtgaggtgtcatgagaggtcccgcacgtgcctttctcggcaccctcaccgtgctggtgctgctgctcgcgagcagc

SEQ ID NO: 618 - DNA, 10953 bp, Unknown
  Kingdom: Bacteria, Phylum: Actinobacteria, Class: Actinobacteria, Order: Streptomycetales, Family: Streptomycetaceae, Genus: Streptomyces
gacctgggtctggcgatgggcaccggcacggacgcggccatcgaggccggcgacctgacgctggtccgcggcgacctgcgggtggccggggacgccatccggctctcccggcggacgctggccacgatcaagggcaacctcgtgtgggccttcggctacaacgtggccgcgctgccgctggccgccgccggtctgctcaacccgatgatcgcgggcgcggcgatggcgttctcctcggtgttcgtggtgaccaacagcctgcggctgcgcaggttccgctgagccgggacaaagtgccggaccccctggagtccggcgcgcgcctcacataagctcttcacaaggctcgcgcatcttccttacgctcgggcctcgatcgccatatcagggctcttgcgcacctaagggacatatgcaagagacgcatgtcacagtgacgtgaacgtaaccatcgaaggggttcgaaggtctaagtttggcgatgtcaggaagcgtcttggggggcgcggactgacgtctggggatgtcttgggggacttccctggaattgcgttgccgggacacgtacatcggggagctttgagcggccctcccgggcgtgcgctgtcccggcagagcgcaacagcggcagtgcgagcacctcggtgtgcccgcgctggcgtggcagtacggcagcacagcggttcaggcgctggtctccacagacgcccggccggatcccgtggggggaatccgataccgggacatgggaaggcgccctggtcgccggcccgtggggggactggcgtcagggcgccttccgttttttcgtcttcttttcgtcttcggcgctcgtcacgcgttcttcagcgcggtacgtgctgcgccaccgcgcgcaggcaccccgcacgcgcacaggccccgcacccggcgggccgaccggccggcggaggcggggcccaggggcgcggcggccccggaggcggtgagcctcagcgctcctcgaccgggacgaagtcgcgctcgacgacgcccgtgtagatctggcgcgggcggccgatgcgggaacccggctccttgatcatttcctgccactgggcgatccagcccggcagccggcccagggcgaacaggaccgtgaacatctcggtcgggaagcccatggcccggtagatcagaccggtgtagaagtcgacgttcgggtagagcttgcgctcgacgaagtagtcgtcggagagcgcgtgctcctccagcttgagggcgatgtcgagcagctcgtccgacttgccgagcgcggagagcacgtcgtgcgcggcggccttgatgatcttggcgcgcgggtcgaagttcttgtagacccggtggccgaagcccatcaggcggacgccgtcctccttgttcttcaccttgcggatgaaggtgtcgacgtcggagccggagtcgcggatgccttccagcatctccaggacggactggttggcgccgccgtgcagcgggccccacagcgcgttgatgccggccgagatggaggcgaacatgttggcctgcgaggagccgaccaggcggaccgtggaggtcgaacagttctgctcgtggtccgcgtgcaggatgagcagcttgtccagcgcggagacgacgaccgggtccggctcgaagtcgtcggcggggaccgagaaggtcatccgcaggaagttctcgacgtaggagaggtcgttacgcgggtagacgaacgggtgaccgatcgacttcttgtacgcgtacgccgcgatcgtcgggagcttggcgagcaggcggaccgtggacaggtcgcgctgcttctcgtcgaacgggttgtggctgtcctggtagaaggtggacagcgccgagacgaccgaggacagcatcgccatcggatgggcgtcgcgcgggaagcccttgtagaagttcttgacgtcctcgtgcagcagggtgtgccgcgtgatctcgcccttgaaggtggagagctcgtcgacggtcggcagctcaccgttgatgagcaggtaggccacctccaggaaggtggagcgctcggccagctgctcgatggggtagccgcggtaccggagaatgccctgctcgccgtcgagataggtgacggcggatttgtacgcggccgtgttgccgtagccgctgtccagagtcaccagcccggtctgggcgcggagcttcccgatgtcgaagcccttgtcgccgacggtgctgtcgaccaccgggtaggtgtactcgccgccgtcgtaccgcagtactacagagttgtcgctcacgtcttccctcaccgacgtagtgcctcatcttcgaggtgccctgactgtctctaccatcccccatttggctcaggagagtgcactcggggtcgaccattgggcctattggcggcactcagtgccgccaacctgctcatcctgccccctcgatccggtcacgggaagtgctctgtgacctttgcgactcgtttgatcgatcatttttggcgatgccgggtgcgggcggggcccgctccgggccaccccgaccgattcatgcatttttgtcgcccccgggggccatccggcgcgtttttccgcctccacccgcccttgagccggaaatccagcgtcagcccttgagccggaagtccagcgccgtgcaccgccgtcccgccgacaccgtacgcaccgcctggccgatcgccttgcgcgaaccgaccaggacgaccagcttcttggcccgggtcacggccgtgtagagcaggttccgctggagcatcatccaggcgccggtggtcaccgggatgacgacggccggatactcgctgccctgcgagcggtggatggtcaccgcgtacgcgtgcgccagctcgtccagctcgtcgaactcgtaggagacctcctcgtcctcgtccgtcagcaccgtcaggcgctggtcgaccgggtcgagcgaggtgaccacgcccaccgtgccgttgaagacgccgttctcccccttgtcgtaattgttgcggatctgagtgaccttgtcgccgacccggaagacccggccgcccagccgcttctcggggagatccgggcgaccgggggtgatggcctgctggagcagcccgttgagcgtgccggcgccggccgggccccggtgcatgggcgcgagcacctgcacgtcccggcgcggatcgagcccgaaacgggccgggatccgccgcgccgccacgtccacggtgagccggcccgcctcctcggtgtcgtcctcgacgaagaggaagaagtccttcatgccgtcggtgagcgggtgctgcccggagttgatccggtgcgcgttggtcaccacgccggactgctgggcctggcggaagacgcgggtgaggcggacggcgggaagggggccgccgtcggcgaggaggtcacggagcacctcgccggcgcccacgctcggcaactggtccacgtccccgacgaacagcagatgggcacccggcggcacggccttgaccagcttgttggcgagcagcaggtccagcatggaggcttcgtcgacgacgatcaggtcggcgtccagcggccggtccttgtcgtacgccgcgtcgccgccgggcttcagctcgaggagccggtggaccgtggaggcctcggcgccggtcagctcggcgagccgcttggcggcccgtccggtcggcgcggccagcaccaccttcgccttcttcgcgcgggccagctccacgatcgagcgcacggtgaacgacttgccgcagccggggccgccggtcagcaccgcgaccttctcggtcagcgccagcttgacggccgcctcctgctcgggcgcgagatcggcccccgtacgccccttgagccacccgagcgccttgtcccaggccacgtccccgaaccccggcatccggtcctgcccggtccgcagcagccgcagcaactgggcggagagggagagttccgcgcggtggaaggggacgagatagacggcggtgacggacccctgcgcgtcgccgtccgccgcgggcaccttctcccgtacgacaccggggtcgccgccgtcctcggccggctgcgcgagttcggccaggcattcgatgacgagcccggtgtcgacctggagcagcttcaccgcgtcggcgatcagccgctcctcgggcaggaagcagtgcccctggtcggcggactgcgacagcgcgtactggagtccggccttgacccgctccgggctgtcgtgcgggatgccgacggactgggcgatcttgtcggcggtcaggaacccgatgccccagacgtcggcggccagccggtacggctggttcttgacgacggagatcgacgcgtcaccgtacttcttgtagatccgcacggcgatggaggtggacacctccacggtctgcaggaagagcatgacctccttgatcgccttctgctcctcccaggcgtcggcgatcttcttcgtccgcttgggcccgaggccgggcacctcgacgagccgcttgggctcctcctcgatgatccgcagggtgtcggtgccgaagtgctgggtgatccggtccgcgaagaccggcccgatccccttgaccagcccggaaccgaggtagcgccggatgccctggacggtggccggcaggacggtcgtgtagttctcgacgtggaactgcttgccgtactgcggatgcgacccccaccgcccctccatccggagcgactcccccacctgcgcaccgagcagcgccccgacgacggtgagcaggtcgccggcgcctctgccggtgtcgacgcgggccaccgtgtagccgttgtcctcgttggcgtacgtgatgcgttccagcacgccttcgagtacggcgagccgccgctcaccggctcccgccgcctgccccgcccctcgactcgcctcggtggtcatggggcgacggtaccggtggggtgtgacagagggttccggtgtcccctcctcagcaggcgggcccggcggcgtcaggggcggcggtgcgggttttcgggcgggcggaccatgaggacgtcgaccgggtcctccgattccaggacgaaaccgtggcgctcgtagagccggcgggcggggctgccctggagtacgttcagcgcgacggccgcgccttccgcgtcggcccggtccagcagcgtgcccagcacggcggaaccgaggcccctgccctggtgctgcggggcgaggtagaagtgctccagccattgccggccgtcgaccggacggaacgtcacgcacccggcgagttcgccgccggccacgacgacggacgtgtaccgcggggagaaggaatcgcgcagccgctgccgcacccggtgctcgtcgtaacgcccgaggcgttccaggtcggcgcgcatgaccgaggcccgcaactccgcgatcggctcgacatcggccgccacggcgggacgcagcgtccagggcgcgcttcgcgccgccgcctcggtgttcacgggcacgggcatgttcatcggcgtgggtatgggcacggcggattattggcttgggccacgacttccgacaagacgttgtctcagccggtgggcgcctcagcggccgacctgaacgtttatgcgcccctcgaatgggtgaacgccaggggatatgcccgccatacgggtcattgatcaacctactttgcgcacgtggtcgcatcagcccacgagggcatgcaccgcatcttccaggagcggcccgagatcctgaatccggtgttcggggtactgggtgtctcactgccgaagaaggcgacgtgaaggcagggctgaaggcaaggctgaagccatcctcgccgtactgaaggtgcgcggcatccccgtaccggacagtgcccgggggcgcatcaccacctgcaccgaactcgaccgcctggacgcctggctggagcgttcccccctggtcgcccgggcaggggacctcttcggcgaggacaccgacgtagccgagtagcccgccggccaggtgaaccgtggccggactcccgcggggcgggagtccgggccccgctgccgacggcagtcgccgtccgcctcacccgggtcagcaaggggtcgatccggccatggagccgacggcccgcacccttcctcccgaccgggcccgcgccgctcacctcgcagggccccctccgccccctccggtcacgattgggtttcagccactcccaccctcttgtcacgatctcgtgtaatcgattccaatccctcgtgtaatcgattccacgaggaggtggagcggcgatggcgagcatcaaggacgttgctgccggggcgggtgtgtccgtcgccacggtctcgcgcgtcctgaacgaccatccgtcggtcagtgccgaggcacgcgcgcgcgtgctggccgccgtcgaggcgctgggctaccggccgaacgccgtcgcccgttcgctgcgcacggaccagacccgcaccctgggactggtcatcagcgacgtgctcaacccctacttcaccgagctggcccgttccgtggaggaggaggcccgtgcgctcgggtacagcgtgatcatcggaaacgccgacgagcggcccgacctccaggaccaccacgtacgcacactgctggaccgccggatcgacggcctgctcgtctcccccaccgacggcggctccccgctgatgctggacgcggtgcgcgcggggacgccgatggtgttcgtggaccggtggatcaagggcgtcgacgtgcccgtggtgcgggccgacgggcagcaggcggtgcgggatctcgtcgcgcacctgtacgcgctcgggcaccggcggctcgcgatcatcgcggggcccgcggccaccacgaccggcagtgagcgtgtgcaggcgttccgcgaggcgctggcggcgtacgggctcgccctgcccgaggcctacaccgggcagggcgacttccaggccgagagcggacggcgggtcaccgagggcttcctcgacctgcccgagccgcccgaggtggtcttcgcggccgacaacctgatggcgctcggcgcgctggacgcgatccgggcgcgcgggctgcgcgtgccggacgacatcgccctcgcggcgttcgacgacatcccgtggttcgtgcacaccgatccgccgatcaccgccgtcgcccagcccacgggcgagctgggacgcgccgccgtacgggccctggtggaccgtatcgagggccgggggccgcagtcggtgaccctgcccgcccgtctcgtcgtccgccgctcgtgcggtgaggcggccgtcggggctcccgcccggacggccgtcccggccggccccgaccccaagtccttcgcaacgaacaggagcatgccgtgagcgacccggaggagttgctgcgcatcgagggcatccggaagaccttcccgggcgtggtggcgctggacagcgtcgacttcgacctgcgccggggcgaggtgcacgtgctgctcggtgagaacggtgccggaaagagcacgctcatcaagatgctctccggtgcctacacccccgacgccgggcggatctgggccggtggcgaggaggtgcgcatccatggtgcgcaggactccgagcggctcgggatcgccacgatctaccaggagttcaacctcgtaccggacctgacggtcgccgagaacatcttcctgggccggcagccgcgccgcttcgggatgatcgaccgcaagcggatggaggccgacgccgcggccctgctcgaacgggtcggtgtgaacgtgtcgccccgcgcgcgggtgcgcgaactcggcatcgcccggctgcagatggtcgagatcgccaaggcgctgagcctggacgcccgcgtgctgatcatggacgaaccgaccgccgtgctgacgtccgaggaagtcgagaagctgttctcgatcgtgcgggcgctgcgggccgacggggtcgggatcgtgttcatcacgcaccacctggaggagatcgccgccctgggcgaccgggtcacggtcatccgggacgggcggagcgtgggccaggtgcccgcctccacgcccgaggacgaactcgtccggctcatggtggggcgctccatcgagcagcagtacccgcgggagcggaccgagcggggcgagccgctgctcgccgtggacgggctcacccgggacggcgtcttccacgacgtcagcttcgaggtgcacgccggtgaggtcgtcggcatcgcggggctggtcggcgccgggcgtacggaggtcgtgcgggcggtgttcggcgcggacccgtacgacaagggcgacgtccgggtcgcgggcgcccggctgcggcggcacgacgtgaacgcggccatggcggccgggatcgggctcgtgcccgaggaccgcaaggggcaggggctcgtcctggacgcctccgtggaggagaacctcggtctggtgaccctgcggtcgacctcccgcgcggggctggtcgacctcaaggggcagcacaccgccgccgagcggatcgccgggcagctcggcgtgcggatggccggtctcgggcagcacgtgcggaccctgtccggcggcaaccagcagaaggtcgtcatcggcaagtggctgctcgcggacaccaaggtcctcatcctcgacgagccgacgcgcggcatcgacgtcggcgccaaggtcgagatctaccagctcatcaacgaactgacggccgccggcgccgccgtcctgatgatctccagcgatctgcccgaggtgctcggcatgagcgaccgggtgctggtgatggcccagggccggatcgccggggaactccctgccgaccgggcgacccaggacgccgtgatggcgctcgccgtcagcactcctacgaacacgacgaccgaagtggaggcctcccgtggccactgacacgctcaagagcaaggcgggcgcggggggcgcctccggcggcctgcgccgcctgctgctcgacaacggcgcgctgaccgcgctgatcgtcctcgtcatcgcgctgtccgcgctctccggtgacttcctgacgacggacaacctgctgaacatcggtgtccaggcggcggtgaccgccatcctggccttcggtgtcaccttcgtcatcgtcgcggcgggcatcgacctgtcggtcggctcggtggcggcgctgtcggcgaccgtgctggcgtggagcgccacctcgcacggcgtgccggtggtcctcgcggtgatcctcgcgatcgccacgggcatcgcggcgggtctggtcaacggtttcctgatctcctacggcaagctgccgccgttcatcgcgacgctggccatgctgtcggtgggccgcggtctgtcgctggtcatctcgcagggctccccgatcgccctgcccggctcggtctcgcacctgggcgacacgctcggcggctggctgccggtgcccgtgctcgtcatggtcgtcatgggcctgatcacggcgttcgtgctgggacgtacgtacatcggacgttcgatgtacgcgatcggcggcaacgaggaggcggcccggctctcgggtctgcgggtcaaggggcagaagctcgcgatctacgccctgtcgggtctgttcgccgccgccgcgggcatcgtgctcgccgcccggctgtcctccgcgcagccgcaggccgccaacggctacgagctggacgcgatcgccgctgtcgtcatcggcggcgcgtcgctggcgggcggcaccggcaaggcgtcgggcacgctgatcggcgcgctgatcctcgcggtgctgcgcaacggcctcaacctgctgtccgtgtccgcgttctggcagcaggtcgtcatcggtgtcgtcatcgcgctggccgtgctcctggacaccgtgcgccgcaaggccggggcgactccgcaggccgcgggcaccggcagcggcggcggcaagggcaagcaggcggcgacgtacgggctcgcggccgtggtgaccgtggccctggtggccgcgacctccctgctgcacaccgggtccgcctcgacgaccccgaagatgggtctgtcgctgtccacgctcaacaacccgttcttcgtgcagatcaagtcgggcgcgcaggccgaggcgaagaagctgggcctgaacctgaccgtcaccgacgcgcagaacgacgcctcgcagcaggccaaccagctgcagaacttcaccagttccagcctcggcgcgatcatcgtcaacccggtggactcggacgcggccagcaactccgtgaaggccgccggcaaggcgaacatcccggtcatcgccgtggaccgcggcgtcaacaacgcgaagacggacgcgctcgtcgcctccgacaacgtggcgggcggcgagctggccgccaagaccgtcgccgagaagctgggcggccacggcaagatcgtgatcctgcagggccaggcgggcacctccgccgcccgtgagcgcgccgccggtttcgcccagggtctcaaggcctacccgggcatccaggtcctcgcccagcagcccgccgacttcgaccgcaccaagggcctcgacgtgatgtcgaacctgctccaggcccaccccgacgtgcagggtgtgatcgccgccaacgacgagatggcgctcggcgcggtcaaggcgctcggctcgaaggctggcaagtccgtgcaggtcgtcggcttcgacggcaccccggacggcctgaccgccgtcaagaacggcacgctgtacgcgtccgtcgcgcagcagccgagccagctcggccggatcgccgtggacaacgcgctcaaggcggtccagggcaagaaggtcgcgccgatggtgaaggtgccggtcaaggtggtaacgaaggagaacgtggccgggttcagcggctgacccgcgacccgttcccgtaaggagacactgcgcatgtacgactacgacctgctggtcgtggggtcggccaacgccgacctggtgatcggcgtcgagcggcggcccgcggccggggagaccgtcctcggctcggacctggcgacccaccccggcggcaagggcgccaaccaggcggtggccgccgcccgcctcggggcccgcaccgccc

SEQ ID NO: 619 - DNA, 7352 bp, Unknown
  Kingdom: Bacteria, Phylum: Actinobacteria, Class: Actinobacteria, Order: Streptomycetales, Family: Streptomycetaceae, Genus: Streptomyces
aggccgacaacaccgtccaccgccgggccagggcccgtgtcgaacacgccttctcccggatgaagacctacaagatcctccgcgattgccgcctacgcggcgacggcgtccaccacgccatcctcggcgtggcccgactgcacaacctggccctcgccggatagccccagctcggcccacgtccatcccgccatggctcaacacccgcttacgggacgtcgtttagggtccgtcttcaaatggcaggcccacatcaggagcgatgcgagggtgacggctgcttggtaggactcggcggtcttgtcgtaacgggtggcgatccctcgccactgtttcaggcggttgaagcagcgttcgaccacgttgcgccgcttgtagaggtgcttgtcgaaggccggcgggcgcccgccgcgatggccgcgccggagccggttgcggatctgatcggaccgttccgggatggtgtgaccgatgccccgccgcctgagccaggcccggatcgctctggagctgtagcccttgtcgccgatgacgtggtcgggccggacgcggggccgccccggtccgaggcggggcacccgtatcgcgtccatcacggcggtgaactgggtgcagtcgttggtgttcccgcccgtgacggtgaaggcgagtggacgtcccagggagtcgcacgccaggtgaatcttgctggtcaggccgcctcgggggcgtccgagccccggggaacggagcccccttttcgggcccccgcagcatgctggtgggcacggacgacggtggagtcgaccgacacgagccagtcgatgtccccggccgcgtccgccctcgcctgggcggcctggagcatccgctcgaacgtgccgtccagagcccaccgacggaaccgggtgtgcagcgtggcccacggtccgtaccgctcgggcacgtcccgccaagcggccccggtacggaacttccacacgatcccgttgagcaccgtgcggtcgtccaaccgcttcctgccccgcaatgacccgggcagcaacggccggacgaactcccactccgcatcggacagttcatggcgacgtatcacctgaccatgatccgccactcaagatcatttgaagacaccgcctagcaacgcgcctcacccagaggggagggacagaccggctcagccaccaccagcgtggagatcaacacgaacacgaacgatgccacatcgacagcggccggctccgccgagccgatgacggctccggcggaccggaagtctcggcggagcggagttcgtgtactcggacggatctgccgacccggattcgtcgcgcgagacgaacggaccgtagggcagaccacctagggtcgccggcagcgaggctaggaggcgaagtatgcggacactgttgcggggcggtcgtgtcatcgacccggctacgggctttgacggcacggctgatgtgctggtctccgacggcgaggtcatcgccgtcggaccagggctgtcggccgccgacgatcaggtcgagatcgatgtcgccgggtacatcgtcgggcccgggttcatagatctgcacagtcacgtgcactccatcgcgggccagcggctgcaggcgatggacggcgtcacgacggcgctcgatctggaagccggcatgatgcccgtcgaacgggcctacgccgaggcggccgcggcgggacgcccgctgcactacggcttctcggcttcctggggttccgcgcgggccagggtgctcgccggtatcgaaccggacgcgaacatcaacaccgtgctcgccgtgctcggcaatcctgcctggcagcggtcctcgtcgaaggccgaactggccgcctggctgtcccttgtggagggtgagctggcggcgggcgcgctcggcgtcggcgtcctgctcgggtacgccccggccagcgatccggccgagttcctggcgttggcaaagctggccaagcaggccgaagcgcccacgtacacgcacgtccgcgagctggtcgagatggacccggccacgccggtcgacgggtcgagggagatcgccatcgtcgcggccgagaccggtgccgcgatgcaccactgtcacgtcaacagcacgtccggacggcacgtcgaccgggtgctcgccacgctggagtcgggccgttcggccgggtcgcgggtgacggtcgaggcctatccctacggggcgggcagcaccggcatcggcgcggcattcctcgcgcccgagcggctcaagatgaaggggctcgacccgaggcgcgtgctgatgctggagacgggcgagcggatcgccgacgaggcacggctgctgcaggtccgcgccgaggacccgggagcgccgtgcatcctcgagttcctcgacgaggagaacccgagggaccgggacctgctgcaccggacgctcgccttcccggatgcgatcgtcgcgagcgacgccatgccggtgcactggcatggcgccggcaacgaatccaccgaatggccgctgccccctggcggtgcgacgcacccgcgcacggcggggacgttctccaagtcgctgcggctgatggtgcgcgaggccggggtgtggacttggctggaggcgttccggcgctgctcctacctgcccgcgagggtgctcgacgagatcgcgcccggcgcgcggaccaagggcaggctgaacgtcggtgcggacgcggacatcgtcgtcctcgaccccgccaccctcaccgacacggccacgtacttcgattcgacccggccctcggtcggcgtccggcacctgttcgtcgcgggcaccccggtggtccgtgacgggcagctgctcgccgacgcctaccctggccggccgctgcggggggagccacgatgacggaattcagcctggaagctctgctcaccgacatcgaaacgctggtgcgctgcgaatccccgtcgtccgacctcgacgcggtggcgcacagcgccgaagtgctggcggacctcggcaaggcggtgctcggcgtggagccggagcggatcgtcatcgacggccggacgcatctgcgctggcggttcggcgacggcccggcgcgcgtgctgctgctcggccaccacgacacggtctggccgatgggctccctcgaaacgcacccgttctccgtggcagacggggtcctgcggggcccgggctgcttcgacatgaaagcgggcgtcgtgatggcgctccatgcggcggcggcactgccgcgccgggccggattgtccattctggtcaccggggacgaggaactgggctcgccgtcgtcgcgagggctgatcgaggaagaggcccgcggctgcgaggcggtgttcgtgttggaggcttcggcggacggcggcgcgatcaagacccggcgcaaaggggtttcccactaccggatcgaggtgaccggccgctccgcgcacgccgggctcgaaccggagaacgggatcaacgccgggatcgagatcgcgcaccaggtgctcgcgctcgccgcgctcgccgatccggagcgtggtaccagcgtggtgccgaccgtactttcggccggcacgacggtcaacaccgtgccggcggcggccgcggttgaggtcgacgtgcgggtgtgggacgaggaggaacagctccgcgtcgaccgggcggtgcggtcgctgcagccggtgctggcgggcgtacaggtgcggatcagcggcgggatcaaccgtccgccgctggacgcctcttcttcggccgcgttgttcgggctggcgcgggaactgtccgcggaaatggggctgccgagactgaccgaggcgagtgtcggcggtgcttcggacggcaactacaccgcggggatgggagtgccgaccctcgacggtctcggcgcggtcggcggcggggcgcacgcggatcacgaacacgtcctgatcgaagaattaccgtggcggaccacgttgctgttcgcgctggtggaaaacgttctggcgaagggaagcccgtcgatgccgacgaatttggcggacgattctggtcgagcccgacggtggccctccggggcaagccgggaaaggagcatcccgtgacgaatcttgtgatgaacaccgaacggccggtcacatcggaaacctgcgacgaggcgatcgcggccgcgcgggcggcggccaccgcgtcgggggtcgaggtgcgggagatcaccgatatcgcggaactgacctcggtcggagtgctcttcgagacgatctggcggtcggctccgggcacccggccggtgaccacggagctgctgcgcgcgctgtcggcggccgggaattacgtggccggcgcgtttgccggcggagagctgctcggcgcgtgcgtcgggttcttcggaaatcccggaaaacgcagcctgcacagtcacatcgccggagtcgccaaggccggtgccggccgcggaatcgggtatgcgctgaagctgcaccagcgcggctgggcattgacgcaagacgtctcggccgtcaagtggacattcgatccgctggtgcgccgcaacgcctatttcaacctcggcaagctcggtgcgctcccggtgctgtacctgcgtgatttctacggcccgatgacggacggcatcaacggttcgggcgacaccgaccggctgatggtgtcctgggacctggccggcacggcagtgcggggcgccgcgttcggcgagcccatccggaccgacgcgaaggctctactcgagcggggcgctgtcgtggcgctctcggtggacgcggacggcggcccggcgacgggctcggcagatgccccggtggtggtcgtcgccgtcccggccgacatcgaaggcttgcgcggcaccgactccggcaaagcagccgcgtggcgggccgcgctgcgcgaaacgctcggcggactgatgtccgccgggggccgggtgaccggcttcgaccgggccggcttctatgtgatttccaaggaggagcagtgaaactcagcggtgtggaactgcgccgggtgcagatgccgctcgtcgccccgttcaggacttcgttcggcactcagtccgtgcgcgaactcctgctgctgcgggcggtgacgccggcgggcgagggctggggcgagtgcgtgacgatggccggcccgctgtactcgtcggagtacaacgacggcgccgagcacgtgctgcgccactacctagtccccgcgctgctggctgcggaggacgtgaccgcggcgaaggtgacgccgttgctggcgaaatttaaaggccaccggatggcgaagggcgcgctggaaatggcggtgctcgacgccgaactccgcgcgagcgagcgctccttcgcggccgagctgggctcggtgcgggacaccgtgccatgcggtgtctcagtcgggatcatggacacgatcccgcagttgctcgacgtcgtgggcgggtacctggacgacggctacgtgcggatcaagctgaagatcgaaccggggtgggacgtcgagccggtgcgcgcagtccgcgaacgcttcggtgacgacgtgttgctgcaggtggacgccaacaccgcctacaccctgggcgatgcaccgcagctggcccgcctcgatccgttcggcctgttgctgatcgagcagccattggaagaggaggacgtcctcggtcacgccgaactggcgcggcggatcaagacgccgatctgcctggacgaatcgatcgtgtcggcgcgcgcggcggcggacgcgatcaagctgggcgcggtccagatcgtgaacatcaagccgggtcgggtcggcggttacctcgaagcgcggcgggtgcacgacgtgtgcgcggcgcacgcggttccggtgtggtgcggcgggatgatcgagaccgggctcggccgggcggcgaacgtcgcgctcgcctcgctgccgggcttcacgcttcccggggacacctccgcgtccgaccggttctaccagagggacatcaccgagccgttcgtgctgtccgacggacacctgccggtgccgaccggtccgggcctcggcgtggcgccgattccggagctgctcgacgaggtgaccaccgcgaaggtgtggatcggttcgtagcctggcacgaattccgccgatagatttggccggatcgaaccatccggttggaccggggccggatctaccttcggggagtgctgacacccgtgccgagcaagccgcacacgagtctgggccgcgtcctcgaagccctcggggacgtgctcctcgagccggtcgccgtcgggcgggtcaccacgcggcacctcagcggcgtggtgatccacgatccgcacgacgacgccgagttccccgccgaagcggtcgtcctcggtgtgggcgtgcgcgaaaccgacgagatcgcgaagctgctgcacaccgtcggcgaccgtggcgcggccgcgctggtcgtgcggtcgcccgtctccgcgtcggcggagctggtccgggcggtcgactccaccggggtcgcgctgctcgggctggccagcgcggcgtcgtgggcgcagctcgccgcgatgctccgcacgttgctcgccgagggcgacgtcggcgatgtctccccgcagacgctcggcgggatgccgtccggtgatctgttcgcgctcgccaacgcgatcgccgcgctgctggacgcgccggtcacgatcgaggaccgcaactcgcgcgtgctcgcgttctccggccgccaggacgaggccgatccttcccgcgtcgaaacgattctcggccgccaggtgcccgaacggttcacccgccagctggagaaggaaggcgttttcgaacgcctttaccgggaccaccggccggtctacgtctgcccggacggctacgacgagaacatcgccaagcccagggtcgcggttgcggtccgggccggtgacgaggtcctcggctcgatctgggccgcagtcgacaacgagctcagcgaagaacgtaccgcggcgttggccgacgcctcgaagatcgtcgcgctgcatatgcttcggctgcgcgcgggtgccgatgtcgagcgccggctgcgggccgatctggtgagcaccgcgctcgaaggcggctccggcgcgccggaagccatcgcgcgcctgggactgctggggcagcccaccatcgtgctcgccatgggactccttgagggccccgacgacgacctccggctcgtcgcggaacgccagcgagtcgccgacgcgttcgccatgcacctcagcgccgtccagccccggtcggcggtggcgctggtcggcgacgtcgcgtacggcatcgtcccgatggccgggaatcacggcgattgccgcgaacgctcggtgcgcgtcgcgtcgaccttcctggaacgcactggccgccgggctggcgccgcaatcggcgtcggaccgctcgcgctcgacggctcgggcc

SEQ ID NO: 620 - DNA, 1577 bp, Unknown
  Kingdom: Bacteria, Phylum: Actinobacteria, Class: Actinobacteria, Order: Streptomycetales, Family: Streptomycetaceae, Genus: Streptomyces
cgacgacctgcagttccccggtaccgaccccgaggtgcgggcccggctcgaggaggagctgacgctgcgcggcccgggcgccctgcacgcgcggctcgccgccgccgacccggaggcggcacgcgccatcctgcccagcaacggccgccgtatcgtccgcgcgctggaggtcatcgagatcaccggacagcccttcaccgccaacctcccgggccacgactccgtctacgacaccgtgcagatcggcgtcgacgtggcgcggcccgagctggacgaacgcatcgcgcgccgggtcgaccgcatgtgggacgccgggctcgtggaggaggtccgcgcactggaggcgcacggcctgcgcgcggggcgcacggcctcccgcgcactcgggtaccagcaggtcctcgcggcgctcgcgggggagtgcacgctcgaggaagcacgcgcggagaccgtgcgtgccaccaaacgcttcgcgcgccgccaggactcctggttccggcgcgacccgcgcgtgcactggctgagcggggccgccaccgatctcggggaacttccgcacctcgcgctggcgttggtggaacgaccggttacagcctgatcacgtgatggcatcgggaagcccaggccgtcatccaggcctccggcgccgtgccatcatcaagcttcgatcgacaagtgagtcctagttgggagggcgcgtggcgatggaggccggccctcgcgacaccgcacaaggcacggaacgcatcaccattgagggcaccgagcgcctcaccgtggagcgcgccggtggggagccggacgaggactcactgagccccgacggcccggacgagacacagggcggcgtcaccgacgacggtccggagcccgaggagatgttcgccgggcccgaggtcgaggtcgagctgcgcccgcagcggcggctgcgcatctggcagctcgcgcccatcgtgggcctggcggcagtcggctcgctgatgttcgccttcccgctggccttcgacggcgacagcggtgcgatgatcgccatgctgggactgctgatctgctcctgcgcggcaggctggggcacgatggccgcacgccgcgtcggatacacctggccggggctgccgccgcgcggcaccgggcgacggcccgactggcgtctgctgggcgtgtacgtcctgctggtcgccgtggtcgtcaccctggcggtgtggcgcgtcgcggggctccgctgagcgctccgcgcacgtcggggcctcacccaccgggtctcaccggccgcgggaccccgcacaccgggcgtcaccgctcgccggactccgcacgccggtgcggatgccgggcctcgctccccgggcgctccgtgccccgggcaggtgaggggtcccggagtcccggccggtcggcgtgatcccggtcttgtcgtacccaccccgtacgatcgaggcatgagcacccgtatcgccttcctcaagggacacggcacggagaacgacttcgtgatcgtccccgacccggagaacgccgtggagctgtccccggccgccgtcgccgccctctgcgaccgccgcgcgggcatcggcggc

SEQ ID NO: 621 - DNA, 3725 bp, Unknown
  Kingdom: Bacteria, Phylum: Actinobacteria, Class: Actinobacteria, Order: Streptomycetales, Family: Streptomycetaceae, Genus: Streptomyces
cagagcggccgggcgcgcccggccgctctgcagggagacgacctcccggagcacgcccgtcagctgctcggccatctcctgtgcggaggcgaacctgcggtccgggtcggggtcggtggcgcgcaccaggagccggtagaaggactcgtagcggcggaacacctcgacggtgtccgggtcgggcaggcagtccacgaagacgttcgtgtagccctggaagtcgaaggtgagcaccgcgagcgtgcgggccaccgtgtacaggtcgctggccaccgacgggccggtctcggcgacctcgggcgcctggtagccgaccgtgccgtagatggccgactcgtcgtcgtccatgcggcgcaccgcgcccatgtcgatcagcttcagctcgtcctcggtctggatcgcgttgtcgaccttgaagtcgcagtacagcaggttgcggctgtgcaggtgggcgagtgcctccagggcctcgatgccgtacgcgcacgcctgctccaccggcagcgggtcgcgtctgccgtccgcggcgcggcgggcgttggcgatctccttgagcgacttgccgccgacgtactccatgacgatgtagccgtcgagggagccggtgcgctggtcgaggtgctccacgaagttgtagatccgcacgatgttggcgtgctcgatctccgcgaggaagcgccgctcggagatcgccgccgccatcgcgtcctggtcgccggtgtccagcaggcccttgaggaccacccaccggtcggacacggcccggtccacggccaggtagatccagcccagaccgccgtgcgccaggcagcccacgacctcgtactgcccgtgcaccacgtccccggccttcagcttgggcacgaaggagtacgggtggccgcacttggtgcagaagccctccgtacggcccggacgctcaccgcgggcccggcccaccggagcaccgcagtccgaacgcgagcagaaccgcttgcgctcgggcacctccgggttgtccagcaccatcgagcgcgggtccggccgcggcacctgcggcacctgcaccagaccggcccccagccggctgcggcccgaggaacccgcggccgaaccggaaccgcgcaccgacaccgagcggtcggtggaccggcccgacagggaacgcgacagccgcccggacaccgaccggcgcgacctcgacgactgcgacgacgtgcccgcgccgcggccaccgcgcgcactggacggcgaactcccgctgcccgccgagccgttgccgccgcccgcgaccccggtgggcgccgaggcgaccatgccggtcaccgacaccaccggggccagaccgcatgtgtcgcagtacagctcgccgccgcccacgtcctcgtacgcgccgccgcagtccggccgctgacaggtctgtcccgcccggctcatgactcccccctgccgtcgtcgtcccgagggccgccctggcgcggcacccgcgccgcgctgagcagttcggccgccgcccgctggtagcgcagcacggcctgttcggccacccgcaggtcgcagggcgcgctccacagcatgcggcgggccgcgtcgtaccgctcgaccagcagcgggtcctccgccagcccgttccgggcgaccttcgccttgtacgcgtccagccggccgcgcagctcggcgcggaccgccagcggtgcggtgaccgccgtcaacgactcgcgtgcccgcagcagttcgtcctccgccttctgctccagggcctccaggagcggggagaggcggtgccactgggcctgcctgcggtactcggcggccgtcgccagctgctcctgcagcgcggtcggcgggccgctgaccaccggcacctcggtggcggcgatcttcgccagcacctcaccgcgcgcggtgcgcgcctcggcgagggtgcggtccgcgcgggagagcacgtcccgcagccggatcagccgctgttcggcgtcctgccgcacgccgagcacggcgtcgatctcccggcgcacctcctccagcgcgcgcgcctcccggtcgtacaccgtggtgtccggccggccgccgcccggcgccgcactgccctgcgcgggcacccagtgggcgagcgggtcgctgaccacctgctcgcgcaggtcggtgagggtgcgggtgatgcgttccaggtcgtcgcccgccgggtgttcgccgggacggacgccgaccgagtgcgcgaggcggcgggtgcgctgcagttcggcggcgagcaggtcgatccgggcgggaagcgccgaccacaccgcgtcggcggcgacgaccatgtccaggctgcgcgcgtacagctcgttcatccggtccaccagcgcggccagcgagaagcgctcgctgagcctgccgggaccggtcatcgcggcggcgtcggcggcggacccggcgatcgtgacggactcgccgcgcagcagctccgtcagctccaccaggtcctcgcggctggaccagcggcgccgggaacggatctcacgggcggtgcgcaacgcggccgtgtaggcgtcgaagtacgcccacagcagcgttatcgacgcctccgtcgccgcccagcgctcctgggtgacgccggtgagccgggcgccttcgaggagtctgcggcccgcgtggtcctgcagggcgaggagcgaggtctcgatcgcctcgtgctccgcgccgagccgcgccagcgcacggtccacctcgtcccggtccagcaccggcccggcggggtccgcggcgcccatcgatcacctctcgctgctcttcgtgttccgtcggtcgtacgccggtcggtggcgtccttcggtcatcgcccgtgcgggcgccgggagccggtcaccggtagccggacgtcggcggagtcgccgactccgaatccttacccagcgtgggggacagccagtggtcgtacgcctgcttccagcccccgtccttgcggtagttctccagtatccggttgacctgacgtaccagatcgtcggcgccgcgcttcatcgccacgccgtagtactccttggtgaaggtgccgcccttcagctccaccgtcgggtcctgcgcggcctggctcgcggcgagggcgccgtcggtcaccaccgcgtccacctcgttcagttgcagccgcaccaggcagtccagctggttggggacggtggtggagatgtcggtggaggcgggcagggcgccggtcctcttgtcggcggccaggtggtcgtaggcggtcgaaccggtcgcggagcagaccttcttgccggcgagcgacttgtcgtagccggtgatcgccgacgtgcgcggcgcgaggacctgctggccggtcaggaagtacggggcggagaaggccactttctccaggcgcttgcaggtgatggtcatcgtgcggaccaccatgtcgacccggccggtgtcgaccgcgtgctcgcgctcgttggtgggaatggcccggaacgtgatcttccccgcgtcgccgaggagttccttggcgatgcggtgggcgagggcgatgtcgaagccgtccaggtcgtcggaggtgtcgttcgggttgcggtagccccagccgtagctgttctggtcgacgccgaccacgagggtgccgcgcttcctgatcgcgctgacggcggggccgtccgtgtccgccggcggcaggctgcggttctgcacgtcgctgtcctggcagtcgccggacctggcctgcacgccctgggcggtccgcgcggtgccggcggccaccggggtgcggc

SEQ ID NO: 622 - DNA, 2150 bp, Unknown
  Kingdom: Bacteria, Phylum: Actinobacteria, Class: Actinobacteria, Order: Streptomycetales, Family: Streptomycetaceae, Genus: Streptomyces
cgggtgggggaccggcggtcgccgaccgccggtcccccacccgtcacccgtgcctacagggccccgaagcccaccttgcgcggggcggcctcgcccagctcgacgtacgcgaggcgctcggccgggaccagcaccttgcggccgtgctcgtccacgagggtcagcagcggcgacttgccggccagtgcctcggccaccgcccgctcgacctcctcggggctctgaccgctctccagaacgatctcgcggggcgcgtgctgcacgccgatcttgacctccacggctatgtccctccgacggtcagtgaagtgcgcgaccttccgcgccgtacccagcacacattagcccggtgaggggacggacacgctccgccggggcacgccaggagcgaacagcggacgggaacaaacgaccaccccgtccgtgggggcgcccgttcgtcagtggtgctggtcgatgccgtgcagcgggaagcccgcgatgccgcgccaggccagggaggtcagcagctggaccgcctggtcgcgcgggacgctgcggtcgctgtgcagccacgagcgggccaccacctgcgcgaggccgccgagacccgaggcgagcagcatcgattccgcgcgcgagagaccggtgtcctcggcgatgacgtcgcagatcgcctcggcgcactcgttcgtgaccttgtccacgcgctcgcgcacggcgggctcgttcgtcaggtccgactcgaagaccagccggaacgcgccgccgtcgtcctcgacgtacgcgaaataggcgtccatcgtggcccgcacgcgctgcttgttgtcggtcgtcgaggccagcgcgctgcgcacggactggatgagcgcctcgcagtgctggtcgaggagcgccaggtagaggtcgagcttgcccgggaagtgctggtagagcaccggcttgctgacgccggcgcgctcagcgatgtcgtccatggcggcggcgtggtagccctgcgccacgaagacttcctgggcggcgcccagcagctggttccgccgggcacggcgcggcagtcgcgtgcctcgcgggcgcgctgcctctgtctgctcgatggctgtcacgccgcctcccaatgtcgtcctgtgcggtgtgcgccgcgccgccatcgtacttttcggtaaccgtcctgtgcgcggtgcgagcgcagaatttcactgaccggacggggaagaaaccggcacagaaggtttccaacgggtcgagtccgggcatagggcatcgccgctgctgctcagcggtggtccggcaccgtcaccggtagtcgtcctcgtcgtgggacacgacccgtgcctgctcggcgagatccgcttcgttcgcgcgggcggggtccgcgcccgtcaaggggtcgtcgtgttccggtgcgatgtcggcctgctgctcggcggcgtcgtcctcgggggcctcgacgtcgatctccgtgccgttctcggtggcctcgtcctcgaacgtctcgggatcggtggggtcgaatgccatgctgggctcccttcctgtgaacgtccctgcgaatgtccgtgtgtccctggaagaagcaggggctccatgcgggtgccctctgtacgagcgtaggagacacacgatccggatgccatgcggtgcgcgaggggtctgtgcccggcgtgcgtggtgggaatgtccgtgccgggcgtgcgtggcgggaacgtgtgtgcccggcggggctctcgcaggtcgctgtgacggcgaacacatgaatcgcgacgtgatcgtctcgtaacattgccgcatgtcttcgaccgagctgcccgccgtgccgcccgccaacgtacttcccagggtggggcccgtcggtgtcgaagagggagagcggctgcgctcggtcgaactgccgggaatcacgctgacggtgcgctccaggccacccgcgcgggaggacctgccgcgcgcgctgtacgtccacgggctcggcggttcctcgcagaactggtcggcgctgatggcactcctcgacggtgacgtcgacggcgaggcgctcgacctgcccggcttcggcgactccccgcccccggacgacggcaactactcggtcaccgcccacgcgcgcgcggtgatccgctacctggacgcctcgggcggcggcccggtccacctcctgggcaactcgctgg

SEQ ID NO: 623 - DNA, 1162 bp, Unknown
  Kingdom: Bacteria, Phylum: Actinobacteria, Class: Actinobacteria, Order: Streptomycetales, Family: Streptomycetaceae, Genus: Streptomyces
tcggactcctcgcgggggcggccggggtcggcgccggggaagacccggacggacgcggcgcccacgtcgtgcgccagttgcagcagcccgcggatctcgtccaggacgggacggtcgtcgccgggcgcggcgacgcgcgcgtacccggccaggcccaccaccgcgaccccggccgcttcgaacagggcggccgtctcagcccgttcggcgggggagaggccggggtgcaccggttcctcggggtgcgcgcgcagttcgacgccgtggtagccgtgcgcggtcgcgagcgccaggacctccgggatcggcaggccggggacaccgagagtggagaacgcgagcttcatgggccggaccctacccgccgcccgcccggaccacgcggaaccgcccgttgtctactcctgcccggcgggccggaacacgttgagctgcgccccggtcttcgccgtccgggacgacaccagctgccacgtccgcttcaccccgtccgtcgggaagaccgacttgccgccgccgaggagcaccggcatgacggccagccgcagctcgtccaccaggtccgcggccagcagcgcccgcaccagcgtggggctgcccatcatcgccaggtcgccgctgccggacgcccgcagttcgcgtaccttcgcgagcgcgtcggcgccgggcacgcgcacggtgttctcccaggtcagcgcggactcgtcgagggtgtccgaaacgacgtacttgggcagcgagttgagccggtcggcgaaggggtcaccggcccgctcgggccaggccgcggccatcgtcaggtaggtgcggcggccgtagagcagcgcctcggcctgctccaggcccgccgcgaacgctccgccgagcacctccgggtcgaagaaggggtgcgaccagccgccgtgcgcgaagccgccgtcggtgtcctcctggggaccgccgggcgcctgcacgactccgtcgaggctgatgaactcggtgacgacgacacgcatggtgatgccttccgtttcctggctgatcggtacgggagggaagaccgcggccggctcccgaactcatcggtgcgcgcccgggatcctggatcagaaacccgagtccgtacctgaaccgaaccgtacgacaccacccccggcgcaccccccgaagccccggccgcccg

SEQ ID NO: 624 - DNA, 3531 bp, Unknown
  Kingdom: Bacteria, Phylum: Actinobacteria, Class: Actinobacteria, Order: Streptomycetales, Family: Streptomycetaceae, Genus: Streptomyces
cggggcgagcagcgtgcgcaggtcgacgggttcgccgtcccgctccccgccgtgcccgtcgtgcccgtcgtactcgtcgtgccggtcgtactcgtcgtactcctccacgacccggacgagcgcgccgtccgccgcgctctcggacacgcgggagacgggcagcaggccgccggagaccagggtgcgcagcgccacctcctgctcacccgccatccggcccagctccgccgcctcgccgccgatgaccgcgccgcgccgctgcaccatggcgagcacctggagcacgctgtcgtggatgtcgcgggccagccgctcgcgttccctggtcgccgcctcgatctccagggcgcgggccagggtgcgctcggaggcgcgggccacctcgacgacgtagccgatggcgatggaggcgacccagaccagcatcacgttgtgcacggtgtcgcgggccggggtgccgcgctcgacgaggttggcgagggcgacggcggtggaggccacggcggcccagcgccagccgcccttgacggcgaaggcgaggacggaaccggccgtccatatcgacggcagcgtcgggccgccgtccacgatccgcgcgtgcgcgtcggcgagcggggtgagcaggatgccgcccacggccagcgccaggtcggcggtgaggaagcgcttggtgcagtgcgcggcgctcgcgacccggggcagggtggccagggtccacacgaacagcacgcagtagtacgcgatggcgacccccgggcgggggaaacggctgtaggcggtggcgaacaggccgatggcgtagaacagggtgagtacgcggtaggcggcgagcgcgcgccacagcggctgctcgaccgacatcctcatgacgcgctcgcgcctggccatgtccccccggtcccccgttcctgccccgtgccgccgccccggcagccgcgccccggcgtgctactgcgcgcccgtctcccgctcggcgcggtcgggggtgttgcccgctccgtcctcggctccgtctccgtccccggctccgggctcgccctgcgcggcggcggcctgcgcggcctgctccgcctctttctccgccttctcggctgccttctccgccttctcggccttctcggcctttccggcttccttctccgcttccttctcggccttcgccgcctccgcgatctgccgcttggccgcggtcgcgtagatgtcgacgtactcctggccggagagcttcatgatctcgtacatgacctcgtcggtcacggcgcgcagcacgaagcggtcgtgctccatgccctggtagcggctgaagtcgagcggcttgccgatccggatgcccgggcgcatcagcttggggacgaccttcccgggcggctggatcttctccgtgtcgatcatggcgaccgggatgaccggtgcgccggtggccagcgccacgcgggccaggccgcccggcttgccgcggtagaggcggccgtcgggcgagcgggtgccctcggggtagatgccgaacagctcgccacgctccagcacctctatgccgctcttcaccgccgcctcgcccgcgccgcgcgcgccggagcggtccacggggagctggccgacgcccttgaagaaggcggcggtcagccggcccttcacgccgggcgtggtgaagtactcggccttggcgatgaacgtgaccttgcggtcgagcaccgcgggcaggaagaacgagtccgagaacgagaggtggttgctggccagaatggcggggccctcggccggaatgttctccacgccctccacccagggcctgaaggcgagcttcagcggccccccgatggcgaccttcatcgtgccgtagaacaaccgactgcctcccgtgtgtgtcgctcagaccataacccggggcgacgcggaaggcgcctacggccctggtcggtgtcagtgccgtcgcgtacggtgaagtacctgcgatcggcggccgtgtgccgcaggcgcaccaccctgccccgcgcacccctgtcatccgacgtgcccagcccacttcacgaacaggagaccgacgtgccggtcctccccggagccgagccgttccgccacgagggcggcgaggtcggcgtcctcctctgccacggcttcaccggttccccccagtcgctgcgcccctgggccgatcacctggccgagcacggcctgacggtctcgctgccgctgctgcccggacacggcacgcgctgggaggacatgcaggtcaccggctggcaggactggtacgcggaggtggaccgcgagctgcgcgcgctgagcgagcgatgcgcgcaggtgttcgtggccgggctgtccatgggcggcgcgctggcgctgcggctggcggccaagcacggggacgcggtcgccggggtcgtggtggtcaacccggccaacaaggtgcacggtctgtccgcgtacgcgctgcccgtggcccggcacctggtgcgcacgacgaaggggatcgccagcgacatcgcgaaggaggacggcgcggaactgggctacgaccgggtaccgctgcactccgcgcactcgctgcggaccttcttccggctggtggacggcgagctggcgcaggtcacgcagccgctgctgctcctgcgcagcccgcaggaccacgtggtgcccccggccgactcggcgcggatcctcagccgggtctcctccgtggacgtcacggaggtcctgctggaacacagctaccacgtcgcgacgttggaccacgacgcggaccggatcttcgaggagagcctcgccttcatcggccggatcgcacccagtgtcggcaaggaagggacggccgcaggtggctgagcacgactccgaccgcgagggccgcgagcaccgtgaaccagcggtcgatccggcgcggcccgccgagccggcacggccgggggacgcggtgcggccgagcgagtccgggaagccggtggacccggtggacgcgatggagccggtggacgcggtgaagcccgcggggtcggtggagccggtgcgggccggggatccggcgcagccggacgaacctcggaagccggtggacgcggtggagcccgcccggtcggccgagccggtgcggcccggggatccggcgggggccgaggagcggatgcgggccgtcgagccggttcggcctggcgagcccggcgaggccgttgaggtcgccggttccggggatgcggggggttccggcggggctgagagttcccgtggggccgaggattccggtgagggcgctggtgcgctcgatgaggaggcggcgtgggccgctatcgtcgccgggtacgggcaggagccgccggatccgccgggggccaggcccttcaggcccatcgaggacctgctgctgccggaaccaccggacgcggacgaagccgagggcggcgaggccggcccggccaagccgctgggcagctccgtctccttcgcgccgggcctcgcggcacccggtgcgggcccgcgcgacttcacgccgggtgggccgtccgacgacgacttcgacgcggacgacgagggtcactt

SEQ ID NO: 625 - DNA, 3525 bp, Unknown
  Kingdom: Bacteria, Phylum: Actinobacteria, Class: Actinobacteria, Order: Streptomycetales, Family: Streptomycetaceae, Genus: Streptomyces
gcggcgggctgtcggtgcgctgcaccggcggccggtgggcgatggtctccgcgaccgccacgctgaggggcggaaccgccccgggctgcggctgcggctcggtactcgatgtgctcatgcgcctcaaccgtcccctcgaccggcgcgtacggaagcatcgtgccaccaggagtggccggtatgtgaccgagtgcccccgatcagccccggatggggggttaggaagcataaagaagcacgatatgcacgtcggtccggggcgtccgtccgggcgtcgacgggacgtcggtccggacgtcgagccggacgtcgagccgggggggggggacacccgatcggcgcacggcatccgcccggcatcatggtgggcatgcgtgcagtggtgcagagagtggacggcgcgagcgtcgtcgtggacggcgagacggtgggggccatcgagggcgaggggctgtgcgtcctcgtcggggtcacccacgaggacaccaaggagaaggcggcccagctcgcccgcaaactgtggtcgatccgcatgctgcaggacgagaagtcgtgcagcgacacgaacgccccgctcctggtgatcagccagttcacgctctacggcgacgcccgcaagggccgccgccccacctggaacgccgccgcccccggggacgtcgccgaaccgctcgtggacgaggtggtcgcccagctgcgctccctgggcgcgacggtggcgacgggccggttcggcgcgaagatgcgggtatcgctgacgaacgacggcccgttcaccgtcctgctggagatgtgagcggtccccgccccggggactacggctctacgacgacctcctgcgccgccgccgtgtcccccgccatcagccgggcgtccagcggcacgttccgcttgaccagggcgagggcgaccgggcccagttcgtggtggcgtacggaggtggtgatgacgccgatgcggcggccgtccgggccctcgtcggcgaggcggatctccgtgccgtgcgccggcaggtgcacctcgctgccgtccaggtgcaggaagaccaggcggcgcggcggcttgccgaggttctggacgcgggccacggtctcctgaccgcggtagcagcccttctggaggtgtacggccgtgccgatccagcccagctcgtgcgggatggtgcggtggtcggtctcgaagccgagccggggccggtgctgctcgacgcgcagcgcctcgtgggcgaggatcccggcgggcgggccgccctgcgccgcgtacgactccaggtcggcgcggggcaggaacagatcacggccgtacgccgtctcgcggacgacgacgccctcgggtgcctcggcgatcgaaccggccggcaggtgcaccacggcgaagtcggcggtgcggtcggcgacctcgacccggtagaagaacttcatcgactccaggtaggcgatcagcgcctcctgggtgtcgggctccacgtgggcccagaccgtctcgccgtcgtcgaccaggtagagcgcgtgttcgatgtggccgtgcgcggagaggatcagcgcctcggtggcccggccggccggcaggtcgctgacgtgctgggtgagcagcaggtgcagccagctcagccggtcctcgccggtgacggtgacgacgccgcggtgcgacaggtcgacgaagccggtgccgtccgcgagcgcgcgctgctcgcggaacaggtcgccgtagtgtgcggcgacgccttcgtccacgccctcggcggggacggcgccgggcagcgacagcagggggctcttcatacgggcaagcctacgacgtgcccgccggccccttctgggaacagtccctgcaacggccgaagatcgcgaagtgcttcatgtcggtgtcgaacccgaactgccggcgcagcttgtccgtgaactccgcggccacctcgacgtcggcctcgatgacgttgtcgcagtcgcggcagacgaggtggaggtggtggtggcggtcggccaggtggtaggtgggggcgccgtggccgaggtgggcgtggctgaccaggcccagctcctccagcagctccagcgtccggtagacggtggagatgttgacccccgacgccgtcttcctcacttcgccgaggatgtcgtcgggggtcgcgtgctccagggtgtccacggcttcgagcacgagttgacgctgcggcgtcagccggtagccgcgctgcctgaggtcgctcttccagtcggtgctcaccacaccgaagagtctaggccgcccaggggcgccggggactactcgaagaccgcctgggacggcgctatgacgcccccgggactgctcgaagacggcccgggactacttgaagaaggcgatgccgtcgtcgggcaggtcgtccgggagggccttggcccagcgctcgacctcctccggggtgacggccttcttcaggtgcgccgacatgtaggggcgcagctcgacctcgggggtctgcttctcgccgacccacatcaggtcgctcttgacgtagccgtacagccgcttgccgccggtgtagggggcggaggcggcggtgcgggccacggcgtccgtggccaggtcgatctgcggcttcttgtcggccagctcgccgtaccagacctcgatgacgccgtcgtcgcgcgtcatcgtgacctcgaccttgcgggcgtcgtcgatccgccagaagccggactcggactccagcggccgtaccttgttgccgtcgttgtccagcacccaggtgtgcgagtggtactccaggaagtcccggccgtcgtgggtgaagctgacctcctggccgaagttgcacttctccgacccggggaagtcgtgcacgccggcaccggcccagtcgccgagcaggaaggccagggggaccaggtccttgtggaggtcgggcgggatctcgatcatgagcggtggctcccggacgtcgtcagcgctggccctggtacagcttcttcacggtcaggtaggcgaaggcgaggacgccgacgcagaccaggaccagcagggtttcgaagaagatctccacggggtgctccttgtcgagcgcggtgcggtacgtaggtacacagggccgggccccagcttagtcggcccgggcccggccctcttggcgaggtactccctcacccgttcagccgagcagttcgctctgcagcgtcaccgtctgctggaagggaacggcggccgccgagcccttgcgggactgcacgaccagggcgaggacgtcacccgcgcggaggtaggcctggcggacctgttcggtgccgtagggctcggcctcggtgtagaggtaccgctccatgccgcgtacccgcgccgcggcggggaagccctggtccgtgacggaggtgtccgccccgcgcaccggatacttcggtcccccgtacgccgccagctccgagcggacctcgtcggcggcgaccgcggtgtcgaactggagcaggtagatccgtgtgcgggtgccgtccgacgtggtccagccgcgggccgcgatgtgccgcagccccagcgcggtcagctcggcgc

SEQ ID NO: 626 - DNA, 7841 bp, Unknown
  Kingdom: Bacteria, Phylum: Actinobacteria, Class: Actinobacteria, Order: Streptomycetales, Family: Streptomycetaceae, Genus: Streptomyces
cccggcggcgatctcccgcagcaggtccatcaccgctcgggcgcgggcggtctggcccacaccgccgagcgtggcgatcttgacttctagggcggggccgccgtcccggagctggagttccgcgacctcgccgccgccgtaggtctggctggtcgcgggccgctggttgagcacggagtagccgagtccgcgggccaccagggagcgtacggtctcgtagctctgggtgcggtagcggacgtcgggggcggtgccggtggcggcgaccagtgagcggaagtagtcgcggctgtgggggaggtcgaggaggacgaggggttcggcggacagttcggccagctccacgctgccctgaccggccagcgggtggccggtggcgacgatgacgtaggccggggcacgggcgatcgtctcgctgtgcagctccggatcggcggacaggccgaggccgtaggtgagggcgaagtcgatgcgtccggacgccagggcctcgatgagctggtccgtctccgcctccaccacctcgatctcgatgcccggatggcgccgggtgcactcgctgaacaggggcggcaggtaagagggggcgagagtgacgaaacagccgacggcgacgggcccggagagggtctcgccgtctccccgggcctcccgttcgatctcgcgggcgcgggccagcaggtcccgcgcctgctgctggagccgctccccggcgggggtgagggtgagcccccggccccgccggcggatgaacagctgcacctgcaggtcacgctccaggttgtagacggcggtggagacggcggactgcgcgatgtgcagctgtgccgaggcctccgtcatcgacccgcgttcggccgccaccaggaagtagcggagctgaacgagcgtgaaacccactggtgccgtcatacgtgacccttgcgcctggtgaccggtgtcggtgccgaccctatgcggcactgtccaccggggtctcgccggccgccgccccggacacgtcctcggggtgcagcagcgcgcagccggcggtctcccgcagagtcagggcggcgatgagaccggcgagggcgaacaccatcaggtacgggccgggcaccagggtggagccggtcgcggagatgagcacggtcatcaggtacggcacggtgccggcgaacagggcggcggtgatgttgtacgagatggacaggccgctctgccgggtgcgggtggggaaggcctccgccgaccacaccgcgtacgtgccgaggatcgccgccaggatcacgccgagcagcagaccggcgacccaggtcccggcgagcccggtccgcatcagcaggaaggccggggtggagaagaccagcagggccgccgtcgccccgatgaacaccggcttgcgccccacccggtcggacagcatgccgaacagcggcacgagcgcgagacccagcagcgagatcaccgtcgacagcagggcggcgctgtcggccgagtggcccaggtggtccgtctcgtaggtgaccaggtaggtcagcacggcgtagaagggcacgtgcatggccgccatcaggcccgccgcctgcaggagctgccgcttgtgcgagcgcagcagctcgcgcacggggctgcgcgggacggagtcgccggcctccagcatccggaactgcggggtgtcctcgatcttgctgcggatgatgaagccgatgacgcccagcggcgcggagacgaggaaggggatgcgccagccccaggaggtcagctggttctcgctgagtccggcggacagcagcaggaagacgaacgagccggcgaggaagcccagcagggagccggcctccagccagctcaccccgaatccgcggcggcgccggggcgcgctctcggcgaggaagctcgccgcgctgccgaactcgccgcccgcggcgaagccctgcaccagccgcaggaccagcatgagtatcggcgcggcgatcccgatcgaggcgtagccgggcagcaggccgatcgtcagggtcgcgccggacatcaggaagatgaccagcgacagggtgcgcttgcggccgatccggtcgccgagcggcccgaacaccagggcaccgatgggccggatgccgaacgacaccgcgaacacgccgaacacggcgagcagcccggtcgtacggttctgggacgggaagaacacggtcgcgacggtgccggcgagataggcgtacgccgcccagtcgaaccagtgaacgaacacgccgacggcacccgcgatgacgctcctgcgcagtgcgaccacgtcggtgcctgcctcgacgtcggtcctcgtgtccgccctgtcatgcgtgtcggcgctgttgtaggtgcgcatgcgcgcctccttgggggatgggtggagaagcggtggctgtgcgggtgctgccgacgccgtgcccttcagggcaccggcaggccggtgagggaggcggggctggtcagctcgcgcagctccgcctcggtcagcagctcgcgctcgcgcacaaggtcgagcgcgggtctgccggtgtggtgggcctccagcgcgagggcgcaggcggtctcgtagccgagtgcgggactgagcgcggtgaccagcccgacggaggccgccacggtccgtgccagccggtcgcggttggcggtgatgccgcggacgcagtgttcggtgaggacggtgatcccggcggtgaggtgggcgaggccggcgctcaggctgcggaacacgatcggttcgaaggcgttgagctggagctgtccgccctcggcggcgagggtgacggtcacgtcgttgccgatgacctcgaacgcgatctggttgaccgcctccgggatcaccgggttgaccttgccgggcatgatcgacgaaccggcctgccgcgcgggcaggttgatctcgccgaacccggcctgcggccccgaggacagcagccgcaggtcgttgcagatcttggacagcttcaccgcgatgcgcttgagcacgccggacaactggacgaagacaccgacgtcctgcgtggcctcgatgaggtcgggcgcggacaccagcgtcgggatccccgtcagccggcgcaggtgctccatcgcgcgttcgcggtagcccggacgggcgttgaggccggtgccgatcgccgtaccgccgaggttcagctcgtgcagcagcaccctggcctcggcgagccgctgctcgtcctcggcgagggtggcggcgaacgccccgaactcctggcccagcgtcatcggtacggcgtcctgcaactgcgtgcggcccatcttcagcacgtcggcgaactcggcgcccttggcggcgaacgcctcgcgcaggcaggccagggcggcgagcagctcggcgatgtgcgcgtccagcgccagtttcaccgcggtcggatagacgtcgttggtgctctgaccgaggttgacgtggtccagcgggtgcaggatcgcgtaccggccccggccgtgaccgagcagttccagggcgcggttggcgatcacctcgttggcgttcatgttggtcgaggtgcccgcgccgccctggatgaggtcgaccacgaactcctcccgcagtgcgcccttccgcagctcggcgcaggcgtccgcgatcgccgaggcgagggtggagtccagggcgccgacctccgcgttggcgagggccgctgcgtgcttcaccgcggccagggcgccgatcaggtgcgggcgggcggccacggtctccccggtgagcgggaagttggccaccgcccggacggtgtgcacaccgtagtaggcgtccgccggcacgtcgacgtcaccgagcatgtcgtgctcggtgcggtacgtgtccgtgtccgtgtctgcgtctgtgccgccgagcatgtcgcgctcggtgcggtacctgtccgttcccgtcatgccaccgctccttcgtccgccgtgctgcggtccacgccggtccacgccagcgcgatcgcgccgtcgagcagggcccgctgcgccgtcccgcccacgcagtacgcggcgaactcgtgctggtggttggtggcgggcagggagccgatgccgatgtagggatggatggccggcaccacctgcgagacgttgcccatgtcggtggaggcgcggttcatgcgcgcggcctggccgggcggcgcgaactcccgtcccaggccgagggcgttggcgcggtagtgcgcgagggcggactcgtccgtgcggaactcggcgtacggcttgctctccggctcgatctccagctcgcagccggtggcgagggcgccggcctcgaaggcccgcatcacccgcggttccagctcggccagttcggcgagggtctccgcgcggacgtaccaccggccgctcgtccgctccgggatggcgttcggcgcgtcaccggcgtgggtcaccaccccgtgcaccctggccgacggcggcagttgctggcgcagcaggccgatggcgacctgggccacggtgaacgcgtcggccgcgttgaccccggcctcggggtacgccgccgcgtgcgcggacttcccggtgtacgagatcctggagtggctgaccgcgaacgggcgggcctcggcgacgtcgaccggcgccgggtgcaccatcatcgcgaggtccactccggcgaaggcgccccgctccagcatctcgatcttgccgccgccgccctcctcggccggggtgccgtagacctcgacggtgagaccggcctcgtccgcgacggcggccaggccgagcgcggcgcccacggcactcgccgcgatgaggttgtgcccgcacgcgtggccgaggccgggcagcgcgtcgtactcggcgcacagcgcgatccgcacgggcccgctgccgaaccgggccaggaacgccgtctccaggcccaggtaggacgaggtgacgtcgaacccggcacggtcgagcagttccggcacggccgcggcggcccggtgttcctcccaggcggtctccggatcggcgtgcagccgctcggacagggcgatcagcgcatcggcgcgccggtcgaccgcctgccgggccgcccgcttcagcgcgcccgtcgcggagtcctctcgcggcgcgcccttcacggactgctctcctcgcgcgcccatcacaggtcgcccgggacgccgtaggagggcgcggaggcggggtcgagtccgcgccgcacgtagtcgtcccgctgcggcagccagatgtcgaggagttcgccgagccggtccgcgggctcctcggcccagtcgacccgcaggtcggtcacccgccagtccacgtccgcgacgaccgcgaggcccgcggagtgcaccggcccctcctcgccgccggccgcgacggcggccttcagcgcggtgaccaggcgttcctccagctccccggtcgccgccgcgtacgcgtcgagcaggacaccgggtatgtgctcgccggagagcatgttgccggccgccaccgcaccgtccgcggtggccgaggcgtacgtgccgagcgtgcgcgcaccgctgtaggcgaagccgggaccggagcggcccagcacggtcagctgccggtactcgatggtcttcgcgttgtgcgcggcgccggtgacgtcggccagggcgcgttcggcgtcgccgtggtccgcgagcccgtccagcaggcccgtaccgagcgtggggtcggtgatgttctgcgaggtcgccgcgccgacgccgggccgcagatgggtgacgcgggcggcgaccgccggggacgacgagctggccacgatgccgaaccgttcgccgtcgcgtaccaccagggacatggtcatgcccggtcctcctcggggatcacggcgatcgcgtcgatctcgcacagccactccgggcgggcgagggcggagaccaccaggccggtggagatggggtgcacgcccttggtccagcggcccacggtgcggtacaccgcctcgcggtagcgcgggtcgatgaggtagatggtcagcttgaccaggtgctccatgcggctgcccgcttcttcgagcagcatcttgatgttggccatcgcctgctcggcctgggcctcggcgtcgccgatgccgaccgactcgctggtgtcgaggtcctggccgatctggccccggacgtacaccgtgttgccggcgacgacggcctggcacaggtcgttgtcgaggctctgctcgggatacgtgtcacgtgtgttgaacggacggatccgggtgtgtccgccggcgacgatcgggtccttcgtccggcggctctcgctcgtggacgtcatcagctgctcctcagttgttctggatcgccggcgcgatgccgggccggtcggtggtgccgtacgcgaggtagccccgctgggtgacgatgtggtcggcgacatacctggcgtcgtgccacacaccccagatgaagctcgaccctcggcgggacagccagggcaggcccaggaagtagacaccgggctccgaggagactccccgccggtggtccggccggcccctctcgtcgaacgcgtcggcctcgagccagctgtagtcggtggcgaagcccgtcgcccacacgatcgaggtgacaccggccgcggccaggtcgagttccaggagagggtcgctcacgcggtccgggtccggtccgaggacatgtgcctccggctcctcggggaggtcgagcccgttgcgctcgacgtacgcgtcggccgccttgaggaacgcgaggtacttctcgtcgccgagcgcgatgttcgtgccgaggtcgggcgcgaagcgcaggacgccgtcgtcgtacgacgcggtcatgccgaccagctcgataccggcggaggccagggcacggaagtccacggtgtggccgccgcgggcgccgctgaccgcgatcgtgacgtgttcggcaccctggggcggcgtctgcgcgtcccagatcccgagcaccccgagccaccagcagaagtcacgtccgcggtactgccggggcggacggtcgtgcgggccgacggagaggaagacccggcgaccggaccggcgcagctcgtcggcgatctgcacccccgaggagccggccccgaccaccaggaccgcaccctcgggcagctgctggggattgcggtacccgctggagtggatctgcacgggaacggcgccgtcggggacgatgggcgggatcacgggccgctggaaggggccggtcgccgcgacgacgaaacgcgcgtcgatcgtgtccccgtccgacgtctcgacccggaagccgggccggccggcccgcttgcgcaccgaggtgacctcgacaccgcaccggaccggggcgccgatcttctcggcgtacgccacgaggtagtccgcgacctgctccttcgaggcgaaaccgtcggggtcgacgtcggagaactccagccccgggaaccggtcgtgccaggcgggcccgttcgcgaccagggagtcccaccgctcggaacgccagcgctcggcgatacggtgccgctcgagcacgatgtgcggtatgccgtgcgcacccaggtgctcactcaccgcgacgcctgcctgccccgctccgacgacgactacttcagtttcttcactgggcacttcagcctccactcaggcggtagtccatcggcggtgtcgcattgactgctaccgcacgagacatccttgagcgggacggaaaacctgtccaacagatgtttccgttgcaggtgatctgatttattgatccagctagggagccgcacggtctcgtgtccggctgcggcttccctgccgccgtcatcgacgcgcacggtcacggcgaccggccgcgcaccgcgcacggcgagcaggggatcgcggacctgcgcaaggcgcaggcggcgggcgagcgggaaggcccgatcgccgtccgctgcaacgcccgcctggccgagcaggccccggc

SEQ ID NO: 627 - DNA, 1146 bp, Unknown
  Kingdom: Bacteria, Phylum: Actinobacteria, Class: Actinobacteria, Order: Streptomycetales, Family: Streptomycetaceae, Genus: Streptomyces
ggaggagagccggcgtgagcttgaggatcgttgtcactgtgaagtacgtgcccgacgccactggcgaccggcacttcgccgatgacctgaccgtcgaccgggatgacgtggacggtctgctctccgagctggacgagtacgcggtggagcaggcgctgcagatcgccgaggacgcggacgacgccgaggtgaccgtgctgacggtgggtccggaggacgcgaaggacgcgctgcgcaaggcgctgtcgatgggcgcggacaaggccatccacgtggaggacgacgacctgcacggcacggacgcgatcggtacctcgctggtgctggccaaggcggtcgagaaggcgggctacgacctggtgatctccggtatggcctccaccgacggcacgatgggcgtcgtaccggccctgctcgccgagcgccttggggtgccgcaggtgacgctgctgtcggaggtctccgtcgaggacggggtcgtgaagggccgccgcgacggtgacaccgcctcggagcagcttcaggcgtcgctgccggcggtggtgtcggtgaccgaccagtcgggcgaggcgcgttacccgtccttcaaggggatcatggcggcgaagaagaagccggtggagtcctgggacctgtccgacctgggcatcgaggcggacgaggtcggtccggagggcgcgtacacggtggtggagtcggcggcggagcgtccggcgcgcacggcgggcacgatcgtcaaggacgagggcgagggcggcaggcagctcgccgagttcctcgcgggccagaagttcatctgagtccgcatccgctgttccgcccctcacacttcgcaagcaggagagaagaagtcccatggctgaagtcctcgtctacgtcgaccacgtggacggttccgtccgcaagcccaccctggagctgctgaccctggcccgccgtatcggcgagccggtcgccgtcgctctcggcaacggcgccgccgatacggcctcgaccctggccgagcacggcgcggtgaaggtcctcacgcacgacgcctccgagtacggcgagtacctggtggtgccgaaggtggacgcgctgcaggccgcggtcgcccaggtgtccccggccgccgtgctggtgccgtcctccgcggagggcaag

SEQ ID NO: 628 - DNA, 942 bp, Unknown
  Kingdom: Bacteria, Phylum: Actinobacteria, Class: Actinobacteria, Order: Streptomycetales, Family: Streptomycetaceae, Genus: Streptomyces
cgccgcccggcaccggtgtgatcagcgaggcacgctccaccgcggagtcgaagtccacgtccccgacgttgcccgcgttgtagcccgcgtcgatcacgaccgcgcccggcttgatgtcctcgccgcgcaccagccgcggccggcccaccgccgccacgacgatgtccgcctcgcaaaccaccgacgccagctcccgggtcctcgaatggcagtaggtcaccgtggcgtccctggccagcagcagcatccccaccggcttgccgaggatcgcgctgcgcccgaccaccaccgcccgcttcccggccggatcgacgtcgtaggcgtccagcagccgcaggatgccgccgggcgtgcaggagacgaaccccggcagcccgaagctcatcgtggcgaacgacgcgaaggtgacgccgtcgacgtccttctcgggcgcgatcgcctcgaacgcggcccgctcgtcgatgtggtcgccgacggggtgctggagcaggatgccgtggaccgacgggtccgcggacagcgtccgcagcgtgccgaccagttcctcggtgccggtcgtcgcgggcagttccacgtgccgggaagcgatgttcgccttgcggcaccggttctgcttcatcttcacgtaggtcacggaggcggggtcctcgccgaccagcaccgtcgccagacacgggcgggtgcccgtgcgggcggtgaggtcggcggccttgtgcgcggtctcctcgacgatgcgccgggcgagcgcggtgccgtccatgaggcgggcctgggacatgtccactcctgagcgtgcggcggatcgcccaggcgcgcggctgtgacttcggctgggaccgctccccggtggtgctccacctcagcgccagtcacggcccggccccagcctacgccaggggtgccggcgatccgcgccggggtgtgccgcgctcaccggcggcg

SEQ ID NO: 629 - DNA, 2537 bp, Unknown
  Kingdom: Bacteria, Phylum: Actinobacteria, Class: Actinobacteria, Order: Streptomycetales, Family: Streptomycetaceae, Genus: Streptomyces
ccagtgccgcctcgccccgctcgggccgggcggcctccaacgcgccgagggccaccaggccgctgcggaccagggcgaccgcctcgacgcaggaggcgccgccgggcaccggggaggccatggcctcgtccagcagggcgaagtcggcgtaaccgtgtccgaagcagagtccggtgacgcggtcgccgggccggaagcgggtgacgtccgcgccgacggccgtcacctcaccggcgacctccccgcccagcgggaccggttcggcggcctcggtgaccttgcggacgacgggcagggtgaccccgacggcttcgcaccgcacgaggacctctccggggcccggctggggcacgggcaccttctcgacgaacagcgggccaccggccgactcataccgcacgcggcgcatcgaacctccacagacaggagcgggacaggaaaggggcagaacgggacggaaaggggcaggatcgagccaggggttcagcgggatcgagccaggagttcattgggaaacccaacgattacaccgtacggtacggcttggccgttgggaagtccaacgtttttttcgctacgctgccgtcatgcccgaagccgaagcacccctcgccgagatccgttccctgcccagctggctcctcggccgggccgccgcccggggaagggctctggtcgccgacgcgctcgccgcggaggggctgaagatgtggcaccacgtggtgctctccgcggtccgcgacctcgcccccgtcgcccaggccgacctcggacgcggtgtggggctcgatcccaaggacctggtcggcgtcctgaacgacctccagtccgccggtcacgtcctgcgcgagcccgaccccaccgaccggcgcaagaacgcggtctcgctcaccgcccagggcgcccggctgctggcacgctgcgagcaggctgcccgggaggccaacgccacgctgctggcgccgctgtcgccacaggagcgcgacgccttcacggacctgctgacccgggtgtcgggcacccgggagtgaggggacgcgcgccgcgcgtacaccggggcgcgggtgccggggcggcacgacggggccccgcggccggccctgaaccgctggtcagccctgggccgccggggtcccaagggtgacgcgttcctcgcccgcgtaaatgttcatggaggcgccccgcaggaagcccaccagggtcaggccggtctccgcggccaggtccacggccagcgaggacggcgccgagaccgccgccaggaccgggatgcccgccatcacggccttctgcgcgagttcgaaggaggcccggccggagaccagcaggatcgtgcgggacagcggcaggtcgccgttctgcagggcgcggccgaccagtttgtcgaccgcgttgtgccggcccacgtcctcccgtatgtccagcagctcgccgtcctcggtgaacagggccgccgcgtgcagcccgccggtccggtcgaagacccgctgggcggcgcgcagccggtcgggcaggctcgtgaggaggccgggcgtgacgcgcaccggcggctcgtcggcgatcggccagcgggccgtcgtacggaccgcgtccaggctggccttgccgcacaggccgcaggaggaggtggtgtagacgttgcgttcgagggtgatgtcgggcaggacgacgtccggcgcggtcctcacgtccaccacgttgtacgtgttgactccgtccgtcgtcgcgcccgcgcagtagacgatgttcaccaggtccgacgccgcgcccagcgcgccctcgctgaccaggaagcccgcggccagcgcgaagtcgtcgcccggggtgcgcatggtgatggcgagctgcctgccgttgagccggatctccaggggctcctcggcgaccagcgtgtccgggcgggaggagaccgccccgtcccgtatgcggaggaccttgcgtcgttccgtgactcgtcccattgtcctgatcagccccggttctggttctgtacgtgctgtggccgaaacggcccttgctgctgaggtcgacgatctcattgtcctgcacgtggagtgcgaggtcgcggcccgctccgcggtacgcgcggacatctgcggtacgcgaggacgtccgcgacacgccgtacgcccgcggtgccccggtctctgaccgaaggcgacaagcccggcgggtgtttcctgtggcttcacctgccgccctacccgtgagtcactgatcagactggtgaatccgcaacccacggcaacgaggggaccctcccaatgaacggctcgcgcatcgccgccgtcggccactaccagcccgccaaggtgctcaccaatgaggacctggccggcttggtggacaccagcgacgagtggatcaccagccgcgtgggcatccgcacccggcacatcgccgggcccgacgagccggtcgacgagctcgccgcgcacgccgcggcgaaggcgctcgcggcggccgggcgcacgccggccgacatcgacctggtcctggtcgccacctccacggccgtcgaccgttcccccaacacc

SEQ ID NO: 630 - DNA, 1774 bp, Unknown
  Kingdom: Bacteria, Phylum: Actinobacteria, Class: Actinobacteria, Order: Streptomycetales, Family: Streptomycetaceae, Genus: Streptomyces
  misc_feature (1511)..(1512): n is a, c, g, or t
gccctgcgcctcgcgcgcggcgatctccttcagccgcagcgagagctgcagcgtgctgggccggtcctcgggatccttggccaggcaggcgcggacgagcggagccagcgcgtccggcacgccgcgcagatgcggctcctcgtgcaccacgcggtacagcatcacctcggagctgccgtgcccgaacggcgagtcgcccgtggacgcgtacgcgagcgtcgcgcccagcgagaacacgtcggtcgccggggtgacggcggcgccgcgcacctgctccggcgcgaggaagccgggcgagccgacggccgtgccgacgtgggtgagtgtcgaggcgcccgtcgcccaggcgatgccgaagtcgatgatccgcggccccttcggggacagcaggatgttggacggcttgaggtcccggtgcaccacaccggcctcatggaccgcgaccagcccctcggacagggcggccccgatggcggcggcctccgccgcgaccagcgcgccctcgtcggcgaccttgtcgtgcagggaggggccgggcacgtactgcgtggcgaaccacggacggtccgcctccaggtccgcggccaccagccgcgccgtacagccgccccggatccgccgggccgccgagacctcgcgcgcgaaccgggagcggaactcctggtcctccgccaggtccggccggatgaccttcagcgcgacccgctggcccttccggtcggagcccaggtagaccacgcccatcccgcccgcgccgagccgtcggtgaagcctgaacgagccgacgacgcgcgggtcctcgcgcctcaggcgcatcatcgccatgttcatccccgctgcccggtccctgtgacgagccacagcttacgtacccggggccgctcacgcgcagaggccgcgccctctcgacccgatcgattgtcagtgccgtgcgcgagagttgagcgggagtcagcggttcggacggcgcgccggccgcttccggaccaagatcccaaccggctgtggcacaagggggattgagcaccgcgaggaccaccgcgtacggccggcgcgggcggtgcgcaccaggcgggcagggcggaggaaggcggcggccagggcggacggcgagccgggcggaacggcacgcggccaccgggcggaagtgagcgatgtcaccgaccgtgtccggaaaagccgggcagtttgggcaccccttcagggaagaccccgagacggcggaaggcgtctccacccaggggagtacgccccagcccacggctcatcctccgggaggcccgccaatcggtacgagggcatgacgcccgggaccggccgcacgcctagatttgaggtcagcggcgggtgcagcactcgtcccccgaggtcagacacccgccgctgccgacgacaaccgaagaggtcaggagagggaccatggcccacacggcaccgcggacactgctccgcacgcagggacgcctcacgcgtccccgccgcaccggccgtcgccaccccgtggtggcgannccctggcggccctgctcctgctcgtcttcgacggctggaacacagtggccacacaggcgtcgtccgtgggcgtgatgctggggcgctgagcggcgccccaggcccggaagagcggtccgggcggggacatccacccatgaaaccccgtggggacgggggtgcggcggacggcaggatgccggcgcagctggggagctgcgccggcattgtcgtgcccggaccttccccgtgcagcgccccgccaccggacccaccgccacac

SEQ ID NO: 631 - DNA, 14988 bp, Unknown
  Kingdom: Bacteria, Phylum: Actinobacteria, Class: Actinobacteria, Order: Streptomycetales, Family: Streptomycetaceae, Genus: Streptomyces
cacgggaccccggccggggtcgcctgtgcgggcccgctccgctcaggagccggcgcccggcctgtccacgagttccaccttgtccaccgcgttgcaccagcggcagcgcaccgactcgatggtctcactgacgacctcgcgctcctccaccgtgggctctccggccaggtcgagatgaacgtactcgacgaccttcgaggagcgggtcacgtcgaaacgggtgaggttgccgcagagggtgcagcgccaccgcgtcgtggcggtcggcaggggaaccgtcatcgggctgctcactttccttccggagtccgtgacgcgccagcttcccaggagcgccggctcgtaaccctacggcctgggggccactcggcgcccggctgtccacggcggcgaggcggcgtgtgctgatgcgtcctgttacgtcatgctctgtacacatgatctgctccaggaacggggtggccgcccgggcggccagggccctcagggcggtacggtccacaccggcgccggcgacgaccgccctgatcgtcctgtgctgcgtggccttcgcggccggccccgcggcgggcctcgtccccgcctacggcaccgggaacacgctgctgcgggcccagcaggcctacttccggcactggggcgtgatccccgccgacctgttcacgggctccgcccgcgccgcgctcacccccgccacggccctgttcgtgcacggcagctgggtgcacctgctcggcaacatgctcttcctgcacgtcttcggcgcgctgaccgaggaacgcatgggccgcgtcgagttcacgctgttctacgtcggctgcggctacctggccctgctcggctacgcgggcgcccacgcggactccgggcagaccctggtcggggcgtcgggcgcgatctcggcggtgctcggcgccttcctgtacctgttcccgcgggcccgggtcaccagcgtgctgccgttcctcttcttcctgccgctgcgcctgccggcctgggtcgtcctgccgttctgggcggccctgcagtggctggccgcgggccaggcctccgaggggcccggcgtggcctacctggcccacgtcatcggcttcgcgctcggcttcggctacgcgtgggcccgctacggccgcacggctagagtgaaggtcagccctgctccggcccccgagggagagaaacagccgtgatcaccgcgatcgtcctcatcaagaccagcgtggaccggatccccgagatcgccgagcggatcgcctcgctggagagcgtgagcgaggtcttctccgtcaccgggacgtacgacctgatcgccatggtgcgggtgggccggcacgaggacctggcggagatcatcccgggccggatcagcaagatccccggcgtggaggccaccgacacgcacgtcgcgttccgcacgtactcgcagcacgacctggaggcggcgttcgcgatcgggctggactcctgaccgcctgaacaccgcctcccggacaccgcgccccggccgtcgcgtccggggcgccgcgcgtctcacacggccgggacgcagcggccgtcctccgtgcggtacgaccacttcgcgccctcggccaccagttcccgcaccgccgtcacgaaccgctccacgtgctcgtccggggtgcccgcgccgaagctgacgcggatggcgttgagggacttctcgccgggcgcggcctcgggggcgccgcactcgccctgggtctgcgggtcgctgccgagcagggtgcgcaccagcgggtgggcgcagaacaggccgtcgcggacgccgatgccgtactcggcggagagcgcggcggcgaagtgcgagctgttccagccctcgacgacgaaggagatcacgccgacccgcgcggcgtcgtccccgaacagcgagagcaccttcacctccggcaccgcggccagcccctcacggaccttgccgatgaggtactgctcgcgggccaccagcgtgtcgaacccggcctcggtcagcgccttgcaggccgcggcgatggagtaggcgccgatgacgttcggcgagccggcctcgtggcgggcggcgctgtcgtgccactccacgtccactcccccgtcggtgcgccgcgtcacccggcggctggcgccgccaccggcgaggtagggctcggcctcgcgcagccagtccgcgcgtccggccagcacgccggagccgaacggggcgtagagcttgtggccggagaaggcgacccagtcgacgtcgaggtccttgacggacaccgggtggtgcggggcgagctgggcggcgtccaggacgatccgggcgccgtgcgcgtgcgcggccgcggccagctcgcgcacgggccacagttcgccggtgacgttggaggctccggtgacgcagaccagcgcggggccgtggggctcgcggtcggccagggcctgttcgagggtcgccacggcctgctcgggggtgcgcggggcgttgaggtaggtcacctgggcgtcgcgccagggcagcagggaggcgtggtgctcggtctcgaagacgaagacgcggcagtcggccgggacgacgcgggccagcaggttgagggagtcggtggtggaccgggtgaacaccacctggtcgtccgtacggcagtcgaggaactcggcgacggtgcgccgggcgttctcgaacaggtcggtggagagctgcgagaggtagccggcgccgcggtggacgctgccgtagtacggcgcgtacgcggccacgtcgtcccatacccgctggagcgcgggggcgctggccgcgtagtcgagggcggcgtaggtgacctcgccgccggtcaccagcggcacggtgacatcccgtcccagaacgggcagcggggcacaaacggactggtcggcggcaacggtggagacagacatgagggaactcccgtgacagcagggtgaattcaccacgcgagcagagacagctccagcgcggtgaaggagaaaaagggggtgcggaggcggggctcgacgccctaaagcattcgcttgctcacggaaggctccctcgtacgaccaggacccctggtgacgcgaggggtccgcgcttgccgtagacctcgctgcctacgacctggtcttcacccggggcaccccgccacggacggagggttgccggacagccggccggggccatatggctgtcactcatgacctggtccaacatcctgccatacgatcttgcgtgcgcaaggcgcagtccggatcgtggactgcgccccgcgtcacaccgcgccgtacggcctcaggcgttgctggcggccacccagcgctccagcgtgcgccgggcggcgccggagtcgatcgactcggccgccttctccatcccggcccggatccgctccgccagcgtccccgagccctgctccagggcgaccagggccgccgccgagttcagcagcacggcgtcccgtacgggcccgctctcgccgtccaggaggcggcgggcgacctccgcgttgtaggaggcgtccgcgccgcgcagggcctccaccgggaccagttcgaggccgacgtcgcgcgggtcgaaggcctcctcggtgaccttgccgtcccgcacgacccacacccgcgaggtcgccgtggtggtcagctcgtccagcccgtcgtcgccgcggaagaccagcgaggagttgccgcgttcggcgaagacgcccgccacgatcggcgcctcgtgcgccacggccacaccgaccgcctgggccttcacctgcgccgggttggtcagcggaccgagcaggttgaacaccgtgcggatgcccaactgcccgcgggcggcgccgacatgacgcagcgccgggtggaacttcaccgcgaagcagaaggtgatgccggcctcctcggcgacctcgaccacccggcgcggggtcaggtcgaggttgacgccgagcttctccaggacgtcggatgccccggaggcggaggacgcggcccggttgccgtgcttgacgaccttggcgccggtgcccgcgacgacgatcgaggacatggtggagatgttcaccgtcttggcgccgtcgccgccggtgccgacgatgtcgacggtggcgccgggcaccttgatcacgttggcgtgctcgtacatcgtccgtacgagcccggtgatctcctcgacggtggcgcccttggcgcgcagggccaccgcgaaggccgcgatctgggcgtcggtcgcctcgcctcccatgatccggtccatcgcccaggcggtgtcgtcggcggccaggtcccggccctccagcaggccgttcagcatcaggggccaggaacggcccgccgcggtgtcgcctccagcgggggtcacagcgctcataagccgctcctgaatcggcgtcccggacgccgggacgcttcctgtcgtatcgccttccaccctatccagccccgggacacggcgaagggccccgtccggggttcggacggggccctcctaccgtggcgtggcgacgctcagggtgtcagcgatcagtggtggccgtggccgctcgtgatctccttgtactcctcgacggtcggcttcgcgatctggctgtcctcgccgaagtaggcgttgctgagcttggcgcgcagcttctccgtacccgcgaccttgcgctcgacaccgttctcgtcgaccgtcgggccgatctcggccggctcgtactggtggtgggccgtgagggtgtacagctgctcctggctgagcggctcgtggacctcgatgaactcaccgtgcggcaggcgcttgatgatgccggactcgcggccgtgcagcaccttgtccttgtcccggcgctgcaggccgaggcagatccgtttcgtgacgacgaacgtgacgaccggcgccaggaagaacgcgatgcgcacgaaccaggtgatcgcgttgatcgacaggtggaagtgggtggcccacaggtcgtttccaccgccgaccagcagcacgaagtaccaggcgatccacgcggcaccgaacgcggtacgggtcgggacgttgcgcgggcggtccaggatgtggtgctcgcgccggtcgccggtgacccaggcctcgatgaacgggtacagcgcgatcgcggcgaggaccacaccgaacagcgccagcgggatgaacacgcccaggaccagcgtgtggccccagaagttgatctcccagccgggcatcgcgcggatgagaccctcggccatgcccatgtaccagtcgggctgggcgccggtggacacctggtcgggccggtaggggccgatggcccagaccgggttgatctgcgcgatcgccgcgatggccgcgatggcaccgaagaccaggaagaagaagcctccggccttggccatgtagaccggcagcagcggcatgccgacgacgttgttgttggtcttgccggggcccgcgaactgcgtgtgcttgtggtagaagaccaggatcaggtggccgacgaccaggccgagcatgatgcccggcagcagcaggatgtggatcgagtagaaccgggccacgaagtcgtgaccggggaactcgccgccgaagaggaagtacgagatgtacgtgccgatgatcggcacggacaggatcgcgccctccatgaagcggacaccggtgccggacagcaggtcgtccgggagcgagtaaccggtgaaaccggtgaacatgcccaggacgaacagcaggaagccgaacatccagttgacctcacgcggcttgcggaacgcgccggtgaagaacacacgcatcatgtgcacgaacatgcccgcgaggaagatcagcgcggcccagtggtggatctgccggatgagcagaccaccgcgcacctcgaaggagatgtgcagggtcgagttgaacgcctcgctcatcagctgtccctggagcgggacgtagctgccgtggtacaccacctcgttcatcgacgggtggaagaacagcgtcagatacacacccgtgaggatgatgatcaggaagctgtagaggcagacctcacccagcatgaacgaccagtggtcggggaagatcttgcgcatgttggccttggccaggctgtagatgcccagccggccgtcggcccagtcggcgagcttctcgccggccggtgccttcccgcgcgcgcgggtcgggttgctcgctgtagtactcatccgcgctcccagaatgcaggaccgacgggctcctcgaagtcgccgagcgcctcgaggtacccctcgctgtccacgccgatgcgcagctgcggcagggcgtgaccggccgggccgaagatgactcgggcaccgtcggagaggtcgaaggtggactggtggcacgggcacagcacgtggtgcgtctgctgctcgtacagggagatcgggcagccgacgtgggtgcagatcttcgagtaggccacgacgccctggtgcgaccactccagctcgcgcttgtccttgatgttgtccggctggagccggacgatcatcagggccgccttggcgatctcctgctggaagtcctcgctcgcctcctccaggccctcgggcttggcgaaggtgagcgaaccgaccgcgatgtcctcgggacgcatcggcaggttggtgttcatgttgaccaggcgcttgcccttcgcccacagggtgtggcgaagcgattccttgggcagcgggcccaggtcgcgcagcaggaacagcccggacagcggcaccagcgtgagcgcgcccagcatggtgttgcggatcagcggacggcggccgatcgcggactccttggcaccctgccggaagtccgcgtggaccttggcacggacctcgggggacgcctcgatcgggtgacgctcgtcggcgacctccgcgtccgacatcagcgtgcgggcccagtggaccgcgcccgcgccgatgcagaacagcgccacgcccagcgtcagacccagcgcgaagttcatcgcgctgacgtgcccgatcgggaagacgaagatcgacttgtcgttcgggatggtcacgtacgagacgatgaagcccacggtggccagcatcgacaccgtgaacatcagggcgacggcacgctcggaccgcttggcggcccgctcgtcgatgtcctggatccggtgctcgtggggcggcagccccgggtcggcgaacgggttcttgtcgtccgcgactcctacggcgccgtgcgccgagccctgctcggcaggcaggttctcttctggaatgtcttggctactcatgacttcttggcctttgcggtccgggcggcgacccacacggcgacggcgatcagggcgcccagcccgaagatccagccgaacagaccctcactgaccggcccgaggccacccagttccagaccgcccgggttctccgtctggtcgccgttgaccgcgttcaggtacgagatgatgtccttcttgttcttctgggacatcgtggtgtcggggaacgacggcatgttctgcgggccggtctgcatggcctcgtagatgtgcttcgggtcgacgcccgtcaggtccggtgcgaacttgccgtgcgtgagcgcaccacccttgccggtgatgttgtggcactgggcgcagttggtgcggaacagctcaccgcccttggcgatgtccgcgccctgggggctgtactcgttcttcgtcggcacggccgggccggcacccagggaggcgatgtacgccgccagctggtcgatctcgggctgggtgtagatgaccttcttgcgcgggacctgcgcgcccggctgctgggccggcatgcggccggtgccgacctggaagtcgactgccgccgcgcccacgcccgccaggggcggaccgtcagtggtgccctgaccaccggtgccgtggcagcttgcgcagccgacctggtagagcttcttgccctcctcgatggtgagggactgagcggtgtcgtcggccttcgccttgctcgcgggcgcgaacgcggtgtacagcccccccgtggccgccagcgcgagaaggaggacgacgaccgccgccagcggatggcgtcgtcgtgcggagagctttttcacggattaccccggtgtcaggatcttctgcgtcgatgctttgcggacttggatcggttcgtcggctacttgatcaggtagatcgtggcgaagaggccgatccagacgacatcgacgaagtgccagtagtaggacacgacgatggccgcggtcgcctgctcatgggtgaacctccgggccgcgtaggtgcggccgaggaccagcaggaaggcgatgagaccgcccgtcacgtgcaggccgtggaagccggtggtcaggtagaacaccgagccgtacgggtcggaggacagggagagcccgtcctccttcaccaggctggtgtactcgtagatctgaccgccgatgaagatcgcacccatgatgaaggtgacgatgaaccagccccggagcttcttcacgtcaccgcgctcggcggcgaagacgccgagctgacaggtgagtgaggagagcaccaggatcgtggtgttgcccgaagagaaggggacgttgagatggtccgccatcgtcttccagtgatcgggtcccgtcaccgatcgcagggtgaagtacatcgcgaagagggccgcgaagaacatcagctcggaactcagccagatgatggttccgacgctggtgaggttcggccggttgaccgacgggtgcgcgtgcccggtttctactgtcgttgctgtcgccacgaccgacattatgtcggtcgcttatcccgccctcactccggggggtgccgttcggagtgtctgcggggtgtgtccagcccgtatggcccatcgaaggggtgttccaggcggtgttgacggagtctgggagggagtagcatccgcgccatcggtacccggaagttcccgcactttgccgtgtcttctcaaggtcttgccaagaggcgtggaggaacaatgcaggcgaccgcgacggtcctggtctacagcgacgacgccaacacccgggagcaggtgcggctggccaccggccggcggcccgcccaggacgcgcccgtcgtggagttcgtggagtgtgccacgcccgcggcggtcgtcgccgagctggaccggggcgggatcgacgtctgcgtcctggacggcgaggccgtgccgatgggcggcatggggctgtgccgccagatcaaggacgaggtcttccgctgcccgcccgtgctgctgctcatcgggcggccgcaggacgcgtggctggccacgtggagccgtgcggacgcggcggtcaccttgccggtggagccggtggagttcgctgcggcgctggctgggttgctgcggaagccggcgctggtctgagcgcgccgggtccgagcgggggcgaccagtagctcgggacggcccgctgtcctgcgactgcgggccgtccgcggctgggcgcgtccatgcggcaaagccgcatgtcgatacccctcgcgccccttcgtcggcgtccgctcagaggctctgcggggtcagtctggcctggttgccctggggggtggccgactgggtggcggaggtcagggcgctgccctggagccatttctgccaggggaggttccagtcgccgaagccgttgtcgaacagttccatcggctcgcccttggagttgatgacctggacgacgtcgccctcgtggatgttgtcgaagaaccacctggcgttgggggtgctcatgccggtgcagccgtggctgacgttggcgatgccctgggagccgacggaccagggggcggcgtggacgaactcgccgctccaggtgacccgggtggcgtagtacaccggcaggtcgtaggagtccctggagccctgggcgatgccgacggtggagctcttcatccgcacgaagtactgcttggcgagcacgaccttgacgccgttgcgggtctcgaagccgggcttgccggtggtgacggggatctccttgatcttctcgtcgttcttgtagaccgtcagcaggtgcgtggcggcgtccgtgacggcgacgacgcggtccccggtggtgatggtcagcggcttggcgtcgccgccgtacagcgtgtccccgatgcggatgtcctgcagggtgctgtgcacctggatggtggcgtgcgcgggccagtagtccctgggccggtagtggagcgtcttgtcgtccacccagtaccaggcgccctgcacggcgggcgtggactggacctggaggccgcgttccacgatggcgcgctgcgccttgtccttcaccggctggtcgagtccggccacgatgggctcgccgacgccgtaggtgcccgcctccgggctgaacgtgacgttcaggcgcttggtggtggtgggcttgctggtgtcgaaggtgacgaccttacggccgggtgcgcccttgtcgtcctcggtccgcaccgtgagcgtgtagtgggcgcccgcggccagtggtgaggtgctgtgccaccggctgccgtcggcggcgagttcaccggagacgtgccgtcccgtggcgtccacggcggtgacgtccgtgatgcgcccgtcggagcccgaggcggtgaccaccaagggtttctccgggtcggccttcttgccggcctccgtaaggccgctgaaggagatctggtccgccgcgtcgtaggggtcggcggccagtgggttgtcgtccgcgccgcaggcggtgacgcccgcgcctagggcgaccaccagaagagtgcagctgacaccggcctttgcgccccgcgagaacagtgtggtggtcatggcagcacgctaaggagcttcgtcaactccggcactgcgggtcgtccgttcgggggataccggtacgacaaaaagagggaacccgggcactcgtccgatggagcgcccgggttccctgatgttcagtttgtgctactgggtgcggttctcaccgcggtagtactcgaagacccagccgagcagcgcgaggaagacgatgggcgccgcgaagtacagcagccaccagccgagcgccacgccgaggaaggccagcgcgccaccgaaaccgagggcgagcggctgccagctgtgcgggctgaagaagcccagctcaccggcgtcgtccgcgacatcggcctccttgttgtcctgagcgcccgcgtcgacccgcttggccgtgaagccgaggtagaagccgaccatgatgctcaggccgaaggagaggaagagcgccgtggtgccggccggctccttcgaccacaagccatagacgatcgccatgacgagcaggaaggcgctcagccagatgaacatcttgccctggatcttcacttgccggcctccttgccgccggcgagggcagccttctcaccgtggccggcgttctcgagctggtcgagcgcggcgatctccgggtggtgcaggtcgaacgccggggattcactgcggatccgcggcagggtgaggaagttgtgccgcggcggcgggcaggacgtcgcccattcgagcgagcggccgtagccccacgggtcgtccatgttgaccggcttgccgtacttggcggtcttccagacgttgtagaagaacggcaggatcgacgcgccgagcaggaaggagaagatcgtcgacaccgtgttcagcgcggtgaagccgtcggccgccagatagtcggcgtaccggcgcggcatgccctcgacgcccagccagtgctggatgaggaaggtgccgtggaagccgatgaacagcatccagaaggtcatcttgcccaggcgctcgtcgagcatcttgccggtgaacttcggccaccagaagtggaagccggagaacatcgcgaagaccaccgtgccgaagacgacgtagtggaagtgcgccaccacgaagtacgagtcggagatgtggaagtccagcggcggcgcggccaggatgacaccggtcagaccaccgaaggtgaaggtgatcaggaagccggtcgcccacagcatgggtgtctcgaaggagagactgcccttccacatggtgccgatccagttgaagaacttcacaccggtcgggaccgcgatcaggaaggtcatgaaggagaagaacggcagcagcacaccaccggtgacgtacatgtggtgggcccacaccgtcacggacagacccgcgatggagatcgtggcaccgatcagacccatgtagccgaacatcggcttgcgggagaagaccgggatgacctcgctgatgatgccgaagaacggcagcgcgatgatgtacacctctggatggccgaagaaccagaagaggtgttgccagagcaaggctccgccgttcgccgcgtcgaagacgtgggcaccgaacttgcggtccgcctccagggcgaacagcgcggcggccagcaccgggaaggccagcaggaccagcaccgcggtcagcagcacgttccacacgaagatcggcatgcggaacatggtcatgccgggcgcgcgcatgcagatgatcgtggtgatgaagttgaccgagccgaggatcgtgccgaagccggagaaggccagacccatgatccacatgtcgccgccgatacccggcgagtgcaccgcgtcggacagcggcgcgtaggcgaaccagccgaagtcggccgcaccctgcggggtgaggaagccgcccaccgcgatcagcgagccgaacaggtacagccagtaggcgaacatgttcagccgcgggaacgccacgtccggggcgccgatctgcagcggcatgatccagttcgtgaagccggcgaacagcggcgtcgcgaacatcagcagcatgatcgtgccgtgcatcgtgaacgcctggttgaactgctccgtcgacatgagctggaggcccggacgggccagctcggcgcgcatcaggagcgccatcacgccgccgatgcagaagaacgcgaacgacgtgaccagatagagcgtgccgatcgtcttgtggtccgtggtcgtcaaccacttgatcacgacgttaccgggttgcttgcgccggaccggctgctcgctctcgtaggagcccgctgccgcagcggcaccctgaggttcgttgaggatgctcacaggttgttcgtctcccggttcttctcgtggctcgtctgcgcgatgccggcgggaacgtaaccggtctgccccttcttagcgaggtccttgaggtgctgctcgtaacggtccggcgagacgaccttcacgttgaacagcatccgggagtggtcctggccgcagagctcggcgcacttgccccggaaggtgccctcctcgttgggggtcacctggaaggagttggtgtggccggggatgacgtccatcttcatcaggaacggcagcacccagaacgagtggttgacgtcccgcgaggtgaggatgaagcggacggtcttgcccttgggcagccacagggtcggacccgggttgccgttctgcgggttccgcgtggccggcgtaccgaagtcgtagacaccgccggcgttcgccgggaagtccttcttgaaccggtccggaatggccagcaggttcttgtcggtcttcgcgtcacccgccgaaccggcgacgggcgtgacgtagttgaaggcccagctccactggtagccgacgacgttgaccgtgacgtcgggcttcttggattcgtcgaggagcttcgactcgtcgcgggccgtgaagtagaagagcaccgagacgatgatgagcggaaccaccgtgtacagggcctcgatgggcatgttgtaccgggtctgcggaggtacctcgaccttggtgcggctgcgccggtggaagaaagcactccacaggatcagaccccacaccagcacgccgaccgcgatcgcggccgcccaggacccctgccacagcgagaggatccgcggagcctcttccgtggccggagtgggcatacccagccgggggaagtccttgtatgtgcaaccggtcgcggtcgccaggaccaggcccgcagtcagtgcctgcagcagcttccgccgcatcgggcgccgcggcgagcggtcggagccgttgggactcacgtagcgccttcccgagagtctcgcccgcgcggttggctgcggcctgccttctcgctggtcggtcgccgccctgcgtcgggcaggggtttggatgtttatgcggaccaaaccctactggacgccttccggcgggtcgcggggagggtgccatacgcgccgcgggtcaccccgaaggggtgggatgtccctgggtgcgctgatatgtgacgggggctgaggcgcccggaagcccgggtgccgttcgccttcacggcggccgcgggtccgtcgtggtcacgcctcgcggcggagccgcaggtcggacactttcccgcgcccttcggggcgcttagcgtgagggtgtgccctacttcgacgccgcttccgctgcccccctgcatcccgtggcccagcaggctcttctcgcctccctcgatgaagggtgggccgatccttcccgcctccacaaggagggcaggcgggctcggttgctgctggacgcggcgcgggaggcggcggcggacgcggtggggtgccgggccgacgagctggtgttcacctcgtccggcacgcgcgccgtgcacaccggtgtcgccggtgcgctggccggccgccgccgcgtcggacgtcacctgatcgtgtcagccgtcgaacactcctcggtgctccattcggccgaggcgcacgaggccgacggcgggacggtcacccgggtcgccgtcgaccgggccggcgcggtgagcgccgccgcgtacgggagtgcgctgcgcccggacaccgcgctcgcctgtctgcagtccgccaaccacgaggtgggtacggaacagccggtctcggaagtggccgaggtgtgccgggcggcgggtgtgccgctgctggtggacgcggcgcagtcgctgggctgggggccggtggccggcggctggtcgctgctgacggcgagcgcgcacaagtggggcgggccgcccggtgtcgggctgctcgtcgtgcgcaagggcgcgcggttcgcggtccggggtccggtggacgaacgggagtcgggccgggcggccgggttcgagaacctcccggcgatcgtggccgcggcggcttcgctgcgggcggtacgggcc

SEQ ID NO: 632 - DNA, 507 bp, Unknown
  Kingdom: Bacteria, Phylum: Actinobacteria, Class: Actinobacteria, Order: Streptomycetales, Family: Streptomycetaceae, Genus: Streptomyces
agcacggcgtacccgccgaggggcacgtcgtcgcggccggcgtaggacccaccggacccaccagacccactgtccagggacccgccgtcgtaggaccggtcgtccggggactggtcgtccggggaccggtcgtcctgggaccgctcgtcgcgggactgttcgtcctgggaccgctttccggccgtcatggaacctccctctcacgatggcgcgaagtcgcgggccgaccgcacggacctggccgtacgggctggtcacccgcgcccgggcccgagtgccccgccccgcccccgctcacacgtacccccgcgcggtacgggcccgcttgagagcgacctccccgggtacccacggcgcatggcgttggaccggagaatcacgcagggggcggggcgcacggcgccggtgcggcggacgaacccgacattcggacgggccctgatgcgatgggccaccacgaccgatcacaaggtgatcggcaacctctacatggcgacggcgttctcg

SEQ ID NO: 633 - DNA, 1615 bp, Unknown
  Kingdom: Bacteria, Phylum: Actinobacteria, Class: Actinobacteria, Order: Streptomycetales, Family: Streptomycetaceae, Genus: Streptomyces
gcggccagggcggcggcgagggactcggcgaagatacggtggtcgtcgacgaccaggacgcggacacgaaccactgaaacccccttccccaggctccttcagggagcaggggattcccgtcatcggagacgagggccggccccgtcgaggaggccggcggcgcgggcacggcgcacgacgcccggggccgccggaccgcacggccgccgccatgcggaactgctacccctacttcgggcgccgtacccggctgtctcgccccctgatcggcaccggcccccaccggtaccgctcctcagggtacgaccgggggccgggaggggaaggaaattcgcagaactgaccggtgagcgagtctagggtgtgccgcatgtttcgtatcgaggcggaagtggacaaagagcgtcgcgatctgctccgctcccgcctccgtgacaccaacacggcagcgtcgcccgcgctggccgccctgcgcaggacccccgccgcccgcgaagtcccgctccacctgtgggccatggacgactccggcggcctggggggcggcctggtcggccacacctgggcggactggctgcacgtgggctacctgtgggtcgacgcccgccaccgcggcgcgggcctcggctcccacctcctgcgccgcgccgaacgcatcgcccgcgaccaccgccactgcaccgccgcccgcctggagacctgggacttccaggccccggagttctaccgcagacacggctacaaggtggtctgcgcgatccccgactacccgccgggcatcacggagtacacgctgatcaagccgctggggtgagccggggaacgagcggggccggcactacgacggctcctcgtccagccccatgtccttggcgctgtaccggggcagaccggtggtctcgaccgtccaggtccccagatcggtggcgacggtcaccggtttcccgtacgggaggtgcagtcggttctcgtacacgggccggcccccgctgcgaccgatctcccactggtacgtccacgtgccgtcgcgtggatcgaggatcaggtagtgggggatgcccatggcgggatagtcgcgagtcttgtgctcgtagtcgttctccgggttcgacggcgagacgatctcgacggcgaggacgatgtcacggggatccagcggatcgtccgtctgcatggcttcgccggggcacacgaggaggtccgggacccgcagcttgccgagcgtctcgtcgtccgtgtcggtcgcttcgaaggcgaagaagccctcgggcagctgctcgtccaactgcctcgaaacgagcttcgccgtgaactggtggcgaggccgcgggctcatcatcatcacaagctgtccgtcactgatctcgggccaggcgaagcccggcggcggggtgatgtgatcgcggcggcggcgcagccgccggtacagagcctgctgggtcatcggatcctcccggctccagtatgacggcacggcctgccgacgggcacgacgccgcgtcacccggccggcaccgcctcccccaccgcccggtgcaccgcccgggccagtcgggcgccccacagtgagcgcgggcccgcgaaagcgtggggggtctcgtcgggggacggggtg

SEQ ID NO: 634 - DNA, 6295 bp, Unknown
  Kingdom: Bacteria, Phylum: Actinobacteria, Class: Actinobacteria, Order: Streptomycetales, Family: Streptomycetaceae, Genus: Streptomyces
tgcctgtgcgggcggggcgaagcccggggccgcgccgggctgcggctgctgggaggccgccgccggggcgggagcctcttcttccagtacctcgccgccgaagttcttcaggagggcttccaggccgccgtcgaacccctgtccgacggcggcgaaccgccagacgtccttgaggtagatgtctcccagcatcacggcccgctcggtggagaactccgcgccggtgaaggagtaccgggcgacctcctcgccgcccgcgacgatgcgcaggtagccgggggcgacctgcgacatctgcccggcgccgtcgagagtcgccgtgaacgaaagcttctggatctgcggcgggatccggtcgagcgtgaccctgaaggactccgtgtcgccggcctgcgcgcccagcagctggatggcctcctcgggggacttcggctggttgaagaagacgaagtaccggtcgtcggagagccgttctccggcgtcgagtccgaagcagctgatgtcgaaggtcagtccggggccggagatctgtactcccacgtacagatccgtgcccgcggtcaggtcactgatcctggccttgtggccgcgttggaattccctgggcatgcgtaacgaccgtcccccatcccgaatgcgagtgcgtcgcgccaggctaacggcaaactccgacaccggaccaagccggtacagacccggtacacaatccccgcccggccgtggcgtacggccttcagcgcacccgcacaccgcccggaggaccggcgctcactcgcctcgctcggccggcggatgcggcagccgcgccgccgccaccacaccctccaggtagccgcgggcccgctcggtgcgcgggtaggcctccaggagccgccagaagtcggggccgtgcccggggaccagcagatgggccagttcgtgcaggagtacgtagtcgacgacgtactcgggcatcccctggaggcggtgcgagagccggatgctgccctcggccggcgtgcacgaaccccagcgggtgttctggttggtgacccagcggaccgaggcgggccgggccctgccgtcgtagtactgcgccgagagccgtgcggcgcgctcggccagctccgtgtcgccgagcgagcggcggctctcctgggcggccagcttgtccagcatgacgttcacccagcgcctctcctccgcctcggacatcctggcggggatgagcacgacggtgcggtcgccctcgcggtacgcggagaccgtcctgcggcggcgggcgctcctgcggacctcgatcgggctcgtcgccgggccgctcggcggcgggctcgtcttgccgcgctgcggcgttccggcacggtgcagtgggtcggcggacacgccccgacgttaccgggtgtaggcggtggaagtccccggcgcgggacgcttccgtaccgatcccccaccgacggtccgattcatgcgatgaaccattcgtacgacgaaccccaccgcctgtggacaactttcggcaccgctcggcgggaccgggcatgctggcactcgtcggcggagcaatgaccggctcctccggcccggcgtacttctctcccagctcttctctcccagctcatactgctgtctcattcatccggctacgggggccgcacatgcatccgatggtgaaacccgcgctgcggcgcggctggcgcgatctcaacaccgtgcagttcgggatgacgcccgcgcacgcactgaccctgggtcccgtcgacaccgcgacgggaagtttcctggaactgctcaacggcacgcgcggtctgcccctgctgcgggaggaggggcagcgcatggatctgcccgagggccatgtcgatctgctcgtggagcggctggcccgggccgggcttgtggacgatgcgcggggaggcggcgcggcggccggtgcgctccggtcgaagaggcaggtcatggaccggatggctcccgatctcgcctcgttgtccgtcctggcccgagaaccgggtgaggcgatcgaccggctggccgcccggcgcggtatgagggtgcaggtgcgcggcgcgggccgggtggggtcgttactggccgccctgctgtccggcgcgggggtcggcgaggtcgaggtgatggacggcggctgtgtggagccgtgcgacgtggcccccggcgggctgcccgccgacgccgtgggtgagcgcagggacgtcgcggcgcgccgggccgtgcgccgcgccgcaccggacgctccggtgcgccgcggcacaggggtgccgtcagggacggaggagaccggtcactcgctggtcgttctcgccccgcgcgacgacgtcgccgtgtacgcgcccgacccggtcacggcggcccccctgatcgcgtccggcactccccatctgtacgccggggtcgtggaggccacgggagtcgtggggcccctggtactgccggggcagacgagctgcgccgattgcctgcaccggggacgcacggaccgggacgagacctggccgcgactggtggcccaatggcggtccgggaagcagcaccgggtgcgcccctgcgacctggccctcgccacgaccgtcgccggactggcggcagcccacgcgctggccttcctggacggggactcgccctccagcgccggcgcccgctgggaggtctccgcgcccgccctgaactggcacgggcgcccggtgtggccgcacccggactgccgctgcggggcggcgggcaaacccgtggtggaagacacctcaaaggtgggcgctccacgcgagacaatggctgagcaacggccgtcgtccacgccccgccggcaggcggacgcggaacggcttgctgggacttggagggcgcatgtctgatcttccccggaaggcggtcacccggaccgccaagctcgccgcgctgccgctcggcttcgccgggagagcgacctggggtctcggcaaacggatcgtcggcgagtccgcggagatcgtcggccgggaactgcagcagcgcacggccgatcagctcttcaaggtgctcggcgagctgaagggcggggcgatgaagttcgggcaggccctgtccgtcttcgagtcggcgctccccgaagaggtcgccggtccctaccgtgctgccctgaccaagctccaggaagccgcgccgccgatgccgacgcggaccgtgcacgccgttcttgaggagcggctcggcacggactggcgtgcgctgttcgaagagttcgaggacaaaccggccgcggcggcctccatcggccaggtgcaccgggccgtgtggcacgacggccgtgaggtggccgtcaaggtccagtaccccggtgccggtgaggccttgctctccgacctggggcagttgagcaggttcgcccgcctgctggggccgctggtccccggcatggacatcaagcccctcatcgccgaactgaaggaccgggtctccgaggaactggactacggcctggaggccgaggcgcagcaggcgcacgcggaggagttcgcggacgacccggacttcctggtccccgcggtggtccaccagtgcgaacaggtcctggtcaccgagtggatcgacggtgtcccgctggccgaggtgatcgcggacggcacgcaggagcagcgcgaccgcgcggggcagctcctcgcccgcttcctgttctccggcccggcccgcaccggcctgctgcacgccgatccgcatccgggcaacttccgcctgcttcccggcggccccgagggcgaggacgactggcggctgggcattctggacttcggcaccgtcgaccgtctgcccggcggtctgccggagccgatcggcgcctccttgcggatgacgctggacggtgaggccgacgcggtctacgacatgctgtgcgcggagggcttcgtcaaggagtcgatcgagctggatcccgacgcggtgctcgactacctcctgccgatcatcgagccggccgaggtggaggagttcaccttcacccggggctggatgcgcagccaggcggcccggatcgccgatccccgctcccccgcctaccagttgggcaagcggctcaatctgcccccggcctacctgctgatccaccgtgtgacgctcagcacgatcggtgtgctgtgccagctgggcgccacggtgcggctgagggacgagctggaggagtggctgccgggcttcgttcccgaggccgacgaggaagtcgaggagacggagacggaggcggaggcggaagaggccgtcgtcgaggcgtgagccgggagggggatcaccaccaggcggagtcgagtcgcccctcgatcgagcgcaggtgctcacgggaacaggcgtcgcagaagtagcggcggactccgttctcgacggagcaggtccaggtcggaggcggttcctgcgccgaggcgccgcagcgggcgcagctcacagacgggcgccgctcgtcggcggcgctgcggtcgtcggcggcgtagtggtggtcggcatcttccgggtccggggctccgctgggacgcgtcacgcggtgacgatacctccgcccggggaacggcggacgtaacgcaccgcggggccggtccgtgcggacggaccggccccgcggacgcagaggtgccttccctgccgggaggccaccgctgagcggtgtgggcggttactgcatgaccgccatggcgagcgcgcggcgggcgcgcagtgaggcacgctcggcgcggcgctgcatccggcgggcggtcaccaggcgcacggcatggcgttcccgctccacctcctgcagccgctcctgcatatgcgcacgagccatggcttctgggatgagttgcatctctcgggtcctgttctgtcgcgagtcgttcgcgccggtggtggtgacgtcttcggtggcggagcctgcaggctcgctgggggtggacggcttcatcggggcctgcttctgggggtcgtgcgtgagggggcgatcgatggttcctgcgatgttcatgccgcaaccgggttcttgcgcgggcggccacggggccgcttccgggcgacgacaacgccttggacgaacagctcgccaccccagacgccccagggctcgcgccgctccttggcgccggcgaggcaggcctccatcagcgggcaggtgcggcacagggacttggcgtactccacgtccgccggcgactcggcgaagaagacctccgggtcgtaggaacggcacgggacgggcacgccgaggttctcgatggcgtcgtcgagcgcggtgagcgcggtgagcgggatcaaggtggggtcctccgtgagaccgggcttggggatcgtgtcggaaggcggtacggacggggcgtgcgcttcgagttgcacggttggtcttcctcgtctggtcggtccggccgggtcggccgggtgtcggctgggtaccgggttcttttcttgtcccgaggccccttcggtccgtcgtccccgttcggggaaaacagaagggccgcggatcccgggtggggttccgcggccctgaaggcgccggcctgatcgacgatcaggctggatcactccagggttctggcccacggaaggcccacatcaggtggtgctgcgtcgtctgcttccggataccggcaccggccgccgtaaaggcataggcatgcgcctgtgccgctactgcttccagtgccgtggtcggtcgctcattgcgctcgcggacagaagcacccgcgagggacagggcggactcgggacgcgcggcacgaatgccggacacaccggtgccctggtccgagacgccgagcatgcacagggaggcgaccgagcgatcggtcattttggcggtgctgaagaagctgctcttgatgctgatcactggactcgcctcctctcggcgtctgggggactggggtgagccagtccgtacggatatgcaagtacaacacggaatcagggcctcaggaaggccgctgttcccgtgaccaagaacctatggggattccccgggcatgcgcaaactattttttcgacgagttggcatcagtcgtcgatctctccgtccgcacgctcctgacctgtgcagatggcaagaacatcggctccgtggcggcgcagcttgcgcgtcccgacgccggggatgcgcgccagctcacgggcgtcgtccggggcggcctcggcgatcgccatcagggtcctgtcggtgaagacgcagaaggcgggctgtccgctgagccgtgcctgctcctcccgccactcgcgcagccgctcgtacaggccctcgtccatgtcggaggggcagtcgtcacagcgcatcagtttcatctcgccggcgtcggtgagggtgcggccg

SEQ ID NO: 635 - DNA, 5313 bp, Unknown
  Kingdom: Bacteria, Phylum: Actinobacteria, Class: Actinobacteria, Order: Streptomycetales, Family: Streptomycetaceae, Genus: Streptomyces
cgcccggcccgggccgggcgtcatcgtcagccggatcgtcggtgaactgttcatcaccaccggtgtggtcatgctgctgttcgtcacctaccagctgtggtggacgaacgtccgcgcgcacgcgcaggcgggcaacgaggcgcaccagctgcaggacgactgggcgagcggcaagcgcaacccgggggcgttcgagccggggcagggcttcgccatcctgcacatccccgcgctggacgtggtggtgccgatcgcggagggcaccagcaaggcgaaggtgctggacaaggggatggtcgggcactacggcaagggcgacttcgacacggcgatgccggacgcgaagacgggcaacttcgggctcgcgggccaccgcaacacgcacggggagccgttccggtacatcaaccggctgaagccgggcgacccgatcgtggtggagacgcaggacgcgtacttcgtctacaagatgacgtcgacgctgccggtgacctcaccgggcaacaccgccgtcctgaacccggtccccaagggttcgggcttcaccgggcccggccgctacatcacgctcaccacctgcacaccggagttcaccagcaagtaccgcttgatcgtctggggcaggatggtcgaggaacggccgcgcagcaagggcaagccggatgcgctcgtcagttaaagggcagagggaacagtggcagcgaccgcggacgacaccgcagagcacaccgaggacggccccgcaccgcgccggcggcggggccgccgtggcacggggcggctggcgctcgccgtcagcgtgttcggcgaactcctcatcacggcgggcgtggtcctcggactgttcgtcgtctactccctgtggtggacgaacgtcatagcggaccgcaaggccgaccggcagggcgacagggtccgtgaccactgggcgcactccgcccccggcggccccggtgcgctggacacgaaggacggcatcggcttcctgcacgtgccgtccatgcacaacggcgaggtcctggtgaagaagggcacctcgacggacgtcctggacgacggcgtggccggttactacgtggacccggtcaaggcggcgctgccggagaccggcaaggagggcaacttcaccctcgccgcccaccgggacggccacggcgcgaagttccacaacatcgacaaggtggagaagggcgacccgatcgtcttcgagacccgggacaagtggtacgtctacaaggtctacgacatcctcccggagacgtcgaagttcaacgtcgacgtcctcgcgcaggtcccggaggagtccggcgtgaagaagccgggccactacatcacgctgaccacctgcacgccggtctacacctcgcggtaccggtacgtggtgtggggcgagctggtccgggtccagaaggtggacagcaagcggacgcctccggcggagctgcgctgactcgtcgcacggcgaagtcacgggacacggcgaagtcacggcgggtgcgcgaccgggccccggctgctctcgaggggagagcggccggggcccgaggtgtcacgggtgccggtgatgtggcccggcgggcgggtggtcagccgaagaggccaccaccgtggccgccgccttggcggccgctcccgttgttgttgcccccgttgcccccgttgcctccattgcccccgctgccgccgatggtcgtcagcgtgatcgtggtgccgcccgggttgtcgaccggctgaccgggctgcgggtcctggctgacgacgaacgcgttgtcatcgcccccgctacccgcgaactggatctgggtgaagccggccgcggccaggatctgcttggcgtccgagaccttcttgccccgggcgtcgggcaccggcgtctgctgctgctggacctgcttgccgacctggatcgtcaccttggagcccttgttggcctgctggttggggcccgggacggtgttgatgaccttgccggcctggttggggtcgctgttgtcgacctcgacgcagttgccttcgaggttgttgtcctgcatctgcttcgtggcgtcgtcgcaggactggccccggacgtcggggaccgtggccatcgcgacaggcttggcgaccgtcagggtgatggtcgagcccttctggacttcgttgtcgccattggggtcctggctgatgacgacgccctcgggccggtcggactccttctcctgcttctcgaccttgaagcccttgtccgtcagctgcgactgcgcggtgtcgaaggtgaggccggtgacgtccggtacgagcaccttcggcgctcccgtcgacagcaccaggttgaccgtctcgcccttcttgatgtcgctcttgggcgcggggtcctgggagcagaccttccccttgggctggtcgtcgcagggcttgtcggtgaacgccagcttcaggctgacgttctccgcggagttctgggcgtcccccttggtctggcccacgaagttcggcgtggccacggtgtcgctgttcgtgctgtggccggtgacgacgtacttgccgatcaggatggcgccgatcaggaccaggacaccggcgacgatcaggaggatggtcgaggtgttggacttcttcggctgctggcggcgccggtcggggcggtcgtcgtagccgtagccgccgtcgtccgggttcatgggcggcagcatcgtcgtggcggcggcgcccggctcggagcgcagtgccgtcgtcggctggtcgtccgggtagccggcgtagccgaccgcgcccatggcggcggtggcggcgacgggctggccgtcgaggcaggcctcgatgtcggcgcgcatctcgtcggccgactggtagcggtagtcggggtccttgaccagggcccgcagcacgatcgcgtccatctcgggcgtgatctcggggtcgaagacgctcggcggctgcgggtcctcgcggacgtgctggtaggcgaccgcgaccggcgagtcgccgacgaacgggggccgcacggtgagcagttcgtacagcaggcagcccgtggagtacaggtcggagcgtgcgtcgacctgttcgcccttggcctgctccggggagaggtactgggcggtgccgatgaccgcggccgtctgggtcatggtcatgccggagtcgcccatggcgcgggcgatgccgaagtccatgaccttgacctggccgccccgggtcagcatgacgttggccggcttgatgtcacggtggacgatgccgctgcggtgggcgtactccaggccctggaggatgccgatggtcatctccatggcccgctcgggcagcagcttgcggccgctgtgcagcagctcacggagggtggacccgtcgacgtactccatcacgatgtacgggatcgagaccccgtcgatgtagtcctcgcccgtgtcgtagaccgcgacgatcgcgggatggttgagcgaggcggccgactgggcctcccggcggaaccgggcctggaaggaagggtcacgcgccaggtcggcgcgcagcgtcttcaccgccacggtgcggcccaggcgggtgtcatgcgcgaggtacacctcggccatgccaccacggccgagcacctggcccagctcgtaccggccgccgaggcgacgcggctcttccatagctacctaccagccctctccgtcggtcccggcgggcacggcttgtgccgccggagcttccgtccgggcctaccgtacccggctagttctgtgggacccggccaagcccgtcacccgatacaggaccggtatcgcaccatgcaccgttgtgaaggggccgtgacggatgtcacctcttggagttgatgaccgcctgcatgacgctcttcgcgatgggggccgcgaggccgccgccggagatctcgtcgcggttggcctgctcgtcctcgacgaccgcggcgaccgcgaccggcgagctgccgtcgctcatctttgcgtaggagacgaaccaggcgtacggcttctcgctgttgttgaggccgtgctgggcggtaccagtcttgccgccgacggtgacgccgctgatctgggcgttcttgccggtgccctccttgacgaccgtctccatcatgtcctgcaggatctgggcgttcttcgaggacagcggccggctcagctcctccggctgggtctgctccagggtgtcgaggttcggcgactggagcttgtcgaccatgtacggcttcatcagcttgccgtcgttggcgacggccgagacgaccatggccatctgcagcggggtcgcggcggtgttgaactggccgatggaggactgggcgacctgcgagggctccatgttgtcggagaacaccgaggcgttggcgcgcacgggggtgaactgctcgctggtgaagccgaacttctttgcctcctccagcatcttcttgttgcccaggtccgcgccgatcttgccgaagacggtgttgcaggaccagcgcagtgccacgcgcatggtggcgttcttgcaggggatgttgccctcgttgggcagcggggtactggtgcccggcatgatccacgggtccggcgagtcggtcttctcgtcggccgaggtgtacttgccgttctccagcgccgcggcggcggtcacgatcttgaaggtggagcccggcgggtaggtctcgcgcagcgcccggttcagggtcgggtcgtccgggtcgttctccttgaggagcttgttgcgggccttgccgtccgccgcggaggtgccggcgaaggagccggggtcgtacgacgggtaggaggccagcgccaggatcttgcccgtggacggttcgagcgcgacgacggcgcccttgccgcgcttggcgagcccgtcgtacgcggccttctgcgcggccgcgttgagcgtggtgacgacgttgccgccctgcttcggcttgcccgtgatcatgtccagggtgttgcggaagaagagccggtcgtcgttgccggtgaggatcttgtcgtcgaggttctccagctgcgtggtgccgaaggcctgcgaggcgaagccggtgacgggcgcccacatggggccgttcttgtaggtccgcttgtacttcaggtcgtcgagcgcgttggtcttggtctccacggacccggtgatcggggaaccgccgacgatgatgtcgccgcgtggggtggagtagcgggcgatggtgacgcggcggttgttgtcgtcgttcttcaggctgtcggccttggcgtactggagccagttgtcgcggatgagcagcgtgaggaccagcaggccgcagaagatcgcgatccggcgcaggggcttgttcacgggcggaccacctgggtcatctcggcgtcggggttcgaggcgggc

SEQ ID NO: 636 - DNA, 2678 bp, Unknown
  Kingdom: Bacteria, Phylum: Actinobacteria, Class: Actinobacteria, Order: Streptomycetales, Family: Streptomycetaceae, Genus: Streptomyces
  misc_feature (280)..(291): n is a, c, g, or t
catcccccgccgcggattcgcccgcatcccccgccgcggatccacccgcctcgccggaaccggaaccagcaccccccgcatccgacacacccgacgcacccgacgcagaggcggcgtcggccgccgggggccgtaccagcccgctctgcagggccgccgccgacggacgcgtcgtaccggtcccgtaccgctcctgcagcgactcccgcgcgatcttctcctggagcttgaggatgccctggagcagcgcctcgggacgcggcgggcagccggggacgtnnnnnnnnnnnngcgcagcaggcgaggccgaagttgaagacccacagcgagtagcggcggccccagttcaggacgaccttcatcggctcgggggccaggcgggacagggcgccgagccgcttgggttccgggagcgcgacgggctcgggcaccgcggggttcacgtccatgccaggacgcccttcttgtatgcgtagagcaggccgacggtcaggaagccgaggaagacgaacatctccaccagcgtcgccgcgccgtagccgggggcggcgaagaccgtcgcccaggggaaaaggaagatcgagtcgacggcgaagatcacgtacaggaaggcgtagacgtagtagcggacctgggtgtgcgcccagccctcgccgacggggtcgacgccgcactcgtacgtcaggagtttctcgggcgtggggaccaccgggcgcagcagccggcccgcgccgaaggcggcggcgacgaacagcacacccacgacggcgagcagccccacgaccgagtaggagtggaagtagtccgccgcgacgacgacggcctgcccccgcgccgtctcccgcaacgtctgcgtcaccgtccgtccctcgctccctgacctgccgggccctcgtgcccgtgccgcccgtccgaccgtttgtccgaccgccggccgcgtcgcctgttcgaccgcgcgtccgaccgcgtgtccgacgatctgtacgcacgggagtctaggccctgataaagagcgggtaagcagcccgtcacaccgtgagatgcggggtggggttttcccccgctcaccagggcggccgacctcatggcgcgtccggccgccgcacggcacgctggcccgtatgaccgcacctacctcctctgccggtccggcggcgtccggcgccggggacccggcccgtacggaccctgcggacggcgatcgtctgccgccggcccgcttcgccttcggcctgcccacgtggaaggagatcactcatctcctgctgaacctccccgtgtcgctcatcggtttcgtctacgtggtgaccgtgctggtcaccggcaccgccctcaccgtcaccgtggtgggccttccgctgctggcgtccggcctcgtgggggcgcgcctgctgggccggctggagcggaagcgggcccgggcgctgctcggggtgcgcatcgacgagccgagcccgctgccgctgggccgcacgaggggggcgctcaaccggttctggctgatgctgaaggatccggtgggctggcgggctgtcctgtacgagttcatccggctgccctggggtgtcctcaccttcgccgtgacgctgacctcgctgttcgtgctgtggccggtcctgccgttcatcgcgcgggcgctgaccaacgtggaccgggcgctggtgcgcggcctgctgtcgccctccgacgagctggagcggcggatcgcggagctggagtccgaccgcggtgtcgtggtcgacacggccgccgccgacctgcggcgcatcgagcgggacctgcacgacggggcgcaggcccggctggtcaacctggccatgggcctcggtctggccaaggagaagctgctggaggacccggacgcggcggccgagatggtcgcggaggcgcacggcgaggtgaagctcgcgctgcaggagctgcgcgacctggcccgcggcatccatccggccgtcctgaccgaccggggcctggacgcggccctgtcctcggtcgcctcgcgctgcacggtgccggtgaaggtgacggccgacctgcccgcgcgcccggcggaggccatcgagggcatcgcctacttcacggtgtccgagctgctgcagaacatcagcaagcacagcggggcgcggtccgccgcggtggacgtgtggcggtccgacgaccggctgctgatccaggtgtgggacgacggccgcggcggcgcgtcgctggacggcggtacgggcatgcgggggctggcggagcggctgaacgccgtggacgggctgttcgtcgtcgactcaccgcagggcggtccgacgacggtcacggcggagcttccctggcgggaccgcacggccggctccggcgccggccaggcgccgcgcgccaagaggtagggaaaacccccggaccgagacgccgacgcgctccatggcccggccggcccgcgctccagcagtcttgagtcacggcgggacgaccgcggaaagcagcacgaagacccgcgcgaacagccgtacggacgagcagcacacgaggggaacgggacgacgcccatggccaccgagtacggatcgcagtacggacaggagtacgcgccctacggcggggccgggttccacggccgcggcggcgccggatcctacgacggtgacggtgacggcggcggccggcggcaccggctgcccgccggactgcgg

SEQ ID NO: 637 - DNA, 3971 bp, Unknown
  Kingdom: Bacteria, Phylum: Actinobacteria, Class: Actinobacteria, Order: Streptomycetales, Family: Streptomycetaceae, Genus: Streptomyces
gcccggccgggccggtcccagtacggcgatctcgatgggcgccgtgccgccgcggtcgaacttggccgcgttctccacgaggttggagacggcccgctggagcatggccggccggccgtcggtcgtcgtgtcgccgctcgcgcggaccacgatgtcgcgtccggtgcggcggcgggtgaggccggcgacgtcctcggcgatgtcggcgagatcgacgcgctgcggcggctcggtgtcggactggcccgcggcgaggtcgaccagttcgttgacgaggtcggtgagttcgcgggcctcctgggtgaggtcggcgacgagttcctcgcgggaggcgggcggcagttcgtcgatgcggcgcagcagcgagatgttggtgcgcagcgaggtcagcggggtgcgcagttcgtggccggcgtcctgcaccaggcggcgctggtcctcctcggactgggcgaggcggccgagcatgcggtcgaaggagcggccgaggcggcccacttcgtcgtagccggtgaccggcacctggacgccgagccgccgggtgcgggcgacgtcctcggcggccgaggtgaggacgaccagccggcgggtgatgcggcgggccagccaccagccgcacaggccggccgcgatgaccacgatcgccatcaggatcagggtgcgctgctggagcgcgcgcagcaggtcctcggtgtcgctgaactcctgggcgacctgcacggcgccgcggccgtcgccgagcgcgacggtggcgatgcggtacacgtcgtcggcgacgggcacgtcctggtactcgatggtcttcccggccacgtcgtcggaggcgacggcccggtcgtcgacggtgacgggcagctgcgggctgccgtggtcgacgatctggccctgcgcgccgagcacctggacgtcggtgcggctgggccggacgacctcgtggccggggcgggaggaggagaagtcctcgggcgtacggtcgtagcgccgcacctcgtcctggacgtcctggacgacctgggtgaacacggactgctggtccacgcgcaccaggcgggcggcggagttgtacgacaggatgccgacgaggacggtgacggcggcggtcaccaccgcgaacgacaccgcgaacgtggtccgcagcgacgagagcctcggccgcggtcggtccgtcagccgcgcgaggcggcccatctcagtcctcccgcagcacgtaccccacaccgcggacggtgtggatgagctgcggcgcgcccggctcgtcgagcttgcggcgcaggtagccgacgtacacggcgaggttcttggagcccggtccgaagtcgtagccccagatgcggtcgtagatggtggagtggtcgaggacgatgccggcgttgcggacgagcagttcgaggagttcgaactcggtgcgggtcagctcgacttcgcgggcgccgcgccacacccggcgggcctggaggtccatgcggatcccggccgcctcgatctgccgctcgggcagggacggcggcgccttgaccggtgcctcctcggcgacgggggcggccggttcggcgggggccgggctggtgcggcgcagcagggcgcggagccgggcgaagacctcctcgacgtcgaacggcttgacgacgtagtcgtcggctcccgcgtcgagtccggcgatccggtcggcggtctccaccagggcggtcagcatgaggatcggggtgcggtcgccctcggcgcgcagcacccggcagacctggagtccgtcgatgccgggcatcatcacgtccaggaggaggacgtccggcggggtcttgtgggcctgcgcgagcgcctcgacgccgtcggccaccgccgtcacctcgtagccctccagggtcagggcccgctccagggcatggcggatggcgcggtcgtcttcggcgagcagcacagtctgaggcacgcgaacagtctgccaaggcggggtggggtgatccgggcgcgcgggcctacgatcacctctttttacccggctctcaccgtgtcggacgcaaccggcggcaggtgcctaccgtcctctcacccaccgccggccccgtcctcgttcgtactgaggtacgacaaccccaggtagaggggcggatacgaatgcctcaggcacgcagccgggccagctgctcctcgaacgggatcacggtcagatcgtccgccgcctgtgccggtgcggcccggtgccgctgcgccgggagcccggccgtcagcgccgccagttcgcccgccgcccgttcgatccgctcgggcagtccttccgcgccccagtcctcggaggcggcgtagacgccggtggggacgacgacggcccgcaggtaggagaagaggggccgcagggcgtggtccaggaccatcgagtggcgggcggtgccgccggtggcggcgaccaggaccggcttgccggccagggcgtccttgtcgcgcgccccgagcacgtcgaagaaggacttgaacagtccgctgtacgaggccgagaacaccggggtgacgacgatcagggcgtccgccgcggtcacggcgtccagtgcggcggccagggcggggccggggaagccgctggtgaggttgtgcgcgatgtcgacggcgaggtcgcgcacctcgatcacctggacgtccgcggccgtgcgcgcggcggtcgcggcggccagccggtcgccgagcagccgggtggaggacgggacgctcagtcccgccgacacgacgacgagcttcatacggcgctcacctcctgcgaagccgatcccgcggcttcggccagcagggacgtgtgggtcggggcgtccggcacgcccgccgggcggcccttggcgaactcctcgcgcagcaccggcacgacctcctcgccgagcaggtcgagctgttcgaggaccgtcttcagcggcagcccggcgtggtccatcaggaacagctggcgctggtagtcgccggcgtactcgcggaaggacagggtcttctcgatgacctgctgcggggagcccacggtcaggggggtctggtcggtgaagtcctccagggacggcccgtggccgtacaccggcgcgttgtcgaagtacgggcggaactcgcgcaccgcgtcctgggagttcttccgcatgaacacctggccgccgaggccgacgatcgcctgctccggggtgccgtgcccgtagtgggcgtagcgggagcggtacagctcgatcatccgcttggtgtggtcggcgggccagaagatgttgttgtggaagaagccgtcaccgtagtacgcggcctgctcggcgatctccggggagcggatggagccgtgccagacgaacggcggtacgccgtccagcgggcggggcgtcgaggtgaacccctggagcggcgtgcggaacttgccctcccagttcaccacgtcctcgcgccacagccggtgcagcagggcgtagttctcgatggccaggttgatgccctcgcggatgtccttgccgaaccaggggtagaccgggccggtgttgccgcggcccatcatcaggtcgacgcggccgtccgcgagctgctggagcatcgcgaagtcctcggcgatcttcaccgggtcgttggtggtgatcagcgtggtggaggtggacaggacgaggcgctcggtgcgggcggcgatgtagccgagcatcgtggtcggcgacgacggcacgaacggcgggttgtggtgctcaccggtcgcgaagacgtccaggccgacctcctcggccttcagcgcgatggcgaccatggccttgatgcgctcgcgctcggtcggcgtccggccggtggtggggtccggcgtgacgtcaccgacgctgaagatcccgaactgcatggtcgctcaccctccaggttgttgaccgttcaactatacctgctgaacggtgcgcgacccgcgggtattccgcatgcgcggcggcgcgggcgtcgccgcgcatgcggggccgtcccggctcagccgccgcccacgccaccgg

SEQ ID NO: 638 - DNA, 7819 bp, Unknown
  Kingdom: Bacteria, Phylum: Actinobacteria, Class: Actinobacteria, Order: Streptomycetales, Family: Streptomycetaceae, Genus: Streptomyces
gacgcgcaccgccttcggtccgtacgccccgcccgctcccgcccgcgaactcaccgccgtctccgccgacggcgcccggctgcacgtcgaggtgcacggacccgagggcgcgcccgcggtcgtcctcgcgcacggctggacctgctccaccgccttctgggccgcgcagatccgcgaactcgccgccgatcaccgggtcgtcgcctacgaccagcgcggccacggacgcagcccggcgagcccggtgtgcaccgcgcgggcgctcgccgacgacctggaggccgtgctcgccgccgcgctcgcacccggcgagaaagcggtgatcgccggccactccatgggcgggatgacagtgatggcggcggccggccggcccggcttccaggagcacgccgcggccgtcgtgctgtgcagcacgggcagttcacggctggtcgaggaggcgaccgtcctgccgatgcggccgggccggctgcgcaccgggctgacccggcgggtcctcggctcccgcgcgccgctcggtcccgtcacgccgctcgcgctgcggatcctcaagtacgggacgatgggcgccggttcggcaccccacgtggtcgaggcgtgcgcacggatcgtgcacgcctgtccggcccgggtgcggcacgcctggtcccggatcttcgaggggctcgatctcgccgacggagtacggcggttgcgggtgccggccgcggtcctcgtgggcacggacgaccggctgacgccgccggtgcacgcacggacgctggccgaggcgctgccgcagtgcgcctcgctgaccgagctgcccggcatcggccacatgacccccatggaagcgcccgagcagatcaccgggaagatccgggacctcgtcaccacgtacctgagcccgcacgggcacgacagcgacaacggcagcgacaacggcagtgacagcgtcaccgacagcgaggccgcacggatcggagagggcgcatgagcaaggtcagcctggaaggacaggtcgcggtcgtcacgggcgccgcacggggcgtcggtgagctgctcgcccgcaaactgtccgcgcgcggtgccaaggtggcgctggtcggactggagccggacgcgctcaagcaggtcgcggagcggctgcacggcgagagcgcccactggtacgccgacgtcaccgaccacgaggcgatggcgcgggtcgcggccgaggtgaaggaacggttcggccgggtcgacatcgcggtcgccaacgccggggtggcgaccggcggtccgttcgccgactccgacccggagtcctggcgccgcgtgatcgaggtgaacctcgtcggctcggcggtcaccggccgcgcgttcctgcccgccctcaccgagagccggggctatctgctccagatagcctcgctcgccgcgatcaccccggcgccgatgatgacggcgtactgcgcctccaagtccggtgtggaggcgtacgcgcacagcctgcgcgccgaagtcggccaccggggcgtgcgcgtgggcgtggcgtacctgtcgtggaccgacaccgacatggtgcgcggagccgatcaggacgacgtcatgcgggagttgaggcagcgtctgccgtggccgtcgaacaagacgtacccgctgggcccggccgtggaccggatcgtggacggcatcgagcggcgctccagccatgtgtacggccagtggtggctgcgcgggatgcagggggtgcgcgggtacctgcccggggtcatcgggaccgtgggacagcgggagatgcggcggttcgcggaccggctggcgggcatgcggaccgggctcgtcggagcgggcggggcggccgacgaacagcaccggacgacctcggtcacacatcgtcactgatcgacatgcacagggtcacggcccgtgtgaatctggtcgaggtcgatcccctcacccacttggggatccccctcacacgggagtgaaacagcatgggtatgaaggacaagttccaggaccagtccgagcagtggaagcagcagggcaaggagcgcatgcaggagggccgcgagaaggccggccagggtcgtgagaaggccggccagcacgcgggccagcagcgtgagcgtgggcgtcagaacatcgaggacacccacgacgagatggaggaccgtctcaacgaggactacgaccggtaggcagcgggctgccggaagtcgttgctgagacgtggggtgccctgtgtgcggggcaccccatgttcacggcgtaactcccgcgggcgttacgtcagtcggtgcgcgggggcagcttcgggcgggccaggtcggggacgcgactgtagtccggcggggtcgcggccgggtgggagtccaggagccgcagggccagttcgatggcgtcgtccatcccgacgtgccggccctcggcccagtccagcggggtgcgcagcgcctcgacgtcgggggagacgccgtggttctccacggaccagccgtacgcgtcgaaccaggccgcgttcatcggcaccgtgatgacggtgccgtcgccgaggcggtgcctgccggtcatgccgaccacgccgccccaggtgcgctgaccgaccaccggccccagcttcagcagcttgaacgcggcggtgatcatgtccccgtcggaggaggtcgcctcgtcggcgagggccacgagcgggccccggggcgcgttcgaggtgtacgacaccggctgggcgtcccgcgtcaggtcccagcccaggatggtccgggtcagcttctcgatgacgagttcgctgatgttgccgcccgcgttgccgcgcacgtcgacgatgagcgcgggccgggacatctccatgcgcacgtcgcggttgaactgcgcccagccggagccgcccaggtccgggatgtgcaggtagccgcacttgccgtcgctcaactcacgcgtgaccgcccggcgtttggccacccagtcctggtagcgcagcggccggtcgtcgatcagcgggaccagcgcgacccggcgcgcgggaccctggcccccggcgggcgcgaaggtcagctccacggtcgtacctccggagccggccagcagcgggtagggcccggccaccggatcgaccgggcggccgtccacgtgggtcagcacggatccctcgcggatgcccgtgccggccagcggcgagcgggcgcgcgagtcggaggagtcgccgggcaggatccgccggaccacccagccggcgtcgcggcgcaccaggtcggcgccgagcagcccctgccagcgctggtagtgcgcggggccctcattgcggcgggcggcggcgacgtaggcgtgggaggtgcccagttcgccgaggacctcgcgcagcaggtcggcgaactcgtcgggcgaggcgacccgttcgaccagcggacggtactgggcgaggacgccgtcccagtcgatgccgcacatccgcggctcccagaagtacgcgcggatcagccgcccggcctcctcgtacgcctggcgccactcggcgcccgggtcgacgacgtgcatgatccggcgtacgtcgatccaggtggtggtgtcgctgtcgcccagctcggtggagggcacggcgcgcaggtcgccctcgtcgacgacgacgagccgggtgccgtcgccgctgaccgcgaaccagtcgaggtggccgacgagttcggacttcttcgccttgctgatggtgaagtactccagtgtgggcctgccggtcatgtcgtccgggttggcgaacgtctcgccgagcgcgccggagatcggccagcgcagccagaccaggccgccgcccgcgaccggggcgagcgccgagtacttggaggcgatgaccgggaacggcgtgacgcggttctccaggcccgccacctccaccgtgacggcgccgggctcgccggcctcctcgtcctccacggggtccaggccgcccgcggccggccggccctcggggttgagggcgaagggtgagggggtcgcggaggagagcgggaccaggtagggcttgcagccgagcgggaaggacaggtcgccggtgtgcacgtcgtacaccgggtcgaagccgcgccaggacaggaaggccaggtagcggccgtcccgggtgaagaccgggttctcgtcctcgaagcggccgttggtgacgtcgacgaccagccggtccttgatccgggccatcttgatctgccgcagcgtccggccgatcccgggatgcgaccaggtgagccaggcaccgtccggcgagaacgcgagatcgcgcacgggtccgttgacggaccggacgagttcggtgacgaggcggctcggtgtgcttgggggctgggcgtccgtgtcgcttgcggcgttcgggcccgaggtgccggtgccgcctgctgcggtgctccgattcggggcgtccgtgtcgcccgcggtgctcgggtccggggtgcctgtgtcgcctgcggcgccgtggcctgcggtgtccggaccggccccggtggtgtcgtcggcggcggtggcttcatcggccccggcgccgggggtcgcggtggactccgcggcctccgcggaagcacccgtaccgatctcctccgtaccgtcctcctcccggacgtccagcagcagcagccggccgtcgtgggatgccagggcgaggcgttcgccctccgggtcggagaccatctccaggacccggcccagttcgccggaggcgagccggcggggtgggcgggcgccggaggcgcggggcaggtgggcgatctccacggcgtcgtcgccgtccgcgtcggtgacgtaggcgatccggccgctctcgccgagcatctccggcagccggacgcggaccccgggcgtgtcggtgagggtgcgcgcggggccgtcgcggtgcgtgagccagtacagggagccgcggacgacgaccgcgctggcccggccggtctcgtcgacggagaggccgtccaggttctgggcggcgggcaccgggtagcggcggcggccggcgcgcggcccgctgagccggacgtccagccggtgcgggaccgagtccggggcgaggtcgtccaccatccacagctcgcccgcgcactggtacaccacccgcgcgccgtcgctggaggcgtggcgggcgtagaaggcgtcgtggtcggtgtgccgacgcaggtcggtgccgtcgtacgcgcaggagtagaggttgccgacgccctcgtggtcggagaggaaggcgatccggccgccgacgaacatcgggcaggccaggtggccgccgatgtcgggcagcagccgctgtccgtgcagccagagccggcccgtcgccccgccccggtagcgcttccaggaggcgggctcgtgcggcggggtgccggtcagcagcaggctcttgcgctcgccgccgatctcggcggcctggaggtcggagaccggcccccagggcagtttgcggccgggcgagccgtcggtggcgaccttgtaggcccaggtgaagtaggagaacggctcgccgtgcgaggtgacggcgaggatctcgctgtgcccgtcctcctcgggcggcgtccagccgcacacccgggtgtcggagctgccccagtacgtcagctggcggcccggaccgccgtccaccgggacgaggtggatctccggcgcgagactgcgccaggtggtgtaggcgatgtggcggccgtcgggggagaagcgggggtggccggtcttggtgcggtcgacggtgagccgccaggcgcggtccgggccgtcgagcggtgccagccagaggtcgtcctcggccacgaagcacagcagatcgccgctgaggtgcggcaggcgcagatagctcacctcctcaatgcttcgccgggggacgggcggcagcaaccggagcacctgatgcggccccccgacggaagccctgtgcggacccggcaggacccttgtgcggactcggcaggagccttatgcggacccgacttatacggacccgacaggagtgaccgagagcacgtacgaaacggtttcgtttcgatgatggcgtgcgctacattcatgtcgtacgaaaacgaaaccgtgtcgtgcggagcgggaggcggacgggatgaccgagatggcggcagcgcgccggagccggatcacgcccgaacgtgaggccgagctgtacgaagccgtgctcgacctgcttcgcgaggtcggctacgacgccctcaccatggacgcagtggccgcccgcacccgttccagcaaggccacgctctaccgccagtggggcggcaaggccgaactggtcgtccgcgccgtcaggcacggcaagcccgggaagccggagagcatcgacaccggatcgctccgcggcgacctgcaccggctgaccagccgcgaggacgactgcaccatggagcagaactccgcgctgatgcggggcctggccatggcgatgcactccaacgcggacctcagacaggccttccgggagcagctcatcgaaccggagatggccgagttccgcagactgctgcagcgcgccgtcgaccggggcgaggtccgcgcggactgtccggcgctcgacttcgtggtgcacatgctggccggcggcttcgtcgtccgggcactgatcgagggccagccaccgacccgggccttcgtgcggttcgtacatcgatgccgtggtgctccccgccctcggcgtccccgtcacctcctgacgcccctccccggcgcccacaccttccccagcaagcccaccctctgacgtcaccgctcacgtcgtcgggctgatgacccctgccctgatccacccccacgacctgaccgggagtacgcccacgtggccacgttcctgtacaaactaggacgcctcgccttcaggcgacggcacttcgtcgcgctgatatgggtggcgctgctgacgctcgccggcgtcggcgccgcctccgcgccccccgcgggcaacacctccttctccatcccgggcaccgaggcgcagaaggccttcgacctgctggaacagcgcttccccggggcgagcgccgacggcgcgaccgcccgggtggtcttcaaggcgcccggcgggcagaagatgacggacgccggcaacaaggcgaccgtcgagaagaccgtcaaggagctgtccgacggctccgaggtcgcctccgtcgccgacccctacaccgggcacgccgtcagcaaggacggcaccgtcgcctacacctcggtgaagtacaaggtctccggcatggagctggaggactcctcccgcaccgcgctgaaggacgccgcgcagcacgcgcgggacgccgggctgaccgtggagatcggcggtgacgcgctcagcgccgcgcccgagaccggcgccaccgaggtcatcggcatcgccatcgcggccgtcgtcctcgtcatcaccttcggttcgctgctggccgccgggctgccgctgctgaccgcgctcatcggcgtcggcatcggcgtctccacggtctccgccctcgcgtacgccctcgacctgggctccaccacctcgatcctggcctcgatgatcggcctcgccgtcggcatcgactacgccctgttcatcgtctcccgctaccgcggcgaactggccgagggccactcccgcgaggaggcggcgggccgggccaccggcaccgcgggctccgcggtggtcttcgccggactcaccgtcgtcatcgccctggtcggcctgtccgtcgtcaacatcccgatgctgacgaagatgggcatcgccgcggccggcacggtcgtcatcgccgtcctcatcgcgctcaccatgatcccggcactgctcggctacgccggccgcaaggtcaagccggccggtacgaagagcaggctgctgggcggcggccgggccgcgaagaagccggcc

SEQ ID NO: 639 - DNA, 8038 bp, Unknown
  Kingdom: Bacteria, Phylum: Actinobacteria, Class: Actinobacteria, Order: Streptomycetales, Family: Streptomycetaceae, Genus: Streptomyces
gggacgggggtgtgcacggagcggagcggtgggccgacgggccgctgaacccgtcggccgagctgcccgggcaagcaggtcagcggcggggttcgccgaacacctgagggtactcggcgaccttcttcgcccagtcgtcgtcgtagcggacgcggaccacctcccagccgaagtccttcagccgttcctccgcctcctcgtcgcgcagcacgatgtcgtcgtggtcgtggtgcggaccgtcgacgaagaccgcgatcgggccgaagccggtgtcgtacacgaagtccggcttggacagggcctcacgcaccgttatctgctggtggtccgggagccggtgtccgtgcgacctcaggtattcgacgaagcgctcctccagggtcgagtcggccccctgccgcagcgcgtcggcgtgctcgtcgcgcgagcggcccggggtgctggcgccgacggtgccctccgcgaaggcttcgaggagtccgtgcaccagctggcggtcgatgacgcggtggtggcgctggttgccgaaggagagcagacagtcgtagcagcccttctcgcaggagtcgccgttgctcttctcgtctccccggtcccggcccagctggtcgaagtgggcgatctccagggccttgcccgcggcacgggccagagcgccgggctcggcctgcagacgcctgaggacacccgcgccgccctcggcgctctcgatgaacagcagccgctcccgcggcccgtcgtacggcggcagctcctctgtgtcgagttcggcgtcctccagctggaactccgcctcgatgccacgctccagggcgtactggagggtgacggcagtgtcccggtcgaccggctcggccaactgcaggacgagaatgttccgggtgtcctggacatacgggatcaccggcatcttgcggttcgccttctcggcgtccgcgagcccttcctgctcctggggggtctcccggccgcccttcttggccgcgccgcccgcgagccactcgcccgtcaccgggtccatccagaagccgatctcgcccttggcgacggagcggcggtagccgaggttggtgagccggacggttgcgctgtcgccgtaggccagctcggcgagggcgcggccggacgcggtctgcgccatggcccgcagtgatccgtcgcggccgtcctcgtgcttcttgaagcggtaggagatctccaccttgtagccggtgcgctgacgctcctcctcgtcggaggagatccggtcgcggcggtgcgtgaacacggtgtgcaggtgcagcagaccggtccgcgcgtcaccgagtccgctgccgcagcctccgcagacgtcctcgcgctgctcctccggggacagatagccgcagcgcccgcagaccttcgcgctctcggtggtcagctcgcccgcggtgtccggcggcagctgcacccggtccaccttgtaacggctgccctcgtggtagatcagggcgccgggcccgaactcccggatcgcgatgaaccgggagcgctggagatagtcgccgtcgtagccgccgcggctggtacggccggtacccgggatgtaggcggcgagcggcagccgggggaaggagtagcccggcaggaatccctcggaggcgaagtagcggtacgggaagaagtccgacatcacggtccgctcgccgccctgctcgttgcgcagcagcgcgagctggctctcggcctgggcgcggcggcgcttggcctggtccttggagcggcccgtggtggtgcggttgagaatgttgcggtgctggatctctcgctcttcgagggcccgccggaagaggttgcgccagcgttcgcaggccctgcggaagctgcccggcgcggcttcgacggtctgctccagccaccgctcgtgccaccaggacgtgccacgcagcaggtcgccgcagccgtccaggacggtacgggcccgtgccagggcgcgccgccgggcagccggctcgtcgatggctgcggccaccgacgacgccagttccagcgaggggtggtcaccgtcggactcgatcagcctggccatgctgctgcccaggtcgagccgggtctcggccagccagatcgcgtgcacgtgggaggcgagcaggtcctcgttggccaggtcgagccggggcggggcgacggcaccggacaccatctgtgcacgccgggcgaagtagtactggtcgtggctgttgccggtcgcgcagtacgtggtgacgagcgcgggctgcccactgcgtccggcgcggcccgagcgctgtgcgtagttggcgggggtcggcggcacgttgcgcaggttgaccgcgttcaggctcttgatgtcgacgccgagttccatcgtcggcgagcagtacaggaggggaagccgggtgccctcgccgaacaggtcctcgcgttcctggcggacgtcggggtggacctgcgccgtgtgctcggcggcgtgcagaccggcgaaggtggcggcgatgtcctggtagagccgcttgaagaaggcgttgacgcgggggccgcgctcgtcgcggtaggtgcggcgcagccggtccacggcgccgtggtcgtcgtcacgggcgtgccagcggatgaccgtgtggttgatccggtagccgggctcctcgccccgcccctgggaaacctcggtcaggaccccgccgtcggccaggacccggagcaggtcgcggatgacgtcctgggcctcgtccagggacagtccctgtccccagttcgggaaggtgccgctcttgcggacgtggcggccgaacgcgccacggccggtgaggttcagctcgctgcgaccgcgcccggtacggcccgggcgtccggctcgggcgacggccacaccggccggaggcggtgccgcctccgtgtcggcgatcccccacgcgtcgttcagcctggccgactccttacggagttcggcgaacttggcctcggtgaagtagggcgtgtccacggcgcgctggcggcgcagctcgtccatgaggaccgtggacagccgatggcgcacctcgggggtggccgtgcgcagcgggtccgcggtcccccgccaccggtcctcctcgccggcgatcgcctccagacccgcgtactccaggccgagcagcccggtctgctccaggttgggcatggtgacgcgccagccgcgttccaggtcgaggaagaggcggtactcggcgatcgccgccagcgcctccagcgtgctctcggccagctcctcgatctccgtgggcttggccgcgtactcgtgcggggagagccccatcgccgccaccacctcttcgccgagccgcttccatcgcagccccttgttgccggccgcgaccatggcccggtagagggcgccgcgaagctgcgtcaccatgacgaagtcgttgaagtgccccgactgcaggctcgcgtcctgccggttgtcgacgaaggtgagcagcttcctcgcgtccggcttgagttccccctcggggatgctcttcaggtgacgcacgatcgaggcgctgatgacggaggtggccgtcgagcggccctcctggtcgagggtcatcagcttggcgaaatcccgctccttgacctgctcgtacccgacgccgcactccaggcagaagaggaacggggccggcagatacgccgcgtagaccccgccgttcgccttccccccggcggtgccgtccggtcgcacccacaccggctgcggtgcccgcttcctgcggctcgcggtgagcaccggggcgcccttgcgctcgtcgaaggtgagccagctgtcggggaagcggcgctgctcgatggcgtcgccgacctgttccggccacgggttggcggccgagatgtacagatacccctgttcgtcgtcctcgtcctcgcgcgtacggaaggcgatactgccgtcaccgccctggtcgcgggccaccatcaggtactcctggccgcattcgcggcagaaggacagcggcagcagcagcttctcgggggcacccgggacacgctgctggtaggtgcgggtgatgtgacggtcggcctctccctccagggagacgtagacggacccgcccttggacaggaactggtgcagcctgaaggcgaacagcggacggtcgtcttcctcgctgcgggcggccgctccggcctggagggtggcccggatggcctccgcgcacgcctcgtaccagcgcttctccggatcggtctcctcgatgccgaacgcctcggagcgcaggcgcagagcggcggtctccacggtgaccggttcggcgcggaccaggagcttgctgccgtcctcgtcctcggcctcgaccaggccgaaggtggtctcgatccagcgggccagcggatcggcggccagccgcccgtactcggccggcgggttgttctcccgtacccgcgtcgcgagttcggacggcgtgggcacggcgtccccggtcgcccgcaccagggtctcgccgaccacccgctccggggagatctccgtgtcgaagagggtggaggcgacccgggcgacctcacggcggcgcgcggcgggcgtgccgccggtggccatcgtcgcggacgtacccacgcactgcaggccgggtgactcgcatgcctcgcgtacgcgccgcaccagcacggcgacgtcggcgccctgccgcccccggtaggtgtgcagctcgtcgaggacgaggaagcgcagccccttggccgccccgatgagcttctcgcgctccttgggccgggtgagcatcagctccagcatcacgtagttggtgagcaggatgtccggcttgcgctcgcggatggcctccttctcgtcctctttctcctgaccggtgtagcgggcataggtgaccggctcgttcccctcgccgtatccggcggtgaggaacttcgccagctcccgttcctggctgttggcgagggcgttcatggggtagacgatgatcgccttgatgccgggcgcggcaccggcctccttctcccgcagcacccggtcgacgatcggcacgatgtagccgagactcttgccggaaccggtgccggtggtcaggacgtacgagtccctggagtcggccgccttgatcgcctccagttggtgccggtggaagtggatcgggcgaacggtggcgccccgctcgtccttgcccgtacggaagatgtccgcacacgccgggtggagcagtccttccggccgtgcgagatcctcgaccgaaccgccgggcgcgaagctcgggttgagggagaggtaggggttgggccactggtctccgtcggcgagcgacttcgacaccttggcgtcgatgcgccggtcgtcgatcaccacggacccggacgtgtactccttgtagtcccggatgagccgctggtgcaccttgaagacgtccacgtgttccccacttgttcccgaggcggtccggagcaacggtagccacccgtcggccgcggtgcgccacactccccttgatcgtacgccgcacatcacagcatgtgattgtgaactcagtcaatagacatgcacctcaagcaagtgggttcacgaaacaacgtgctcatgccacactctgtgcgaggcgcccgccaggcggacgcgtcgggacacggagacggacgcggacggagtcgccccgcacatggacatcggacctgtgatcgccaagcgttaccggatcaagcaacggatcggatccggtggcatgggagtcgtctggctcgcccacgacgaacacctcggccgcgatgtcgcactcaagaccatgaacacaacaccgggcctgacacaggaccagcgcacacgggacgccgagcgcttccgacgtgaagcccgcgccgccgcacgcctcgaccacaccggcatcgccaccgtctacgacctcggcgaggaacggggcacacggttcctggtcatgcagtacgtgaccggcatcgaccttgaggaccggatcgccgaacaggagcagctgagcatcgaggaagcagcttcgatcggggtccagatcgcctccgtcctcgcctccgtgcacgtgcgtgacgtcgttcaccgcgacctgaagggccgtaacgtcatcatccgtaacgacggcgtggtcaaggtcctcgacttcggtgtcgccgccttcctcgaacccggcaccgccaggctcaccaccacgggcgagcggccgggcagcctggaatgcatggcacccgaacagatcctgggcaaaccggtcgaccagcgcaccgacctgtacgcgctcggctgcctgctccacaagatgctgaccggcgaacccgtcttcgagcaccgctcggaactcatgctccccggcctgatcctcgaccacccgccgatccccctgcgcgacctgcgccccgatacccccgagggcctggaagccctcgtactcgaactcctcgccaagacaccggacgaccgcccgccccacgccggcgaggtctggcgacggctcgccccctggctccccgaacgcggcgacccggtgaccgcactcaccccttgggccgaagtcgatccgctgcgccccttccggcacccgatggggccggaagcgcgcccggtccgcgcctgggcgggaacgccgcgaccatgatgacaggtgacgagaagtcaaaaagtccagcacctgtccagcacggtaaaagtcgcggggcctgaccccgaagggtcagaccccatttgacctatgtatccgccagatcagcgaagtggttgtacgtcacccgctacacattgaaccggaactccaccacatccccgtcctgcatcacatagtccttgccctccatgcgcgccttgcccttcgcgcgggcctcggcgaccgagcccgtctcgagcaggtcgtggaaggagatgacctccgccttgatgaagcccttctggaagtcggtgtggatgacaccggcggcctcgggggcggtggcgcccttcttgatggtccaggcgcgggactccttggggccggccgtcaggtaggtctgcaggccgagggtgtcgaagccgacgcgggcgagggtggccaggcccggctcgtgctggccgacggactccaggagttccagtgcctcctcctcgtccagctcggcgaggtccgcctccagcttggcgttgaggaagatcgcctcggcgggggcgaccagggcgcgctgctcgttcttgaagtcctcgtcggtcagttcgtcctcgtcgacgttgaagacgtagaggaagggcttggtggtgagcaggtggaggtcgtgcagcagctccgcgcgctcggtgccctggaggatgccctgggagaagagcgtgtcgcccttctccaggatcgcctgggcctcctcgacggccttgaccttcggcgccacgtccttcttgatccgcgactccttctggaggcgcgggaggaccttctcgatggtctggaggtcggcgaggatcagctcggtgttgatcgtctcgatatcgtccttcggcgagaccttgccgtcgacgtgcacgacgttctcgtccttgaaggcacggatgacctggcagatcgcgtccgactcgcggatgttcgcgaggaacttgttgcccaggccctcgccctcgctggcaccgcgcacgatgccggcgatgtcgacgaagtcgaccgtggccgggaggatccgctccgacttgaagatcgaggcgagctgggcgaggcgaccgtccgggacacccacgacaccgacgttgggctcgatcgtggcgaacgggtagttggccgcgagcacgtcgttcttggtcagggcgttgaacagggtcgacttgccgacgttcggcagaccgacgattccgatcgtgagcgacacgttgcgacttcccgtacgtgaggagactgggggccagggggccgatccaccagtctacggcgtagcggcgtcccgtcctcacgacggttcgaacgcctggccagccacagaccaccacaggaccgccacgccgcgcggcgtgtcaaacggcctattcaacacataaacagacctaggttggtccagtggagcaacacgggaggcgacctcagcagcacggaccgcgacgcggcggcaggccgccgcgtcgcggtccgtg

SEQ ID NO: 640 - DNA, 4184 bp, Unknown
  Kingdom: Bacteria, Phylum: Actinobacteria, Class: Actinobacteria, Order: Streptomycetales, Family: Streptomycetaceae, Genus: Streptomyces
gtgccgcgccgcgcgctactcctcgtccgacgtggtgccgcgggtgcgtcccacctcgggcagttcggcctcctgcatgcggatgtgcaggacgtcgccgatgaacaggtcgtagaccaggactccgaccacgccgccgacgagcggcccgacgatggggacccaccagtaggcgctgaacgagcccggttcgctgcccggcagcgccaggtctccccagcccgcgaagaacgtgaacagcctggggccgaagtcacgggccgggttgatggcgtacccggcgttcgcgccgtaggacatgccgacggccgccacggcgaggccgatgacgagcggtccgaggttcgccttcaccgcggtgttgcgcaggtcgacgacggccacgatcagcatgaccagcagggcggtgccgacgatctggtccaccagcggtccccagtagccgccgtggaagtacggcgccgggaacgtggcgaagatggagaaggacgcgacggtgtgcccgtccgtcttcggtcccttcatggcctggtcgaaggtgttgatggcgtcgtggtagaccccgtacaccagggccgcgccggcgaaggcgccgaccacctgtgagatccagtacggcaccaccttcgcccaggggaacttgcgccgcaccgcgaacgcgagcgtcaccgccgggttgatgtgcgcgccgctgatgccaccggccacgtagacgccgaaggccacggcgaacgcccagccccaggcgatgagcagccagtcaccggcgcccaggaagaaggtcgtgggtccctcggtccggcccgaacccggcagcgccgcgaccgtcatggcgaccgagccgcagccgaaggcgatgaggacgagggtccccaggaattcagccaggcattcgccccacagccccccacggctcctcaagcgcgcaggtgagatcaggggtgggatttctacggccatatcggccccctcgacgaacggtccggcctgtgcgccggtacggtcctgcttcgggcggccccgcgttactgcccagtcgcggccccgcgtctcagctcagtctgcgcgccaggacccgagtgggccactcggccggtccccggccctcgaaaacaccctccgaagtccccgaacacaggtcaagagtgaactccatacgggtgatcccttcagggggcccgcaatgcccgggaacgcgaaaacagcagtacgtcggccgctccgccgtgaatcggcctgtccggcccgagtggcacccccgctgacaccgcacaagactgctctatggtttcgtgatcaggcgaaaacgcacggtctcggggaccggccaccctggccgatggttttcgacctttctcagggagttcgcatggtggagaagtctgccgacatcctgatgcccgggccggacggatccgccgtcgcccgacgcgcagacgccggggcgacggcgggcgacaccgaaagcccggcggcgacggacaccgagcgggtgctcgcgggcatcctggcggacgtcgtgcacaccgagcaggtgccggccgagagccacttcttcaccgacctcggcgccaactccctggtcatggcccagttctgcgcacgagtgcggaagcacccggacctgccgtccgtgtccatgaaggacatctaccggcaccccaccctccgcgccctggcgaccgctctcgcgcccgccaccgccgcggccgctgccgaccccggcacagtgaccgaacagccaccggcacccacgcctgacacggccgttgccgctcctgcccctgctccgcctccggcgcgcaccgcacggcccgggcgggccgaccacgtggtgtgcggagcacttcaggcgctgattttcctcgcctattcgttcgtcatcggcatggccaccgcacagggctacgaatgggtcgcggcgggatcggggctggcccagatctacgtgcgctcgttcctgtgcggcacgatcggattcgtcggtctgtgcgccgttcccgttctcgtgaaatgggttctcgtcggccgctggaaaccccgggagtttcccgtctggagcatggcgtatctgcgtttctgggtcgtcaagtcactgctccacgccaatcccatggtgctgttcgtcggcaatcctctgtacgtcatgtatctgcgggcgctgggcgcacggatcggaaaggacgtcacgatcctctcccggtccgtgccggtctgcaccgacctgctcaccatcggagccggcacggtgatccgcaacgacgccctgttcctgggctaccgggcgtacgccggagccatccagaccggcggcatcaccttgggccgggacgtcttcatcggcgagaagacggttctcgacatcgacaccgccatgggcgacgcggcgcagctcggccatgcctcggccctgtaccgggggcagcggatcccggccggcgagcggcggcacgggtcaccggcccagcccacgcacgtcgatcacgtacgggtcccgccggcccggtgcggcacgctgcgccgcgccggcttcgcgctcagcacgctgctgcagttgttcctcctctacctgccgctcgcggtgggcggtgtgtacatgctgttcgcagaggtcccggtgctcagcaaacgcctggacgcggagacccggggcatcacggccggcgagttcctcggcgacaccctggtcgtgtccgcggtgctgttcttcggcggcgccctgctcggtctgctcgccctgtgcaccgtgccgcgggtgctgcgcctcgcggtcaggcccgaccgggtctacccgctctacggcttccactacgccgtgcaccggctgatcgcgagcctgaccaacgtccggttcttcacctggctgttcggcgacagctcctacatcgtcccgtacctgcgcggcatcgggtacgacctctcccgggtggagcagaccggttcgaacttcggcaccgaggtgcagcaccagtcaccgttcctggtgtccgtcggcagcggcacgatggtggccgacggcctgtcgatcctgaacgccgactactccagtacgtccttcaggatgagccgcgcctcgatcggcgcgcgcaacttcctcggcaacaacatcgcctacccggccggtgcgaggacgggtgacaactgcctgctggcgacgaaggtgatggtccccctcgacggcgagatccgcgagggcgtcgggctgctcggctcaccgtgcttcgagattccgaggacggtcgagcgcgactcccggttcgaccacctgcgcaccggcgacgcactgcgccgcagcctggccgcgaagaatcgttacaacctgcgctccatggccctgcacctgctgatgcgctggctgcacacggcgctgctcaccgccttcggtctcgcctcggtcggtctgtacggcacgctgggacacatcgtgatcggcgcctacctggcgctcaccgtggtcttcaccgccgcgtactacgtcctgctcgagcgctgcctgaccaggttccgcgcgctgcgcccgatgctgtgctccatctacgagccgtacttctggtggcacgagcgggtgtggaaggtgccggaccggtacctggccgtgttcaacggcacgccgttcaagagcctcatctggcggctgtcgggggtgcggatcggccgccgggtcttcgacgacggctgcttcatcaccgagcggacactgaccgccatcggggacgactgcaccctcaacgccggcagcaagatccagtgccattcgcaggaggacggcaccttcaagtccgaccgcaccacgctcggcgcgggcgtcacgctcggcgtctccgcgcacgtccactacggcgtgacgctcggcgactcggccgtgctggcacccgactcctttctgatgaagggcgaggaagtcccgccggacgcggagtgggaaggaaaccccgccgctcccgcggcgaactgagggagggtcattcgatgggaacgctcgtggcagcggacagggacttctggaccgatgtgctgaccgccggtgggttcaccgccgtcccgcggtgggcgccgcggccccttccgggcgtggccgggcacgaggagaccgtcccggcccaggtggccgaggcggtacgcgcgctcgccgcggaactgggcgtgccggtgagcgcggtcctgctggccgcccacgccaaggt

SEQ ID NO: 641 - DNA, 5981 bp, Unknown
  Kingdom: Bacteria, Phylum: Actinobacteria, Class: Actinobacteria, Order: Streptomycetales, Family: Streptomycetaceae, Genus: Streptomyces
acgctcacgcgggagccctgagacatcagggctcccgcgtgagcgtgtgcgtggcgtcaacgtgtcgtattcggtgtccggtaccgggaactggagttctgcggcatgcgccctactggcgcgaggcgagggcggcaggacaagatcttctttccggcggctccggccggttggaaccggtactggaaccggtacgagtggcggggtcgatgcaggaccgcaggacgagaggagcgccatgttcgagaccgctggtctcgactccgtggaagtacgggcctaccgcagtctgatcaggatgtcggaggccacgccgtcccagctcgcccgcagcctggggttgtccgggcgggatgcggccgtgctcctcgacacgctggaggcgaagggactggtgagccgcgccgcgggttcggcgcaccgcttccgcgcgtctgcgccggacctggcgctcggccccgtgttgctgagtcggcaacaggaactgcaggccgcgcagtccgtggtcgagaagctcaccgaggaataccgcagtgaggtccggcgccggggcccgggcgagacggtcgagaccgtcaccggggcgcaggcgatggcccggacgttcgagcagctccagcgcggcgcacgcgaggagatcctggcgctgtgcaaaccgccgaacgtggcggtgccctcccggggcaacgacaccgaactggaggtcctggcctccggggtgcggtaccgggtggtctacgagaggtcggcgctggaggtgccgcccgaggtgtaccggatccgcgagttcgtcgggcgtggagaacaggcgcgggtcgccgtggaggtcccggtgaagatggtggtcgcggaccgggagctggccatgctggtgtctccttccgcaccggctttcagtgtggacagcccgcccgacgccccgccggccgaaccgtccgcaggtccgtcggctcagccatcggccgccccgccggctcaaccgcccggcggtccgtgggccgccgccccgtcggccggtccccgggccgggtggtccgctgagccgtcggccgagtcgtccgccgtcctggtccgccccggcgcgctgctcgacgctctcgtcgcgttcttcgagagcctgtgggacggcgcctccccgctggtgctgaccgaggacgggctggtcggcgagacggagtccgaccggatacctccgccggaggacctgctcctgctgtccctgctgctcaccgggctgacggacgccgcggtcgccggccagttgggcacgagcctgcgtaccgtccagcgccgtatccgtgacctgatcgagttcgccggggtccagacccggatgcagctggcctgggaggccgcccgccgcagatggctgtgacgaccggcggacggcacacacgagggaccggacccggtcgcccggggcaggtccctcgcggagccgtacgggggtgacggtgccgaaggctccgtcacccctgccggatcagtgctcgaacacctggaactccgaggcccgcacgttgaacgccgccgtggaaccggtggcgcagtcggtcacgttgttcgggtcgttgtcctgctcgcccgcgaacgccgggccgccgacgcactggttggtgacggtctcgaagcgcaggtcggtcgcggtggtcagcgggatgtcgaagccgcgcatcgtcaggtccggcgccgccggacgcggcttggccgccgcgaaggcgtccgccggactggtgtagaccggcttgaactgcccgggctgggaacagtcgacggactcggtgcgggtgcaggccgcgatccggaactggcgcagggccgagaagcggctctggctgccggtgtcgccgcccgggtccttgctgtcggtcggccggttcagggcgctgacctggacacggcggatcttgctcgggccgtcgccggccaggtggacgctgacgcccttgccggccaccgacgtcctggtcttgtcgccgacgaacgcccagttggtgccctcgtcgtcgtcgatgaggcgggccaggttcagtccgtcgccggtgatggtggcgccggccgccgccgaggccaggttgcgctccatgtgcaccggtatggtccgctgggacgttccgccgacctggaagtcgaaccgcaccagtccgtggcccggggctgtcgcgaccgcgtcgtagcggccgggggtgaggcgcgcggtggcatcgaggccggaggccgtgccggcgaccggcgtggtgcgggcgctgaagtggccgatgtagaccttggcgccgtcgatcgccttgccgccgccgtcggtgaacttgaaggtcaccgtgccgttcttgccgttcggggtggagaagtccgcgtgcggccgggtgtcgctcgtcgaggtggcggtggcgccgatgccgaggccgcgctgggcgaacgccgcccacatgacgtccaggtcggcgccgccgaagcggacccggtccgcggcgagcatcgcgtcccgcgcgtcgaccatggtgatcctgccgtcggccatcagcagataggagtcgaacatcagctggatccagcggcggccgccgccgcagtcctccaccgcggacttgccggccgcgcacgaggcgaggaccttcttggacggctcgccgtacttgccgacgagcgcctggcgcacctcgtactgcacggcgttccagatctcgccgtcggagtgcacctccgctccgctcatgtcgtagccgaagttggagtagttgagcgggctgcggtcgatggcgaagttgcggatgccgcgctcgttgttgtcggtcacgtacgggccgaccacccacgggtccaccccgtccgggaccgcgccggtctcgatcagccgctcgctggcgaccagatcgctccaggactcgcccatcgagccgccgtgggttccggagataccggcgtcggggccgccgatcatgcggttggtgatggcgtgggtgtactcgtggccgatgacggaggcgtcgaagtcgccgtcggcgcagcgtccgtagaaggcgccggcctgcggctgccacaggtacatgttcgtcagcgccacgccgccgtcggcgccggtgctctggttggcgttgttgcgggtgctggggttgctgccgccggaccgggcgacgcccatctccgggtcgccgcccttgccgcccagggcgtaggtgtcgtgctgcatgttccacgccttctcggtgaacccgaggtggtacgagaagtcgtgcataccgttgtgctgggcgaacaggttgccgatcgcggcgtcccggtccggctgggccgggtcggtcagcaccttggggtcgcagccgctggcgtgccaggcgtcggtgtaggagtaggcgtaggcccggtcgggccgcacgttcggggtgatgccgagccagttgcgcccggtggccgtcaggccgtcactggcgaaggcgttggcgcccagcgtggtgcccggcttgtagtaaccgccgtacgtgccaccgcccttgccggaggcgatgtcccagggctggtgcggtgtgcccggcgcctcgtcgcctaccacccggtcgcagcccggggccgccgtccagcaccaggtctcccgggtgtcggcggaggagtcgttcagcgggggcgagaaggggaacgccttccaccgcgggttgccgtcctcggccccgtcgaccacctgctcggactccaccagggagcgccgggccagcacctcgccggtgcgcgcgtcgacgatgctgtcgtacagctccggctcctcgccggcggtgcccgcctgcacctggtaggcggagcgcaccgtgccgtcggtgtcggcgacgaccaccgggcggaccatctgggtgccgtccaggtccgcggcctcgtacttctgccacttcccggtgcccgcggtctcggtcagaccgcccggcgacatggccacgtcggccagggcggccttgacggcgtcctgctccgacagcgtcgcgggctgcggggtgccggtgaccggggcgagtgcgccggtgacgctgaccacggtgccgtcgaccacgcccacggagaccaggccgtcccggccgagcggcctgccgtccacctcctgggcgagcagcaccgccgcgcccttgccgatcggtgtgttcgacaccagcttcaggtcgtcgacctggccgggggagatgccgaacagggccgcgttgtccttgaggtaggcgcgggcggcctgttcgggtgcggccggcagtccggtcgccagtgtggtgcccgcgccgtccggcacgaccgtggccggggtgccgtagcggctccagcgcacccgggcgtcggcctcggccgccgcgcccttggccttggccgacggggctctgtgtgtcccgggcaggtccttgtcgggcttgccgtggtcgcgggcaccgagcatgcccgagccggagtccgacgatcgtgactgcaccgggcccgggtccgcaccggcggacggggtctggatgaccgcgacgatgcaggctgtggccagcgccaggacgctgtgccgcacacgtctggagcgtgtggagtgtgtgcgcactcgtacccctctcctcgtgaaggaccggacgggacgacccgtccgggtccgcggagactggcacgtgacgcgttgccacaggaatggccctgcgtggcggaaacgcgacactgcacggttccgccagaggccgctgccgggcgcggtcggcccggccggcgaaggaggcttcacgacgaccgggccggcagcgcggcgatcgtctcgtcttcgactcgacggcgcgaagggtgtgcggcatcgcccgggccgcgtccgcgatgacgaactcgttcctcgcaccggtatgggctcgccgggagggagatcggcgatccgccgcaccgccccggcccgggcgcgtgggcgacctcgcggcccgcgtcgcggccacggccagtggcagggcgccgatcgaggcgggctggtcgaccgcgacgcatacggtgccgtgcttcgcggtcagcttcagcgcacacctcgcggcgcctgggttcgctgtcgggcagccgcttgtggagggctctcttcccggctgcggtcagcgcggtggtgtggactgcgcccctccggcgtccggggacggccgccgcacggacgtgctcgcgagccggtccgtacggcgtacgccctctgccgactacgcctggggcttggggagttcacatcccttgcggcccaggtcgagcttgctgccgtcgacgacgcacggcacgattccgtaggtctcctgcgcgtagttcgtgccctggcggacggtgatgcggcccttgcggtcgatctcacaggggttgttgagcgtgcactgctcgccgtcctcgttaccggtgttgttgacggcgaccacgcgtccggtgtggtcgtcgatcaccggggagccggaggtgccgccgatggtctggcacgcgggcgtgtagcgcaccgagtccttccaggtccaccagtactccttgagctggtccacgaacccgtcgacggagcacttgtactgcttcttccagtaccccgacgtcacggtgatctcggtgttcttgcgcgggtggcgcgggtcgagcagcagtggccgtacgtggtacttgctctcgatctcggcgtaggtggtggtcgtccggtacagcgagatgtcggtgtcggtcatcgtcgcgtacgagatctggtcggcctggagcgtgccgagtaccgcggcgtcctcgtcgaggagcttgaacgtgcgggtggacggctggtccacgatgacctggccggccttcgggaagccgctctcgatgcagtgcccgttggacagcacgagggcggggtcgtcgggctgggactgcggggtacgcacgacggagccggaacagttgctgagcgcgacggtgccggcgaacgtgacgggcgcgtcgttcggtctcgcgcgcgtgccggcgtccccgcccgcggtcccggcgacggcgggtgccgcgcccacgcc

SEQ ID NO: 642 - DNA, 2850 bp, Unknown
  Kingdom: Bacteria, Phylum: Actinobacteria, Class: Actinobacteria, Order: Streptomycetales, Family: Streptomycetaceae, Genus: Streptomyces
ggccgccgcacctcccagacgccgacccggtagccgcggggcaccggcacggcgtacggctcggtcaccgttccaccgggccgggcgcggccggctgcccggccgcccggaccgtccgcggcggcggcgcggtcagcaccgccaggtcgtcctcgcgcaccaggtcgaagcggagcgcgagcgagacgagcgactccttcttgccgttgagccgcggaccggtctcggcggtctccggaccgggcttgagccgcagcttcacggccaggtagtcgatgttccactgcaccgaggtgcgggacgcggcgggccagctgggccgcagccgctccacgacctggtcgacggtgggcagtggcgcgtgcggatcgccgcgcagccgcggctcgcacagggcggcgagcacggcgaagtagcgcttggcgcggtcgaccgagaaggcgggcgcggtgggttcgccgtccggtccgtccggcccggccaggtagtcgtgccggggcgcccacacctcgatgggcagcaggtcaccggcggcgggcagcacgatccgggagaactcgaaggggacgggggcgtccaggcggcccggtccgaccttgatgtgctcgcccgcgccctccgggttctccacgacgtaggtctggtgggcggagaggttgctgagtatccagaaggcgccgtgcgcggtgatctcaccggcccggcgggagaccccgtcgtgcccgatcaccaggccgttgtccggggcggagcgcccgaaggcgaggcggtcgccgggcgccagccggaactgggtgccggttcgctcgtcctccgtggtcggcggaggtaccacgatgatgctgtacaaggtgcgtctccccgtgcctgacggctacggatcccagactagggcgacgcaccagggccgtgtccccccttgtacggggtgagacacggccctgggggtgaatggcgcgaagtggcctgtgcgatggtcggacggtcggtccggtccgtcagtaacgcgggcggttgaaccacgccttgcccttggaaccgccgacgaagcaggcgatcaggatcgcgagcaccaggtggacgaggcccacgatcgtgaacggccacaggccgagcaccgcggtgatgatgccgaagaccaggatggtgatgcgcgcgccgttgccgccggaggtgaacttcgtggccagcacggccgcgaacacaccccacgcgaccgcgaagaccaccagcgcccacagtctgccggtcgagtagtcggcgagctgctggaaggcggagttgtccttgaggctgtcgtccttctgtgcggcgttgatggtggccgccgcgacggcgaagatgcccgcgcctatcacctgcaggccgacgatcacccacagcatcacgcgggccgcgctcacgttgccgggcatggtctgcggcacgccgccgccgtagggctgctggacgggcggggcctgcgggtagccgtatccgggggtctggccctgcggggactggccgtagccgggctgctgcggggcgccgtaggggttgttcgggtcgccgtaactcatggcgctggttcctccgtggatcaagtgcggggacgacgcgcggcaccgtacggaggagagttctacagaaagcggtccgtccccccgatgagctgcccgcggcactgtgctgctcatcgttcttgaccgaatgcttacttgtccagtcgtatcagtcatgtgttgtgcaagtgcaacatcgcgatcatgtacgcaggaaccagcgttcggccgggccacccggattggaacaccgggccggtcatccgcgaggatgggaccatgaccgcccagattctcgatggcaaggccaccgcagccgagatcaagtccgatctgaccgcccgcgtggcggcgctgaaggagaagggcgtcacgcccggcctcggcacgatcctggtcggtgacgaccccggcagccgcaagtacgtcgccgggaagcaccgcgactgcgcccaggtcggcatcgcctccatccagcgcgagctcgaggccaccgccacccaggaggagatcgaggcggccgtccgcgagctgaacgaggaccccgcctgcaccggctacatcgtccaactgcccctgcccaagggcatcgacgagaaccgcatcctggagctgatggacccggacaaggacgccgacggcctgcacccgatgaacctcggccgcctcgtcctcaacgagccggctccgctgccctgcacccccaacggcgtgctgaccctgctgcgccgccacggcgtggagatcaagggcgccgaggtcgtggtcgtcggccgcggcgtcaccatcggccgcccgatgcccctgctgctcacccgccgcagcgagaacgccacggtcacccagtgccacaccggcacccgcgacctgtccgcgcacctgaagcgggccgacatcatcgtggccgcggccgggtccccgcacctgatccgcgccgaggacgtcaagccgggcgcggccgtcctcgacgtcggtgtctcccgcaacgacgagggcaagatcgtcggggacgtccacccggacgtcgccgaggtggccggctggctctccccgaaccccggcggtgtcggcccgatgacccgcgcccagctgctggtcaacgtcgtcgaggcggcggagcgcagtgtcggctgaggcgggccgcgccgtgcgggagacggccggggaggggttcgggacgcaggcccggcgcgacgctcctgagggctccggggccggttccggttccggttccggagctgggtcaggaacgggatcgggggccggggctgaggcgtccgggggcggagccgggcacaagcaccgtgcg

SEQ ID NO: 643 - DNA, 1583 bp, Unknown
  Kingdom: Bacteria, Phylum: Actinobacteria, Class: Actinobacteria, Order: Streptomycetales, Family: Streptomycetaceae, Genus: Streptomyces
  misc_feature (408)..(433): n is a, c, g, or t
cttcttcgcgctgcagcgcgagcccgacctggcggacgcgatggtgcgcgccctgaccttcgccgaccgcagcgtgagtcccgaggtcgaccaggtgtcccggcagacgaccgcgatcatcctggacgcgatgggccaggacgacccgacgcccgagcaactctccgcggtccgggtcatcgagcacacctggctctcggccctgatcacctggctctcgggccgcgcctccatcgcgcaggtccaggcggacatcgagacggcgtgcaggctgatcgccccggcggagggcgagcagaaatagcccgatttccggattttcccgctccggggtattgcgtccggtgacgggcgttctatcctggaagggcctacgaggcgagtgagggagtccgaccggagtagccnnnnnnnnnnnnnnnnnnnnnnnnnngcgtgcccgcccgcaccgttcttcgtgtgcccgccccgcacccttctttgcgtgcccgcccgcaccgttcttcgtgtgcccgcgcccggtccgcgctgctatgcaggggccatggacccccttgagcggctctgcgccgaacgcgcctgcgaacgcctgatcgccgacttcgtccgccgtctcgacctgggcgacccggcctccgtggccgagctgttcgtcccggacggtgtgtgggagtggccgccgccgggtgacggcaggcgcgtcgaggggcgtgacgcgctgcggacgtacttcggctcccgcccggcgggccggctctcgcgccgcgtgatgtccaacgtcctggtcacggtggtctcggcggacacggcgacggccacgtcgtacttcaccacctaccgcttcgacggccacaccgccgcccacggcatggtgccgccgggcccgcccgtccaggtcggcgactacgcggacgtcttccgccgcaccggcggcggtgactggctgctggtctcccggaccctgcacctgccgttcggcggacccacgcccagggcgtagccgcaggccgcgcacagccgccccgcagccgcttccggcccggccggtagagtggcccggtcgtttcacgcctgtccggggggaagccggtgcgaatccggcgctgacccgcaaccgtagaccgccccccgtggcggcgagccggaatgccccgggcgcgcgcgtgagcggctcgcgtacgccggcagcccgccgccgtacggcaccgtcgagggatacggagccgagccgccggggtgtcccgtgctgtccggctccccgcagggagaggcatccgccgatcatgaacatccgccgcagcgcagcggccctggccgccgtcgccgccgtcgccgtgatcggtgtcccggcgcaggccgccgtcgccgactccgctgcgacccccaccgcctcgcccgcactcccgccgggcctctacggcaccgccgacccgaagtacgacggcgtctggcggcagtccctcgcgctgctcgcgcagcacaccgtgggcgtgcggcccgccgttcacgccgtggactggctggccgggcagcagtgcgcgagcggcgccttcgcgcccttccgcgccgacccgtccaaggcg

SEQ ID NO: 644 - DNA, 3658 bp, Unknown
  Kingdom: Bacteria, Phylum: Actinobacteria, Class: Actinobacteria, Order: Streptomycetales, Family: Streptomycetaceae, Genus: Streptomyces
  misc_feature (441)..(442): n is a, c, g, or t
gttcagcgtgggcgcggtggtggtcgccgccgacgggacggagctggcccgcggccactcgcgggaggccggggatccggtggtgcacgcggaggaggccgcgctcgcgaagatcgacccggctgacccgcggctgccgggggccacggtgtacagcagtctggaaccgtgcgcccgacgcgcctcccggccgcggccgtgcgcccggctgattctggacgcgggggtacggcgggtggtcacggcctggcgggagccggacacgttcgtcgaggcggccgacggggccggtttgctggcgggcgcgggcgcggacgtcgtcgtcctgccggagttcgagggtccggccaaggcgcccaaccgccacctgctgtgacgcgtgtgcattccaccccggagatgacgtacactggtttcaacgacgcggggtggagcagctcnnatcctgtccccgctactgaagactcagggccggaatccgatcaaggattccggccctgagtgttttccgccgacgtggggcgtggtcacgcgaggtgagcgagccgtccccgtccgcataacaactgacacaccatcaccaaagcggcctgtggatgcatgggctcgattgcgcccctgaatggcctgaagtccagtcaactcgccccggttttgtcgctcatgagtggtacgtcctggccaaaaaggtttaaggatcaagccgtacggcttggaatcggagccccgggtctattaacgttcgataacgcagcgcggtcgtcccagccgtcaccagaggcggctccgtgcgcgcgcgccgaatcccgcgagggaaccggggaaccaccaacttggggtgaatcgggcgtcgtccgccgtgtccgcgcggtcggttgacgcgcgtaggagaccttcccgctccgaacccgtcagctaacccggtaggcgagacggaaggaaaggagcacgcccgcgtggcgtccaaccggcctgcctctgaagccccgcccgtgccgagccagcgcaccgagtccttcgcctatggcggccggcgccccgacgagggcccctgggaggagtggaaccccaccgaggattccgtccgtcccgtgcgcggccggcaccgcgtcgccaagcagcgcggcggtggactcgcccgcagctccaccgtgctcggtgtgggcgtcatcgcggccgtcggcgcggccggcatggccagtgccgacaccggcaagccgccggtctcgatctccctgcccgacctgcctgatctgcccgacctgcacggcctgcccgccgtgggcggcctcttcgacgggtccggccacgacggtcacgagggctccgcgaccgcgctcagcgacgtcaccgaggccccggccgggaccaccgggaccaccggggcccaggcgacgtccgggaccacggcgcgcagcgcctccgacgcgggcgaggcgctgcgcaaccgcatcatggcccaggccgagcagcagcaggcccaggtcgaggcgaaggcgaaggaggccacggaggccgccgcggccaagaaggccgctcagcaggccgaggaggccgccgcccaggcgaagaaggaggccgaggcaaaggccgccgccgcgaagaagaaggcggaggaggaggcccgccagaaggccgaggcggcgaggctggccgcgctggccaagcagtacacgctgccgacctcctcgtacacgatcacctcgaccttcggccaggccggttccatgtggtcctccgggcaccacaccggcctcgacttcgccgcgcccaccggcaccctgatcaaggccatccacagcggcaccgtcaccgaggcgggctgggccggcgcctacggctaccgcacgatcctcaccctggacgacggcaccgagctgtggttctgccaccagtcgtcgatcagtgtctcggccggccagaaggtgagcacgggcgaggtcatcggccgcgtcggcgccaccggcaacgtcaccggaccgcacctgcacctggaggtccacccggacggccaggccgccggcatcgacccgatggcgtggctgcagaacaagggcgtcaacccctgaactcctggtcccctgaaaccctgaacccttggcccctgaatccctgaatccctgagaccgtccgctgggggcagctccgccgggcctgttcgcgcgatcttcgcggcgcggaccggcggggcgcggaatgagcggccaccacttgctcgttgatgtctgcatgacttctctccgcaagctcggctcgtccgacctcgaggtcttcccgctcgccctcggcggcaacgtcttcggctggaccgccgaccaggcgcagtccttcgccgtcctggacgcctacacggccgccggcggcaacttcatcgacaccgcggactcctactcggcgtggatcgaaggcaaccacggcggtgagtccgagacgatcatcggccagtggatcaaggagcgcggcaaccgctccgacgtcgtcatcgccacgaaggtcagccagcacccggacttccagggactgtccgccgccaacatcaaggccgccgccgacgcctccctcaagcgtctgggcaccgaccacatcgacctctactacacgcacttcgaccagcccgccgtgcccgtcgaggagatcatcggcgcgctcgacgagctggtgaaggcgggcaaggtgcggcacatcgccgcctccaacatctccgccgagcgcctggccgcgtcgctcgagttctccgagcgcgagggcctcgcccggtacgtggcgctccagccgcactacaacctcgtctcccgcgacacctacgagggcggtctgcgggacctcgccgagcgggccggtctggccgccttcccgtacttcgcgctcgcgtccggtttcctgaccggcaagtaccggcccggcgcgacggtcgacagccggcgcgcggagggcgccgccaagcacctggagactgagcgcggccagaaggtcctcaccgcgctcgacgaggtcgcccgcgcccgcgctgccgagccggccacggtggccctggcgtggctggcggcccagccgaccgtggccgcgccgatcgcctcggcccggacggtcgaacagctcccggcgctgctggcggtggccgagctggagctgacggatgaggaggtcgcgcggctcacgcaggcttctgcctgagccccggccgcggccccgacggccttaccgcgtcacggcctcagggccccgggcctcacggctgtgtccggtagggctggtgcgggccgtaccccggcccggtcagcggctgcccggtcagcggctgcccgtgcgggggctggccgtgcggagggccgccgtacccgggctgctgcccctgcggcggctgaccgtgcccgtacccgtacccgtacccgtacccgttgggcccgtacccgacgtgcccgccgtacccctgcccgtacaggccgtacgcagccggccacggcggcgtgacgacccgtacgggcggtgcggtcatccgcgccgcctgatccagggcgggctgggccacctcgcgcctgcgccacatctcgtgcagcagctcccgctcccgtacgccgaagtcggcgccgccccgcccgagccgtcccctgcggcgcaggaacgccagcgaggtcgcgtaggcctcgtactgcgcgac

SEQ ID NO: 645 - DNA, 3757 bp, Unknown
  Kingdom: Bacteria, Phylum: Actinobacteria, Class: Actinobacteria, Order: Streptomycetales, Family: Streptomycetaceae, Genus: Streptomyces
ccgacccggccaaggccgccgactacgtccagataggcttcgagggcatatcgaacgccgccaaggccatcggcgacttcatgacgtgggccgccaacggaggaaaatgatgatccgccacctggtcctcttcaagctcaacgagggcgtggagcgcgacgatccgcgtgtcgtggagggcgtccgtgcgtttcgggccctgggcgaccagatcgaggacctgcgcttctgggagtgcggctggaacatcagcgaccggcccatcgcccacgacttcgcgatcaactcggcggtcgaggacgcggacgccctgaagcggtacctggagcacccggcccaccaggcgggcgtggccctgtggcgggagttcgccacctgggtgatcgcggactacgagttctagccatacggccgtacggctgtatggccgcatcccaggccccgtaccggaacggtgcggggctttgtcgcgtccccagggcgcgaactaagcaccttgagtgctaattcatccctcaacacgtgcatatgcggtgcttgaacacttagctcctgtcttgtgatgctatgaccgcttttgacggatgagttgatcgacgaagaggtggcgttgaccgtgtcggccagtactgcgccaccccaggaggacgctcccgttcagaccccggaccagccccagacccagcaccagtcgcagcatcagaacccgccacagcccccgtcccagagcccggactccgcgccgggtccggctcccgccgcggctccggagaagcggcgcggcgccgacacccgggcgctgacccaggtgctcttcacccagctgaaggagctggagccgggttccgccgagtacgcccgcgtgcgcggggcgctcatcgaggccaatctcccgctcgtgcgctacgcggccgcccgcttccgctcccgcaacgagccgatggaggacgtcgtccaggtcggcaccatcggactcatcaacgccatcgaccgcttcgatcccgaccggggcgtgcagttcccgacgttcgcgatgccgacggtcgtcggcgagatcaagcggtacttccgcgacaacgtccgcaccgtccacgtcccgcgccggctgcacgagctgtgggtgcaggtcaacagcgcgacggaggacctgacgaccgccttcgggcgctccccctcgaccgccgagatcgccgagcggctgcggatcagcgaggaggaggtgctctcctgcatcgaggccgggcggtcgtaccacgccacctcgctggaagccgcgcaggagggcgacgggctgccggggctgctcgaccggctgggctacgaggaccctgcgctcgacggggtggagcaccgcgacctggtccgccacctcctcgtccagctccccgaacgcgaacagagaatcctgctgctgcgctactacagcaatctcacccaatcgcagatcagtgcggaactcggcgtctcccagatgcatgtctcgcggctactcgcgcgtagctttcagcggctgcgatccgcaaacaggatcgaggcgtaaccgtcacgagcgaatcgctcaccagggcggatcccgacatcttcggcccgaaaggccgtcagacccctttctgccacggctgattcgcgtatcggatgtcgacatgtcactacagcgtgttgccgacatgtgacattctgcgggaagcgcgtttgccgtggcttcggctccggtattcaggtgaaggctgagttctcctcgtcagagagcgcggccacgaccgtcccgcgacccagagggggtggcatgtccgcagaacagggcagctccgaggtgctgatgctcaccaagagcgaggcgccttccccggcgctcgagccgatcgacgccctcgacgacgtggcggccctcgcggccgtcccggctccggccccggcgtccgaggtatcggaagccatcgacacccgcaccctgtcccgctccctgttcctgcggctcgccgtgctcgacgaggacagccccgagcgtgcctacgtccgggacaccctgatcgagctgaacctcccgctcgtgcgctacgccgccgcgcgcttccgctcgcgcaacgagccgatggaggacatcgtccaggtcggcaccatcggcctgatcaaggcgatcgaccgcttcgactgcgaacgcggggtggagttcccgaccttcgcgatgccgacggtggtcggcgagatcaagcgcttcttccgcgacacctcgtggtcggtccgggtaccccggcgcctccaggagctgcggctggcgctgacgaaggccagcgacgagctgtcgcagaagctggaccggtcgccgaccgtcggcgaactcgccgcggtgctgggcgtgtcggaggaggacgtcgtcgacggcctcgccgtgggcaacgcgtacacggcctcctcgctcgactccccggcccccgaggacgacggcggcgagggctcgctcgccgaccgcctcggctacgaggacacggcgctggagggcgtggagtaccgcgagtcgctcaagccgctgctcgccaagctgccgccccgcgagcgccggatcatcatgctgcgcttcttcgccaacatgacgcagtcgcagatcggcgaggaggtcggcatctcgcagatgcacgtctcccggctgctgacgcggaccctggcccagctgcgcgaggggctcatctccgactgacccggaccactcccggcacgttgatggccgccgaggcgcccgtacggcgcttcggcggccatcgtgctgtcctgccgcgtaccaggcgcctcccggcgcctctgcctctccgttctcgtccccgtctcctgcttccgtgcctacttgagcgcgagccaggcgacggccgcgacgacgatcacggcgacgacgacaccgacgatcaggccgacccgcgggccggcgggcgcctgctgctgcctcgcctggggagcggcctcgtcgacgaacgcgcggaacatctgggtgctgccggcggggtcgtggtggccctgggggccctgggtgttagccatggcccgagaccctagcgaaagtgccgggcgctgcccaagtggggggccggtttgtgccgttggtgcggtggtgccgccgcgccgggaccgcgccacgaggctctcgcccccggaccccgcttcggcctgaagggcctcgccttcaagcgacggaccggcggttcctccccccggcccgcaacgacgtcacgcgcaccccctcacctgcttatttacgttcgcaatacttgcctttgccaagtttttgcgccatcgagccccgatttgtttgcctgcagcaaccaaacgaatctatggttgccccaagcaacgattacgggaggtgccatggccgagcaggcgcagtacgaggagcttgcgcgtcagctcagcgccgtcggcgccgtgaaacgggacatggggcggatcctgccgcccgactgcccggccggctcggccgccgtgctgacgctgctcggccgccacggagacatgcgcatgagcaagctcgccgagctgctcgccgtggacatgtcggtgaccagccgccatgtcgcgcacgtcgccgcccgaggctggatgcgctgagctgacgcgcaagctcctcgtactgcgcctgctcggccatggcacctcccgtaatcgttgcttgtaacaaccatagaggtggttaattgcctcaggctcccaaatcggccgagcggccaacaaaaacttggcaaaggcaagcattgcaaaggtaaacatc

SEQ ID NO: 646 - DNA, 2716 bp, Unknown
  Kingdom: Bacteria, Phylum: Actinobacteria, Class: Actinobacteria, Order: Streptomycetales, Family: Streptomycetaceae, Genus: Streptomyces
  misc_feature (448)..(449): n is a, c, g, or t
  misc_feature (2405)..(2406): n is a, c, g, or t
gatcggcgagcgtggcggccccggcgcaccgcaccggagactgttcaccgcccgccacgcgggacggacggtcgcctacgtgtcgtactctcccgtcttcggtgaacgcggcggctggctctacgacctgacccggcggctccccgacgccccgcccggcaccgtcgagatggtcttcgccaccgcgttgcgccgcttccaggacgagggctgcgcctggctgcacctcggcttcaccccgttcgtacacctccggagggacgcctgtgccttcgggcccacgagcggcgtactgcggcgctgtctggaactcctcgccgccaaagggcaggcgatctatccggccgccacccaggagtcgttcaagctcaagtggcgcccgcagctgatcgaacccgagtacctggccttccagggcggggtcaccccgggtgccgtatggcggctnngacagaaggacagaaggacagaaggacagaaaggcagagatgaccacctccgtcgcccacggcccggcccgcaccacagtgatccccgcggaggccgaccggcaccgcgcccccagcctcctcgacggcgcgctgcacgccgacctgacgccggagggctgcgacctcggctactggttccgcgccgtccccgaaggcaccctcgcaggcgacccgatgggccgcaccccggacatcaccgtccccgagcacatgctgaacgaagggccgctgcggcaggccgtgatgcaggaactggccttccgttccatggccgaggagaaggcggcccgcgccatctcctacctggtcgcccatgcccccgacctcagcggcatggacttctacaccacccagttgatggacgaggcccggcacgcctacgccttccgcggccacctgctggaactcggcgtcgaggagagcgatctcgaagccaccatggaggccctcgccggcgccgaccgggacgcggtcctcgccccgctggaggagttcggcctcgaagtcctgcgcgaccagcgggactacgtcggcggggtcatcaccctgaccgtcctggtggaaggcgtcctcgcgcccaccgcggaactcagtgaacgcaagtggcgccccttcgatcccgccgccgcccagatcgaacgcgccgccggcatcgacgagatccgccatctgtcggtgggcaccaccatcgtccgacggcacctggagaggcaccccgaggaacgcgagcgcatcggcgaactcatcgcccgcggcaccgaactgtggtcccggctgcccgtgcgcgaactgaccctgcggcgcgagcagctctaccagcagggcctcgaacagcaccgggacatcgccggcgactacgaggtgtggccgggccgcaggctcgccgacaccaccgccgaggaacggatgatgaccgccgccgaatgggccgagaacacccagcgggcgcgcctggccgacatggggctcgcgccgtgagaaggcctccgcaccccctacgacaccgagaacgaaaggcctggtggcacacccatgaccgacattccggcagtcgactccgcaccgcgtgaaccgggcgcggcggaggaggacttccgcgaactgacccggcgtgtcacggcagccgggctgatgagcccccgcaaggggcagtacgcggccgccatcgtcacggtgtggctgatgaacgccgtcggctgggcggcgctcgcgctgagcgacggcagctggtggcaggccgccctggccgcggtctggctggccgtctggcacgaacagctcgccttcctgctgcacgacgcgggccaccggcagatcagccgctcccagaagaccatccgcgcactcggcctgatccacggcaacctcatgctcggcgtgtgcttcggctggtgggtgcagcaccacaaccggcaccacaaccaccccaaccacctggagctggaccccgacatcctgcgccgggtggccatcttcgcgcccgaacaggcccagcagcgcaccgggttcgcccgcttcctcgccgccaaccagcgctacctcttcttcccgctgctcggcctggagtcggtggtgctgcgcatcgccggggtcatcgccctgcgccggcgagcggtgcgcaaacccgggctggagggcggcctgatggccctgcacgcggtgctcttcttcggagcgctgttctggctgctgccctggccgagcgccctgctgttcctcgccgtgcaccaggtcctgctcggctacctgctcggcctcgccttcgccgtcaaccacaaggggctgcccacccggacgggcggcgagtggagctggctggagcgtcaggtcctcacctcccgcaccctgcccacgagcctgatcggtgacttcttctacggcggcctcaactaccagatcgagcaccacctcttnngttctgcgccgagcgcggcatcgcctacaccgagacgggagtcctggagtcctaccgggacctctcacgccacctgggttccgcgagcgaggtcctgcgctccggcaccgtcaccgcctgacaaccccgcccgcgtacgtgcccccgctccgtacgcaccccgtacacacaccggaagagaggaaccagcggatgaagatcacccgaaccgccaccaccacaccctcggcccgccggccccggctgcgcagagcgctgctgcccgccgccctgctcgcgggtctcggcctgctcgccccggccgccgtcg

SEQ ID NO: 647 - DNA, 4091 bp, Unknown
  Kingdom: Bacteria, Phylum: Actinobacteria, Class: Actinobacteria, Order: Streptomycetales, Family: Streptomycetaceae, Genus: Streptomyces
cgacgcggggtggagcagctcggtagctcgctgggctcataacccagaggtcgcaggttcaaatcctgtccccgctactgaaggccgagggccggaatccgatcaggattccggccctcggtgcgtcacgggtcacccgcacccggccgtgacacatgacagcgcggagccccggcaccaggaaaggtgccggggctccgcgctgcaatagccgtacgtcagaccgacgagcagttcgggcagaggccgcggtacgtcacctcgacgtccgagacggtgaagccgaagcgctcggagtccggcaggtcggccagcgggttgccgctcgggtggacgtcgcggatcgcgccgcagcccgcgcagaccaggtggtggtgcggccggtgcgcgttcgggtcgtaccgcttggcacgcttgtcggtgctgacctccagcacctcacccagcgtgaccagctcgcccagcgtgttgtagacggtggcgcgggagatctcgggcagcttcgtcacggcccgcgcgtgcacctcgtcggcggtcagatgtacgtgctcgccgtccaggacctcggccacgacccgacgctgcgcggtcatgcgccagccgcgtccacgcagccgttccagaaggtcactcatacacaccagcctaacagcaaggagaacagatcccgaacaagtgtgactttggagccttacttgacttagacattgtccattgtaggatcgagcctggctcaggccaagcgacaggaccgcagaaatttgccgcaggaggcgacgtgacccaggggccgctcaccacggaggccggtgctccggtagccgacaaccagaacagcgagacggcgggcgtcggcggcccggttctcgtccaggaccagctcctcctggagaagctcgcgcacttcaaccgcgagcggatcccggagcgcgtggtgcacgcgcggggcgcgggcgcctacggcaccttcacggtgaccgccgatgtcacccggtacacgcgcgccaagttcctctccgaggtcggcaaggagacggagaccttcctccgtttctccaccgtggccggcaacctcggtgccgcggacgccgtccgcgacccgcgcggcttcgcgctgaagttctacaccgaggagggcaactacgacctcgtcggcaacaacaccccggtgttcttcatcaaggacgccatcaagttccccgacttcatccacacccagaagcgcgacccgtacacgggttccaccgaggcggacaacgtctgggacttctggagcctttcgccggagtccacgcaccaggtgacctggctcttcggcgaccgcggcatccccgcctcctaccggcacatggacggcttcggctcgcacacgtaccagtggagcaacgaggccggcgaggccttctgggtcaagtaccacttcaagacggaccagggcatcaagtgcctgaccgccgaggaggcggacgtcctggcgggcaaggaccccgactcgcaccagcgtgacctgcgggaggcgatcgagcgcggcgagttcccgtcctggacggtgtacgcgcagatcatgcccgtggcggacgcggcggcctaccggttcaacccgttcgacctgaccaaggtgtggccgcacgccgactacccgctggtcgagttcggcaagctggagctgaaccgcaacccggagaacgtcttcgccgaggtcgagcagtcgatcttcaccccggcgaacttcgtgcccggcatcggcccgtccccggacaagatgctccagggccgcctgttcgcctacggcgacgcccaccgctaccgcgtcggcatcaacgccgcgcacctgccggtgaaccggccgcacgccaccgaggcgcgcacccacgcccgcgacggcttcctgtacgacggccggcacaagggtgcgaagaactacgagccgaacagcttcggcggccccttccagacggaccgcccgctgtggcagcccgtcgaggtcacgggcgcgaccggtgaccacgcggcgccgtcgcactccgaggacgacgacttcgtccaggcgggcaacctctaccggctgatgacggaggaggagaaggaccggctgatcggcaacctcgccggtgccctctcccaggtctcgcgcgaggacatcgtcgagcgcgcgatcggcaacttccgtcaggccgacggtgacttcggcaagcggctggaggccgcggtccaggccctgcgcggctgacaccagcactggatcgtttgccggggcgggcgggccgggttccttcggggacccggcccgcctccgttctcgtgcgcgtacggtcgtacggtcccggttcgggccggatgtgagccgtgcgggatcaggcggtcacctgggccgcgtgctgccgggccggtgcccagcagcggatgatgtcgcggaccgagacgatgccggccggctcgccgcgctccaggacgatgaggtggcggaagccgccgtgcgccatggcccgtgccgcctcctccagggtccaggacggcgccgcgaagacgacgtcggtggtggtgtgggcgtgggcgtgctcggtgtccgggctctggccgaggccgacggagttgaggatgtcgcgctcggtgaggatgccgatgccgccggcgtcggggtcgtggaccacagcggcgccgacgcggcgggcggacatcagggcggcggcctggcggagagtgtgggcggggccgatggtgaggaccaccgtgctcatggcgtcgcggacgagcaggggggcgagcatgggatggagccacctcctcaaggaatccacgcggcggacgacccggaagggggccggggccgcgtgagggttggattcacttgttcacaagtgggggcttcccagagtctcaggcaaagcaggggtcaacaagggggcgtgcgtgacgtgttgggtggtgcggaggtgaccgccggtgctcaggtgcgccggttgagataccccagcatctcgtcgtgcagcagcccgttcgacgccgccgcgttgccgctgtgcgggccgggcttgccgtccaggcccgtgaaggtgccgcccgcctcggtgacgatgatcgcgttcgcggccatgtcccacagcgacagctcgggctccgcgcagaagtccaccgacccctcggccaccatcatgtagggccagaagtcgccgtacgcgcgcgtgcgccacacctcgcgggtcaggtcaaggaagccgtccagccgcccctgctcctcccagccgctgagcgaggagtacgcgaacgaggcgtccgagagccgggacacgcgcgagaccttgagccgggacgcctgcgagaggctgcggccggcgaaggcgccgtggcccttcgccgcccaccagcggcggccgagcgcgggcgcggagacgagcccgacgaccggctggtacccgccctcgccggcctccgtcaaggagatcagcgtggcccacacgggcacgccgcgtacgtagttcttggtgccgtcgatcgggtcgacgacccagcggcgcgggccgctgccctcgacgccgtactcctcgccgaggaccgcgtcacggggccgggcgcgctgcagctggccgcggatcagttcctcggccgccttgtccgcctcactgaccggggtcatgtcgggcttggtctcgaccttgaggtcgagcgccttgaagcggtccatggtggccgcgtcggccgcgtccgcgaggacgtgggccagacgcagatcgtcgaggtagtcgggcatgtacggaaccgtatccggccgaggcgaatccgggccacagggggcgcggaacagcaggtggccacggcaagccgtcgcggacccttgacagcgcccgcgcccgcgtcaaacctgtgcccacacctgctcccccgggaggcgatgatgcctgcagcgcgggattgcctgctggacgccgctcgtacggcgctggcccgccggccgtggtccgcggtgcggatggtggacgtggccgcggcggccggcgtgtcgcggcagacgctgtacaacgagttcggcggcaaggacgggttggcgcgggcgctggtcaggacggcggcggacggctacctcgccggggtcg

SEQ ID NO: 648 - DNA, 4874 bp, Unknown
  Kingdom: Bacteria, Phylum: Actinobacteria, Class: Actinobacteria, Order: Streptomycetales, Family: Streptomycetaceae, Genus: Streptomyces
ctctgccgctgatgccgggcggcgcccggcatcagcggcagagcgcggtcgatgcggtcctcgaaaccctcgttgagcagcaccgacagctcggcgagggtgatggcggcgccggtggcctcgatgaggaagccggcgctgcgggtcatggggccgccgacgacgacatgtctccaggcttcgtcgagtgtgtgtccgagcgcggcgaagacctccacctccacgtcccaccagaagccttcggtgtccaccagggtgccgtccatgtcgaggagcacggcctgcagggtggagccttcggccgttccggtgccgagcgcggggaccgtactggtcatccggcgtacctccttgagggacgatcaggccggttcccgcgcgggaaccggcctgcagtggaccgaccagtgtacgtcgtgaacgggacgaacgcctcgttcggcacatccgcgcccgccccgccggggctccggggggcgggcagacgccgggggtggctcagcgggcgttgaagtacttcgcctccgggtggtggatcacgatggcgtcggtggactgctcggggtgcagctggaactcctcggagaggtgcaccccgatccgctcgggctgcaggaggccggcgatcttcgcgcggtcctccaggtcgggacaggcgccgtagccgagggagaaacgggcgccgcggtacttcagggcgaacatgtcctccatggcgtccgggtcctcaccggcgaagcccagctcggagcggacgcgcgcgtgccagtactcggccagcgcctcggccagctgcacggacaggccgtgcagctccaggtagtcgcggtaggagtcggacgcgaacaggcgtgcggtctcctcgccgatccgggagccgaccgtgacgacctggaagccgaccacgtcggtctcccccgactcctccgggcggaagaagtcggccaggcacagccggcggccgcggcgctggcgcgggaaggtgaagcgggtgcgttcgttgccctgctcgtccaggacgatcaggtcgtcgtccttggacacgcacgggaagtagccgtgcacgacggccgcctccaggaggttctccgtctggagccggtcgagcaggccgcgcagccggggcctgccgtcggtctccaccagctcctcgtacgtcggcccgtcgccggtgcgggcctgcctcaggccccactggcccttgaacagggcgccctcgtccagccaggaggcgtactccttgagctggatgcccttgctcacccgggtgccccagaacggcggctcggggaccgggttgtcggtggccacgtcggagcggacgtgaccctcctccggccgttcctccacctcgacggcggcggcccgcacccggcgctgcttcagctcgggcagcttcgcaccgggcacgccccgcttgacgccgatcagggcgtccatcaggcgcagcccctcgaaggcgtcgcgggcgtagcggacctcgccctcgtagatctcgtggaggtcctgttcgacgtaggcgcgggtcagggcggcgccgccgaggatgaccgggtagttcgcggccaggcccctggcgttgagctcctccaggttctccttcatgatcaccgtggacttgaccagcagtccggacatgccgatgacatcggcgcggtgttcgtcggcggcctccaggatcgcggagacgggctgcttgatgccgaggttgacgacgttgtagccgttgttggacaggatgatgtcgacgaggttcttgccgatgtcgtgcacgtcgccgcgcacggtggcgagcacgatcgtgcccttgcctgcctcgtcggtcttctccatgtgcggctccaggtgagccacggcgaccttcatgacctcggcggactggagcacgaacggcagctgcatctggccggagccgaacagctcgccgacgaccttcatgccgtccagcagggtgtcgttgacgatgtccagggccttgcgggacttcagggcctcgtcgaggtcgtcctgcaggccgttcttctcgccgtcgatgatccgccgcttgaggcgctcctccagcggcagcgcggccagttcctcggccttgccggccttcagcgacttcgcggtggcgccctcgaacagctgcatgagcttctgcagcgggtcgtagccctcgcggcgacggtcgtaaatgaggtcgagggcggtggtgacctgctcctcgtcgaaccgggcgatcggcaggatcttcgaggcgtgcacaatcgccgagtccaggcccgccttgacgcactcgtccaggaagacggagttcagcaggatccgcgcggccgggttcagaccgaaggagatgttggacaggccgagggtggtctgcaccttcgggtggcggcgcttcagctcccggatgccctcgatggtggccaggccgtccttgcgggactcctcctggccggtgcagatggtgaaggtcaggcagtcgacgaggatgtcctcctcgtggatgccccagttgccggtgaggtcgtcgatcagccgttcggcgatctcgaccttcttctcgggcgtgcgggcctggccgtgctcgtcgatggtgagcgcgacgagcgcggcgccgtgctcgcgggccagctcggcgacccgggcgaagcgggagccggggccggcgccgtcctcgtagttcaccgagttgatgaccgcccggccgcccagcttctccaggccggcccggaggacgtcgacctcggtggagtcgaggacgatcggcagggtggaggcggtcgcgaagcgtccggccagttccgccatgtcggcgacgccgtcccggcccacgtagtccacgcacaggtcgagcaggtgcgcgccctcgcggatctggtcgcgggccatctccacacagtcgtcccagcggccctccagcatggcctcgcggaacttcttcgacccgttggcgttcgtccgctcgccgatcgccaggtacgaggtgtcctgccggaagggaaccgtctggtagagggacgcggcgcccggctcggggcgcgggtcgcgccgggtcggcgtcaggccgcgcacccgctccacgacctgccgcaggtgctcgggcgtggtgccgcagcagccgccgatcagggacaggccgtagtcgcgcacgaagtgctcctgcgcgtcggccagctcgggcgcggtcagcgggtagtgcgcgccgtccttggtgagcaccggcaggcccgcgttcggcatgcacgacagcgggatgcgcgaatggcgggagaggtagcgcaggtgctcgctcatctcggccggtccggtcgcgcagttcaggccgatcatgtcgacgccgagcggctccagcgcggtcagcgccgcgccgatctcggagcccagcagcatggtgccggtcgtctcgacggtcaccgacacgacgagcgggacgtcgtgaccggtggcctccatggcgcggcgggctgcgatcacggacgccttggtctgcagcaggtcctgggtggtctccacgagcagcgcgtcggcgccgcccgcgaggagcccttcggcgctctgctggtaggcgtcgcggatggcggtgaacgtggtgtggccgagggtgggcagcttggtgcccggtcccatggagccgaggacccagcgctgccggccgtcgcgggccgcgtactcgtccgccgtctcgcgggcgatgcgggcgcccgcctcggacagctcggcgatgcgctcggggatgtcgtactcgccgagcgcggtcaggttggcgccgaacgtgttggtctccacgcagtccacgccggcgtcgaagtaggcggagtggacggagcggacgatgtccggccgggtgacgttgaggacctcgttgcagccctccagctgctggaagtcgtccagcgagggctcctgtgcctggagcatggtgcccatcgctccgtcggcgaccaccacacgggtggcgagcgcctcgcggagggcggacacacgggtccggctgtcggcggaaggggtcggcggcaacgaggccatgaaggggctccctgaaggtgcgacggctgtcggctttgcgtcttccccggcacgcgcgggcgatgggcccggcgctttccgaggagggcgcacgccgcaagagtagccgggaccggcaccgggcggtcaggggcgtccaccacccggacgagcgtgtcaccgtgtccgggtggtggacggaggatggccggacggtgatccggtaccgccgcggcggtgaccggacgggctgccggatgatggccgggcggtgaccgggccgggtggccggttgcgtgccgggtgtggaccggccattagcggagagtcgacatggaccggtagtgttcggcattgccgaacggcggcagtgagtcgcacgccggcggtcgaaggggacggagggcagcacggcgatggcacggaacatccagtcgctcgaacgggcggccgcgatgctgcggctgctcgcgggcggcgagcgacggctcggcctgtcggacatcgcctcgtcgctgggcctcgccaagggcaccgcacacggcatactccgcaccctccagcacgaggggttcgtggagcaggacgacgcctccggccgctaccagctcggcgcggaactgctgcgcctgggcaccacctatctcgacgtgcacgagctgcgggcacgcgccctggtctgggccgacgacctggcccgctccagcggcgagagcgtctacctgggcgtgctgcaccagcagggcgtcctgatcgtgcaccacgtcttccggcccgacgacagccggcaggtgctggagatcggggccatgcagccgctgcactgcacggcgctgggcaaggtcctgtcagcctacgacccggtcgcgcacagcgaggcactg

SEQ ID NO: 649 - DNA, 4774 bp, Unknown
  Kingdom: Bacteria, Phylum: Actinobacteria, Class: Actinobacteria, Order: Streptomycetales, Family: Streptomycetaceae, Genus: Streptomyces
ccacgaccgtggcgccggggccgtccgggcggtgcgtgccgaccgtcgccgggatcagccgcagcgcctgttccacgggcagcgggagccggatcgtcgcggtcagcgggtaggggccgttcgcggtggagcgggagacgaggtgggccgggtcgggcgggtcggccaggtccacgggctgcccggtcgcgtggatgtgctcgacccggtcggcgcggaacgtgcgccactggtcccgtgcgacgtcccgggccacgaagtaccagcgacgcccggtgtggacgagccggtaggggtcgacgtcccggacggtggcccgcccctgcccgtcccggtacgccagccgggcgcgctcggcccggcggcacgcggcggccaggtcgagcagcatgccggaggtgatctgcggctcgctggcccggggcgtgtgcacgaaggcggcgtccatctcctccagccgcccggcgatccgccgcggcagcacctgccgcagcttcagcagcgccgacaacgcggcctggtcgccgccgagcgccccgctcagcgccgcctcgcgcagcccgaccgccacggcgagggcctcctcgtcgtccaggatcagcggcggcacccgggacccggcccgcagccggtagccgccccacggccccgcctcggactcgacggcgtaaccgatctcgcggagcttggcgacgtcccgccgcaccgtgcgctcggtgaccccggtccgctcggccagttccgcgcacgtccacgacggccgggcggccagcacggagaccagtcgcagcaaccgggcggacgcactgatcacgccggaagttttccacaccctccgctcatccaggaccggaactgtcctggtcccgtcctacggtcctcccatgagcgccgagaagagcaactccgcacccgtgtaccgctacgccgccgtcaccttcgactgcgccgaccccgccgagatgggccgtttctacggcgagatgctcggcctgcccgtcgccttcgccaccgacgacttcgtcttcctcgccaaggacggcacgcccggcctcggcttcaaccgcctgaaggactaccgccgccccacctggcccgaccccacccaggagaagcaggcccacctcgaagtgggcgtcgacgacctggacgccgccgaggcccacctgctcaccctgggtgccacccggcccgaccagcagccggaccccgaccgctggcgcgtcctgctggacccggcgggccacccgttctgcatcacgacactggtctgaggccgtacgtcgagacgccccgccgtccctcagggatggcggggcgtctcgtcgtacgggaacggcggcggccgttacgtcgtagaccgacgtctccgtgcccccggacgccgctcgctcggccgggtgaccgggtcgccggcctccagcgcggcggccctgcggcgcaggccgaagtcggcgagggcctcggccagcttgaggacggacggctcgggagccatcacgtcgacgcgcagaccgtgttcctccgccgtcttggccgtcgccgggccgatgcaggcgatgaccgtgacgttgtgcggcttgcccgcgatgccgaccaggttgcggaccgtcgaggacgaggtgaagagcaccgcgtcgaaaccgccgcccttgatcgcctcacgcgtctccgccggcggcggcgaggcgcggaccgtgcggtaggccgtgacgtcgtcgacctcccagcccagctcgatcagcccggcgaccagcgtctccgtggcgatgtcggcgcgcggcaggaagacgcggtcgatcgggtcgaagaccgggtcgtagggcggccagtcctccagcaggcccgcggccgactgctcgccgctcggcaccaggtccggcttcacgccgaaggcgatcagtgccttggcggtctgctcgccgaccgccgcgaccttgatgccggcgaaggcacgcgcgtcgaggccgtactcctcgaacttctcgcggaccgccttgaccgcgttgaccgaggtgaacgcgatccactcgtagcggcccgtcaccaggcccttgaccgcgcgttccatctgctgcggggtgcgcggcggctccacggcgatggtggggacctcgtgcgggacggcaccgtaggagcgcagctggtcggagagcgacacggcctgctccttggtgcgcggcacgagcaccttccagccgaacagcggcttggactcgaaccaggagagctggtcgcgccgcgccgccgcggcgctgcgctcgccgaccacggctatcaccggccggccgccgtccggggacggcaggaccttggcctgcttcagggtctgcgcgaccgtgccgagggtggcggtccaggtgcgctgacgggtggtcgtaccggcgatggtcaccgtcatcggggtgtccggcttgcggccggccgtgacgagttcgccggccgtggcggccaccgagtccagcgtcgtcgagacgacgaccgtgccgtcggaggcgccgacctccgtccagcagcggtcggaggcggtacgggcgtcgacgaaacgcacgtcggtgccctcggcgtcccgcagcggaacaccggcgtacgcgggcacgccgacggcgctcgcgatgccggggacgacctcgaaggggacgcccgcggcggcgcacgcgagcatctccgcggcggcgtccgtgtcgagtcccgggtcaccggtcaccgcacggacgacccgcctgccgccccgcgcggcctccatgacaagatgtgcggcatcccgcaccgcgggggccccgacggtggctgacgtgctgtcaaccaccgtgagctgaggtgtgcccgtgcccggaacggtgtccgacgaggggtcggagtccgtgtccacgacggccacgccctgccgggcgtgcgtgcggacgacgtcgagcacctcgtgctcggcgacgaggacgtccgcgttcgccagcgcctcgacggcgcgcagtgtgagcagtcccggatctccgggtccggcaccgaggaaggtgacgtgcccgtgttcaggaccggcgggaagggtggtggggctcaatgtgctcgctcccccatcagaccggccgcgccctgggcgagcatctcggtggcgagttcgcgaccgaacgccatcgcatcgtcgtgtgtctggggcacgggaccggtggtggacaactgcaccagcgtgctgccgtcggtcgtgccgacgacggcccgcaggcgcatttccttgacagtctgcccgtcggccagaaggtcggccaaagcacccacaggggcgctgcaaccggcctccagggcggcgagcagtgaccgctcggccgtcacggcggcccgcgtgaacgggtcgtcgagccgggcgagcgcggcgatcagttccgcgttgtccgcggagcactcgatcgccagtgccccctggccgggggcgggcagaaccgtgtcgaccgacaggaagtcggtcacctcgtcgctgcggccgatccggttgagtccggccgcggccaggaccaccgcgtccagctcaccgctgcggacgaatccgatgcgcgtgtcgacgttgccccggatcgggacggtctcgatgtccaggccgtgggcgcgcgcgtacgcgttcagctgggccatgcggcgcggggcgccggtgccgatgcgtgccacccccttcggggaggacgcggcgaggtcggtgaatttcagcgcgtcccgggcgacgaccacgtcccgcgggtcctcgcgctcgggtatcgcggccaggaccagttcctctggctgcgtggtgggcaggtccttgagcgaatgaaccgcgaagtccacctcgccccgcagcagcgcctcgcgcagcgccgcgacgaacacgcccgtaccgccgatctgcgccaggtgctcgcgggagacgtcgccgtacgtggtgatctcgaccagttcgacgggccgtccggtcacctggctcacggcgtccgccacctgcccggactgggccatggcgagcttgcttcgcctggtcccgagcctcagtgccttgttactcatgccggccctcggttcttgccgttcttctgggagtcttcgtcggcccgggtgacggaggccaccgtctccgggtcgaggtcgaacagggtgcgcagcgcgtcggcgtacccggcgccgccgggttcggccgcgagctgcttgaccctgacggtcggcgcgtgcagcagcttgtccacgacgcgccgtacggtctgggtgatctctgcccggtgcttgtcgtcgaggccgggcagccgtccttcgaggcgggcgatctcgctggtcacgacgtcggcggccatggtgcgcagggcgacgacggtgggcgtgatgtgcgccgcccgctgggccgccccgaaggccgcgacctcgtcggaaacgatacggcgtacctggtcgacgtcggccgccatcggtgcgtcggcggaggcctcggcgagcgactcgatgtccaccaggcgcgccccggccagccggtgcgcggccgcgtcgacgtcgcggggcatggccaggtcgaggacgaacaggaccggttcggggcgcgggagcacggcgaccggctcgggcttgcgcagctcggggacgcggccgacggtggcggcggtcgccgcgagcgcggtgatcagctcggcgtcggcgccggcctgcgcctgcgcgtcgcgtgcgcggccccgctccagcagggaggtgccgccgtcgacccaggcgccgtgctgctccagggtggccgcgtcgatgccggcgacggcggactcgccgagcaggg

SEQ ID NO: 650 - DNA, 6952 bp, Unknown
  Kingdom: Bacteria, Phylum: Actinobacteria, Class: Actinobacteria, Order: Streptomycetales, Family: Streptomycetaceae, Genus: Streptomyces
cgcgcagcagaggtcttccagcgcctggtagaggcgttcggggtggaagggccgggtgcggtgccacaccagcgtggtgacgcccgcgtcgtcggcgtcctgcggcaggagtgcgcaggccgggtgctgagccgtggccgccgcttccacgtcgaatccggcgaaggccagttgtgcgagctcgcccgaggcggcgtcgacctggcggccggtgggatgcagctgggtcagcagggcgtggtcctgttcgtccgcgtcctggccgtccacgagggcgaggacgggggcgtactccagttgccgggcccaggtgtcgccgacggtgcgctggtccgtggcggccgcggcgagtccgacctcggccaggtcgtctccgttggagaggtagggcaggaccagagccgggtccaccgccgtgatcacgttggtgagcatcaggtcgtcgccgctgtgggcggcgacgacctccgccatggccttgggctcgaccgagtcccacagctcgacgatcgccagccgcgtcagaccgtggccggccagacgctccagctcggggacgaggtcgtcgcgcagtgcacagcacgcgcagtcgttgaccagcggtgcctcacccgacgtcagcacgcccgacgcgtcgcggaggagacgtcgtacggttccctcgcccgcggtggccaggtcgtgatgcagggcgatgctccccggcaccgccttcagcaggcggtcgacgacctgggtgcgggcgtccgcgtgcaggccgccgacgatgacgaccggcagtcggccttcctcgcgcatcagcggcctccggaacggccgtagcggcgctcgaagcgttccacgcggcccgcggtgtccaggacgcgggcggtaccggtgtagaaggggtggctcgccgaggagatctcgacgtccacgacggggtaggtgttgccgtcctcccactcgacgtgcttgtcgctggtgatggtcgaacgggtcaggaaggcgaagtcggcggccttgtcgcggaagacgacggggccgtaggcggggtggataccgggcttcatggcgtgctccttccagcggtgggtgatcaggtcagcgttcttcgcggaagccgacgtgtcggccggcgatcgggtcgtacttgcgcaggaccaggcggtcggggtcgttgcggcggttcttgcgggtcacgtaggtgtagccggtcccggcggtggagcggagcttgatgaccgggcggagttcgttgcgagccatgggcgctactatatgggaacgatttccattatcgatagccgttcctcgaggagaggcaggtcatcctgtgtccgcccactgccaactgaccggcgcgcagccgggattcggcaacaacatctcccactcgcaccggcgcacctcgcgccgtttcgacccgaacatccagcgcaagaggtactggctgcccagcgagtcccgctacgtgcggctgacgctgagcgcccgcggcatcaagacggtcgacaccatcggcgtggaagcggctgtagcccgcatccgcgcccggggagggaaggtctgatggccaagcgaagcaagatcgcgaagaacgagaagcgcaaggccgtcgtcgagcggtacgccgcccggcgggccgaactcaaggagatcatccggcgtccttcctcgacggaggccgagcgcggggccgcgatcgacgaactgcgccggcagccgcgcgacgccagtcccacccgggtccgcaaccgggacagcgtcgacggccgcccccgaggccacctgcgcaagttcgggctctcccgcatccgcgtgagggagcaggcgcacgcgggcttcctgcccggtgtcacgaagtcgtcctggtgacggcggtccttgcgcgctgacggagggacgccaaggcgggggcacggctcatgtccgggccgtaccccgcccgaggcggtacgggcatgcccggagattcctggcgtgctcgtgctcgtgctcgtggtcgcggtcgcggtcgcggtcggtgcgtcggcgagagatgaggccgaagtggaagccgtccgccctgagatccggcaggagtgcacacatgagtgacgccgcacgcggccaccggggccgttccttcacccttgtcgtccgcgcctcgtgtgaggccgccaccgagcaggtgatggacgggccgcgccgggcggtccgcgccagtccccacggggccctgatctccacaggatgcctgcggaagatcctgcactgcgcggaccggcgcggtccgcacgctgcggtgcagccgtgcacggaggatcgcaggcccaccggagccgtcgtacgtctcggcccgctcgtcaccgcggccgacgccgaagcggtcgggccggtctcggcggtccgttccagcaggggtatgaccgagatacgcgccgaaggggcaacgagatggtcttgaagccctgatgcgctcggactcacctgcggcggcgggcggcagggttgcgctccgagacctgccgggcgagcgaccgggtgtccgcggtcgaagctccgaccgaatgcggttctgctgtgcggacttgaggggaggggactgtcagtgcccgacgccgaccaggctcggcgccagcatgcttacctgcgtcatgcccccagatcctccgtcacgggcaggcactcggcgagcaggtcgacgacatcgcgccaggctcgctgcgcgtgccgtgggtggtagccgacgccggggaccacggggtggtcgaccggcgggtggtggaaggcgtgcaaggcgccgccgtagaccacgaggcgccagtcgacgcccgccgcctgcatctcagcggtgaacgcgttccgttgcgcgggcggcatgatcgggtcttccgacccgaccccggcccacaccgggcagcgaatgcgcgccgcctcgcccggtcggcccgtggtcagtgcgttgactgtcccgatcgcgcgcaggctgacgccgtcgcgcccgagttccagcccgatggcgcccccggtgccgtagccgacggcggcgatccggtcggggtcggtccgcggttcggtgcgcaacacgtcgagcgccgcatggccgatgtcccgcatccggtccggatcagcgagcagtggcatgcaacgggcgagcatctcctcggggtcacccagatagcgcccgccgtgaaggtcgaaggccagcgctacatatcccagctcggcgagagcatcggcccggcggcgctcgacgtcgctgagccccatgccctctggtccgagcagcaccgcgggccggcggtcgacaccggccgggagcgcgaggtgcccgatcatcgtcaggccgtcggccgggtactcgaccgtacgcgtcgtaatcttcgtcatgagactggactgtagtgatcgtcgagcccggtccggccggtgttctgccgctggcagacgctcaacatcaccaccaacagggctcttgcgttctcaggtggcgagatgaaggggcaccgggttcggtgggacggggccaacctcgtcgtggccaaccggctttcgccgccagaggggggtgtcagaccgcaccgatacggtcgctccatgagagctacaggaacgttcacggtcaaagcgttcgtcccgaccgagctgaaaccggatccggttgtgtccactgggctaccggtgggtgtggcaacgatggacaagtacttcgggggcgaggttgccggttgctcggcgaccctgttcacggctgcgtccgaccaggcgaccggcgcgggcacgggcacctgcgtggccagggaatcgttcgatggctcgctgtgcggccgggccggcgccttccacttcgtgcactcggcgacgacgtccggcagcgatcgcacaactgagttcttcacgatcgtgcccgcgagcggcaagggagggctggcaaggatctctggtgctggagcaatggccgtcgacgctgacggaacgcatcgggtccgctccgactacgagttggaagcgggccgatgacagacgacgtgcatgaagcaagggctgtcggactacgcatgtacgaggcattcaatggccgggacctggctgccctcgagacgatcctcgcgccggacttcgtgagccacccgctgagaacgaccggtatcgaggccgtcgcagatgcctgggccaggatgttcgcagcccatcccggcattcaagtctccgttgaggacatgctcgtggaccgcgaccgggtcgccgtccggtccgtcctgcgtgggctttcgaagtccatgcccgacggcgcggagcacgcacccaccatgatggagatcttccgagttcgccagggccggatcgccgagctgtggggactgtccagtttcggccggccatccagccaggccacccatcgagccgcagtcaatctgcgggatccttcctcccggccgggcctgaaacggcagatcaccatgcagccgtctccgtgagcttctccgtgaacgccggggctttctccacgcgctgacgggaggtcatcagggtgtgcaggttccacgtcgcggcgtgctccagcagggcggtctgcaggagcgccgtgcgccagcccctcggcgcctggtccgcctctccgtagaccggggagggggcgcggatctccagggcgttgatctcgaaaccggcgaggacgccccgctcgatcgcctccgagacgcaccacccctccttgccccggggctgtcccccctgttcgtttcgcgctccggtcacgcggaccatgactgagctatcctccgcgcatgcgtggacagttcaccggctggccggagcgggcgatggacgtgttgtggcagcttcagggcgaaccgacccccgcgacccgggagcgctaccgtgccgaccgcgaacgactggtgcggcagccgatgatcgccctgctcaacgagatcgcggacaccgatccccggtacgaggacttctccgtctggcactaccgcaccggctcctggtggtggcagcaccagggagcggtgatccgactcggccgcaaggtagagatcggtctccgcttctccctggacggcctgcggatccagggtgcctggtggtaccccgaccccggccaggtggacgtgttccgcagagccgtggccgccgagggaagcggccgcgaactctccgccatcgtcgaggacctccggcgcaagggctacgacctctccggggacgtgatgaaacgcccgccgcgcggctgcccggcagaccactcccgtgcagacctgctgcgccaccgttcactgatcgcctcccgttccctgggctgcgaggagtggctgcacactcccgaggcggtggagcgggtcctctcggccgccaccgcacggtgaccggaccgccccttcggcatgcccgcagcttccactcagaccgcccaggaacatggtgtaccgatatatctaatggtgctctgtcatggttcgtgcggttctcgccggaccggcaaggtcctggcacgcgagaggggatccgttccgtgtctgcatcgccgctcagcagggctgaagaggccgagaaccgccgtgtcctggcaggggaagtggacgtgctggtcagcgggcacggtccctgaccggagcgccctggtatcaggcgcggaccggtgaccgcctggtggtcacttacgcggccggcgaccgcggcccaggctggacagacgtacgaggtccaggacagcgccgagggccgggtgctgctcctcgtcgaccacaccgccccggacgacgccctggccggtgggttcgccgggccgccctacctgtacggcggcgaccccttcgagacaccctggacggaagccggccccgaccgcctcgcagtcctccgcgacggccaggccgtccaccagggccgccacgccctgccccgcccggacacggccggaccgcgcatgaccatggcggcgcgggcggacggcaccacgggatgggccgtgttccaggagcgcgcgtgcaccccggcggaagccgatgacgtgctcggacgtgctcgccaaggtcgtgaccagggcgcaggagagcgtcaggaagcagccgcgcgcgtagtcccgcaggtcaggggcccctgacgcaccgtaaggagggcggcccggtcgccatcagatggtgagcgggccgtctcacttcgcgtgcaggatgatctgccagcgcatgccgagcgcggtccacgccgcctgctgctcttcggtcaactgtcggtccggcgtgcgtgttgtccacgacggcccccagcttgttctcggtcccgtccggcagtacctccaccgcgttccgggagcgcccgcagatgcccctcccgcggcgaagaactgccgggcggcggtgcgggcgggcccgggcggcgggcaccgccggtgaaccggcgcgggtgccggtcgcggcgggccgcggtgccggtgcgggcgccgtgtcagccgggggtcaggaccatgcggaagcgtgccccgccggagagcatcttgcggtaggccccgtccacgtcgtccagcgggacggtctcggtcatggggcggatgccgtgcagcgcgctgaaggccatcgtgtcctccacgtcctgcgaggtacccgacgggtggccgcgcacgacgcggccggtcatcagcagctgggccgggctgatgccgagcggcgcggtgtccgcgccgatgaccacgagttcacctcggggggccaggccgtccacggtggcggtgatggccgcggagttgccggcggtggcgagcacgactctggcgccgccgagggaccgcagcgcctcgtcgaccggggtgccggaggtgctgtcgacgtagtggtgggcgcccagccgcttggcgaagtcggccttctcggcgccgcgggcgatcccgacggtctcgaagcccatggccgccgcgtactgcacgccgaggtgccccaggccgccgaggccgagcaccgcgaccaggtcgcccggccgggcgacc

SEQ ID NO: 651 - DNA, 604 bp, Unknown
  Kingdom: Bacteria, Phylum: Actinobacteria, Class: Actinobacteria, Order: Streptomycetales, Family: Streptomycetaceae, Genus: Streptomyces
ccaccacccgcaccacccccgccacgcactgccagaacgacctcccggaaggagccgagcagtgagcacgtcgacaggtgacactccgacgggaggcaccacgccgaccgacctgcaggccgccgcagccgacttcacctggctgctcaaccggttcgcgaccgagaccgccggtgtcgtcgacgccatcgccgtctcctccgacggactgctcatcgccgtctcgcagttgcgcgagcacgccgactccgagcggctggccgccatcgtctccggcatcaccagcctcgccgccggcgcctccggcaactaccgcctcggcgccctcaacaaggtcatcatcgacctggagggcggccacgtcctggtctccgcgatcggcagcggcgccgtgctcggcgtggtcaccgacaaggaggccaagctcggcaacatcgcctacgagatgacgctgttcgccaaccgcgccggagccgcgctcagcccgcagctcgtcctcgaactgaagaacagcgtcggcgccgcttcggcgcgctgaccggccaccgccggtcgaggaaggaagaagaacccatggcggacggcgggcctgccggtgtgatca

SEQ ID NO: 652 - DNA, 2786 bp, Unknown
  Kingdom: Bacteria, Phylum: Actinobacteria, Class: Actinobacteria, Order: Streptomycetales, Family: Streptomycetaceae, Genus: Streptomyces
ggcgtgccggagcgcaacggttcgccgtcgaggcgggcgccccggccccggacggcggtggcgagccggtcgagggccggggcgtacgtccaggaggccaggaccacaccgcgcagggtgagggcgatcagcgtgcagaagccggggtcgccgtgcacgaactggcgggtgccgtccaccgggtcgacgatccagaccggggcgtcgccgcctatcgcctcgtagaccgccgggtcggcgtggaccgcctcctcgccgaccacgagggatccgggcagcagggcggcgagcgcgtcggtcagataccgctcggcgagccggtcggcgtcggtgaccaggtcgtgcggcccggacttctggtcgatctcgtgctccgcgagccggcggaagcggggcatgatctcggccgcggcggccttgcggaccgcctcctccacgtcggccgagcggtccacgagaaactcttcgatggtttccgtctcttcgatcatgcttccatgagagcacgcgcctgtgacaacgcccgcccgtcgggtgcataccgggtggaatcggcgtgaacacccggcgccggggccggactcgtgggctcctgctcctgttcctgcttgtccctctgctcagcggccgaccgcgtacccctgcatcccgcgcgggttcgccgccgccgacaggacgccggtgcgcggatcgcgggcgaccgcgcacaggcggccctcggaccaggcgtcgccgaccgtcacgtcatggccccggcggcgcagctccgcgacgacgcccgggtccgtgcgggactccacggtgacggagccggggcgcatgccgcgcgggtagaaggagcccgggaaggcgtcgttgtgccagttcggggcgtcgacggcgccttggaggtccaggccgccgcggacggcggagcgcagcgcgacggccaggaagaagtgcagctgccactggtcctgctggtcgccgccgggcgtgccgaaggccatgacgggtacgccgtcgcgcagggcgagcgacggggtgagggtcgtgcgcgggcggcggccgggggtcagcgtgttcggcaggccctcctccagccaggtcatctgcagccgggtgccgagcgggaagccgagttcgggtacgacggggttggactggagccagccgccgctgggtgtggcggcgaccatgttgccccagcggtcgacgacgtcgaggtggcaggtgtcgccgcgggtggcgccgtcggcgcggacctcgggctcgccgggcacgggggacgtgggcggcttggcgaccgtcggctcgccgactcccagggcgtcgaagtcgccgtcgtccgcggcgacccggtacgcgtgcgcgctcagtcgcgggtcgcgtccgccggggctgcccgggcggagttcgtaggaggccttggcgccgatcagttcgcgccgctcggcgttgtaccgggcggagagcagttccgtgagcggtacgtcggccgcgtcgccgtaccaggcctcccggtcggccatggcgagcttgcagccctcgatgagcaggtggacgtagtcggcggacccgtagggaggcagttcgggcgggaggagggcgagttgctggaggaagaccggtccctggctccaggggcccgccttgcacagggtccagccgttccagtcgtaggtcaccggggcttcgtaggacgcggaccagccggcgaggtcggtggcggtgagggtgccggtgtggtgtgcgccgctggtgtcgagcgtgggccgccccgcctgccggaccagtgcctcggcgacgaagccggaccgccacacctcgcgcgcggcgtcgatccgcgcctcccggtcgccggccccggccgtttcggcgagcaggcgcttccaggtggcggcgagggcggggttgcgcagcagttcaccgggccggggcgcccggccgccgggcaggtacacgtcggccgacgaggtccactcggtctcgaacagttcccgtacggtctcgacggtcgccccgacgcgttccacgggcgcgtgcccgtgctcggcgtacccgatggcgtacgcgaggacctcgtcgagcgacttggtgccgtggtcgcgcagcagcagcatccacgcgtcgaaggcaccgggcacggcggcggcgagcggtccggtgcccggcaccaggtcgagcccgagccccttgtagtgcgcgaccgtcgccccggccggcgccacgccctgcccgcacagcacccgcacctcaccgcccgccggcgcgagaaggatcggcacctcaccggccggcccgttgaggtgcggctccacgacgtgcagtacgaacgcgccggccacggccgcgtcgtacgcgttgccgccgccctccagcacggccatcgccgactgcgaggccagccagtgggtggaggacaccatgccgaaggtgccctggagggtgggacgggtcgtgaacatagggcctctcacctcgctgtttacgtgtcgcggcccaggtgacgggcgctcaggacgggtgctggggagaatctggggagttcgcgccagcctcctccctctcccgctccccccgaaggctatcgatcgccccacgccgccttcttccgcgcctgcggcagtcgttcagccacacgggccgcctggtccagagcgcccggctccttcagctcctgtcggtgcagtcctgccaccacctcggcgcggtcgcggtggaatcgctccggctctgacggaggcccgaatcccggagagggctgggcgtcggctccgccgagacggtgcggacctgggtccgca

SEQ ID NO: 653 - DNA, 3228 bp, Unknown
  Kingdom: Bacteria, Phylum: Actinobacteria, Class: Actinobacteria, Order: Streptomycetales, Family: Streptomycetaceae, Genus: Streptomyces
cggcgtcgcgccgaactcctcgtccgcgctccgctgttgcccggcgaggacgcgggcgcgggccggctggtcgtactggagggcgagcggccggaggcctggtggctgcccggcgcggctccccggctggtggtcaccaccgccgcgctgcgtcgcctgaaggggcgtcagctggatgccgtcctcgcgcacgagcagggtcacgcgcgggcccggcacgactggctgctgcactgctcggcggcgctggcggacggctttccgcaggtgccggtgttcgccgcgttccgcgacgagatgcaccgcctggtggaactcgccgccgacgacatggcctcacgccgcttcggccgactgaccaccgctctggccctggtcgaactcaacgaggaccgcggcgtgttcggcggcccctgtcccactccgcaggcgcacgtgccgcatcgcgtgcaccgtctgctcactcccccggaccggctcaccgccgcccgccggctgcgcctgaccgccgtggcctcgctcgtgccggtgatcccggtgctggtgacgctggtacccggcctgcgggcactgggctgagacgacgcccgggtcgacccgcgaacctcgcaggccgtgcgatccgcggccgtggcgtccgccgtccccgacggtggccggcgcgggccaggtgagcgatgatcacctccatggccaagaccgctgtgctcttcgacttctccgggaccctcttccgcatcgagtccgccgagtcctggctgcgtgcggtgctggacgcggccggtcttcctctggacgagcaggagttgaagcaggccgctcgcgagctggaggcggcgggggcgctgccgggcggcgcggaaccggtccgcgttccggacgaactggccgggctgtggggcgtcagggaccgcagcgcggaacagcaccgtgccgcgtacaccggcatgtcccgtcaagtgacgctgcccgaccccgcgttgcacgacgcgctgtacgaccggcacatgacaccgcaggcctgggacccgtaccccgacgcccccgaagtgctgcgcaccctgcgcgaacgcggtgtcgcggtgggcgtggtgagcaacatcggctgggacctgcgcccggtgttccgcgcccacggcctggacgcctacgtcgacacgtacgtgctgtcgtacgagcacggcatccagaagccggacccgcggctgttcgcggtggcctgcgcggcgctcggcgcacagccgcgggacacgctgatggtgggcgacagccgcgaggccgacggcggtgcggcggcgctggggtgcgcggtgcacttcgtggaccacctgccggtcgcggagcgcccggacgcgctgcggcccgtgctcgacctggcgggcaggtctcggtcggggcgcgcgtgaggtgaggggctcggacggaacgggtccggcccgaaggggcccgtgtccggcagcgcggcagcccggcagcgcggcagtcgaaaagtagcctcaggaaaacaatcgggtgtgcatgtgcccgtctcggacgatcccccgcgtcgcccgagacgggcgggcagcccgaccgcaccccgtggaggggccgacctgctcgcgttgagtatagttggctggcagccagtcaacgcaggagttacaggatgtccccgcgaagcgcctcggtcaatgaagagttgcgacggcgttcccgggaacggctgctgcaggcggcggtcgaactcgtgggcgagcacgggtacgacgcgacgacgctcggggacatcgccgaccgtgcgggttcggcgcgcggcctggtgtcgtactacttccccggcaagcgccagctggtgcagtccgcggtgcaccggctgatgaaccgcacgctggaggaggcgctggagcgcgagccccgcaccgacgacggccccgagcggatggcacgtgccatcgacgcgatcctggggctggcccgcgaccggcccgtactgatgcgccagcacatggcgggaatcctgcaggccgagggcttcgtgcagtgccccgaacagcaacgtctgtcggtcctgctgcgcgacaccgtggccaggcacggctcggcggacgtcgacgccgactacccgatgctgcgggccctgctgatgggcgcggtctacgcggcgctcatgcccggagcgccgatgccggtgccgctgctgcgggccgagctgttcgagcggtaccgcctcgactgggagctgggcatgcccccggacagcaagggccccgggggcggcgcctgcgggacggacgtctcccggttcttcgccacgggccggcacccggcggagcggccggaagagtcgaagtagtcgatgcagtccctgcagtcgatgtagtcgaagagtggtcccgtgcgacacgccgcgctccggcgtcgtcgctctcccccgccggaccgccgggtgtcatgctggagttctcagggctctcctccgtccgccccggagtcagggggttttgccgtgctgcgtgtcgccgtcgtcggctcggggccgagcgggtgctataccgctcagggcctcgtccagcaggacccctcggtgcgcgtcgacgtcctcgaccggctgccgtgcccgtacgggctcgtgcggtacggcgtggcgccggaccacgagaagatcaagtcgctgcagagcagtctgcgcgcggtcctggagcacgagcgggtccggttcctcggcggtgtgcaggtcggcgggcccggcgggctgccgaccggccggctgcgcgagctgtaccacgcggtggtgtactgcgtgggcgccgcgaccgaccgccacctcggcatccccggcgaggacctgccgggctgctggtcggcgaccgagttcgtgtcctggtacagcgcccatccggacgccgtggacgacggcttcctgcgggacgtgcgcagcgccgtggtgatcggcgtcggcaacgtggcggtggatgtcacccgcatgctcgcccggggcgccgcggagctgagccccaccgacatgcccgaggccgcactggccgcgctcgccgggagcggggtgaccgagatccacatggtgggccggcgcggcccctcccaggcccgtttcaccaccaaggagctgcgcgagctggattccgtgccggacaccgctcttctcgtcgacccggccgagctggcgctgggcggccggcagcgccgaaaggtcggcgcaggccggatccagcgccagctcggccgggt

SEQ ID NO: 654 - DNA, 9772 bp, Unknown
  Kingdom: Bacteria, Phylum: Actinobacteria, Class: Actinobacteria, Order: Streptomycetales, Family: Streptomycetaceae, Genus: Streptomyces
gggcctggtgatggggatgtccatcgaacgcaacatcggcctgaccgggctgcgcaccaccgtcaaggccggactgatggaccgcggcgccgaacgcagccgctccctggactgggcggtcaggctccaggtcaagtacgcccggatcgccgacgccgtctccaccctctccggcggcaaccagcaaaaggccgtcctggcccgctggctgctgcgcggctgccgtgtcctgctgctggacgaacccacccgcggcgtcgacgtcggcgcccgcgccgagctgtacgcggtcgtacggcggctggccgacgagggcctggcggtgctgctggtctccagcgaggtgccggaggtgctgggcctggccgaccgggtcctggtgctgcgcgagggacgcgtcgtgcacacggcgcccgcccgcgacctcgacgagcaccgcgtcctcgacctcgtgatggacgcacaccccgtggccagtgaagggagcccggcgtcatgacgcagcacgtgtccccgccccggggcggcaccgagaagaccgcgaccgcggacggcccgcccgcctggcgccgcctgcccgtccgcgccgacgtccgcaccctctccctgctcggcgtgctggccgtgctcgtcctcatcggcgggctcaccagaccggacgagttcctcgacacccgcaacctccagctcgtcctcacccaggcctccgtcatcggggtcgtcaccgtcggcatgaccttcgtcatcacctccggcggcatcgacctgtccgtcggcgcgatcgtcgccctctcctcggtctgggccaccacggtcgccacccaggagtacggcttcggcggcatcctcctcaccgccgtcctggtcggcctcggctgcggcctggtcaacggactgctcgtcgcctacggcggcatggtccccttcatcgccaccctcgcgatgctggcctccgcgcgcggcctggccctccagatcaccgacggccgcacccaggtcgtcaccgtcgacggcatcctcaacctcggcgaacgcgactcctacgtgctcggcgtcccaccgctcgtcctggtcttcgcggccgtcacggtcatcggctggctggtgctcaaccgcaccaccttcggccgccgcaccatcgccgtcggcggcaacccggaagcggcccggctggccggcatcgacgtccgccgccagcggctctacctctacctgctgtccggactgtgctgcggcatcgccgccttcctgctgatcatcctgtccggctccggccagaacaccaacggcaacctctacgagctggacgccatcgcggccgcgatcatcggcggcacgctgctcagcggcggacgcggcaccatcaccggctcggtgctcggcgtcctgatcttcaccacgatcaccaacatcttcgccctgaacaacctgcagagcgacgtccagcagatcgccaagggcgcgatcatcgtcgccgccgtgctggtccagcgccgtaccgcgagcacgacctgaggaaaggtttcaccgccatgtcaccactgacgagccgcagagggctgctcttcggggccgccgccgtgtccaccggtgccctcctcaccggctgcaccagcaacgacgccaaagacgagaaaccggccggcaacgaccagccggccgccgacggcaagcccggcaagcacgtcaccatcggcttcgcgggcccgcaggccgaccacggctggctcaacgccatcaacgaccaggccaggagccgcgccaagaagtactccgacgtcaccctggagagcaccgagggctccaacgacaccgcggcccagatcggccagatcgagacgctgatcaacaagaaggtcgacgtgctggtggtgctgcccgccgacggcaaggcactcacccaggccggcctgaaggccatgcgcgccggcatcccggtggtcaacctcgaccgcgtcttcaacaccccgcaggcgtaccgctgctggatcggcggcgacaactacggcatgggtctcaacgccggtcactacatcggcgaaaagctcaagggcaaggccgacgcccgcgtcgtcgaactcgcgggcctggacaacctggagctgaccaagcagcgcagccagggcttcgacgacgccctgaagaactacccgaacatcaagaaggtggcccgccaggccgccgagttcaccgtcgagtcgggccaggccaagatggcccaactgctccaggcacagccggagttcgacgccctgtggaaccacgacgacgaccagggcgtgggcgcgctgcgcgccatcgagcaggccgggcgcgacgacttcctgatggtcggcggcgcgggcgccctcaccgccttccaggccatcaaacaggacaacggggtcctcaaggcgaccgtcctctacccgccgaccatggccgcctcggccatcgacctggcccgcgccctcggccagggcaagggcatcggcggcctcgccgagtacgagatcccgtcctcgatcacgctctactcggccgtcgtcgacaagaccaacgtcgatcagtacatgcccaccggcttcaggtgagccggccgtacgagacacagccggccgccgttcgcgcggctccggcaccgccggtgggccgggaccgaccgaccccccaccgtggcacgacgacgaggaggacctccgtatgggacagccgcagcagtcagagggcgcggcgcaggggaagccgccgctgcgcgtcggcatggtcggctacgccttcatgggagccgcccactcccagggctggcgcaccgtgggccgcgtcttcgacctgccccggcagccggtgctcaccgcgctctgcggccgggacccggtcgccgtgcgcgccgccgccgaccggtacggctgggccggcgccgagaccgactggcgggacctgatcgcccgcgacgacatcgacctcgtcgacatctgcacccccggcgacagccacgccgggatcgcgctggccgcgctggccgccggcaagcacgtcctgtgcgagaagccgctcgcgaacacggtcgccgaggcggaggagatgacccgggccgccgaggccgcccgcgcccgcggccaggtggccatggtcggcttcaactaccggcgcgtcccggccaccgcgctggcccggcggatggtcgccgagggcaggctcggcaccctgcgccacgtgcgggtgtcctacctgcaggactggctcgtcgacccggagttcccgctgacctggcggctgcgcagggagtccgccgggtccggctcgctcggcgacctgggcgcgcacatcgtcgacctcgcgcagtacctggcgggcgagaccctggccggcgtctccgcgctcaccgagaccttcgtacgggaacggccgctgccggcggccgccaccaccggtctcgccgcagccccggccccggacaccgcctcggccaccgcgaccgtcaccgctcccaccgcccgtaccggccaggtcaccgtcgacgacgccgccctgttcaccggccggttcggctccggtgccctcgcctccttcgaggccacccgctacgccaccggccgcaagaacgccctgcgcatcgaactcaacggcgagcgcggctcgctcgccttcgacctggaacggctcaacgaactgtggttccacgacggcaccgaacccgacgagcgcgccgggttccgccgcatcctggtcaccgaacccggccacccctacctggaggcctggtggccgccgggccacggcctgggctacgagcacaccttcgtccaccaggcccgcgacctcgtccacgcggtcgccgaaggcggcggcgccgagccgtccttcgcggacgggctccaggtgcagcgggtgctcgccgccgtcgaggagagcgccgccaagaactccgtctacacccccgtagccgtctgaggaggcccgcgagatgccgcgcccgttcacgctcttcaccggccagtgggccgacctgcccctggaagaggtctgccgcctcgcccgcgacttcggctacgacggcctcgaactcgcctgctggggggatcacttcgaggtcgacaaggccctcaccgactcctcctacctcgcctcccgccacgaactgctcgacaagtacggcctgaagtgctgggccgtctccaaccacctcgtcggccaggccgtctgcgacgcgatcatcgacgaacgccaccgggcgatcctgcccgagtcggtgtggggcgacggcgacccggagggcgtacggcagcgggccgccgcccggatgaaggacaccgcgcgggccgccgccgccttcggcgtcgacaccgtcatcgggttcaccggctccgccatctggcacctggtcgccatgttcccgcccgcccccgagtcgatgatcgaacgcggctacgaggacttcgccgcccgctggaaccccgtcctggacgtcttcgacgccgagggcgtgcggttcgcgcacgaggtccaccccagcgagatcgcctacgactactggaccacccaccgcgccctggaggccgtcggccaccggtccgccttcggtctgaacttcgacccctcgcacttcgtgtggcaggacctcgacccggtcggcttcctgtgggacttccgcgaccggatctaccacgtcgactgcaaggaggcccgcacccggctcgacggacgcaacggccggctcggctcccacctgccgtggggcgacccgcgccgcggctgggacttcgtgtccgccgggcacggcgacgtgccctgggaggacgtgttccggatgctgcgctccatcgggtacgcgggccccgtctccgtcgagtgggaggacgccggcatggaccggctgcagggcgcccccgaggctctgacccgcctcaaggcctacgacttcgagccgccgtccgcctccttcgacgcggcgttcggcaactgacctcttcccccctccgggatgacggcgcatcccggcgcacgcactcacccgtacgaccggccccatcgatggaggcatccgtgcacgggaacgaccgcaccacccgcaccaccggccccgacagaaccgactccgcaggacggcggcgcccggccttccgcaaggcggtcgcgctgctcagcggcgccctgctcgcgggcgcgtccctgaccctcgccgcaccccaggccggcgcagccgtcgccggcgagaagaccggcccgaacaccgcccaagctcccgccgaggacttccagcaggtcaccctcgccaggggcgcggccgaggtcggcgagcccatgtcgctcgccgtcctgcccgaccgctcggtcctgcacacctcccgcgacggcacgctccgcctcaccgacgcggccggcaacacccgcgtcgcgggcaagctcgacgtgtactcccacgacgaggagggcctccaaggcgtcggtgtcgacccggacttcgccaccaaccggttcgtgtacctctactacgcgccgccgctcagcacccccgccggcgacgcccccgagaccggcaccgccgccgacttcgcgcccttcgacggcgtcaaccggctctcccgcttcgtcctgaagacggacggcaccctggacacggccagcgagaagaagatcctcgacgtccagacctcccgcggcatctgctgccacgtcggcggcgacatcgacttcgacgcggcgggcaacctgtacctgtcgaccggcgacgactccaacccgttccagtccgacggctactcgccgctcgacgaacggcccgaccgcaaccccgccttcgacgcccagcgttcggccggcaacaccaacgacctgcgcggcaagatcctgcgcatcaaggtcaacgcggacggctcctactcgatccccgacggcaacctcttcgcgccgggcacggccaggacccgccccgagatctacgcgatgggcttccgcaacccgttccgcttcagcgtcgacaagaagaccggcatcctctacgtcggcgactacggccccgacgcgggcgcggccgaccccaagcggggcccggccggccaggtcgagttcgcccgcgtcaccggccccggcaacttcggctggccgtactgcaccggcgccaacgacgcctacgtcgactacgacttcgcgaccaagacctccggtgccgccttcgactgcgacgcgccgaagaacacctccccgcacaacaccggcctgaccgacctgcccccggcccagcccgcctggatcccgtacgacggcccctccgtgcccgagttcggcgacggctccgagtccccgatgggcggcccggtctaccactacgaccccgcgctcgactcgccggtgaagttccccgaggcctacgacgggaacttcttcgccggtgagttcggccgccgctggatcaagcggatcgtcagcgacgacaagggcaccgtgcagtccatcaaccccgtcccctggaccggcacccaggtgatggacatggccttcggtcccgacggcgcgctgtacgtcctcgactacggcacggcctggttcggcggcgacgacaactccgccctgtaccgcatcgagaacgccaccgacggccactccccggtcgcccaggcagccgccgaccgcacctccggccaggcaccgatgcaggtccgcttctcctcggccggcagcagcgaccaggacggcgacgcgctcacctacagctgggacttcggcgacggagccaccgccaccaccgccgaccccacgcacaagtacaagaagaacggcacgtacaccgcgacgctgaccgtcaaggacacctccgggcgcaccggcagcgcgagcgtgcaggtcgtcgtcggcaacaccgcacccaaggtgacgctgcaactccccgaggacgggcagctgttcagcttcggtgacgccgtaccgttcaaggtgaaggtcaccgaccccgaggacggcaaggccatcgactgctccaaggtcaccgtcaccttcgtcctcggccacgacacccacggccacccgctgacctccgcgcagggctgctccggcaccatccagaccagcgccgacggcggccacgacgagaacgccaacatcttcggcgtgttcgacgcccagtacaccgacaacggaggcggcggccaggccccgctgaccacccacgaccgcaacgtcacccagccccgccaccggcaggccgagcacttcggcgactcctccggcgtctccgtcgtcgccaaggcgagcgcccacggcggcaagacggtcggcgacatcgacgacggcgactggatctccttcacgccctacgtcctgagcaacgccaaggagatcaccgcgcggatctcctccggcggcgcgggcggcaccctggaggtcagggccgggtccccgaagggcaccctgctcggcaaggccaccgtgccggtgaccggcggctgggagaccttccaggacgtcagcgcctcactgtcccgcgcgcccaggggaaccaccacgctctacctcgtcttcaggggcggcaccggagccctcttcgacgtggacgacttcgtcttcaccaccggctgaggggaggacacatgaagcgctccaccggccggctcgccacggccgtcacgggcacagccctgctgctcggctccctgtccgcccccgcctccgcccatccgcacgacggcggcgcacgcatcctggtcttctccaagaccgccggtttccggcacgactcgatcccggaggggatcgcggccgtgcgggaactggccggacagcgcggcttcgccgtcgacgccaccgaggacggacgggccttcacccccgccaacctgcgccgctaccgggccgtcgtgttcctgtcgacgaccggggacgtgctcgacgcgcggcagcagaaggccttcgagcagtacatccgcaacggcggcggctacgtcggcatccatgccgccgccgacaccgagtacgactgggcgttctacggcgggctcgtcggcgcctggttcaagtcccacccggcgatccagccggcccgggtgaacgtcgaggaccacgcccacccggcgacctcgcacctgcccgggacctggaaccgcaccgacgagtggtacgactaccgctccgacccgcgcgagaaggtacacgtcctcgcctcgctggacgagtcgtcgtacaccggcgccaccatgaacggcgaccacccgatcgcctggtgccagagctaccagggcggccgctccttctacaccggcggcggccacaccaaggagtcgtacgccgacccggccttccgcgcccacctgctcggcgggatccggtacgccaccggcgacgcccaggccgactgccgcccggagaacggctaccgtccgctcttcgacggcaccgccgcctccctcgacggctggaaacaggcgggcccgggcaccttcgccctggacgacgacggcaccctgacgtcgtccggcggcatgggcctgctctggtacgcggcctccggcttctcctcgtactcgctgaagctggactggaaggtggccggcgacgacaactccggtgtgttcgtgggcttcccgccctcggacgacccgtggtcggcggtggacaacggctacgagatccagatcgacgccaccgacgtacccgagaagaccaccggctcggtctacggcttccagtccgcggacctcgcccggcgcgaccgtgcgctgaacccgccgggggagtggaacacgtacgagatccgcgtcgagggcgaacacctgctggtgttcctcaacggcgtgcggatcaacgagttcaccaacaccgatccggcccggagcctgaccgacggacacatcggcatccagaaccacggacccgatgaccaggtgtcgttccggaacatccggatcagggaactgcccgcggcgcacgctccgcgggaccactgaacggcggcgggcgggggacgccggacccccgcccgccgtcacccccctcggccaccagtcctcgtcaccgtctgccgtcaccacctcgaaagccgtctcttccggcgtcccgcgacaggaggctgtccatgcccgcgtccttccccgaccgtcccgtcggcgtctggctgatcggggcgcgcggctccgtcgccacgaccgtcgtcgcgggctgcgccgccctcgccgcgcggctgcacccgcccaccggcctgctcaccgagaccccgctgttcaccggcaccggcctgccgccgctgtcctccctcgtcttcggcggccacgacaccacggactgccccctgcccaaacgggccgaggcactgaccgcggccggtgtcctgccgtacggcgtcaccaccgccgtcacggccgaactcaccgccgccgaccgcgagatcagaaccggcggaccacttcccggcgacctgcgcgacgaggaggagctgaccgccgccttcaccgccgacatccaggacttcgtacgccgcacgggcgcggcccgcgccgtggtggtgaacgtggcctccaccgagccgtcgccctcccgcacggccctgccgccgagttccctgtacgcggccgcggccctgcgcgcgggctgtacctacgtcaacttcaccccgtccaccggcctgcaccaccccgcgctgaccggggccgcgcgggcgagcggactgccgtacgcgggccgcgacggcaagaccggccagaccctgctgcgctccgtgctcggcccgatgttcgcgcagcgcgcgctcgacgtgcgggcctggtcgggcaccaacctgctcggcggcggcgacggcgccgcc

SEQ ID NO: 655 - DNA, 3157 bp, Unknown
  Kingdom: Bacteria, Phylum: Actinobacteria, Class: Actinobacteria, Order: Streptomycetales, Family: Streptomycetaceae, Genus: Streptomyces
ggcgggttgccgtgcttgcgcgagggcaggtcggcgtgcttgctgtgcagcatcgccagcgaccggacgaggacttcccgggtctcggcggggtcgatgacgtcgtccacgagtccacgctcggcggcgtagtacgggtgcatcagctcggccttgtactccttgaccatcttctgccgcatggcctcggggtcgggcgcgtcggcgatctggcgccggaagatcacgttggccgcgccttccgcgcccatcaccgcgatctcgttggtcggccaggcgtacgtcaggtcggcgccgatcgactgggagtccatgacgatgtacgcacctccgtacgccttgcgcaggatcagcgagatcctcggcacggtcgcgttgcagtacgcgtacagcagcttcgcgccgtgccggatgatgccgccgtgctcctggtcgacacccggcaggaaccccggaacgtccagcaaagtgacgatcgggatgttaaaagcgtcacacatctggacaaagcgcgcagctttttcactcgcctcgatgtcgaggacaccggcaagcacctgcggctggttggcgatgatgccgacgacctgaccgtccatccggcccagcgcgcagatgatgttgcgcgcccagcgctcgtggacctccaggtactcgccgtcgtcgacgatctcctcgatcaccttcgccatgtcgtacggccggttgccgtcggccgggaccaggtccaggagcacgtcggagcggcgctcgacggggtcggagcactccacgcggggcgggttctcgcggttgttctgcgggagcagggagaggaggtagcgcacctcggcgatgcaggtctcctcgtcgtcgtaggcgaagtggcacacacccgaggtctcggcgtgcacgtccgcgccaccgagcccgttctgggtgatctcctcgccggtgacggccttgacgacgtccggtccggtgatgaacatctgcgaggtctcgcggaccatgaagacgaagtcggtgagggcggggctgtaggccgcgccgcccgcgcacgggccgagcatcacgctgatctgcgggatgacaccggacgccctggtgttgcgctggaagatgccgccgtacccggcgagcgcggagacgccctcctggatacgggcgccggcgccgtcgttcagggacacgagcggcgcaccggccgcgatggccatgtccatgatcttgtggatcttcgtcgcgtgcgcctcaccgagcgcgccgccgaagatgcggaagtcgtgcgcgtagacgaagaccgtacggccctcgaccgtgccccagccggtgaccacaccgtcggtgtacggcttcttcgcctccaggccgaacccggtcgcccggtgccggcgcagctgctcgacctcctggaaggaaccggcgtccaggagcagttcgatccgctcccgcgcggtcagcttgcccttggcgtgctgcgccgcggtcgccttctcgctcggacccgccaccgcctgcgcacggatcccgtgcagctcggcgacccggccgcgcgcgtcagccggctcgccggtgggctcacccgtcgtctcttccaaaacggtcatgtagcgaccttacgaaggacaccaaggaaagcgagccgtcgactccgtacagtctccggcccgttttcctggtacccctgaacagaacctgggcgccgtgcagcctttcctcctgctcagaggggatcggcgttgtagaggtcacacaaactcagggtgcgagagccacctcacattcatgggtggcacatgccttccccggagtgacacgcagacccagatgggcgcctcgccggaccacctcgaccgtgtcgtcgtggcgcagcacgcgccgcaccggacggtcccgggtgtcccagacgatctccagcggctcgccggtgcgcggcggctcgctcacgcagagcgtagcggtacggccctgacgccggaccagcacactggccccgcccgacgcggtgagcggtcccaccgtaccggcccgccagaagttggcggcgagcaggccgagcgagggcacggcgacggcctggcagtcggcgtcgttggcgaggaccgtcatccagcgccggtcggcggcgcgcgcggcgacggcacggcgggcggcgccgggcatgaggaggtacgcgcaggaggcgtcggccgggtcggtgccgtggtcgaaccagagggtctgccagcgccgggtgcggcgctcgggcgagctggtggtgttgatgtcggaccaggcgccggtgcggtcctcgcgcagcgccttcggttcctggcggcggggaccggggaacacccagccgccgtgcccctccaggtgggcccagccgtcgccgcggacgaaggcctgggtgccgccctcccccaggttgcggttgtcgacgacggtctcgaccggcacgccgtcggcgcaggtgatccctgcggtcaggcagatgacggcgtcgtcggcgcagaaccaggacttgcgggcttccagcgtggagccgagccctttgacgtgctgtccgatcgccgcgtacgtgccgtccgtggtgccgccgacccaccggacgtccgggcgggaggcgccccactcgccgcccgcgcggtcggccaggcgcttggtggagacggtggtgccgggcagccggtaccagtcgacggtcggccagaaccagtccgtgtactggtcggtgggctcgcccgccgcccaccacagaaccatgccggcgccggtgtgccagccgcgcgggttctccccgttgccgcactcgtaggaggtgatgcggtcgctggccatggagatgttggcggtgaagcgcgggcggcggtggacggcgcggtccatggccgggaagaggtggtggcccagcggttcgggcgcggcggcgacgggcgagtcggcgaccgcgtgcagccgggcgaggtcggcgacgtcgaactgcggcgcggtcagggccggggtgacggtgtcccgttcgatccagcccttcacgcgcgcgtgccagcgttcgcgctcggccgggctcgcgccgtcggcgagcagcgcgatggcggcgatcagcccctgcccgtggaagtggtcgctgcgcatgacgtgccggtcgtcaccggtgaggtaaccgcggctgatcgcccggccgttgacgctgtcc

SEQ ID NO: 656 - DNA, 3114 bp, Unknown
  Kingdom: Bacteria, Phylum: Actinobacteria, Class: Actinobacteria, Order: Streptomycetales, Family: Streptomycetaceae, Genus: Streptomyces
gggcacggcggcggcgagcgggtcggtcgtgccggccggggtggtggcgatcacgagaggggcctccagggcctgctcggcccgcgcccagtccgccgtacggacctccacgcccagccgttcgccccaccggcgcatctcggccgcgcgggcgtcgctgcggacgtaggcgacgacctcgccggtgcagacgcgggcgagtgcggccagcgcggaggaggcggtggctccggcgccgaggatcgccgccgagtcgacctgttcgatgccgtgctcgcgcagtgcggcgaccatgcccgggatgtcggtgttgtcaccggtccgccggccgtcctcggtgaggacgaccgtgttgaccgcctcgacggaggccgccgtctcgctgatctcgtcgagcagcgggatgacggcccgtttcagcggcatggtcagcgacagccccgcccactcgggcccgagcccgtcgaggaagccgggcagagcggcctcgtcgacctcgaaccggtcgtaggaccagtgggcgagccccagctccgcgtaggccgcgcggtgcagcaccggggagagggagtgggcgatgggcgaaccgagcacggccgcccggcgggatggcttcatcaggacatcttctcggacatcaggacttcttcttggacaggttccactcgtcgaccagcttgtcgtgctcggcgagtgtcttcgtgaacttgctggtcttgccgtccatcgagatgaagtagtaccagccgtcgtccgtcgggtcgagagcgcccttgagtgcttcctcaccggggttgtcgatgggtcccgggggcagcccggtggcgtagtaggtgttgtacgggttggcgtacctgcgcagctcggcgatgctcaggtcgatcttgctctggttcttcacgtagttgtacgtggagtcgaactccagcttgccgttggtctgcgtgttgccgggcttgaggcggttgtagacgacctcggccatcttgcggaagtcgtcgtggctcgtgccctcggcctgcacgaggctcgccacggtgagcagttgccaggggccgtcgaggccgaggctctcggccttcttcgcgaggccgagctgcgtgtaggtctcggtggcccgggagaccatgtccttgaggacgtcctcgggtttctgccccttggcgacggcgtagctggaggggtagaggaacccttcgagcgggtccttgaggttggggtggttcagtgcccattcgggcaggcccagcttcttgtagtccttcttcgcggcgctcgccgtggtgccctcgggcaccccgaggcgcttgtcgatcagcgtgtagacggccgcgttgcgcgagccctcggcgatgatcaggttgctgcggctcttcgggctgagcatcagctgcacggcgctggcggccgacatgtgcttctgcagcgtgtagacgccgtcctggatctgcttgccgttggggttcgcggcctgcgcggagacgaacgcgtcgacgctctcgacgacgcccgccttcttcagctcctgcccgatcacgtatccgccggcgcccttggggatgacgacggtgacctgctcgccgttgccgctgcccgcgaagtccggggccgtgccgaaacgattttggtagaactggtagccgtagtagccgaccccggcgacgccgccgccgaacaccaggacgacgaccagacaggcacagccgttgcgccttttccggccgggcttgcccgcacggcccttgccgccgcggccccggcccttcgcgggggcgtcggcgtcgggatcctcgtcggcgtcgtcgccgccgcccgcgaagaaggagtggtcctcctgggcgggctcgggctccgggtcccagtcggggcgctgctccggctcgggactgcggcggttgggcggctccggtggcggataggcgtcgggggtgccgtagagatcgggctgctccgggccgtacgccatggactgtccgccgtacgggtccaccgggtcgccgccgtagggcggctgcgcgtgtgcaccgccgccgtcccaggcagcctgctggtactgctgctcctcgggacggccctggtgctggttcccgaactggtggccgccctgctcgccgtagtgcggagactgaccggtgctctgctcgccgtagtgcggggactgaccggtgccctgctcgccgtagggctgctggtacgggccgccgtagccgggctgcggctcctggctccagccgccgtactgctgctgcgggtggggctgctggtactgctggtccggctgcgggtggtgctgcaggccgccgtaggaggactgcgggtccgcgggggcctgctgtcctccccatccgccgtccccgtacaacgggtcctcgggatgccacggttcggggcctgggccccggccatactcagtcatcgatcccctagcgccgcgagacggtggtcacgttgcgtgacgaccgctgccgtcccgcctcttgctgtgcggcggctgttcgagggccgccgcatcgcgcggaacgttaccgtatcgcgatcagatgaccacttcgacgccctctccgggtgctgcgcctgacacccgttcggattccagggcctgctgcaggatgatgacggctgctgcctggtcgatcacggagcgtcccttcttggacttcactccggaggcccgcagcccctgactggccgtcaccgtcgtcatccgctcgtccaccagacggaccggcaccggggcgatgcccttggccaactcccccgcgaacgcgcggaccttgacggccgccggaccctcgccccccttgagggagcgaggcaggccgacgacgacctcgatcggctcgtactcctcgacgagctgccgcagccggcggtgggccgccgggacgtcccggccggggaccgtctccaccggtgtggcgaggatcccatcggggtcgcacgaggcgaccccgatccgggcgtccccgacgtcgatcgccagccgtcggccgcgtcgcatcacttggccgtttccgccacgagccgctccacggcgtccacggcgtcgccgaccgcggccgggttctggccgccgccctgggcgacgtccggcttgccgcccccgccgccgcc

SEQ ID NO: 657 - DNA, 1350 bp, Unknown
  Kingdom: Bacteria, Phylum: Actinobacteria, Class: Actinobacteria, Order: Streptomycetales, Family: Streptomycetaceae, Genus: Streptomyces
cctccgtcctctcccccgccgccacgggcaccgtcgtccacctggactgctcacgcgccaccgacggcacgggcacaccggaggccccgtacaactccctggcctccgtcaacgccctgaccttcgggcccggggacaccctggccgtcgcctcgggcaccacctgccacggcacactggcgccgcgtggcagcggcaccgccgacgcgcccatcaccatcgccccgtacggcaccggagccgccccggtcatcgacgcgggcggcgccgagaacgcgctccatctgaccaatcaggaccactggagcgtcaaggcgctccggctcaccaacccggcgagcgccgtcgcacagcgggagggactgctgatcgagtccacggacggccggacgcactccgggttcgacgtcgacggcctgctcgtggaccacgtggcgggcgagacgaacaaggcgacccacgcgacggcgttctccatgtccgcgtgcatccgggccggtgtgtccggcaccggttcgctcctcggtgacgtgcacgtccacaacacccgggtcgcggactgcgggggcggagggatcaaggtccgcgtcggctcggtcaacacccgcctcggccagaacgtcctcgtcgaccacaacacggtcagcgcggtcggcggcgacggcatcatcgtctcctacgccgagtcgccgctgatcgagtacaacaccgcggccgacctcggcaccggcgcctacccgtggaccggcggcaacttcgccgggatctgggtgctcggcgaccacgacgcgacgatccagaagaacgccgtgtacggcagcgtcatgtcggcctacgacagcgaggcgttcgactgcgactggggcaacaccggccactgcacggtgcagtacaacttcagccgcgacaacgccggcgggctcttcctggactgcgacggctgcggaacggtgggcggcgcgaccgaggtggtgcgctacaacgtctccgagaacgactgccggatggtgggcgccgggggcggccggtcggcgctgcgcttctacaacaacgtcgtctactgcccgggccgcaagctcgacatctcggtgcccgccgacagcctgctggagaacaacatctgggtgggcggcgccgacacccggctgcccaccggggccggcgtctcctggcagtggaacgtcttccagggcgtgccgcgtcccaccgccaacggcatcgtgggcgacccgggcttcgtcgcccccggcaccggcggcgacacgctcgcctccgccgacggctaccgcctcagggccggctcgcccgcactgcgcaacggcggtgtcgtcgcggacaacggcgggcgcg

SEQ ID NO: 658 - DNA, 2264 bp, Unknown
  Kingdom: Bacteria, Phylum: Actinobacteria, Class: Actinobacteria, Order: Streptomycetales, Family: Streptomycetaceae, Genus: Streptomyces
gaccagggccgctccggcgtgcagcagttcctccagggcggcgtcgagccggtccgtgcgggccagccgctcggtcagctcgtgcagggttgtgaggtcggagacccagcccgcgagccggtcctggaggagggcgcccggcgggtgggcggtgtgcgggcagtgcgcgctgtgcgcggcggcggccggggaggtgtccggggctgcggaggcgggcgcgacagtgtgggcgggtgcgggaaccgttgaatcgattccagccactttctgagggtgaggggcgttcatggtgtccggctttccgaccggtgcgtactgctcagaagcatcgcaaacccccatgtcattctgcgccgccagcagtgtctccacatgtacacgcactcgtgaggggatgtccagcattgtcctgccgggattcctggtgtcagagggccttccgtggtcttcctcctgaactcttgcgcgtcaacgaagttggcttgaaactgcctcgggtgacggcctattgcggtcgactggtttcgttccacagagcgtcacagcggtcgtgatgggtacgtactcggagaagaccaggggtggttgggaactgcccggaacctggtgacggacccgggcgtcctatccaccgacggccgtgccccatcctcgcgtgacggcggcggagagcagaacgagcgacggcaaagcgccatgctccgccaccccgcgccacgcccatgctcttgagagacgcgtatgggcagggctgccgcagaagcagccggtgcccggcccgaagggtcccccgtgccgaaggcaggggtgtgatgcgccaacaggtacgcccagtgcagtgatcgacacatggtgtgatgtggcccacggtgttgccagcggtgcaacggaaaggaacgagcgctcatgcgcgagatccccggaaggcgacgcaggctcctgtcccggcgcggcgacgggagggccgagccgatcgacgcggccctgaccttcgccgcccagtggcagtggccggtgctccccggcgtggcacgggacccgaggcggcccgcacgctgcgggtgccccgaccccgagtgcacggtgcccggcgcacaccccttcgaccccggcctcctcgcggccaccaccgacgcccggatggtgcgctggtggtggaccaaccggcccaccgcgccgatcgtcctggccaccggcggcaaggcgccctgcgcggtgagcctgcccgccctcgccgcggcccgcgccctgcgcgcgctcgaccacgccggcatgcggctcggcccggtcgtcgcctcgcccgcgcgctggtcgatcctcgtcaagccctactccatggagcagctcggcgaactcctctacgccaaggacttcgtgcccggctcgctccgcttccacggcgagggcggctacctcgccctgccgccctccgagacgggcgccggaccgatccgctgggagcgcgccccgctgcccggctcggcctcgccctgggtgcccgacgtcgaggccgtggtggacgccgtggtggacgccctcactcgtaagggtgtgagcgcgcccgagttgtaggggcgtcgggcgcgccgaggtcaaacgcccgttctggtcgttatcttccctttatgctgcgccatctccagggacacggaagcggacaccccgatggacgccgggacggccgggcgaccggccgtgcgcaccggcacgacgaccttggggacggggccgtgcctccgcgcggtgccgatccccggcggatgcggctgttcgccctcatgggcgtcgtggcgtgcaccgtcgcgctgccgctggccgtggcgtccgcgggacaggtgggcgaccggggcggtgccgccgcgtccgcgacgtcgtccggcgtaccgtccgccgcgccctcccggccgcgaggcgacgacaagatgccgtccgccgcacccacccgcacgccgttcatgctcggcctcgggctggcgaccgccgcccgctgcggccccgaggtctcctcgcccgacggtgtcgaggcgcagacctgcgtactcacccagggcgccgacacctgggcgcgcacctactaccgcaacgccaccggcgaagccctggacgcggacctgaccctcatgggcccgggcgatcacaccgtgcgcacccactgcgccgtgggaggcgacgacgaaccggacacgtgcgagacgccccgggaacgcaccagcggtgcgccggatgcctacacggccgtcgccgagttcgccggacgtgcgggg

SEQ ID NO: 659 - DNA, 3232 bp, Unknown
  Kingdom: Bacteria, Phylum: Actinobacteria, Class: Actinobacteria, Order: Streptomycetales, Family: Streptomycetaceae, Genus: Streptomyces
cggtgtgcggcgcggcagccgccatgcggggcgcggcagttgcagcacgcgtcgtggcggccgcgctgagtgccgccgccggcgccgtgtgctgcgtgggcccggtgggccgtcgggcggtcacaggtagtcgccgtacgcgctgttgccggcagtgtcgccgtcgccgggggcggcggcggtggtgggcttgcgcggtgtgccgcccgggggtgtgtcctcgcccagctccaggtacagcctgtcggtcagtgcgacgcggcttccggcgcgcagcggggtccggccgccctgtttgcgcaggaccgctccgccctcggggttgcgccggacggcgtacgggccgtgggtgcgtttctcgaggcgggggttgcggtgggcctcggcgatcgcgaactcgtaccactgcttcttgttgccgcgtccggccttgtgctcgtacagcagctcgccgtcctcggagaccaggtgcagcttcagcccgtacgggtccctgcggcgccggcgcagccgcgtccaggcgacggcggcgacgacgagcaccgcgagcacgacgaccgcgagcacgaacgcccaccagtaccggtcccagatgccgggctcgggagtgacccgcagggagagcggggaggccgccagggtgcggttgccgtcggtggcgtcggtgaccctgatggtggcggcgaggctcagtccgtcgccgaggcggtcgccgaagacgctcgccggagcgacctcgacgctcaccttccgggtgcccgactcgcccggcttcagcgtcaccgtggccgggctgacggagagcagcccggagcggacgtcgtcgacagacaggtgcagggtgtgagcggtggtgctgctgttgtggacgtcgagggtgccggtgacggtcgcgccggggtggacgtccgcggcgggcaggtcgagcggcgcggtgacgggcggcgggccgggcgccacgtcgatgccgaggtcgcgggtgtcggccttgagtccggaggcggtgagggtggcgctcaccttcagcgtgccctgggcgctgcccggaacccgcacggtgccggtgaagaagccgtcaccggccgtgcggtcggccccggtgccgtcgtcggtgaggttcagcgtccgcggggtgccgcccgctccggtcagccggccggccacgcgcagcccggcgtagtcgcgcgggtccttgatctcgtagccctcgcgggtctgcagccgcatggtgaccgtgaccttctcgccggcctgcggcgagggcgggtcggcggtgagcgcgccgcgcagttcgccctgccacagcacgctgacggcgaccggcagcgagcggtggccttccggtgcctcggccttcaccttccaggtaccgggcagcgggtcgacgaccttgagcgcctccaccgtgccggagccgccggccagttcgaagccggacttctcgtacgtgccgtgcgtgggcaccttgttgccgcgcgggtcgtagtacgtgatcctgaccgcggggtcgcccttgtcgacgacgatgctgcccacggtggccagcggggagatgcctatctccagggtggcgggcgggcgcttgctgggaccctgttcgtggcgcaggcagtgggccgcggcgaagatctcctccagcgtgccgccgatgtccttcgacccggagaccttgtgcgccttcggggcggccgacggcagggcgacgcagcccttctggtagccgcccgcggccatccggtccagctgctgcttgtccgggtcggcgccgaagccgagcggccagacctgcacgccgtgggcggcggcgtcggcgagttcctgtttgagctggcgttcgccctcggcggtgcggtgggccgggtcgccgtaggccgggctgccggtgacgtcgagtttgccgtcggtgagcaggaacagcacacgcggctgggaggggtcggtgccgtcggtcaggtcgtgcacgccctggcgtatcgcgctcgggaagtcggtgccggtgccctcgtccttcttgcggccgcggagcttgccgacgcacgcgtcgatcgtctcgcggcccgccgcgtccagcgcggtgcgcgggcagaccgggtccaccgcgcgctggtcggcggactccgcggcggcgaagccgtagaccgtgacgtgggacgcggaggagacgtcgccgagcgcgatccgggcggcggcggccttctcggccttcatgtcgtcggccgtgagactggccgactcgtcgacggcgaccgcgtagttgacggccgggaacgccggggcggtgtccgccaccggcaccgtgtcctgtccggccggtgccagcagggccacgagcaccgcggcgccgcccagcaccgagaccgcgacgcggcgcgcccgtcccctccccgtctgccgtcttcccgtgactcttaccacggcatcccctgtttcctggtgcgtgtcggtgttgcctggtccgtgacgtgctgcccggttcatgaggtgttacttgctctgtgcggtcagtgggaggtcaggccccagatcagtgccagtgccgacgacggggcgagcgcgcccaccccccagcggatggcccggtacttggcggacaggatcgagctgacgtccaccgcctggacgagcagccagcgcgtgggatcgaggccggcctcggcgacccgggcggtgagccccgcgaggtcgcggggcgccaccaggtcgccgaagtacgtcaccccgtccccgccgcggaccgtgccggtacgcggcagcagcgccccgaccagcgcgcccaccgcgacggcccagaagacaccggcgaggaccagcgtcacgtcggcgatcccgcgccagcccggggtgccgtgccagccgaccaggaacgcaggcagcgccagcgtccccgacagcagtacggcggccttggagtcggcgcggccgaggtcctcccggaccgtgctcagcaggcgttcggcgatgcgctcctccgcccggtcgtggctgtgccgacccccgttcggcacgggcacgaccgggtcggaggaggtctggggtccgccctgggcgctcatcggtcctcctccgcccaggaccagccgtcgtcgtcggtacggctgcggcgcagcggcccggggtccggctccccgtcctcggggtagtagggctcgggacgccggggctcggggtcgtaggactcgggacgccggggctccgggtcgtaggactcgggacgccggggctccgggtcgta

SEQ ID NO: 660 - DNA, 2077 bp, Unknown
  Kingdom: Bacteria, Phylum: Actinobacteria, Class: Actinobacteria, Order: Streptomycetales, Family: Streptomycetaceae, Genus: Streptomyces
cccgtgcccctcccctgggcgaacgggccgaccgctcccccagggagcaggccggcccgttcgtcgtctccggcgggtcaggcgggtcagcgcagggcgcgcagggccttctccgctcccttcgcgccgagtctcacgaacaccggggccgtgcccagaggtgtcgcgtaggacgtcagggtgcggtcgccgtggacggtcctggcgtgggccacgtcgtaccaggtgcccgggggcaggtggacctggcgggtgggggcgtcggtgagctggggggccgccaggaccgccgggcccagcatccactcgtcggtgatcgtgtaggcggccttgtccttcgggaagtcgaagaacaggggccgcatgatcgggtcgccggtgcgcagggtggcctggacctggtcccagatgtagggggcgaggcgggtgtggcgggtgatcgcggcgcggtagaggtcgatggtctcctggtcgtagaccaccttcttgcctgtggtggggtcgttggtctccacgggtgacgtggacgcgtacatcagcggcatcagggacgacgactgcgcccagcgcaccaggacctgcttgctgggggccggctggcccagcgagccgccgatcatgtcggtggtgacgaacgggtagccgatggtggagatggccaggttctgggagacggaggcgcgcagggagttccagccggtgcccttgtcctcctgccgggtgacgaatccggcctggtgggcggtgctgtcccagtggacgcggatgccgacgccctggaggtcgtagccgtcggcgagctgggtgccgagccgctggtagtcggtgggcttgtagccctcgtgcggggcgcacttctcgtcgatgaagcgggtgtcgaacttcaggccgtcgatgccgtaggtgctcatgagggacttcaggcggccctcgtaccaggccttggcgtccgggttggcgaggtcgacgatgcccgcggtgccgttccaccaggtgaccgtgcagggcttggcggtgtcggcggcggacttgagaaggtagccgtggtcggcggcgtaccggtactggtcggagtcgaggttgatccacagggtgacccacaggccgaagtcgaagccgaggtcgtggatcttctgcgacatggccttggggtccgggtaggccttcgcgtcgaaggtcatgttcccgtagttcgactcccacttgtcgtcgagctggagcgtgtggcccttgatgccgttgtcgtgcaggctctgcgcgtagtcgaggagtttcgcctggtcgacgtgggtgtagaactgcgcccaggagttccagacgggctcggcgtactgctggtaggtggcgtcgctcttggccggtctgccgacgatgccgatgtagtcgcggtagacgtcgagcggagtcgactcgacgaagacggtcgccttgtacgggtcggtggactcgatgtcgaagcggccgaggccgtccttgttctggttgacggccacgtccatgacgtggccggtgtccacgcgcagaccggtcgcgcgcgaggtgtaccagaaggggtcgaccatgaagtacgacgccgggccgaaggccgagtggaccacctggccgctgtcgaggggccagggctggtcggtgccggggccgcccgagggcgtctgggcctcgccgtggccgtaccagtggccggcggaggagaggtcgtaggcgatgccgaggcggtcgggagtggcctggccggcgacctgccagtcgagttggtagcggtcggcggcgggggtgacgcgggcctggaccgtcgtgccgggtgccgtggtcgccgcggtgagggtgagggtgccgtcgtgccaggtccagtcggtcacgcgggtggcgtgctgccaggttccggcggtgcggaagcgcagggcgccggtgtcggcgggggccgtccccaggactgtttccccggaccggctcgtggtgaaggcgagttgaccggtcgtcacctgcaggcggtagccgggggcggtgcggctgcgcgggacggtcagggtgagtccgtccggggaggtggcgaggcggggcgtgggcgtctgggcgg

SEQ ID NO: 661 - DNA, 2785 bp, Unknown
  Kingdom: Bacteria, Phylum: Actinobacteria, Class: Actinobacteria, Order: Streptomycetales, Family: Streptomycetaceae, Genus: Streptomyces
tgcaccggcggtggcggcgagtcggcgctcgccgccaccgccggtgcatatgcgtgctttgcgctgtgtgcggcggctgtcgcctacggaatttccctgattctgggctgacaacaggaaacactccagccccaccggtcacgctccgcagcttctgcatcaacccccgtaagcccttctgtggcacttacgggggtttttgctgcattcgactcgccttcgagaggtccgcgaaacgacacatgtcatactgacgaaggctggtcgccgtggtctaagtaacctactctagtgggtagttaactgttcgatggtggcagcccgacaagtcaacgccgacatgtggcagggagcaccatgccaagagacatcgatccgagcctcaaccgacgcaggctgcgaatcgaactgcgcaaggcccgcgagaccgccgggatgactcagcgggacgccgcgaacgccctcgaatggtcgctctccaaactgatcaggatcgaggcggggacggtcagcctcggcgtgacggacctgcgcgcgctgctgcagttgtacgaggtcacggacgccggcctggtcgcggagctggaggacgcggcccgcggctcgaagggacagtcatggtggacgcagtacagcgacgtggtgtcgccccagtacgcgttgtacctggggtacgaggggtcggcggacacgatccgcatgtacaacccgaccatcctgccggggctcgtgcagacggaggactacgcgacggcgctgctgtcgccgatgacgctggagccgagcgcccggcagcaggtggatctgcggctcacccggcaggagcggttcttcgacacggacgacggtcccgcgatggacatcgtcctggacgaggcggccgtgcggcgccagatcggcggccccgcggtgatgcggcggcagctcgaccacctggcgacgctggcggagcacccgcgcaccacactgcgcgtgctgcccttctcggccggggcgcacttcagtgtcaccacggcgttcatcctgctcacgttcaaggacgacgacgacctgctcttcgtcgaaggcccgggcggcggcctgtcgagccgtgacgacctggcactgctcgtccgctaccaggagtgcttcgaggagatcagcaccatcgcgtacgaaggcgaccggatgcgggagttgctcgcgtcggtcagggagagtctggacaacggctgaacccgggccggtacgacccgggctggaacgggggagggcccatggcggtcttcggaatacgggcgtggtggcaacgcctgcgcgcaggcagctcggaacctgaggccgcggtggctctcgacgacaacaccctcaagcgcgaggccatgcagagcccggatctgaccgacgccctcatccggctggagagcgcccggacggcaggtgagatccgtctgctgtcggtgcggctgctgctgggcaccgcctgcggcagtgtcctgctgctgagcgtcgccgtggccacccgggtcgcgcccagcctgcccttcggcgccgccaccccgctgaccacgacgatcgccggggtcggcggggcagccgtcgtcacgacgctgtgcgcggcactgggcagagcgatggggcggcgctccggcgactcccccgcgagagaggtcagcgagggggcgcactccggggctgaaccgtcgcaagggcccggttcaggacccggagccggtccgtgaccggggtgaggccccaccacagtccggcggccacggcgacgagcgcgctcaccaccagccagaccacaccacgtgccgcaccgcccggaacgaggagtgccaccagggcgcccacccccaccgcgacgacgccggtcaccgtggagaagaggagcagcgggccaagtgccgaggcccggctccccgccgaacccgggcttctcagtgcggccgaggccgttccttcggctcgttctcgcatgtgtgtccctcccgtccccccgggcggatcatgagccgcccgcttccgggttcacaacctcttccagaaaaccacaccacgccgcccgcccgaaggcgagcagtccgttccccggacacttcgagtcgcgcacgagcatgcggccatggtcggcggccacctccacgcattctgtggtgttcccggagtagctgctcttgacccacgcgcgccccgacggctccctgcctgccaacgcccacctcctcttgcccccatgggtgtccatgacaggagtcttccccgcttcggtgctcggaaagaggccaaaaggagccgtttcaagcccctgaccgtttgtcaggcatatgagcctcggcacaccggcgcggtgcaggtcaacggcaagttgacgggtgttccggggccgtggtggacttccggggccatgtacggcggcagcagaggaagtccggtgcgaatccggcgcggtcccgccactgtcaccgggaggaacatccccgggagccaggaactctctccgccggtctcgtcgaaccagggcgcggacaccctgagtgaggacccatcgccatgcgcggctgccgaccgaggttcatctgccgaccgaggcacaacagcgacttcctgaccgaccccgcggccggctgaacccatgggtgccgatcgcgtcttcgcgtacggcgccgccgccggcctcctcggtgacctgctcctcggcgatccgcgccgcgggcatccggtcgccgtgttcgggcgggccgcgggcgccgtggaacgcgtgctgtggcgggaccaccgcgggtggggcgcgctgcacacc

SEQ ID NO: 662 - DNA, 2514 bp, Unknown
  Kingdom: Bacteria, Phylum: Actinobacteria, Class: Actinobacteria, Order: Streptomycetales, Family: Streptomycetaceae, Genus: Streptomyces
gccgcgcaccagggcgcgcacggccagcgtggtgaagaacagcgccagcacgtcgtccaggtgcgcgaaccgcaccgagacctccacccacatggggatgaaggcggcaccggcgaccaggacgcgctgctgcaggcgcttgtggttcgttccggtgcccaggccgtgctcggcggccgtccggccgatcagcaccagcatgtacaggcccaggccggacatgaacgcctcggccaggttctcgcccagggcgggcgggaacggcccgaacagcgcggcgacgaggaaggagaccgggccgatctggagttccgggtggttggcgtacagcgcgaggccgccgcccggcacctggttgaagagcagttcctcaccgctcctcagatagtgccaggacacggccccgtgccgttcggccacgaggaaccacaggatggtccacacggtcagcgcagcggtgtgccaccgcagcgggtagcggccgatacggccgaaccgcgcgccgtccccggccgcgcccgccgctctctcaccgttccgcacgttccgtccttccgtcacatgcccgcccagtcagatgcggatcggccgggtacggttcagccaagcaccctagcccaggcgggtgaagagaggtcggcgccgtcgaggacggtgcgggcggcggccctcatctgcggcgcgggcgcggacggtccgcacagggcgctgacgacgtagctgttgagggcgtcgtcgatggggctcggttcgaagccggtgccgtcggcgtcgatacgctcgtacttcatcaggttccagccggccgtgacctgccgcctgccgtccgggctggacagtgcgacggtcccggcgccgaacacggccccgtcgtggccccagaagcgtccgcagccggggatgtcgacggcgtagaggccgaggccgtagtccatgccgtccacggggaccgtgcgctgcatctccttgagcgccgccggtccgatcagcctgccggtgagcagggcacggtagaagcggttgaggtcgtcggtggtggagaccaccgcgcccgccgtgtacgcccacgacatgtcgtagacgctgtagtcgcggggcgggtcgatcaggccgtagaagttctcgtacatccgcgcgtgcggaccggggacggccggggtgcgcgggtaggaggtgtggtgcagcccggcccggtcgatgacgtggcgggtgatgtacgcctccgggtcctggccggtgaccttggccaggagcagtccggcgatgacgtagttggtgttggagtagtggccgggcagcgagccgggcgctccggtggcgggcgcggcgaggcccaggcggaccagttccccggggcggatggagcggaaccgctcctcgtcgaggctggccgtcgagcccttggcgagggacgggaaggcaccggtgacgtagtcgccgatgccgctggtgtggttcagcagcatgcggacggtgatctgccgcccgcgctcgcccgggatcagtccgggcaggtagtcgccgatgggcgcgtccaggcggatccggccgcgttcgacctgctggagcacggcgaccgcggcgaaggacttgctgatgctgcccacccggtggcgcatgtccggccggaccgggcggccggtcgtcacgtcggcggctccggaggcgccggcccagcgccggtcgccgtcgcggacggaggagtagatgccgtacatgcccgcgtcgtgcacggcgtccagcgcggtgccgagtgccgcggggtccaggaccgacgcgggtgcggccggggtggcggagacgggtgcggcgaaggccgcggggacggcggccggggtcagtgacaggacggtggcgacggcggtggttgcggcgatccggcggatgcgcaagggacttcccttccctcgggtccgagcatgtcccggtcatcctcggcgatcacgaggggccgccacatcgttccggcggacgaggtccggcgccgaatccgtgcaggagcgtcacacaggcttcacacagcccaccggcgtgcttgttagcgtgactggccgcccggcagccgacccaggaagatccgcatggactactgctccacatgccgacggcacctcaacggtgccctggtctgccccggttgcggggcgtacgcgccggacatagcgccgaacgccaccgcggactccgcgctcccgttcgcaccgggtccggcggcggacccggcccacgagcccttcacggagtcccgcgccgtggacgtcaccgctgtcccggcgctcgccggcagtacggacactctggacggtccggacagtgcggaggtcctggatccgccgctgacaccggacgtgccctcggtgcggcagcggccggggcgggcggcacggcgacggcagcaggcccgctggaagaagacccagcgccgggccctggtcgccaccgcggtggccttggtcggcggtgtgccggtccatcgaggcgacggtcaggccgccgccgaccaaggccaccgcg

SEQ ID NO: 663 - DNA, 1391 bp, Unknown
  Kingdom: Bacteria, Phylum: Actinobacteria, Class: Actinobacteria, Order: Streptomycetales, Family: Streptomycetaceae, Genus: Streptomyces
ccggcaccggcaccggcaccggcaccggcaccgccaccgccaccgccaccggctccggctccggctccgggcaggcgggcagccgcgcggaaggcgccaccaccggcaccggccgcaccgccgcgcgggacgaggacgccgcgcgggaccgggccaccaccgggaccggggacacgtccgcctcccggcggcccgcgccgtccctgcccggcgcgcttccgctcggcttcggcatgatcgaggacctgcccgacttcgtcccgctcctggacggcctgcgcgcgaacctcggtgcgcgccaccggcgcctggccgcggatctgctgcccaggcagcagctcaaggaccgcaacgacaacgtgcagcggctgctgcgcgtcctggaccgggacggcgccgcgggtctgctgggaagcgccatggacggcggggtcaccgtcgagctgttcgacggtcgccggaccccctactgggcggtgttcaaggtcacgcggcacggtgacggcgtcgtcgagggcgcggcggacgacggccgggacatggagtacatcacctcggccgtcgcccaggaggccaccgcgcaggagaagggcgcgacgaccggtgccgaggtgatcgccggcgtcggcggcaaaccggacggcggggcagggcagctgaagagcaccggcggtgcgggcggcctcggggtggcccggggcggctcgcaccggcagggcacggccgcacgcggccagctcggcatgaagacggtcgcggaggccaagacggccgcctccacgcggctgcgcctgccgatcacgggcaccctcgaactctacgagggcgacaagcggatcgggctggcctccaccggccgcaccgcgttcacccaccgcgtcctcgacaacgacctcaaggcgctcgcccgggtggccgccccgcgccggaccttcaccgcgccccgggccgccccggcacaggacgcccggcaggaccgcctcgacgcctggcgggcccgcggcgcgaagctgccgatggaggcccaggtgaacggcttccaaggcgcccagcaggtacggcagttgctgtcggacgcggtccgggaggcgggcggcgaccagcggtaccgggaaaagggacagtcggccgcgtacaccctgaacgaggccctctccaccgagtggctgaccgcggcgctgccgctgctgacctcctttggagtggacctgcccccggtgcacgccactggagtcgagggccaggacctgcacgcctccgtgcacgcgcggctcagccggggccgggtcctgggcgtcggcgacaagatgaccttcgagacggtcgcccagagcaccctggacgcgccccggcccacccagacggacggcagcagcgcccagggccggggc

SEQ ID NO: 664 - DNA, 5415 bp, Unknown
  Kingdom: Bacteria, Phylum: Actinobacteria, Class: Actinobacteria, Order: Streptomycetales, Family: Streptomycetaceae, Genus: Streptomyces
cctcggggccgagctgggcgcggacgatgcgggcctcggggcggtagccgcggccggtgaggtggcgcttgaacgcgtcccgcgcgggaccgatcagcaggtcgtcggcggcggagacgccgccgccgatgacgaagcaggacgggtcgagggcggcggccaggttggcgatgccgacgccgagccactgaccgatgtcctggagcagttcgacgcacatggcgtcgccctcgcgggccagctcggtgatcatcgggccggtgatgtcggagatgctgcccttgacgtgctcgatgatgccgtaggcgaccggtgagtcggcggcggccagctcacgcgcctcgcggaccagcgcgttcccggagctgtactgctcccagcagccgcggttgccgcacgggcagcggtggccgccgggcacgacctgcatgtgcccgaactcgccggcgacgccgaacttgccccgcttgacctggccgtcctccaggatggcgccgccgataccggtgccgagcgtgatcatgacgaggtggtcctcgccgcggccggcgccgaagcgccactcggcccaggcggcggcgttggcgtcgttgtcgacgaggacgggcaccgccaggcgttcggagaggcggtcgcgcagcggttcgttgcgccaggacaggtggggtgcgaagagcacgcggttgcggtcggcgtcgacccagccggccgcgccgatgccgacggcgtgcacgtcgtgccggtcggacaggtccaggaccagctccgcgatggtgtcctcgacgaccttggggctcttggacttgtccggggtctccgtgcggagcttctccaggatgttgccgtcggcgtcgacgacgcccgccatcaccttggtgccgccgatgtcgatgccgaccgtcgggacacggggcgccgtcaggtgggaacggcgctcacgggtgcccacggtgcgcaggaccggggctcggcgggagccgatgggggcggtgaggtcgcggtaggtgctcatcggccccgattctgccgcacgtccggtaggggtgctgtacggggcaccggcgggccggtgccccgggcgtgccgcacgcgcgcgcgtggaggtgtcccgcgcgggtgccaacacccttcaggagtcgcccttttcgagttcgtggcgcaggtcgtcgagttcgctgccgcccgccatctgccgggtcagctcctccagggtgatctcgtcgcgtgtgtgatgccccaccatcgtgcccctcttgaggagcacgaaccggtcccccacgaggtacgcgtggtgcgggttgtgggtgatgagtacgacgcccagcccctgatcgcgtgccgcggccacatacttcagcaccacacccgactgcttgacgccgagtgccgccgtcggctcgtcgaggacgagcaccttggcgccgaagtggaccgcgcgcgcgatggccacgcactggcgttcgccgcccgagagggtgccgatgggctggtcgacgtccctgaggtcgatgcccatgcgcagcagcgcctcgcgggtggtgcggcgcatgaggtcgacgtccaggcgtttgaacgggccggcgcccttcctgggttccgagccgaggaagaagttgcgccagaccggcatcaggccgacgacggccaggtcctggtacacggtcgcgatgccccggtccagggcctcgcgcggggaggagagggaggtctcctccccctcgatgcgcaaggcgccgccgtcgtgccggtgcagtcccgcgatcatcttgatcagtgtggacttgccggcgccgttgtcgccgagcacgcaggtgatctctccggcgtgcacctccaaggagacgccttcgagggcgcgtacggtgccgtagtgcttgctgacgtcggccagctccaccagtgccgtgcgggtcttcgtctgcgtcacttggtggcctccgcccgcttgcggacccaggcgttgagcagggtcgcgaggagcagcatcgctccgaggaagaacttgaaccagtcggggttccattcggcgaagacgatgcccttgctggtcatgccgaacaggagcgcgccgaccgccgagccgaccgcgctgccgtagccgccggtgatcaggcagccgccgatgacggcggcgatgatgtagatcagctcgttgccgacgccctcgccggactgcaccgcgtcgaaggagaacagcaggtgctgtccggagatccaggcgccgagcgccacgcccatgtacaggccgatcttggtcccggtgacgggtacgccgaccgcgcgggcggcgtcctggttgccgccgacggcgaagatccagtttccggtgcgggtgcgcagcaggatccaggaggcgatcgcgaccagggccagccaccacaggatggtgaccttgaagtcgacgccgccgatggtgaacgtggaggcgaagacggcgtgggcggccgggaacccctccatgtcgccgatcgtcttcgtggagacggtgtcgtcgatcagcttggtgaagcccaggttcatgccggtcagcatcaggaaggtgcccagggtgatgatgaagctgggcagcttggtgcgggtcagcatgaagccgttgaaggcgccgatcgcgagcgtgaccagcagggagacgccgacgccgacccagacgttcgccgtcatctggtagctgaacatcgaggagaccagcgccgaggaggtcaccatcacaccggccgacaggtcgaactcgccgccgatcatcagcagggcgaccgggacggccatgatgccgatcgtcgaggacgcgtacaggaccgtgctcagactggacgcgcgtacgaacccgtcggcggcgagggcgaagaagacgaagacggcgatcgcgccgacgaccgagcccagctcggggcgggcgagcagtttgcgcagccaagaggtgcgcagcagtctttcgtcggtgacggatccggtccgctccggggtggcgctcatcgcgtgccccgattcgcgtactcctcgagggctgccgcctggtccttggtgacgatctgcgggccggtgaggaccggcttgccgccgccgaggacgtcgttgttgtacttgtacagccacagcaggtcgacggcctcgtagccctggaggtagggctgctggtcgacggcgaagccgagggtgccgtccttcagttcggcggcgaccttggcgttcaggtcgaaggtgtcgacctcggccttgctgcccgcgtcggccttggccttgacggcggtgtccgcgtagggggcgccgagggtgacgaccgcgtcgacggatttgtccgcctggagcttggccccgatcgcggactgcacgtcgggcatgttggtgccgttgacgtagaggttctcgaccttgccggtgaaggtcttggcgacaccggcgcagcgctgctcatggccgacgttgccctgctcgtgcaggacgcacagggccttcttcttgccgcgcttgttcagttcctcgccgacggcctcgccggcgacggtctcgtcctggccgatgtgggtgagcgcgccgaacgccttggactcggcggagccggagttcaccgtcaccaccgggatgccggccttctcggcgcgggccacggcggccttcatcgcgtcgggcttggcgagggtgacgatgatgccgtcgaccttcttgtccaccgccgcgtccacgagctgtgcctgctgctgggcctcgtcgtcgtgcgagtacaggaagttgatgttgtccttgaccgcggcctgcttggcaccgttctggacgatgtcccagaaggtgtcgccgtcaccggagtgggtgatcatcgcgaaggtccagcggggcgtgttcaccgccgccctgccctgggccgccgcggccttgcgggcgtcctccgcccgcttgccgccggtgctgctgcatcccgcgagggacagcgacagtgcccctgccagcgcgatgcctacccaggttcgaaaccgtgccacgaggccgtgcccttctagctctgttcagacgtacgcgcggggccgatggcaatcccatcagccccgaacatcgcattatcggacatgagcaggtgaagacaaaccaccggggaccaggacccggtcggcttgtccggacaatgtgacgccccaaggcctccgccggctccaggcctccgagggatgggagggctcccgggcgcggaggacttcaggcctccgcgacgtccagggctcaagagcttctggccggctcaggatcgtacgagcagctggaactcgaacgagtaacgggacggccggtaggtgtgggtgccgaactcgaccacgcggcccgtgtcgtcgaaggtggtgcgctccatcgtgagcaggggcgcgccctccgcctcgccgagccgctcggcctcggacagggtggcggcgcgggcgccgatggactgacgggcgctgtgcagggtgatcccggcggagcgcatcagccggtacagaccggtcacctccagctgcccggtgtccaggtcgagcaggccggccggcaggtggttggtcaggtacgccatcggctcgccgtgcgcgaaccgcagccgctccacccggtgcacgtcggccccttcggtcacgccgagcgcggcggcgacctcggcggacgccgggaccaccgtgttcaccaggaccgtgctcgtcgggcgctgcccggccgtctccaggtcgtcgtagaggctgctcagctccagcgggcgcttgacctggctgtgcacgacctgggtgccgacgccgcggcggcgcaccagcagccccttgtcgacgagcgtctggatggcctggcggacggtggggcgggacaggccgagccgcgcggccagctcgatctcgttgcccagcagactgccgggcgtgagggcgccctgctcgatcgccgcttccagctgctgcgccagctggtagtacaacggcacgggagaactccggtcgacactcagcgcgagcgacacggtggggtccacatctggtttgggcacgggccgagcgtaagcccggcgaccggttgacgggaagtcgtgtagtcagattgtccggacatgctgattgacagggcccgtggtccggccccaccttgttcccatgcgcatcggggtcatcgggacgggccggctcggcaccgttcacgcgaacacgctcagccgccaccgcgaggtcggctccctgattctcacggacgcggacccggcgcgggcgcaggacctggcccaccggctgggcgagaccgccgcgcccggtgtggacgagatcttcacctggggcgtcgacgcggtggtgatcacgacggcgacctccgcgcacgccgagctgatcggccgggcggcgcgttcggggctgccggtgttctgcgagaagcccgtcgccctggacctggcgggcacgctgcgcgcgctcgccgagg

SEQ ID NO: 665 - DNA, 1342 bp, Unknown
  Kingdom: Bacteria, Phylum: Actinobacteria, Class: Actinobacteria, Order: Streptomycetales, Family: Streptomycetaceae, Genus: Streptomyces
ggcgagggagcggtcgttgccgtccgcgtcgtcggcgggcagctcaccgaccgcgacgacggtgcctcccgcgcgcacgaacgcgccgagcgtgcgcacgcacgccacgtcgagcgtcggggtcaccggcagcaccaccacgtcgtaccgtgcggccccgacggcgagccgcccgccacgcacccggccctggctcagcagttcctcgtcaccggcgagcgcgccctcgtgcaggaggtcgaagtcgacctgcgcgcgttccagggcgtaggcggcgtcgctgagcgcgccgtcgacctcgccctgccggtcggtgccggtccactgctcggcggcccgctgtggctggagcagggcggtacgcgccccggaggtgccgcggcccatctccatgacccggccgatccactccgccagcggccgcatcgcccaccaccacggcgccctcgggccgaacggcggcgggaagtacacccgggtctcgtcggtccacagggcgtgcagcaccgcgaggttgacgccccgggtggcctgcgcgccgacggtcgcgtgcacgaacgagggcgtcacctgccagcccatgttgccgaacatctccagcagggcccgctcccggccctgctggtgggctgccgagaccggattgcgcgggatcatcgtctgctcaccggcgacgtactcggcggtgatgatgtccccgccgggcacgtgcgcccactggttgaccttgtgcaggtctccggtggaggggatccgcttggccggcgccgtctcgtcgtacagcggattggtgatcagggcgacgccgcgctcctcgtaccagcgggcctgccgctggaaggagcgggcgaaccggttggacacggcctgccagtactgccccctagcgatccggccgcgccgcccgaggtcgtcgaaggcggcggcgtacgccactcccggcgtgaccccggtctcgcgcagcgcccggtccagggtgggcgaccacggcagccgcttgaagtgtgcctcggcggaggcgaagaacggctcgtcgtcccagaaacccgggatcaccgtgccgaagtagcgccaaaagcgccggtggtactcgccggggacgatgtcgaggaacagctccaccggctcgtcgtcgaggaggtcgacgtagctgcggctgtacccctgcgtgtcgtcgacgagcggcacaccgccgaacaggtcgacctgccagcggcccgccgggacctgccaggtgccgccgtccgagagcctggccgtcaggtcgacgacgtcggcggcgtcggcggaaccggcgggccgggccgcggcggccgacccgtgcgcggcgagctgggcccgc

SEQ ID NO: 666 - DNA, 2715 bp, Unknown
  Kingdom: Bacteria, Phylum: Actinobacteria, Class: Actinobacteria, Order: Streptomycetales, Family: Streptomycetaceae, Genus: Streptomyces
  misc_feature (480)..(572): n is a, c, g, or t
cagcaccagcacgacggctgcccccagcgcggcgcaggcccaggtcgccgcccaggcctgcggcgggtcctgggcgagttcgtcggcgagcagccgggcgaagacgagggtgccgaccggtcccagcagggccaggagcagggcgaggtcgacgtaggaggtgcggctgtagccctgggagagcaggagcaggccggggcagaccagggcggtggagaggttctgcgccacgacgcggcggccgagcgggcctgtggcgacgccccacagggtggtgccgaggccgacggcgaggacggccgtcgccgcgacgagccagccgttcaccccccgctcaccgcccgccgtccggcccgcgcgaccagcgcgcccacgcccgcggcgcaggcgccgaccacccattccagggtgtagacggtgctgatgagcatcagccacagcacgacgagcgcggcccaccacgccagcacctcgcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgtctgaccgctcggttccgcggtgtctgaccgctcggttctgctgtgcgtcgcgtcccccgcgccgctccccggcatccaagcaccgccccggccggagggtgcgcggcggcgcgcgggtcaggtccccggatgccccgacagcagcaacggaaaccgggcaccgcggcacggccgtcggcgccgccgaccggcatcccggctgctttcgggggtaaccggcttgtcggtagcacgagttggcgtctggaggatgacatggcgagggtggcgttccatccgctcaccgtgttccggtcccgcaagaccaggccccgggccgcctcggagccggtcgaggacacgccccgccgcaggccgctgccgtggctgctgcgccttccggcgatgctgtgcgccttcgtgttcatggtggcgttcgccgtcgtcctggcccggctgacgctccagccgtcgccctcgtccgtgtccttcgtgcacaccaacctgcacccgggtcggtcgctgcgggcctatctgggtgagccgggactgcgggaggcggtccagcagatcggcgggaacctgctgctgggggtgcccttcggggtgctggtcccggtggtcgcgccgcgggcgcgcggactgctgcgggtgctgctgctcaccgcgctggtcatgctgctggtggagttcgctcaaggggcgctgatcaccgggcgggcgttcgacatcgacgacgtcatcctcaacacggccggtgcgctggcaggtcacctcctgctggggcggcgcctgggccgggcggtgcacgcgcgcgcccggcgcgactgacggggtggtgtgcccggtggatcagtgccaggtgaacttgtcgccgcccacccagcggaccacgtccgggtcgtccaggtcgtggacggtgatgccgaacgcggcggcggcctgcaggacgtcggtgacgctcttcgcctcgccgaccacctcgccgtcgatctccacgatgcggaagggcgggtcggtccgctggactccgagcaccaggatccgcggctgggagatgtagggactcgcgctctcggtcatgtcaccaagcctagatcgggtcgggtgcgggtggtgggcacggaggggggccaggtacgggcggttcaggggcgccgccagtcgtcgccggtcagatgggagccggccatcggccccatccgcagcatcccgccgtccacgctccaggacgccccggtgacgtaggaggcgtcgggaccggcgaggaacgcgatgacggcggcgacctcacgggcgtctcccggccggccgagcgggacgcccgggcggtgctcggcgcgtacgtccgtgtcctcctgaccggtcatgggcgtcgcgatctcgccgggcgccaccgcgttcacggtgatgccgtgctcggccagttccagcgccatcacctgcgtgagcagcccgaggccgcccttggccgcgcagtacggggcggcgccgacccggggctggtgctcgtgcaccgaggtcacgttgacgatccggccgccgtcgccctgtgcgatcatccgccgggccgccttctgcccgcacaggaaaggaccgacgaggtccacgtccagcacctcgcgcacgtcctcgaggcgcaggtcgaggaagggcgtggccgtgcccgtaccggcgttgttgaccaggacgtcgatccggtcgccgagcgcgccggccagctcgtccagggcgtccgcggcgtcgggcagccgggtgaggtccatccgcgcgacggcggcgcggcgcccgtgggcgcggacctcctcggcggtctcctcggcgcccttctcgtcgctgtgccaggtgatgccgatgtccaggcccgcccccgccaggcggacggcggtggcccggccgatgccggagtcggcgccggtgatgacggccacccgggcggcctgcgacgaaggtggcgaaggtgcggacatgggtcctcccgcggtacggacgagttcggcgtgcggacgaggcatcgcagtacccgggggcggccggggcaaacggcggcccggaggggggcggccggtgaggttcctggaggtggccggtggggtcccgagcgacggccggtgaggttctgggaggtggccggtggggtcccgagcggcggccggtg

SEQ ID NO: 667 - DNA, 5308 bp, Unknown
  Kingdom: Bacteria, Phylum: Actinobacteria, Class: Actinobacteria, Order: Streptomycetales, Family: Streptomycetaceae, Genus: Streptomyces
gcgcgccgccctgggccgcgtccaccgcgttgtcgatcaggttgccgaggatcgtcaccaggtcacgggagggcagggaccgggggagcagcccgtcgtccaggccgctgtcctgcgacaccaccagctccacgccccgctcgttggcctgcgcggtcttgccgagcagcaaggcggccagcaccggttcgccgaccgccgccaccacctggtcggtcagcgcctgggccagctccagttccgccgtggcgaactccaccgcctcctcggcgcggcccagctcgatcaaggacaccaccgtgtgcagccggttcgccgcctcgtgcgcctgcgaacgcagcgcctgcgtgaagccgcgctcggagtccagctcgcccatcagcgactgcagctccgtcacgtcacgcagggtcaccacggtgccgcggcgctggccgcccgagaccggcgaggtgttcaccaccaggacgcgggcgtccgtcaggtgcacctcgtccacccggggctcggacgccagcagggcgcccgtcagcgggaccggcaggcccagctcggtcaccgaccggcccaccacctccgcctcaccggccgcgccgcccacaccgagcagctcccggccgccgtcgttgatgagggccacccggtggtgcgagtccagcatcagcagcccctcgcgcaccgcgtgcagcgcggcctggtggtagtcgtgcatccggctcagctcgtcggcgttcatgccgtgcgtgtgccggcgcagccgcgcgttgatgacgtacgtggcgaccgcgcccagcgcgaggatgccgcccgcgaccccgaacagggccgtgacctggtcctggacccgccggctgatcgcctcgaccttgatgccggcgctgaccaggccgatgacgcggccgttctcctcgaccggggtgacggcgcggacggaggggccgagggtgccggtgtaggtctcggtgaaggactggccgtgctgcgcgcgggagatgttgccgaggaaggggcggccgatctcgtcctggaccggatgggtccagcggatgccctgcggggtcatgatcgtgacgaagtcgacgcccgtgtcccgctggacctggagcgcgtacggctggaggtgggccgtcggatcggcggtgtggatcgcggaccgtacggagggggagtcggcgatcgaacgggccaccgccgtggtctggcggcgggccgcgctctccgcctggccgcggtcgctgacgaaggtgaacagcgcgtatccggccacgacgagcgccagcagcacggcctgcatggcgaagagctggcccgccaggctgcgaggtctcgggagggcggggatacgcatgccgccagtctgcctctgcgccgtggcgtgaactaaatgaacggaagggtgaccgctctcacacggcacgagatagtcaggcaatccccgaaatcccccggacgtgagccgcacgccggtgatgccgacgacgtcgtcaaggagggccgccgtgaccagcgcagccgatacggcacctgccgcacccgccagtgggcccggccccgcagccaagcgggaccgcacccactatctctacatcgcggtgatcgccgcggtggtgatcggcgtcgtcgtcggcttcgccgcgccgggcttcgccaaggagctgaagccgctcggcacgggcttcgtgaacctgatcaagatgatgatctcgccgatcatcttctgcacgatcgtgctcggcgtcggttcggtccgcaaggccgcgaaggtcggcaaggtgggcggcctcgccctcggctacttcgtcgcgatgtcgttcgtcgcgctggccatcggcctggtgatcggcaacctcgtccaccccggcagcggcatgcacctcaccgaggcggtcaagggcgtgggccacgcccaggccgacgccgccaaggagggcccggtcgacttcgtgctcgggatcatcccgaccacgctcgtgtcgtccttcaccgagggccaggtgctccagaccctgctggtcgcgctgctcgtcgggttcgcactgcaggccatgggccgcaagggcgagccggtgctgcgcggggtggaacacatccagcggctggtcttccgcgtcctcgccatgatcatgtgggccgcgccgatcggtgccttcggtgccatggccgccgtcgtcggcgagacgggcatcgacgccctgaaggcactcgccaccatcatgttcggcttctacgcgacctgtctgctcttcgtgatcgtggtgctcggtgcgatgacccggctggtggccggcgtcaacatcttccacctgctgaagtacctgggccgtgagttcctgctgatcctgtcgacgtcgtcgtccgagtccgcgctgccccggctgatcgccaagatggagcacctgggcgtcagccgcccggtcgtcggcatcaccgtgccgaccggctactccttcaacctcgacggcaccatgatctacctgacgatggcctcgctgttcatcgccgacgccatggaccagccgctctccatcggccagcagatcaccctgctgctgttcatgatgatcgcctccaagggcgcggccggcgtcaccggagcgggtctcgccacgctcgccggcgccctccagtcccacaagcccgccctggtcgacggcgtcggcctcatcgtcggcatcgaccgcttcatgagcgaggcccgcgctctcaccaacttcgcgggcaacgccgtcgcgaccctgctgatcggcacgtggaccggcgaggtcgaccaggaccgcgtgcgccgggtcctcgccggcgacctccccttcgacgagcgcaccctgctcgacgactccgaggacggcccggccgccggctccggactgccggagcagcgcgaggacgacggcaaggaactggccaaggcctgaccgcgacgcgtacgcccaccgctccggacgcccggctccgcctgaacccgggccgggtgtccggcacacagaagaacacgcggaagaaaacagaagaaaggccgctgagcggcagaacaagccgccgagcggccgaggctctctcccccgtgggcccggccgctcggccttctcgtacggtccgcgccgctcagccgctcagcttcgacaccagcgcccccgccagtgaggccggcacccccgccgacgtgagcaccgtgacggcggccgaggggccagcctcagcggcgtcgagcagctcgtcgttgacggcctccatcagcgcgaacaggatctgctcgtgcacgtgggccagcgcgggcgcgggcagcggggagctgaagacgccccgctcgacgccgcgctggagcagctccgcgcagctgctgcggaccggggccaggcgctcgcggatgccctccatggtgacggtgcgctgggcgagcgccaccagcagccggtagcggtcggcgatgggccagatcgccagcaccgaacgcgccagcgcctccgccgggtcctcggcgcccgcccggccccgcgcgtgcgcgtccgccagcgcctgcacggcgtcgtcgacgagcgtgctgatcagcgcctcgcggctggggaagtgcccgtacaccgtgcgccgtacgacacctgccgcgcgggcgatctggtccatggacacgtcggggtcgcgcagcagctcggcgagggcgacgtcgaggatgcggcggcggttggcgtccgcgcgcgtggggttacccgtggtcatggctgacattgtgcctccctcgcgacttgcacagcactgtgcagcgacgtacattgcacatggttgtgcaaatgcacaccactgtgcaagtggccgtgcgggcagctgaacgcgcacgtccacgtcccgtcgcgcacccgaggaaggcgacccctgccatgcgactcgtcatgaccgaaccggtcggaaggacggaccgcccctacgcccggcgctggtgggcgctcctggtgctctgcctgagcctgctgatcatcgtgatggccaacaccgccctcaccgtcgccgcgcccgacatgacccgtgacctgggcctgtccggcgccgacctgcaatgggtgatcgacggctacacggtcccctacgcggcgctgatgctgctgctcggcgcgatcggcgacaagtacagccggcgcggcgccctcgtcctcggactcgtcgtcttcggcggcggcgccgtcttcggctcgctcgccgggagcgccgccaccgtcatcgcggcccgcgcggtcatgggcgtcggcgccgccctgatcatgcccgccacgctgtccctgctcgccgcgaccttcccgcgcgccgaacgcgccaaggccatcaccctgtggaccgccaccgccggactcgccatcgccgcgggcccggtcgtcgccggcgcgctgctcaggaaccacggctgggcctcgacgttcctgatcaacgtgccgatcgccgccgtcgccctcgtcgccgccttcgtcctggtcccgccgtccaaggccgcccgcccggccgacggcgaccaccgcatcgactacgtcggcggcctgctgtcggtgctctggatcggctcgctgatctacatgatcatcgaagggccgcacttcggctgggacgcgaaggcggtcaccgccgccgtcgtcgcgggcgccggcctgctggccttcgtcctgtgggagctgcgccacccgcgccccatcctcgacgtgcgccgcttcaccagccgccgcttcgccggttccaacctcgccgtcgccctgttcttcctggccgtcttcggcgccttctactacctcacccagcacctccagttcgtcctcggctacgacgccctcgccaccggcgtgcgcatgctcccgctggccggcgcggtcttcgccggctcggccctgaccggctacctcaccccgcgcgtcggcatgaagtggaccgtcaccgcgggcatggtcggcgggaccgtcgccctcgccctgctcacccaggtggacggttcctcctcgtacggcgacttcgtggcgccgctgatcgtcctcggcctggccatcggccttgccctctcgccctgcaccgacgcgatcatgggcgcgttcccggagcccgagctgggcgtcggcggcgccgtcaacgacacctcgatcgagctgggcggctcgctcggcatcgccatcctcggttcgctgctgtccacctcgtactcgggtcacctcgccgacgccaccacgggcagcaagctcccggcgagcgccctggccaccgcccaggactcggtcggcgccggctacgccgtctcccagggcatcggcgagcaggcgcgccggctcgccgatgccctgggaga

SEQ ID NO: 668 - DNA, 2833 bp, Unknown
  Kingdom: Bacteria, Phylum: Actinobacteria, Class: Actinobacteria, Order: Streptomycetales, Family: Streptomycetaceae, Genus: Streptomyces
gaccgccgcggcggtcaggccgctgacccaggcccacgaaggtattcgggcaggcatgggcacgcatctcctcggctactcagctgttcggccccgggaaccgtcggctcatcgtactgtgggccgccttgcgcgcggttcagtccaggaccggcagcagctcgggcaggtggccgtcggaggccttcgcggcgcgctgccgttcctcggggacctcgccgtagagcgtggtgcgcggcttcgcggggcggcccgccgccccggccacggcgatcaggtccttcacggacttgtaggaaccgtaggaggagcccgccatgcgggagatggtctcctccatgagggtgccgcccaggtcgttggcgccggagcggagcatctcggcggcgccctccgcgcccagtttgacccagctcgtctggatgttggggatccaggggtgcagcagcagccgggccatcgcggtgaccgcccggttgtcgcgggccgtggggccggggcgggcgatgccggccaggtagaccggggcgttggtgtggatgaacgggagcgtgacgaactccgtgaagccgcccgtctcctgctggatgcgggccagcgtgcggaagtggccgagccagtggcggggctggtccacgtggccgtacatcatcgtcgaggaggagcggatgcccagctcgtgcgcggtggtgacgacctcgatccaggtcgcggtgggcagcttgcccttggtcagcacccagcggacctcgtcgtccaggatctccgcggccgtaccggggatgctgtccaggccggcctccttcgccgccgtcagccattcgcggatcgagaggtcggtgcgggccgcgccgttgaccacctccatcggcgagaaggcgtgcacgtgcatgcccgggacgcgttccttcacggccctggcgatgtcgaagtaggcggtgccgggcaggtccgggtggatgccgccctgcatgcagacctccaccgcgcccacgtcccaggcctgctgggcgcggtcggcgacctggtccagggagagggtgtaggcgtcggcgtcggtgcggcgctgggcgaaggcgcagaagcggcagccggtgtagcagacgttggtgaagttgatgttgcgggtgacgatgtacgtcacgtcgtcgccgaccgccgccctgcggacgtcgtccgcgatccgggtgagggcgtccagcgcgggaccgtccgcgtgcagcagggccagggcctcggcgtcggtcagccgcgtcgggtcgtcggcggcggtgcgcagggcctcgcgtacgtccgcgtcgatgcgctcgggtgccatgccgggcgccgccgcctcccgcagcgcgtcccagtcgccgtagacctcgtcgaagtcgctgcggcggtcgccggtgcggccctcggagtcgacggcggtgtgcaggtcggtgcggccggacgcggtgaacgcctcgtccggctcctgccaggggcggccctcgacggtggcgtcctcgcgcgcgaggccggtctccggatcggcgagggcgctcacgtgcggaaggaggcgcgggtcgagccagggctcaccgcgggtgacgaactccgggtagacacacagccgttcacgcagctcgaaaccggcggcggcggaacgctcgcgcaactggtcgatctgcggccaggggcgctcggggttgacgtggtcgatggtgagcggggagacaccgccccagtcgtcgatgccggccgcgatgagccgttcgtactcgccgtccacgaggttgggcggcgcctggaggcaggcggcggggcccatgatgtgccgggcgacggcgacggtggcgaccaggtcgtccagttcggcgtccggcatgccgcgcatcgccgtgtccggcttggcgcggaagttctggatgatcagctcctggatgccgtggtgggcgcgcgcgaccttgcgcagcgcgaacagcgactcggcgcgctcctcgcaggtctcgccgatgccgatcaggatcccggaggtgaacgggacggaggagcggcccgcgtcctccaggacgcgcagccggacggcgggttccttgtccggggagccgtggtgcggaccgccgggctcggaccacaggcgggtcgcggtggtctccagcatcatgcccatggacggcgccacgggcttgaggcgctggaagtccgtccaggtcatgacgcccgggttgaggtgcggcagcaggccggtctcctccaggatgcggacggagatggcccggacgtaggcgatggtgtcgtcgtagccgtgcgcgtcgagccactcgcgcgcctcgggccagcggtcctccggcttgtcgccgagggtgatgagggcttccttgcagccgagttcggcgccgcggcgggcgatgtccagcacctcgtccggggacatgaacatcccgtgaccggcgcggcgcagcttgccggggacggtgacgaaggtgcagtagtggcacttgtcccggcacagccgggtcagcggcacgaagacgctcttggagtaggtgatgacaccgggacgcccggcggcgcccagtccggcgtcgcgcacccggccggcggaggcgacgaggtcccgcaggtgctcgccgcgggcctggagcagcaccgccgcctcggcgacgtcgagggcgacgccgtcccgcgcacgtttgagggcgcgacgcagggagttctcggtggggcggccggttccggaggtcgcggaagtcgtcatcctccgagcatacgatcgcggtgatcaacgggggcggggcgaaccggccgcgcgaaccgccggaacgaaccggccggcgcgaaacggccggcgcgaaacggccgg

SEQ ID NO: 669 - DNA, 1602 bp, Unknown
  Kingdom: Bacteria, Phylum: Actinobacteria, Class: Actinobacteria, Order: Streptomycetales, Family: Streptomycetaceae, Genus: Streptomyces
  misc_feature (871)..(872): n is a, c, g, or t
cacccggctcgtggaaccggatggcgaggagccgttcatcctgcatcccggtgagttcgtcctcgccagtacgtacgaggtcatcagcctgcccgacgatctcgcctcccggctggagggcaagagttcgctggggcggctcggtctcgtcacccactccaccgccgggttcatcgaccccggattctccgggcacgtgacgctggagctgtcgaacctcgccaccttgccgatcaagctgtggcccgggatgaagatcgggcagctgtgcatgttcaagctcacctcgcccgccgaggccccgtacggcagtgagcgctacgggtcccgctaccaggggcagcgcgggcccacggcctcccgctcctacctcaatttccaccggacccaggtctgacccgaggggcaccaccacatgagcgacgtacgagagaacctcacctacgaactgttcggcacggccgtccgcgaactcgcgcagaccatcgccgacgacgggttcgagccggacatagtgctgagcatcgcgcgcggcggcgtcttcgtcgccggcggactcgcctacgccctcgactgcaagaacatccacctggtgaacgtcgagttctacaccggtgtcggtacgacgctcgagatgcccgtcatgctcgcgcccgtgcccaacgtgatcgacttctccgacaagaaggtcctgatcaccgacgacgtcgccgacaccggcaagacgctgaagctggtccgcgacttctgcctggacaccgtggccgaggtccgcagcgcggtcgtctacgagaagtcccactccctcgtgaagtgcgagtacgtctggaagcgcacggacgactggatcaacttcccgtggagcgtcganncggccgaatcccacccccaccgcgcgaacgaacggcccctgaccgggaaggatgcgggtccggggccgttgttctgcgcgctgcccgcccggcaccgcgtctacccgtggccttcccgctcgatcgggcgcggaaggggcaccgcgagtgtattcggggagtcagggtgtgctgggtggagtgcgtgccaacacccctgtgccagacaccggggtctctgccgtcaggtcgcgtggactcatactgagatcggcggcgatctcggatgccatgtacagcgtctccagggcccacgtctcttcgtcctcttccgtctcggttgccgtatcccagtccgtggccaggcccagggcctctcgacgggatcgttcaaagggcagcggctctcccagcgtcaggtagtggtcctcggccgcgtcggtctcgcagtatcgccgcaccaccgtccctcgctccgcgatcagccacgcagacccgtcaccctgcgcgccgtagtagtacgcctgtgcttctccgtagagagcgctcagttcctcgcacatacgcagcacagcgtccgagcgctcgcgggcgcacggatcgcaccaacgtccgatcaccagggtccacccgtcgagttccgggctcacgtacacccggccgagcctctcggctccggaatggctgtcttcgtcgacggcctcttcagcgcggctgaaggagacgggtaccgggttcgtcagccccagca

SEQ ID NO: 670 - DNA, 7067 bp, Unknown
  Kingdom: Bacteria, Phylum: Actinobacteria, Class: Actinobacteria, Order: Streptomycetales, Family: Streptomycetaceae, Genus: Streptomyces
ggaggggagcgggcgggggcacgggcggaccggcgcggggtcctggccgggcggcggaccggtggccgaagaagcggcttctgcccggcccatctgagaaactgggctcgccgtacggagaaggtacggagaagaaggacaggcaggaggagaagtcgtggcagggtcgtgcggacggccacgacgatcccgcggcgagatgtttcgacgcacgtttcggcgtgcggccgtgggggaggtcactgacacgatgatcgggttgcgcggcgggggccacgcgtcctagaaaagcagtcgggtggagatatgcatcgcggtggcggactgggcgaggggactgacgacctgggtcctcggcgtgcccggcggggaaggcaccggcgcgacgcggaggaaaccgccgaagcacgtcaggcacagggtgcaccgggtgatcccgagcgggccgatcgcctccgggcggggagcaggaatggtggtcgggtgggggtgacgtacaagtacttcggcgcaccggacggtgcgacggcggcccgcgtcccgatctcgatgcgccccgaggagctgggcggcgacgaactcggcatgaacggcatgttcaccaagatcaagccggagaccatggccgccatggtcctcaccggcatcgagggcgtccccctgcaccgggtcccgcccctcgaactggtcgtcctccaccccgactacgccgtcgtcaaactccccatgaccgtcgtcgaccccctccgcgacatcggcgaggaagcggtcggcgccgccgccttcatctggtccacggtcccggaccgcggcggcccccgcgacgcgttcaacgtgtaccagctgctgcacgagtggcaggacttcagccaccggctgcatgaggcggggcatcaggcgtactgcttggtgtggccctgagctgccggcagcggctgctcaaggaccaggaggctcccttggcggagtaccgcgacaccggtccggccgcgggctgcgtgctcggctgtgagttccccggagcatgtggacgccctgatcggggcgcaagccgccgaggtgacgccacctggcgtgccccgcgccctcgccggagccacttccagttgccgccgacgtacggttgaagtaccggggacatcgcgcacttcggctgccatgccgggtcgtcctcggcgagagacgaatccgggccgcccagtggtcggcgcggagacgggtcggcatcatgaccgccgtggccgaagcaaccccacgaagcctcgctgtggctggggccgcgctggatgcgcgcacgggtccgcgctcccgccgaggggaggcgtgatggccctttcccggctggacatccaccggcggaacaggggagagcggacgctcgtcacgctcgtcggcgacatcgggtcggccacgacgccgctgctgcgggccgcattggagcggtgtctgctggacggcgtcaccgtgatcgacatcgacctgaccacggtcggctcctgcgacgccaggggcttggacgtcctcctgtcggcatcacggcgcgccggccgggtccatgcccgcctccggctccaccatccgtccgcgcagatcacccggctcctcgatgccaccggatcggcttcactgctcatcacggcccccgtgtgtcccgtgccgtccgccacgcccggcgagctcctgagcaccgcgacgcaggcgcccgaaggcgccgctcgccgggcggaacagcccgccctcaaggacgggatccgccttcgccggctgacccgctggcaggcggaagacatgcgcgaggacatcgcggacctggctgcggagtccgtcgcgggcaccgccggcgaggcgtaccacgaccgtgcggacttcctgcaccgcttggcggtcactgcccaccgccccggcttcgccctgctggtcgccgagacgacggtgctggtcggttgcgccttcggttttccggtgggctctgacggttccggcggccgggggtccgacggaacgctccaggagatcatcgagcgactcacctcccgagcccggttcgtcgtcctcacccaggtcgtggcccatgcgcacgcgcagcaccgcgatatcgcccgtcggctgcagcagcgtctgctcaccgacctgcactcctcgctcggggtcaccctgctgcatcctgccgaccaggcgggacaagccgccttgtcgtcctgcggctggcagaacatgggtgaggtcgtggggctgcccggccccgtcgcgccctgcgtgctgactctgcctgccgaagggctgccctcggcacgctgatgatgtgcacaggggcgatgagccggcggtcgtacccgtccgaggcggtcaccccggccgtcgtccgccgtacggaggtgtcaccgcccaatggctgtgtgcctctccgggcgacggctgcgcatcacgccgcccgccacggccgggagtagcctgacaggtaccgagaacttccgggcgcacgactacggcggcgccgttcccggcgagtgacagacacgggcagccggaaaccgcccggaacgggatcgcacgatgaacgccgtcacagagcccgccgaaggtaccgcgccgggttacgggcactcctaccggatgcccttgccccggctgcgcctcacgccggatgtcagccatggcccgctggacggtgcgtggtggccgcgctgcgacgcactggaactggaactgcccgtgctggtcggctccttggatccgagcatcggcaccgtcacccgcgtgacggtggggaccgccgcctggccaggtgccccccaggaggtgatggcgcccggccatgtgatcgaggtggtcctgaccgacctcgccgccgaggcgcatgccatcaccgtggactgcggcaccgtggggcgctgggaactgctggtgatccccccggacgagccggccggagtggccacccggctgctgaccgctgccgccgatcccggtaacccgctgtcggccccgcgcctgctggcactcgccgagagcggccccgacggacaggacacatgggagtcggaaggagggaccggccccaggtaagcagcccgacccggccggccccgcgtgaccggcggcgtccacgaccccgtgacggagccatggcaccgacagatcctttgtcatcctgtcccgcccccacgcacagcggaccacggcaggtggaggggttgacggcaggacggcccgcggaccgctccgagagcttcggggaagctctcctcggaaagatcctcgacagcgcgcacgagctgccgccccatctcatcgggccactggtcgccgacgtggtggagcggctcggtgggcgccggccgcaggtgctgctgcaggactacggccagctgctgctcgtaccgctgccgggtgagggcctcacgggcggggaaccgcacgtcatcgacgactccgaggcgggccgctgctttctcgacgcggtccccgtggagctgtcccaggaggacggcgtccggatccatctgcccctgctggacggcggtgaccaggtgggggtcatggcggtgacgctggacagcgtcgatgacgacgaccgccgcctgctgcacaggatctccggcctggtggccgacctgctggtgaccaagcacggatactccgacctgttcttcggcgtccgacgccgtgaggcgatgagcgtcgccgcggagatccagtggtccctgctgccaccgctcgcgatgatcatgcccagggtcgcggtggccggggtcctggaacccgcctacgacgtgggcggcgacagcttcgactacgcgctcaacgacgacgtcctccacgtggccatgatcgacgcgatgggccacggactggacgcggccgcgatggccaccgtggccatcggcgcctaccgccacgcccgccgcgccggcatcggactggcggagatctacgacttcatggaccgcgccgtggcagagcagttcggtcccgagcacttcgtcaccgcgcagatgatgcagctggacacgacgacgggacggatgcagtgggtcaacgccgggcacccgccgccggtcctcgtccgcgaccaccgcgtcgcgcggcgtctgatcgccccgacgaccctccccgtcggcctgggcggttcggtgccccggatcagcgaactcgggctggtgcgcggggaccgcgtcctctgtttcaccgacggagtggtcgaggagcacgagagcggtggggaggagttcggggaggaccggctgatcgaccgtgtgaaccagctggaaaggaccggccgcggcatccgcgcggtgacgcgatccctgtcccacgcgctcaaacaggcgcggggcggacagaccagcgatgacgccacgctgctgatggtggagtggcgcggctgacctccccgccctccggcaccgttccgccggtcgcgcccagcggcgggccgtcagcccgagggaccgcccccgctcccggtgtcgatgaggatctgttccgcctggctgatgttgtctgcccgcaccgcctgcgccatcgcggcgcgggcggcctccggtgccgcgtccggcgggatcaccagcagcgagaagatgtcccggtcgccccgggtgaccaggatcgtgtcgtcaccgaccgggaaggagtcgacgtgcaccaccaggtcgtccacgacgacacgcgtcgggagaccttcccaggccgcggtgtccagacccacccgggtcacgggccccaggtgtccggtgagggcgctcagcagcccgggcagctcagccccgatatcgcgcgagcgcggccaccacgcgccgtcgagaacaccttcgcgtgacgcggtcgtctccagccggagaagcgcacaccccggccggacggcctcgtgaaggccgctgggcagacgccggggaacagaaggtgtgtccgagctggtcatgatgaccacccgtccggagggccggtgcggcagcgggattgccccgcaccttccccacgctactcctggcaccacgcgcgccgatgtccccgtaggccgccctcacactcggcccctgacggaacggatccagcacgcatgaggtcgggaaaccccttgaacgcgcgagcaccatcaagggggcgttcgggctcagagggccagggtgacggcggctcccgcgccgccgaggccggcggcgagggcggcttcgggccagccgcccgtgccccagcggaagaagcggtccacggccagccggccggggccgacggcggcgaccgtcagggcgacgaccgcgatgcagacgttgtactcgacgccgccgtcgctctcccacagtccgtgggcgccggtgacggtcaccatcgcgttgatcatcacgccgatcagcgcggcggccgccagcggtgtgaggaagcccagcgccaggccggcgccgccgaggaactccgagaggccgccgatcaccgcgtagaccgctcccgggcggtagcccagggactcgaagccccggccggtcgcggccaggccgccgcctccgaagaggccgaacagcttctggctgccgtgtccggccatcagcagtccgaaggtcatcctcaggagcaggagtcccccgtcggacgccgtcggtccgggcgcggcggtgctgtgtgccgtcggttccgcggcgaccgacgactggttcacgttgcgcttcacaacgatgcgcttccccaccatgtgagtctccggacaggacggcggaacgggcgcggccccccgcccggcgggatgccgagccgccacgactcacatttccggaacggcggccgtcccgcacctcgggccgccaccctcccccaccatggcggctgccggcagcttccctgtacggcgcctgtgtacagagcgcgggcctcatgtgatcatgacggctgcgatcgccggccaacggtcgcgaggggacgccgcccgcgggcggcacggggaacgccgcccgggagcggcacggggaacgcatcggggggtgcgaagtggcaacacgaacggtttcggtggtcgccgtctgcctggccttcgccggcatcgcgggaggcgtcttcgtcggctcgtccggcctggacacggtggtcggctgcggcacccccgaccacacctacccggaccagacggcacgggactgggtcacgaacgccgatcacgtcgtggtggccgatccggcgcgcgaggaggacaccgggcgccgggactacaccaagggtccggtcagttacgagacggaccgcaaggtgacgttccgcaccggccgtctcctgtggtccgccggccggccccggcagtcgctgggccggagcttcgacctggtggcccccgggtggcgggtgctgcggccgagcggcacccgggtccagagaacggccggggacgccccgcgcctggagaccggccacacctatctgctcgccctgcgctggagcggcggccagtgggtcgtgctcggcgagggcgcctccgtgccgttcgacgggcacaccgccggtcagggtgagtggtgcgggcgcgtgctgagcaaggaggacgtggcacgcggcgaactcttctcccgctcggacgaccacagcctggagaaggccctgctcgggcaggacgagcaggccgtcgtacgcgccctcgcccgcgccgcccgcacgtgacgtactccgggcgccacggcccgccgtttgacgtaagagtcatactttcggccgcgtgaaccggcttgacccctttcgcgacgaccgccggtttccctccgtgcgcgacactacgtactgtagggcccggctcgccacaccactgtcgacgggggatccatgcaacaagcgcattgcccggcgcccggcacttcgctcggcgagaaggaggacggcggactcggccccacggtcgcggtcctcgtcgtgagcctcacgatcgccgccgtcggcgtgtacgaactgtgcggcttcgggctgcacagcctcgcccagcgcccgcacctgttcagcgacggcttcgccacggcgggcgtgatcgtcgccacggtggcggccggcgccgcggccggaaacctgggctggctcctggcggcagcccggaggaa

SEQ ID NO: 671 - DNA, 3228 bp, Unknown
  Kingdom: Bacteria, Phylum: Actinobacteria, Class: Actinobacteria, Order: Streptomycetales, Family: Streptomycetaceae, Genus: Streptomyces
ggctgggcgcgaacggcgcgacggcgagcggcgaccggtgagggcgttccctcggggcggccggcggccggtgcgggggttccctcggggtgaccggtgcgggggtccccttggggcgaagcggtgagggcgttccccttggggcgaccggtgcgggacgtcccgcccgtactgttgcgaacgcaggagaagccgcccgtggtgctcgctttcacaggagcacaagcccttcgtccctgtacgatgaaggcgcaccctgatcgaaccaactctgcctgacgcagagctggcgcgaccgtatggcggtcgggacgcccccgcagtgggcgccggcatctaccgcagtccgcgcaagaggacagctctcggcgcgcccgcacccaagggcccgcgctaccaggcggcagaaaggcacgggccgtgggatccgcggtcaccaccaccgaccccgcgaagacctcgacggcttccgcccgccccggatacgggcaactgctgcgcacccgcggcgcctggacgttcctgctgcccgggttcgccgcgcgccagccgttcgcgatgctcaccatctccatcgtgctgctcgtgcagcacaccaccggctcctacggcgcggcgggcgccaccgcggccgtcaccggcgtctccatggcgctgttcgcgccctacagcggacggctcgccgaccgctacgggcagcgcgccgtcctgctgcccggcgtgctggtgcacgccctggcgggcctgacgctgaccgcgctcgcgctggcgcacgcgcccctgtgggcgctgttcgtggcgtccgtaccgaccggcgcctcggtgccgcaggtcgggcccatggtgcgcgcccgctggggcgtgacgctcaagggctcaccgctgatggccaccgcggcggccttcgagtcggtcaccgacgagctgaccttcgtcttcggcccgctgctcgccaccgcgctgtgcacggccgtcgccccggcggccggtctgttcacggagtccgcgctgaccctggtcggcggtctgctgttcgccgcgcagaagggcacccagccgcccgtctccgacggcgggcacgcgcgcgtggagcatgcctcggcgctgagcatccccggtgtgcgcgtgctgatcgtgaccttcctgggcatcggctcggtcttcggcggcatgcaggtctcgctggccgcgttcaccgagtcgatcggcgagcccggtctcaacggcgtcctgtacgggacgttcgccgccggcaacatgctctccggcatcgtctgcggcgcgatcgcctggaaggtggccccgcagcgccggctgctcgtcggctacaccgcgctggctctggccgcctccgcgctgtggacggcgcactcggtgctgctgctcgccgcgctcggcctcctggtcggcatgtgcatcgcgcccgcgctgatcaccggctacacgctggtcgagggcctggtcccggcgggcgccaggaccgaggcgttcacctggctcaccggcgcggtcgcgctcggccaggccgccgccgtcaccgtggcaggtcagctggaggaccggctgtggggcggcgccggattcctggtcccgatggccggtacggtgctcgcgctgctgaccctgctcaccctgcggtcgcggctcaccgcgcgggccgacagccgcctggtggcacgtggcgtcggtcaccgcgcacccgtcgcagtggactgacgccgaggaatacgtcactatggatcgtcgttagcactcatcgagtgagagtgccaggaggaagacagtgcccacctatcagtaccagtgcaccgagtgcggcgagggcctcgaggcggtgcagaagttcaccgacgacgcgctcaccgagtgccccaactgcggtggccgcctgaagaaggtgttctccgcggtcggcattgtcttcaagggatccggcttctaccgcaacgacagccgcggctcctcgtcgagcagcagcccggcgtcgtcgtcgaagtcgtcggccacgtcgtcctcggactcgtcctcgtcctcgtcggcttcgtcgtcgtccggttccgggtcgtcatcctcgtcgtccacgagttccgcgggcagctccgccgcctgacacagcgcttccaggaccctgccgtcaccggacggcggggtcctcggtatttcctccggcggatccggtcggccggtgtcccgcctgggcggcgggggcttcgcccgggcggctagtgtgcggttcatggcgaacgcagagatcggtgtcatcggcggttccggcttctactcgttcctggacgaggtgaccgaggtccgcgtcgacacgccgtacggcgcacccagcgactccctcttcctcggcgaggtcgccggccgacgggtcgccttcctgccccgccacggccgcagccaccatcttccgccgcaccgcatcaactaccgggccaacctgtgggcgctgcgctccgtcggggtgcgccaggtgctcggcccctgcgcggtgggcggtctgcgcccggagtacgggccgggcacactgctcgtgccggaccagttcgccgaccggacgaagtcccgtgagcagacctacttcgacgggctgccgctgcccgacggcactctgccgaacgtggtgcacgtctcgctcgccgacccctactgccccgcgggccgggccgccgcgctgaaggcggcgcacgggcgggactgggaggccgtcgacggcggcaccctcgtcgtggtggaggggccgcgcttctcgacccgcgccgaatcgctgtggcaccaggcgcagggctggtcggtggtgggcatgaccggccaccccgaggccgcgctcgcccgggaactggagctttgctacacgtcgctgaccctcgtcaccgacctcgacgcgggcgcggcgagcggcgagggcgtctcgcacgaggaggtgctgcgcgtgttcgccgcgaatgtggagcggctgcgcggcgtgctgttcgacacggtggccgcgctgccgaccgccggtgaacgggactgcctgtgtgcgaacgcactgggcgggatggacccgggcttcgtgctgccgtagcgggccgccgcctggaaccgtcccgggacgaggacgactagagaatcgtccgaagcctgcggagccccccttctggagccctgaggcccgggggccctggggcctggggcctggggcctgcggaacctctccttcgagtgacggagttgtccacaacc

SEQ ID NO: 672 - DNA, 2838 bp, Unknown
  Kingdom: Bacteria, Phylum: Actinobacteria, Class: Actinobacteria, Order: Streptomycetales, Family: Streptomycetaceae, Genus: Streptomyces
acggacgacatcaccgccgaagggcggcgcaagctgcgggagttcggcatagcccccccgcgcgtccgcacgccctcggcgcccgtccccctgcaactcggcccgacccgcacccgcacggaccggacacccgcgagccccgcaccggtggaccaggcaccccccgagcccctccgctgcccgtactgcggatccgccgacaccgagatgctcagccggttctcctccaccgcgtgcaaggcgctgcaccgctgcctgtcctgccgggagccgttcgaccacttcaaggaggtgtgatggcccgcttccatccgctgcccgtgacagcggtcgaccggctcaccgacgactcggtggccctcaccttcgcggtgccgcccgagctgcgcgaggagtaccggcacgcgccgggccagcacctcgccctgcgccgggtcgccgacggcgccgacgtacggcggacgtactcgatctgctcgccggcccccgatcccgccggcgagggcccgcggaccctgcgggtcggcgtgcggctggtggagggcggcgccttctcgacgtacgcgctgaaagagatcacccccggtgaagagctggaggtgatgaccccggccggccggttcacgctggagcccgcgcccgggctgtacgcggccatcgtcggcggcagcggcatcacaccggtgctgtccatcgcctccacactgctggcccgcgaacccggcgcccggttctgcctgatccgcagcgaccggacgaccgcgtcgacgatgttcctggaggaggtcgccgacctgaaggaccgccacccggagcgcctgcagctggtgacggtgctctcccgcgaggagcagcaggcgggactgccctccgggcgcctcgaccaggagcggctcacggcgctgctgcccgcgctgctgccgacggccgacgtggccggatggttcctgtgcggaccgtacgggctggtgcagggggccgagcgggcgctgcgcgccctgggcgtgccccgggcccgggtgcacgaggagatcttccacgtggacgccggtacgggccccgggccggcgacgcccgtgacggcgcccgcgcacagcacggtcaccgtccggctggacggccgcggcgggagatggccggtccgggagggcgagagcctgctggacacggtcctgcgcaaccggcccgacgcgccctacgcctgcaagggcggcgtgtgcgggacgtgccgggccttcctggtcgcgggcgaggtgcgcatggaccgcaacttcgcgctggagccggaggagacggacgcgggatacgtactggcgtgtcagtcgcacccggcgacggaacaggtggagctggacttcgaccgctgaggcgaccgccgggccccaccatgaccgtcgaaggacgtggcccggcggccatgaccgtcgaaggacatgccccgaaggacatgccctgaccgtcagggaaccgagcccggccgtcagagcatggagggggctttcagatgacgtggcccggctgtcccccgtcggtcaccacggcacggcccgaggcggcccagacctgcatgccgccgtcgacgttcaccgcgtcgatgccctgctggaccaggtacatcgtgacctgggccgaacggccgcccgagcggcagatcacatggacccgtccgtcctgcggcgccgcctcggtcagctcgccgtagcgggcgacgaagtcgctgatcgggatgtgcagcgccccttcggcatgtcccgcctgccactcgtcgtcctcgcggacgtccagcaggaagtcgtcgtccttgaggtccgtgacctcgaccgtgggtacaccagctccgaaacgcatgggtccgacgctacccgacgcgccccgcacagccgtggccccgcacagcccgcgccgtgcaccaaacgtcggctgcctgtggtcaagggcagggttcagaggtcggcctgcagcgccgcgagctgcgactcgcgttccgtcacgtcgttgccgagttgcccggcgatctggtcgagcaggccgtccgggtcgtcgggggcgagcctgagcatcgccgcgatcgcgctgtcctccagttccttggcgtggagcgtgagcatctccttgcgctgggcgagccactccaggcgggcgtacagctcctcgccgcggctcggcgcctgctcggccgggacgggaccggcggcccactcctccgccagttcgcgcagctccttctcgtcgccgcgggcataggcggcgttgacccgggtgaggaactcctcgcgccgtcggcgctcgccctcctcctgggccaggtcggggtgggcaccccgcaccagctcgcggtagagaccgcggacctcctcgctgggccgcacccgtcgcgggggccgcaccggctggtcggtgagcatcgccgcggcctccgggaacaggccgtccccgtccatccagccgtgcagcagttcctcgacaccggggatcggcgccagccgggccctggcctcctgcgccgcacgcaggtcctcgggatcaccgctgcgggcggcccgcgcctcggcgatctgcgcgtccagctcgtcgaggcgggcgtagagggggccgaggcgctggtggtgcagccgggagaagttctcgatctcgacccggaaggtctccaccgcgatctcgtactcgatgagcgcctgctcggcggcccgtacggcgcgctccaaccgctcctcgggccgcgccgcagcgctctcggacgtcgcccggtccgctccggcaacgccaccctgctcagcttccggggtcgtcacccgaccagcgtaggccacggcgacccgcggcccgaggagcggttgg

SEQ ID NO: 673 - DNA, 6260 bp, Unknown
  Kingdom: Bacteria, Phylum: Actinobacteria, Class: Actinobacteria, Order: Streptomycetales, Family: Streptomycetaceae, Genus: Streptomyces
gcggacccggtgcaggtacgcggcggcggccacggcggcccgcagcagcggctcgggttcgccgccgtcggtctccgcgccgacccagaggcccagccactgggcgaagtccagcggggccagtgacggccggaagtaggtgtccaggcagtcgaggacgctcaggatcggcgcgatcacctcgtcgagcccgccgacgaaccgctgcgcgaggtcgtcgtcggcgaacacggcgggcagcatcatgccgatcggcgcggaggagcccaggccgtcgatggagccgcgcatcaggcaccgtccccgatgacgcgcacccggtggtcgaaggagaagacgagcgagggcgcggacaggtcgatgcggtcggtcgcctcgccgcgcttgccggtcagcgggtccgcggggtgcaggaccacctggtcgaccagttcgacgcccggcacgcgctgcagcaccgcgaacacctcgccggactgcaccggacgcccgaacggccaccccgtgccgctcgccccgccggtcagcgggtccaggtgccggtagagcgcgtcgtgcgcgtcccgccgcacccggtcggtgtcgacgccccggaacgcgtgcaccgtcgccaccaccgtcacaccctggtagtacggcggaccgaccgccaaccgcgtcccgatcagacggcgttcgtccaggtgccgggtgatccggtccagcagggcgtcaccgggcaccagttgctcgaagcggagccggccgcccgggtccggcaccgcctgcggcaccaccagcacccgtaccgcgtacgccccgtgctcgccctcctcgccctccaggcaggtgatccgcgcggtctccggagcggcgcgccgcgccagctcctcgtagtcccgcagggtcaccgcgcgctcctgggcgcgcagcgtgatcggcgcccggaccttcgcctcctccacggtctcgccgtccaccccgccgcgcgcggcctcgcggttggcgacctcggagacgtacgggatggaggtgcgcaggatctgcacggcgccgcgggccacgttcccggcccggccgccgccggtgcggtagcggcgggcgcggatcggcgagcccttgggggccaccgtcccgtactggcgcagggagccgtcgggttcgcgcacggccgggccgaaggcgatctcgccggtggtggcgtccagggtgatgtgccggtcgtccggcccggaggcggcgaagttcgggacgacctgccagtccacccagccgtcgtgctcggcggtctgcagcagcaccggcgggtcgtccccgaccaccggggcgtgcgcgaggcgcagccgctgccccggcagcccggtggactcgccgagcgcctcgtcgtacacggtctcggcgtgcaccgtgccggtggtgccgccgatcgtgaacgcctcggcggcccggatggtgggcgaggtggtgtagaagggctggccggggtggggttcggtgacccggcagcgcagccagcccgcctcctgcccggcgttgcgggacagcacgtgcccgccggggacgtgcaggaccacctcaccggggcggttgagaccgccggtgccgtcccggtcgacctcgcagggctgccagccgtccgccgtccacgcctcccacaccagcggcggctggcgcgggtccacgccgacaccgtcgacgcggctgtccaggtccagggagaccgcgcagtgcggcaccgccgcggacaggccgagcagcatgcagtcgccggggtcgggggactccgcgaagcacagcaggtccttgtcctcctcggcgaggtcatgggtgcggtccaccgccgcctcgccccggtggtgcaccagcaggttccgcaacgcgcacggtacgaccgtcagttcgcgctcggtggcgaagaccaccgcctcctcgctctcggtgcgcacggtcgccacctcggtgcccaccggcaccgccaccggctcctcctgcggcgccgacagccagaacgtcacgtccgtgcgggcggccgacggcgggaacagggtgatccccaccaggtccaggaaggccaggtggttcttctccggcacccggttgagccggtagacgatctggtcggccatgtgggcgaccgtctcgaccagggtgacgcccgggtcggagacgttgtggtcggtccactccggagcacgctgctggatgtagcgcttggcgtcgtcgacgaactgctggaagcggcggtcgtcgagattgggggagggcagtgccatcagcgatcgctttccggagccggggcggtgccgtccggctcgtcgtgggacggaatgacgtagaacgggaagacgaggctgcgcgggttgttggtgccgcggatcgagtagcgcacgtcgatgtacaggacgctctggtcgccgcccgtcgacacctcgacgtcgtcgacctcgatgcgcggctcccagcggtccaggctgacgtacacctcgtgctggatgcggcccgcggtctgctcgttgaccggggcgaacaccaggtcgtggatggcgcagccgaagtcgggccgcatgggccgctcgcccggcgccgtcgacagcaccaggcggatcgcctcctcgacctcgcgctcgccgctgaccagcgcgatcccgccggtcggcccgatacgcaaggggaacgaccagccggaccccacgaactgctcggccatcaggacgacacccgctttccgggaagacggcgaaggtggccacggtggccacagggacagggacggcagggacggcagggacggctcacgggatcaccatcggcacgggaatggtggtgacgccgaagacgggggacgcgaccatggtcgtcggcgccttgatcgtcgtgttggcgaacgaggagatctgcacggtgcccccgccggtgaggttggcggcaccacccgccgcgaggttcagcgcccccccggccatgaccccgatctcggtcgccgcccgcacgttgaccatggcggcgctctggatgctgagcgggccgccgctcttgagggtcaggctgcgtccggcgctcagcgacaggtcggtgcccgcctccaccgacaccgaccggctgcccttgatcgtgaccgagcccttgctgtccacgatgatctcggtgttcgtccggtccaggttgatggtcagccgcttgtccccggagaccagccggacgccctgcttgcggccgcccgtcttctggctgagcaggtccatgcggttgccgtcccggtcggagagggtgtgccggctcgccttcttgcgcaccgcgtcgtgcagcggcacgtcgttgacgggcgtcggcttgtcccggccgttgtagagcccgccgatgacgaacggatggtccagtgcgccccggtcgaaggcgaccagcacctcgtcgttgacgtccatcgggaagatcccgccgccgtccaggccgcccagctgcacggtccgcgtccagtcgctgacgtaacggtcgtccagccacgggaactgcaaccgcacccggccctgcttcagcgggtcgttcacgtccgtcaccagcgcgttggccacactgggcagccgcggcgcggtctgggaaccacccgaggcgagaccgtacagcgaacgccactgccgtccgctgaccgtgacccacacctcgtagtgcttgccgtcgccgaacacgtgccgcaccgaggtgaccgtgtacttgccctcgaagggcacgcccacgtccgccagcgccaccggaactcccggacgcagcaaggggtttccgcgcgcgacgacctccagctcgccgaacgagcccgtcacgtcgtcggcgagggcgtcggccgcgaacttcacctcgttctgcttgtcgtagggcgtgctcgtctcgaccagtttggccgtcgtgaacttggcggcggcggcgcccggcgtggtgccgatggtgatgcccgggttgtcggtggcgggcgcggtcgccgtgagcttcttcttcgtcgtcacgtcccagccgcgcgactcgaccttgcccacctggtccgcggcggtgaccgcggcgcgcagccgcaggatgtcgtggccggcctggagcacgaacgggctcttctcaccgtcggtgctcggcgacggcgcgccggaggccgacttcggcttcacgaactggaacttgccgtccgcgtcgaccgacatgaccatctcgttctcgtcggcgagccgcgcgaggaagtcccagtcggtgatgttggactggctgatgaactcgtacaccgtccgcgtcgactcgatcttcccgatcggcacgccgtcctgggcggccagcttgcgggcgatgtcggaggcgctctggttgcggtacgccgccacccggcgctggcgcagcaggcggtgcccgaggtcgtagccgcggacgacggtgaagctgccggtgccgtcgtagtcggcctccaggccggtgacctcgccggtcagcagcggatcaccggcgccctcgccgtccgccaccggcgcgagcaccaccttggtgccgaacgtgatgttcagcttgccgagcagcagccggtaggggtcgcggaacgtcagccggaacgccgccgggacgccgacgccctggtcgacgtagctgtcgacgaggtccgcggcgaactccggggggagcttggcgccgccgaccttgacgtcgatgacattggagaacgcggtgtgcaccatcagccacgcacctcctcggcggccggcagcaccagttcgacaccggccggcagcacggacgggtcgtcgatgccgttggcctcggcgatggaccgccaggcggatgcgttgccgtactcgcgccaggccagcgactgcagcgagtcaccggccacgacccggtgcacgcgctgcgcggtgagcgcgccggaggtcgggttctgccccttggtccggctcgggatctcgtgcagctggagccggcaggtggcgcggatcggcacacccgtcgtaccgaacagcgtgtaattagcctccaccgagctgacgtacgccgtgaagcgggccgtcgagaacgacccccactggaagacgacccacggcggcgacggctgcttggcggcgacgctctgcgccgtcacctcgcagcaggacagcagcgactcgaccttcttcagcacggtgttgctggtcggctcgtcggacgtgtcgaggaagatctcgacactcatctcccgcgactgcgtacccaggaactccggcagcgggcccttgcgttcgatctgggacggggtgaccttccagttggcgcggcgggtcagcgacagctccgccgggttgaagtcgaaaccgaacgtcttgatgatcccgccgggcgtcctgctcttgcccttcggcggctggtggatcgcgagtgtggcccgcaccaggctcttgccggcgccgcccctgctgcccttggccatgtgtgctgttcccctcagtccttcagtccgctcggttcgctcagttcctcagcccactcggttcgcccgggccgctcagtccgtgaacccgtggtgggcgatctccagcacctcggtcgccacggcggggctcgccgggtcgagggtgggaccggtccagctcaccgggagcacgtcgatcaggccccagcgggccacttcggagccgtccgcgcgcagcgccgcgatctgcgcggtgggccgcttgatgcccgtctgcacggacgagatccacttggcgaccttggtggtgtccggggtgagcgggcgggtcagccggatcgtggagaacgtgacgcgggtcggcaactgccagacgaagccgttgttgccgccctcctgacggtgctcgacctccacctgggacgacagcccctcgcagccgttgaagtagccgaggctctcgccgtcgatgctgagggtgaaccagatggtggaacccgggtcctggcgggacatcgagggtgggcccttctttcgtttccgtcggcgttctggtcggggggtccggtggtgtccggcggggctgtgggctccggtcgtccgcgaccggctccggtggctccgcgctgtgccgggggtcagtgccggtggtcagtggcgggggtcgcggagtttgccgatccgttcgcggtccaggcggagttcggtacggatcagccgggtgatgcggccgatgatccggtgcaccagctcgtcgagctggaagtcggtcagctccctcgggtcgaacgcgcccggcgggatcgcctcgtactccggcggagcggatgggggcgggggcggggagcccgcggaggcgtgcggtgtgtacggg

SEQ ID NO: 674 - DNA, 10835 bp, Unknown
  Kingdom: Bacteria, Phylum: Actinobacteria, Class: Actinobacteria, Order: Streptomycetales, Family: Streptomycetaceae, Genus: Streptomyces
cgccgcggagacggcggtgctgctcggcgagtccggcgagttcgaccgcgcccgcgaggccgcccggcaggcgctcgccgcccatgccctggccccgcgctacgagcagctcagcagctgtctgcgcgaactcgcccggctccaggcccaccagcagggcgcggagggcctgtccggagccctggcccacctcgccgacgccggccgggtcgccgacgaggcccgcgccgccggtttcgaggcccacgaccgctccctggacaccgcactggcctacgaacacggccgggtcaacgcctacgcgggcgagtacgaggacgccctgaccgccctggagaaggcgctctccctgctcggcgatccgggggaggagcaggaacacgcccgtgagtgggccgaatgcgtccggctcgccggggcggtggagggcatctacctgaagcgccccgaacccgccctcgcccgcctcgacgcggcggtcacccgcctgaccgcgctgggccacaccgaggagaccgagccgttgacctccctggcgacgcgactgcgcgacggcgagtgagccgaagggccgccgcggtccgctcgtcatcgggtccgccgccctccccgggcggcaccgcccgtcgccgtgccccgtcctgaccgggcctttcctcggctgcacaccaccggccgtcggcgaaagcgcctcccggccaccggagccggccggccgaccgctcggcagaggcggcaccggaggctccgcacggacgtccgcggcctgcgtgcactcggccggcgcgcgctccacgcgttcggccgcagctcgtgtgccacgatcaacgtgccggcaccgctcaacggtcgagtacgcccgatgggaggcgaaggccggctggagttggccttcgtggccgcgagccgagcctttgagcgtgcccgggcccgagagccctgttgacaggacgaggccggctcgcgtcccgcagtcggtgagtccgcggtagcggatgagggttcaggcggcgctgtcggtcgcgcccgctcagccggccgaagtcttccgtgtcgcctcgcgtgcctcggtgagggctcgctgcctgaggttgccgccggacagctgaatcgtggcggcggccaggatgtcatccctgccgatggtccgcccgtccccccggcggggggacagcgccgggagggaatccgtgaggaacggggccggtgccggttcgccgggcatcaccagcgcgaccgtaccgaaacgtctggccccgccctcgcggacgaccatggccgcgtcccgggcgaggtccgtcaggaacacgctcgcgattccgtccaggtcgcggaccatcgccgggacggctgtcgccccctggctccgcagcagcttcttgaccccggcctcgaacctgtgggcgccgaccacagcactcggtttgcgcgacctgctgcgcttacgagaaggcacaatgacaccctcggcgtcgtacaggacaccggtcaggccttgaaacgtcgggctgtggtcgtaccactcggcccccacctcgagctcgacgttccggtcgatcgccgagagaaggtccccgggaatcagcttcctccgggcctcctccgccgccgttctcctcgcgccgtcgatgatctccgtcagcactgtccgcgtcaccgacgcggcggcccacgcggccgaccgagagacgtgcatcggggtcacgtccctgaacaccgctttgacgagagaaggcttgaacggcgagacatccatgaccgaggcggtctcgggaccgctgcgctcagggcgtgcgggctgtgcggccatcggaagaaacgctccttgctgtcggagttgtcggaggaagttgtcagaggcccacacttcaccacgcggaccccgacggccggaccgatgaccggccacctcccgcacgccctcgtaccgtcgaaggcgttccacgcccgggggcacttgaacgagcgtcctgaggaggcagcggcccgaggccgctgtcatcgtccgccggacgcggagcgcgctcggatcccgtccagaaggtacttggtgcggcggtcgtagtcgtcccggggaggccggtcgccgtgcttgagggcgagggcgttgtcgacgacgagtgcgtggaggtcgcccgccgtgaactccggccgcagcacaccggaggcccgcgccgttgtgatgagctcttcgttggcctcgcttccgacctggcagatctccatgagctgccgcgagtgcggatatgtctgcaacaggacgtcgttgaaggcgggctggcggtactggaggtcgcggatcgcggtgaggtagtacgtgatccgctcgccgaggtcgccgatggtccgagtgcggtcgatgacggcgaacagctcactcgcgacgacctcttcgatgacggcttcgatgaggccgacccgcccgccgaaccggttgaagatcgtggccttgctcacccctgccgccttggcgacctcctccagcggcaccgtcaggccctgtccctggaaggcgccgatcgcggcagcgcggatctgttcggaattgcgccgggcgtcggagcgcagccggggctccggaggcaccgcaccggccatggccctcaccgtcccttcctgtcgctcaccgtcgtaacttgactcgccgggtcagcttacctacggtcgcagacgggagagaacctgacccctatggtcaacttaggattccgtccaccgccaagacggacacggtgggcgctcaggaaggtcgagaacatgatcgttgtcaccggcgccaccggtgggctgggcggcgccaccgtcgagcacctcctcaagcgcgtagccgccgaccggatcggtgtcagtgtccgcgacgccgcaaaggcgcagcacttcgccgaccgcggtgtgcgcgtgcggcagggctcctacgaggatccggccgcgctgcgtgactcgttcgccggtgccgaccaggtccttgtggtgtccggcaatgacccggccgccgacatggtcggcctgcaccgcaatgccatcgaggccgcggtcgcgtccggcgtccggcggatcatctacacgagccaacagggcgccgtccccggcaacccgtaccggccgtcggacctccacctcgccaccgaggcgatcctcggcgactccggagtcgcctggaccgcactgcgcaacggcgcctacggtccgctcgatcaggttctcggcccgtggcagcggaccggcgtgatcgctcggccggaggacggccccgtcccgtacaccgaccgtgccgacatagccgaggccactgcggtcatcctcgccggtgaccgctccttcgacggtcctgtcaccctcaccgcgccgaccgccgtcaccttcgacgatctcgccaggatcgcctccgacctcaccggccgcactgtcaagcgcgtcctcctggacgacgaacagtggatcgccgaccagatcgcgatcggtgtgccggagcagatggcccgactcatgctcacctggtaccaggcagcccgtgcggactacttcgccgaagccgatcctctgttgggcgaactcctcggccgcgagccccgcaccgcggccgaccggctcacagcccacatcggcgcctgaggcttctccgagccgaacacgttgggccgctcggcagccctggccgaccacggccgcttcggcgtgcagcgggcggtgagagggtgggggcgctcatctcgaactcgccccccacctcgtgccggacgggtatcggcggaccatcaccaccgtgtccagcccctcccggctgatcaggaccctcgccgtcgcctcgccgtcggcaggccctgtcgggcgggttcacggtgtcggcctgccagggacgggagcgactcgtgggtgttgtggtggccgttgccgggggatcacctgggtggcacacgtgtcggccacggccacgtggccgacacgggtgtgaggccaccgccgatgaaccgcgtgtcagtcctgcgagcgccccggagccggcgaaggtcccgccagtgtccaggaggccagcaggctcagcgcctgggcggacgccgaccggggttctgcggtgtacaggaacagagtggtttcccggtcaccgggaagcgaaagcgcttcgtactccacggtgagttcaccgaccaagggatgccgaagccgcttggatccatgagtgcgctgatgcacgcggtgctgccgccaccagcggtcgaagtcgtcgctccgttccctcagctcggtgaccagcgcctgcgtggcctgccggtccgattcgcggaccgcgtccagacgcaggttctccaccgcggcgcgggcctggacgtcccagtcgacgaacagatcgcgcgcgtcctgatcgaggaagagccagcgggtgtagttgcgctcggcggccggcatggcatcgaagtccgcgaacagggctttggccatacggttcgcacccaggacggcggactggcgccccaggaccagggcgggaacagcggcgtccagggaatccagcagccgatggagcccggggcgcaggcgctggacgctgggcgggcgcgacggggggcggctggtggtgacgcccacgagatccctgaggtggccaaggcttgcctcgtccagtcccagggcgtgcccgatggcttcgatcacggcaggggacgggctgatggagcggccctgctcgaggcgggcgtagtaatcagcggacacacccgccaggcgggcgacttcctcccgccgaagtccgggcacgcgccggacgcggtcgtccggcggcagccccgcctgcccgggatcgcactgggcgcgggcgcgcttgaggaaatccgcgagctcgcggttgacggaggccatgggaacagtctgtcccgcaaagaacgacgacgggctcaccgaggaaggtctgtcagtcctacctctgcccgacccaggatgcgcagggcccgccatggccctcaccaccgctgttccgcggtccacgatcgagccagcgccggatcagcagtccggtccggcatcccgtcgcggcacctgaggaagaggaacacccatgcctgacaccacccctcccaccacctggctcgtcactggcgcttcccgcggactgggactggagctggtccggcagctgctcgcccaaggcagcaacgtggccgctacgacccgctccgccgagcgcctgacgaccgcgctgggaagcgcggtcgacaccggtcggctcctcgcgctgaccgtggacctgacggacgagtctcaggtcacaagcgctgtgcgccggaccaccgagcgcttcggccggctggacgtcgtcgtcaacaatgcgggctacggctacctcgcggccgtcgaggagaccagtgccgaggcggtgcgggacatgctcgacgtccaggtcggcggggtgtggaacgtgctgcgcgcggcgctgcccatcatgcgtgagcagcgcgcgggccgcgtcgtcaacgtctcctcgatcctgggtctgaccacgatgcccggctgggcgctgtactgcgcgggcaagttcgcgctcgaggggctgagcgaggcgctcgccgccgaggtcgcggacttcggcatcaaggtcaccgtcgtcgagcccggctacttccgcacttccttcctcaccccggactcgctggccctgcccagcgagaccacggagcactacccggcggtgcgggccatggtcgaggaccacctcaagcttcagggccaccagctcggtgaccccgtcagggcggccgccgccatcatcgagcgcgccggcctcgaagacggccctctgcgccagctgctgggctccgacgcgcacgccttcgccaccgcgaaggtcgacgccctgcgcgccaacctggacgccaccgccgcctccgcccccaccaccgacttccccaaagcctgagcaggcctcgcccaccctccaccgttgcgggcgggtgagggccgtcttccgaagaatccgcacgtaggggcgacgccccgcacgagaagttcgtgcggggcgtcgagcttcggtcgggcctcgcggcgcgacccctgaaactcggaccgaacagctctgtcggggcagaacactctttgagcaggcgtctcctaccaggtcaccggtagctccagggggaaccgtctgatcgtcttcgtgtcccaccggatctcttcgggcggcacggcgagccgtagcccggggaatcgctccaggagccgtccgacggctacttcgagttcagccatggccagtggcatggcgatgcacctgtgccctccccagccgaacgtcatgtgcgggatgctggggcggtccaggtcgatgaggtggggattcgggtagcgtccggggtcacggttggcggtcaggtaggagacgtggacgtagtcgccggcccggacccggactccgtccagttccaggtcctcgagcgcgacccggggaatcccgactcctttgcggaacgggatgtggcggagcgtctcgtgcaggacgtcggcgagggtctcgggtcggcgcctgaggtgtcgcagcagtttgggacgtgtcaggagcaggtaggtgatgttgctgatctggcaggtcgccgtgtcctggccgctgagcgccagcatcaaggccatcaccgcgagttccttgtcgtcgagttgttcctcaccgtcccgtgctgcggccatcgcgctgatgaggtccgggcccggcgtgtctcggcgttgttcgacgagttccgcgaagtacgcggtcaggtcggccttggccgtggcggcggcctccttgttgtcagcgccgacgacgagcagttgatgcacggattcctggatcctcggccattcccggcgttcgatgccgagcaggtccaggatggtgtggtggggaagcgtgtcggcgaggtgagagaccagatccgctggtgggccgtgttcctccatccggtcgagcaggtggtccgcgagtcgcgtgatccggtgccgcatgccttcgacgtgctgcggggtgaaggcctgggaggcgaggtggcggacgcggctgctgtgcggcggatccatgacgttgatcgactcgggcgagacgatgggctccggtgtcatccgggggtagtcgtggccgatgatgccggcccggctgagccggaggtcggtggtcacctgtttgacggcgtcgaacccggtgaccagccatgcgtcggcgtcgccgtaggggagccggatccgtgtgggggagtcacggcccatcaggtgcgcgagggcggggtcgaactcgagggcttcgctgaagtcgaacaggcaggtgacggtctcatggtccgcggtcatcagtcggctgctcctttgggcatgggtacgacgtcggtggtgtccatggcccggcccaggctccgggcgagccgcccccctcatgtaccgcatcctcttccgcccgcaggaactcagcactccctgagcacaccacgacaccacctcgtccacactttcctcgacctcaccgctccctgacctcagccgtccatgacgccacagcctcagccgctccatgacctcacagagggcgtccagctcagggcccgacagagcccccggtcccgctcagcgccctcggtcccgctcagcgccctcggtcccgctcagagccctcgggtcccgctcagggccccgggggccgggagcacatggcgggacgcgccgtcaggcggagctgtcacagacccgttcggcctcggcggcggtcacgctgcgccggacatcggcgtccgcgagttcctggcgcccggcggcgcccggatgcccgcccgcggcgatctgggcctcgtaggccttcttcgtctcgtcgaaatccttccgggcgcggtccgcggccgcctgcgcgctcgtgcagtcgtcggtcgtggcggcagccgccgggagcgtggtgaggggaagcgccagaagtacggccgcagcggccgttccggcgagtgagcggatcgattccatgtcctggaactcccttacccgtggcgcacctcgctggtgacgcaccctgcccgtgacgcaccgtgccgcctgccagggcacagcgcaccctctgcccgtggtgcaccgtcacgcggtccggcgcgtgccggtctctcctgacaccggatgcctgcgcgtggacgccggtgtccgcgcaccccctggtgtccgcacaccaccctcgccccgggagacgggcaccgccaccggcgggagtccgccgtcaggccggcgctggtgccgcacgccgtcgtggagccttttcgagcggagcgctcacgtcacccgttcggcctaacggagatgccgcgccgagagggagaccctgcactgggacgagagcgtcgtccggcagtgaggaggacacatgcgcggcacaacggctcccctcgccctcgtcacagcggtcctgagcgtgggcctgttcgcctccggcgcggaggcgaacccggcggcgcgggtgtcaccgacgacggtcgaggccgggggtacggtcacgatccgtgtcacctgcgacaccggcacgtcgcagaccgtcgacgccacgtcccaggccttccggaacggcacggtgacgctgcgccgcacccagggcgccgtgtacaccgggcaggccacgatcgccccggccgggaacttctcctccggcggtcccgatcccgtcgggcgcctgtcgcagtggggcgtcgacggcacctgccccgacgggcacgggttccaggcgggcttcaccgtcgaccggggtcgctgacgcggatgtcacgggaccgggcgggtgtccccgtgcgcggaccgtcccgtgtgcacacctgtggtgtacgccggggcggggtccgcggccgcgtcgtgccggtcgtacaactcggcgaccagggctcgtgcgtagtcctcgtccgtttccgggatggagaacaccacccggaagtagaggggtgcgaccacgcggtccaggacccgttccagtgggggcgtctcctcgccccgtagggccgcggcctccagggccgcgtggaaccgggtgctgacccgctccaggcactcgcgcagtccggcgcggcgctcgtcgacgtccggtgcgacttcggcgcggaagaacgccacgcctcccggccgggacaggtcggtgagtgtccacacggcggcctgttcgaggtccttgcgcagatcaccaagcagcgtgggcgtcccctcgtcctggcgccgggcggccacgtccgccaggagggcggaggtcgtcccccaacggcggtagacggaactcgggttgacgccggcgcggcgcgccaccgcggggatggtcaccttgtcggtgccgacttcctgcaccagttccacggtcgcccggtgcacggcggcgcgcacacgggcgctccggcctccggggcggctctcattgcttttggcggtcaccccctcagcttaaagcaatgaattgcgctttagtgccccaccctcctagagttgcttaaagcggtgatcgccgctttaagcagacttcccgaggagacccatgtcccactacgaggcccagtaccagctcggcaagacgttccactcctgcctcgccgccggcgactgggacggcatccgcgccctgctcaccgacgacgccacctggacgcttcccggtgacaacaccatctccggtacggtcagcggtgccgaggaggtcgtggagcgggcgaagaagatcgcctcctacgggctcgacttcgaactgctgcacatcctggtcagccgcgagaacatggcgctgtccctgcacaacaccgcccgccggggcgaactccgcctggacgagcacctctccaccatctgccgcctgcgcgacggcaggatcgcgagcatcgagacgtacctgtccgacgtcgcgggcatgaacgcgttcttcgtctgaacggcgagcgcccactgtccgcccccggccgacggccggtgacggacgcacgggcctacggacgcacgggcccccggggacacggccggttcgtccgtgtccccggggcgggccgtgccctcgcgcgtgggggtgcggctgtggcggtggcgacggtgctcaccgcgttccgacgtcgtacggggtgccgtcgatgacggcccggagtttgtccgggttggccacgttgtggagcgcggtgatacggccctcggcgtcgaagtcgaaggtgagggtggtgatcacacgccccggcccgctgaacaccacgcccggccgtagatctcgacgagttcggctttcatgtcggcgggctcgacgccctggtaggcgacggtgccgatggccgcgaaccaggcggccaccgtggccgcgcccaccaccgggcgcagggcctggcggaccttgccgccgccgtcggcccacagggtcacgtccggggacagcggctccaccagggcgttgacgtccccgccggtcgcggcggcgaagaaccgctcggtggcctcccgctgccgccccgcacgtgctcgcgggcccggtacgcggcctgccgcgccgcggcctcggaacgctccaccgcctccgcgatctcggcgtggctgaagtcgaaccgcgtagcccgcccccaggatcaccacgcggtgggggtccgcgtgccgttctcctgctgtgcgctcatcgtcacgtcctcctccgctcgctcactgacgcccaccagatgggagcagacggcccggacgtgacatgaaccgaatgcgatgcgcgccacatcgcctgcgtgggcgacccctcccgcaagaccggctcgttcctcgatcgatcccgacggcagcccgcggtacgcctgcgacacaggcggagcgggtcacacgcagtaccagtacgacgcggtcgtcgccgtcgccgtcgccgt

SEQ ID NO: 675 - DNA, 2450 bp, Unknown
  Kingdom: Bacteria, Phylum: Actinobacteria, Class: Actinobacteria, Order: Streptomycetales, Family: Streptomycetaceae, Genus: Streptomyces
attcggagccgtgcggaggacatgagcgcatggtgtcacgtcctccgcacggctccgaatccaggcaccgcttggcatatgccagaggcagccactgtgatcagcggctgcctccagtgcccgcggacgtgcccgtacacgccggccgccgtgcccgtacggccttgttcaccgcgtccatacggccttgttcggcgcgcccgtactgcctgctcgccgagtctcagcgcccgttgaacgcgtccttgagccgcgagaacagcccttgctgacccggctggaactggccctgggggcgttcctcgccgcgcagttcggccagctcgcgcaggaggcgttcctggtcggggtcgagcttggtcggggtctggacctcgacgtggacgatgaggtcgccccggccgccgccgcgcaggtgcgtgacgccgcggccgtgcagcgggatcgactggccggactgcgtgccgggccggatgtcgacctcctccaggccgtccagcgtctccagcggcaccttcgtgccgagggccgccgcggtcatcgggatggtgaccgtgcagtgcaggtcgtcaccgcgccgctggaacatcgcgtgcggcagttcgtggatctcgacgtagaggtcaccggccgggccgccgccggggccgacctcgccctcgccggcgagctggatccgcgtgccgttgtccacaccggccgggatcttcaccgtcagggtgcggcgggcgcggatgcggccgtcaccggcgcactccgggcacggggtcggcacgaccgtgccgaagccctggcactgcgggcagggccgggaggtcatgacctggcccaggaaggaccgggtgacctgcgagacctcaccgcggccgcggcacatgtcacaggtctgcgcactcgtgccgggcgcggcgccctcgccgctgcacgtggtgcagacgacggccgtgtcgacctggatgtccttcgtcgtgccgaaggccgcctcgtccagctcgacctcgagccggatcatcgcgtcctggccgcggcgggtgcgcgagcgcggtccgcgctgcgacgccgtgccgaagaacgcgtccatgatgtcggagaagttgccgaaggaaccggccccgaagccgcccgcgccggcgccgccggactgcgagagcgggtcgccgccgaggtcgtagacctgcttcttctgcgggtccgacagcacctcgtaggcggcgttgatctccttgaaccgctcctgggtcttcgggtccgggttgacgtccgggtgcagctcgcgcgcgagccggcggaacgccttcttgatctcatcctgcgacgcgtcgcggcgcacgccgagaacggcgtagtagtccgtggccacttacgactccgccaggatctgtccgacgtaccgtgccactgcgcgtaccgctcccatcgttcccgggtagtccatgcgggtcggtccgaccacgccgagcttggcgactgcctcgccgcccgaaccgtagcccaccgacacgatggacgtggagttgagtccttcgtaggcgttctcgtgaccgatgcgcacggtcatgcccggatcctgtgtctcgccgagcagtttcagcaggacgacctgctcctccagcgcctccagaacgggccggatggtgagggggaagtcgtgcgggaagcgggtcaggttggcggtgccgccgatcatcagccgctcctcgttctcctcgacgagggtctccaggagggcggagagcacggtggtgaccgtggccctgtcctccaggtcgaagccgtcggggaggtcctccaccagctgcggcacgtccgcgaagcggcgccccgcgacccggctgttgagccgcgcgcgcaggtccgccagggacgtctcgccgaagggcgcgggacagtcgatcatccgctgctcgacccgcccggtgtccgtgatcagcacgagcatcacgcgcgcgggcgcgagtgagagcagttccacgtgccgcacggtcgaacgggtcagcgaggggtactgcaccacggcgacctgccgggtcagctgcgccagcagccgcaccgtgcgggccaccacgtcgtcgaggtcgaccgcgccgtcgaggaagttctggatggcgcgccgctcgggcgcggtcatcggcttgaccccggcgagcttgtcgacgaagaggcggtaccccttgtcggtggggatgcggccggcgctggtgtgcggctgggcgatgaacccctcgtcctccagggccgccatgtcgttgcggacggtggccggggagacgccgaggttgtgccgctccgtgagggccttggagccgaccggctcctcggtgccgacgtagtcctgaacgatggcgcgcagcacctgcagccttcgctcgctgagcatcgcgcacacctccagagtcgtccctcggttcccacctggcactcgtatgcgccgagtgccaggtgggaaccga

SEQ ID NO: 676 - DNA, 4760 bp, Unknown
  Kingdom: Bacteria, Phylum: Actinobacteria, Class: Actinobacteria, Order: Streptomycetales, Family: Streptomycetaceae, Genus: Streptomyces
gatcatgcccgtcacctcacctctgcgcgcctggctggcgcagcgtccgcccgcggccggggccgccgtgatggccagcggcatcgtgtcgatcgggctgcagctgacgggctacgaggtgctgtccctcgcgcgcgaacgggcgcgctggacggccgaggcggggacgccggccgcgctcaccggggtcgccgcgacggctgtgctgggcacgcgcttctcgagcctggggtggcagctgctcgccgaggtgctgctcgcgctggccgtggtgctgtggccgtggctgctcgtgcgggtcgtccggaactcgcagcggcccatgccgggcgccgtgttcctgtgctgcgtggccacggagggactcgccgtgctcggcgcgtcggtggcccgggccgaggccacggcctggctcgcgcacacggcactcgtcttcttctggctgggcctggcgctctatctcttcgcactgtcccgcttcgacctgcgtcaggtggtcgagggacatggcgaccactgggtcgcgggcggtgcgctggcgatctccgcggtcgccggagcgaagctgatcgccgccgaaggcgcggggcgccatctgtggaactacgacgatcacggcgtcctgcacaccgtcacgctcgggctgctggtgctcgatctcgcctggtacgccgtcctgctcgtggcggagctggtacggccgcggctgcgctacgacgtgcgccgctggtcgaccgtcttccccctgggcatgacggccgcggcggcgctctcggtcgccgccgccctgcacgtccccgagttcaagcggcccggcgaggtgctggtgtgggtcgcggtggcggcgtggctggccgtcgcggcgggggcggtcgcggaggcgcgcgcggaactcaggggcgccacgcgctgatcctcacgcccccgggggagcgctcagggggggagtgctcaggtccacagcaccgcgatgaagatgttcaccatggtcagcaggcccaccagcccgaacatgcccttgtccaccttctcgtcgtcgcgcttgacgtagacgaggccgaggatcacgattagcagcgccagtttcacgccgatcttgacggtgttgacgtggtggtcttcggcctggttgaggccgaccaggacgatgccggtgaccagcatggtcagcgcgccgtgcagcatgccgggcacgaagcgggccgtgccccggcccatcgccttcatctgggtgaggaagccgccgagcagcgcggcgatcccgatgatgtgcaggccgacgaagagatggatgagtacgtccatgagccggagcctaaccagagcccaccgaccccccggacaccggcccgaccactggccaccggacaccggcccgaccgctgaccaccggctcaccggacaacagcccgtccactgaccaccggcccatcggacaacagcccgtccactgaccaccggcccatcggacaccggcccgaccgccggcgcccccggtcaccggcctgtccaccggccgccggcgccctgtacacgggcccggcaaccggccgtcccggaccggtcaccggccagcccaccggccgtcccggacaccaggccgtcaccggccaccggccgcccggcacgcagagcgcccaccggcggccgaccgccctgagcaccgcccgtccgcccggcgcctccgcccggctccacgggtcgcatatatgcgatccatagcagctgtccgtccccgctgccccggaaccggcacatcggtcatcgctctccgtgaagacgccgccgtcgggcggcccgcacggtcacttccggtcaccggccgatccggtcgcggcagttccgtacaaccggtcacttctgcggcacggcgcgtcctagcgtccttccccaggtgaccggctccccaccgccgcccgggccaggggcggcagccgggcaccaccgccaaggagtccggcggcggaccgttcccctgtgcgggctgccgccggacgcgcagcgcccgcccccgtggccggccggacgaagggacgtgacggtccacgtggcctcgcaccgcaagccccgacaacgctcactcagcggcagcacagcccgtacggccctcacgctcgtcctcgcgggcgccgcgacggccacggtcttcgacggcacgggacacgccgccccgcagccgacgccggagcaggtcagggcccgggtggaccggctgtaccaggaggcggaggccgccaccgagaagtacgacggcgcccaggagaaggcggacgcggccgggaagcggctgcggaccctgggcgacgaggcggcccgtggacaggccaggctcaacgccgcgcgcgatgccctgggctcgatcgccgcggcgcagtaccgggacggcgggatcgaccccaccgtccagttcctgctctccgacgacccccagcactatctcgagggcgccgcactggccgagcgggcgggcgtccgccagaccgcggccgtggccggggtacgccgggagctgagggcgctcgaccaggtgcgcggggcggcgcgcaccgagctcgcctcgctccgctcgcgtcaggcggaactgcgccggcagaagaagacgatcaccaccaaactggacgaggccaggcagctgctctcccggctcaccccgcggcagcgcgtggcgatcggcgaggacggaagcacggggcgggcgtcccggtccgcggccggggcacgggtggcgctcggcgccccgtgccccggcggctgccctcacctcccgtgccgcggcggccgtcgcctacgcctaccagaagctcggcagcccctatgtgtggggcgcgagcgggcccgacgccttcgactgctccggcctggtccaggctgcctaccgctccgccggtgtctcgctcccccgcaccacctacgcccagatcggcgccggccgccgggtctcccgctccgaactgcgccccggtgacctggtgttcttctactccggggtcagccacgtcggtatctacgtgggcaacgggcagatgatccacgccccgaacccctcggcaccggtccgactggccccgatcgacgagatgccgttcgccggagcgacccgggtggcgtgactgcggtcggcggcagacggtcgccggcggccgtcctcccggtcgcggccggtctgtcagaccaggcggcgtgccgtggcccagcgggtcagctcgtgacggttggacagctgcagtttgcgcagcaccgccgacacgtgggactccaccgtcttcacggagatgaagagctgcttggcgatctccttgtaggcgtaaccgcgggcgatgagcctcagcacctcacgctcacgctgggtgaggcggtccaggtcctcgtcgaccggcggggcgtcggtggaggcgaacgcgtccaggacgaacccggccagccgtggggagaagacggcgtcgccctcctgcacccggaagatcgagtcgatgaggtcggagccggtgatcgtcttcgtcacgtatccccgggccccgccacggatcacgccgatcacgtcctccgccgcgtccgacacggacagcgcgaggaagcggacgggccgctcggtgtcggccatcagcgcggcacagcggcggagcacctcgaccccgccgccaccggggaggtggacgtcgaggaggaccacctcggggcgggtctcggtgatgaccgcgaccgcctggtcgacgtccggggcctcgccgacgacctcgacaccggtctcgtcggttcgcccgatctcggcctggacccccgtacggaacatacggtggtcgtccacgaggaccacgcgcacgcgccgcccgctggtgccgcccgccgcctcggtcgcctccgccgtgtccgctgccgccgtgccgttcgcctcggtcgggtcgctcatcacgtgttctccgccctctccatctccagctcgacctccgtgccgccgtccggcaccgcgcgcagccgggccgttcccccgttgcgctccatgcggccgatgatcgattctctgacacccatgcgatcggtgggtatcgcgtcgagatcgaacccgggcccccggtcgcggacggacacgaagaccgtcctgccctcgacttcggcgtacacctgcacggcgccgccctcgccaccgtacttggcggcgttcaccatggcttccctcgcggcctgcatctgggcgctgacgcgttcgtcgagcgggcagtcgccgaccacgaccacctctatgggcacgccgtgcttgtcctccacctcggcggcgttgcgccgcacggcttcggccagggtcgccggctcgtcgtcctcgtccttgccgttgccctccggcttgtagagccaggcgcgcaggtcgcgctcctgggcgcgggcgagccggcgcacctcgcccgcgttctccgcgttgcgctggatcagggtcagggtgtgcagcaccgagtcgtggacgtgggcggcgacctcggcacgctcctgcgcacggatgcgcatcagccgctcctcggagaggtcctgggtcatccgcacgaggtacggcccggcgagcagcgttatgccgacgaggacggcgagaccggcctggaggacggagccgaggtgagcggcggatccctgcaggacgaagatggcggagacgcccgcggtgaccagcaggacgcccgcaccggcgcgcagcagcgtgagcgtacggcgacggcggccgacctcgacccagcgggcccgccgcgcgttgtccgcctggcgccagaccaggg

SEQ ID NO: 677 - DNA, 1777 bp, Unknown
  Kingdom: Bacteria, Phylum: Actinobacteria, Class: Actinobacteria, Order: Streptomycetales, Family: Streptomycetaceae, Genus: Streptomyces
cacacgctctccacggcggcgagggcggcccgcacgccggccacgtcggcccgcgggtcgagcgccagcagccgggcctcgtcgagatgggtgcgggcgccgacgtaggacttggcgcggcagtagacgagcaccccggcgttgatccgctcgccgcgctcgacccgcgggacgaccctcagcagggcgtactcgaagacgtcccggtcactcgtccggccgccgatgatgtggcgctcccctgcctgccggcccccgatgatgtggtggtcgcctgtctgccggcggccggtgaggtggtggtccccggcctgcgggccgccgatggcgcggtcgtccccgggctgccgaccggtgatgtcgtggtcgctcacttggccgctccctggatgccgtggacgcgctcgtggatcacggcggcccgcgcgagcagcggccgtgcgtaggcgcggcgcagttcgtcgggcgtgccgaagccgggctccccggtcagccaggcgtccgggatctcggcggtcacctcggccagcaggtcctcggtgacgagcggggcgagccgggctgcggcggccgcgaggtccgggccgaacggtgcgagcgcgtggtcggaggcgtcgtacggacgggcggcggaggcctcggcgcccggccagttgtggtgccagatcatggtcgcgccgtggtcgatgagccacagctcgccgcgccacctgagcaggttcgggttgcgccaggagcggtccacgttgttcacgagcgcgtcgaaccagacgatgcggcccgcctcctcggcgtccaccgggaaggccagcgggtcgaaccccagggcaccggagaggaagtccatcccgaagttggtgccaccgctggagcgcagcagttcctggacccgctcgtcgggttcgccgagtccgaggaccgggtcgaggccgatggtcaccagcgcgggcacacggaaccccagccgccgggccagttcaccgcacacgacctcggcgacgagcgtcttgcggccctgcccggcgccgctgaacttcaggacgtacgtcccgaagtcgtcggcctcgacgagtcccggcagggagccgccctcccgcaggggtgtgatgaagcgggtcgcgttgacttccttgagcatcgccccaggttactggggctccgtaaggctcctgacgcgatctgaacgcccggcgccggacggacgtaaccctgtgcgtaggccagtcgcgaagtccgcgtgaagggaaacgcccgtatgaccagcgcatcgattcatccccagcagggaccggcccgccgtacggtcgtggcggcactgggcgcgacggggatcgccgccgccacgctgaccgcctgcgggtcggacgacaagtcggcatcgggggcatccggttctgacggcaagccgtcgtcgggcgcggccggctcaggcgacaagtcggcatcgggggcggggctcgccaggatctccgacatcccggagggcggcgggaagatcttcgccgaccggggtgtcgtcgtcacccagcccgagaagggccggttcgaggcgttctcctcgacctgcacccaccagggctgcacggtgaccgggatcgccgacggcgtgatcagctgcccctgccaccacagcgagttctccgtggccgacgggagcgtcaggaggggccccgcgacccggcccctgcccgcccggaagatcgccgtgcgcggggacgagatcgaactggcctgaggacacgggcccgccctccggacgggcgggccgggctgggct

SEQ ID NO: 678 - DNA, 9128 bp, Unknown
  Kingdom: Bacteria, Phylum: Actinobacteria, Class: Actinobacteria, Order: Streptomycetales, Family: Streptomycetaceae, Genus: Streptomyces
ggcgagtgtgccgcgggccggggcgatctggccttgctcggtgtggaggacgcgcacgggcgcggacggacacagctatggctgaccaacatgaccggtgtcctcgaaggcggcagcgtcgggagtgcgatgttcggcggagggcggggcctggacgcccagcgagccgaccggtcagccgccgccgaattcaggggcgccgagggtgtagaggagcacggcgaccgaggccagggtgaacgcgatcagcgccaggcgctgccaggtgagggtgtgggacatggctggttcctttctccagcggcgttggctgggtggtgcatggcggctgcgacgagcagggccgcagcgatcgccaggagcacgtcgccgatgctgacgacggcgtgcagaggcggaaaggggatgatgtcgcccagggccagcagacgggtaccgtgcccggctggcatgttcctggcagtctgggacccggcgcgcagcccagcgacggccgccgcggaggggctgtagggcatccggccgttgacggcgatcggcacagcgttgagaacggcgcccgtgagtgccagtcccacccccgtcttcaacggccacgtcctgcctcgtgcgttggcgaccagccagaggagggcaagggcgatggccagcccaagcagcggtgtcctgagacggcgtccggcagcgccgggaaggccgacggtagccagttgcaggacctgcacggcggccgcgatccacagcagccacagccatcgcagccgcacgcccggcagcctgctcagccgaccaccgctgagataccccgcagccgttccgacggcaaccggtccgccgaacaggatcagcgcggtgacgcccatggctccaccccgcagctgacgcgcccccgcacgctcattccccacctcactgcgatctagcgccgcaggatccaagtggcctgcgcccacgggccctcaccacgtctcggcgagaccgttgacggatcgttgcagagcgggagtgcgggccgcaagcacccgggaccgactatccggcttcccggacagaactggcctggacgcgaggcggtttgagagacggtggccatgccggtgctcgcgctgcacgcggtggcggtagttcgtcaaacccgacagcggtagagatcttgccgtgtccggtggtgacctgggtgcggttcctctgaagcgaatggctgagctgaaggaaccctgagcggggcggacggattcgtacgggaaacgggactgcacacggcaaccctgagtagcctggtctcgccgcttcgcagcaacgctggaccaagcggcagccaacaggggaacgcctggacagacgtccatgcgtgaacggggaggagacgtcatgcgcgaagtcaccagacgggccgtacaaggtgccgtcgccgccgccctcgcgttcggcggtgtggccgcggcgaccggcccggccgccgcgttcggcaactccgccggctggtcatggccacacgactaccagatcggcgggaacaacaacaccggccgctgcgtggacgactcgatcgactcaaacgccatcagcggcaacctgctgcggggctacccctgcaacggctacagctggcagaaatggcgcgtgatcgatatatcgggcgccgaaaactacgccgtgctcaagaatgaggccaccgggctgtgtctggacgactccaacggtgggtcgaacggcgcggacctgctgcgcggctatccctgcaacggttacggctggcagaagtggagggtcgtcagccggatcaccggtacccaccccgcctacttccagcaggtgctccagaatgccgccaccggccgctgcctggacgactccgacgccggtcgcggcggctcggacctgctgcgcggctacccctgcaatgggccctcgcaggacggtgggtggcagggttgggacctctacatggtcgactgaccagccccgaacatgaaccgctccaggtctgatggaggctcgttccctgaggggaacgagtcatggcacgtccgtcgccttgccctcccgagcttcatgcgcgtgcggtgcgcatggtcgcggagatccgcccggactacccgaccgagtgggccgcgatggaggcggtcgcggccaagctgggcatcggcgccacagagacggtgcggacctgggtccgcaagaccgaggtggccgccgtcctgcggaccggagtcacgtgggaagaggccgcggagatcaagcgactcaaggccgagaacgccgggctgcggcgggcggacgagatcctcgaggcagcgtcggctttcttcgcggccgagctcgaccggccgtcgaaacgctcgtagcgttcatcgacgcacaccgccaggtgttcggggtcgagccgatctgccgtgtcccgacccgccacggactgaagatcgcgacgagcgcacctcctacgccgccaagaaccgcaccgccagcaaccggccggtccgcgccggggagctgaagacgcagatcagccgcgtccacgccgacaattccagcgtctacggggtccggaaagtctggcggcagctgcaccgcgagggcataccagtggcccgctgcaccgttgcccggctgatgcgcgacctcggcctcgaaggcgcccgtgccgccgcctcgcctgacgggcacgctgagcagccccggaggttcctccgccagccagccccgcgcggccagtcgcttggccttcgaccgcgccccttccgccttcgccgggaccggctccggccccaccgcggccgcgagtcgacgacagttcatggcctccccgtgcaccccgttcccgccgaccaggtcgcccgctgggaagcgttcggtcaacaccatgctcgcgacggttgggcgacgacaaaagcacgggcggccgcccctgaccgcgggcgtgggtcagggctcctgggccgggaggcggacgaccagccgggcgccggggtggttgtcctcgatcagggtgcggccgtggtggatcttgacgacgtcgcggacgatggcgaggccgaggccgctgccgccggtgtcccgggatcgcgcgtcgtccagacgggtgaagcgttcgaaggcgcgttcccggtcggcggccgggatgccggggccgtcgtcggtgacgaccaggcgggcggtgccgtcctcggtgtgcaggctgaccgtgaccctgctgcgggcgtggcgtacggcgttgtcgaggaggtttcgcacgacgcgggcgagggcgtccgcgtcgcccggtacgcgtgccgcgccgacggcgtgctggtcgatcgggagctgtgtgcgccggcgggcctcgcgcacctcggtgaagacgatctcgtccaggtcgacggggcgtgtccgaatccgagggcgctcatcgagccgcgccagctggaggaggtcgtcgacgagttgggtgaggcgttcgctgtcgcgcaggagggatgcggcgagggaccgtgtctccagtgagcgggagtgccgggcggccacgtcgagacgggtgcgcagggcgctgaggggactgcgtagttcgtgggcggcgtccgcgatgaagcgtcgctgccgccgggtcgccgtgtcaaggcgttccagcaggtcgttcagtgtgagggcgagtctggcgagggcgtccgtggtgggcggcacgtcgagtcggcggccgaggtcggaggtggtgatctcggcagtctgggcgcgcagcgcctccacaggacgcagcgcgcggccggtgagctgccacaccaccgccgtgaccagggcgacgacggccggtgttccggcagccaggccggtagcgagccgggccactccccggtcgacgctgtcggtcggtacggcgacgtacaccgtcgcgggattcccggccgaaccggcggggacaccgacggcccgccaggatccgttctcgcccacagggacgtcatgaacggtgtgcgcccggggggtgctggaccggctcggagggaagaagaacgcccgcggccggccgcgcaggtttcccgagctggcgatcacggtgccgctgcggccgacgacctgtacggcggcctctccatggccggctgccggtatctccgcaccggcctgggtggtgtcgacgtctgccccgacgacctcggcgcgctgcagggcactggtgtccagaccctggatcagactggcgtgcagccagacgacgaggaggacggcggccgaggccaggccgacggcgatgaccagggctgcggcggcggtcagccgcaaccgcagcgacctgcgagcccaccaggaccgggcgccggcgctcaccggtcaccccgcggcgctgcgcagccggtatccggcgccgcggacggtctcgatggtgctgcagccgaacggggcgtcgatcttgcgtctgagatagccgacgtacacctcgacgatgttggtgtcgccgtcgaagtgctcgtcccacacgtgagtgaggatgtctgtcttgctgaccacttcgtcggtgtgccttgtgaggtactccaggagggcgaactcgcgggcggtcagctctatgtcccgctctccgcgtcggcagcggtggccggcggggtccacgctgaggtcgccggctcggagcaccgcgggccgggcaggtgccccgcggcgtagcagtgccctgaggtgggcgacgaggacgacgtacgagaagggcttgctcagatagtcgtcggctccgaggtcgagggcgtctgcctcgtcgtactcaccgttcttcgcggtgagcatcagcaccggcgtccagaccctggcgccgcgcagccgcttgaggacgtcgtagccggacagaccgggcagcatgatgtcgagcacgatcacgtcgtacggatcgtgcagcgcccgccacaggccgtccggcccgtcgtgggcgacgcgcgtgacgaagccctccgcggcgagtccctcggcgatcgccgcggcgagtccgcgctcgtcctcgatgatcagtgtccgcatggcagcccctggtctcccttccaccctagccctggacgccgacggccatcggctgagaaggagctgagaacgggggcctgtctcagcctcctctcagcgcccggatcggaggctggagtcctcagcaaggcacaggggaagcgaagaggaggacgacgatgagcgacctcagggaggagcgccggggcccgggcgaggacacctcgcggcgctcgcggcagcaggagcgccacggtcggcgtgaggccgagcggcgcgacgaccggcggcgcgacgaccggcggcgcgacgaggaacgccgggagacggaagacgagcggcgtgagcgttcggttcgctccgcgttcgtgttggaacggcccttcggataagggcggcacggcggcagagggagagcccgcacggctgacggcaccggtggacggtgccgtcagccgtgccggacggcgatcgccgcggctcgcgtcgggtcgacgctgacatcggtgatggtccagcccgcgggctgcgcggccgggccgacgcccgtgccgacgtagtcggtggacagtccccgggccaggccggtgccgagccccttgaaccaggcttccttgcgcacccaggcccgggtgaacgccaggggccgcttgtcctcgggcaggcggtcgagttcggtccgttcctgggggtggagggtggtggcgagggaggcgacggcctccgggagcgggaggcgttcgagatcgacgccgacgggggtgcgggcgagcgcgatcaggcagaggtcctggctgtaggcgagggagaagtgaggcgtgccgtccgcgagcgcgggtcggccgtgcagggcgccgcacactgggcacgactgccggatgagagccacctgcagcggtgcgacaccggtttcggcggagaggagcagccggaggacggcgtgcgcggcgacgtaccggaaccggtcctgcggtcgggagaaggcgcgggcacgccgtcgttccgcgcgggtcagggccaggggcaccgggtcgggctgccaggtgccggatgcggtgcgtacgagatacagacgggggccgggggctgccatgggctcactcccgccacatcgattccaccaggtcgcgggccaagtccagagtgtgctgcacgggaaggccgtggtcggcgtaccagtcgtgggtggcttccgggtgcggcccggtgacggccacccggcccgccctgaaacgggccacgagggcggcgggggcgccgttgtcgtagcgggcaaggatccgcgcgtcggcgtcggcgtcgacgaggaagacggggccgtcctggaaatacacactgcgcggcgacccccgccaggtcacctggaccaccgtggagctctcgtcgtggaccgtcgccccggcggtggcgatgtactgatcggtgtcaccgggcaggagatcgaagcccggtgtggctccggcaaggtaaccgcccaggcagaagcccaggtagcggccgccgccgcggacgaacgcgcggatggcgcggcgctgtcggcgcaggatgcggtaggcggagtcgagtgtgccgccgccgggctgggcgtacagcacggcacgggacagcgacacggccgagagcgggagagcctcgtggggcccggtgtagcggacgtccaggtcccagggcccggaggccaggaggtccgcgaccgcctccgggcagccgggcagggcggccggcccgcggtagacgagggccagcgggcggcgtgccccgggtgggcccgtcatcgccggcacctcccggccggttccccctccggcaccgtcggcccggggcagcccccggccggcagaccctgccagtccgtgcccgcgggcaggtgctcgcccttcatgaccagggacagcgcgccgagccggacccgggcgccgaccacggcgtcgtacagaaccaccgtgcgctggccgacgctggcgccggggcccacggtcaccgtcgacatcttcatcacccggtcctcgaagaggtgtgtctgcagggagacgcgcatgtctatcgcggcgtcgtcgcccacctccaccaggtcgaactccgtcaggtacgtggtgccgatccaggtacgccggcctatgcgggcaccgaacaggcgcagtacggtcggcaggaacggggtccccaccaggaagccgacgcctgcgggcaccgctgcggcctcgaacaggccggtgacgaactcggtccggcggacgaacaggctccacagaggttcgacacgcggccggtaccgtccggcgaccgcccacttggccagcgcgcagcacccgacgacggcagccatggcgcccatggcgagcagcggtgacaccagcagcgtgaccaccggttcgccgcggcggcccaggtgagacagcgccagcaggtacccgaagccgccgacggcgagcagcgtcgggggcagggtgacgcggaagaactccacggccaggcggccgagtacggccccgcgggtcggccggaacgtcagatgctcgggatagcgtccgctgtcctggcgcacgggaagccgtagcgcgggcgagcccagccaggtgctgccggccggcacctgaccggcggggggcacggtgccgacaccgaccaggcagcccgggctgagccgggtaccggcgggcacgagtgccgcgttcccgacgaaggcgcgctcgcccacctcggcaggcgcgaccgccatgcgatcggcggcgaaggcggcgacgccgacaccggccatgtcggcgacgaagctgccgtcacgaagtgtgagcaggtcgggatcgatgtgcgccacggtggacacctcggcgccgcgaccgacccgtgctccgagcagccgcagccagggagcggtgtagagggtggcgtacagcgagttggtcagggtcaggctctcctccagcagcttgtccgcgacccacttgcgcacgccgagccccgaccgtacgggatggacgcctaccggtgtccggcgcagcaccgcccgcttgcccgcgccgacgatcaggcacaccgtggccacgaagacgggcccgaacagcgcggccagggcgggttcgccgcgccgccaaccccaccagcacagggcgacgcccggcgccgccgcgacgacgggcaccgcttccagcagggccaggccgagcagggtggcgcccacgtgccctggccgtcggcggtccgtcgagtccgtggcgttcaggagtgactcggcgagcggcgagagtgtctcgacgggccgggcgggcgatccggcgcggcggccccccaccggtgtcgtctcgcccgggcctgccagggactgctcgccgagcgcggcgccggggcccagttcggcaccgggggcgcagacggcgttggcgccgacgtacgcccgcgccccgatggtgatcggagcgatcgtgacccatccgtcggcgacctgccaggggcgcagggtggctccgtagccgatcgccgcgtcactgccgatacccagcagcgtcggcaggccgatcacgctggtggcgatggtggtgcgcgggccgacccgtgcccccaggagtcgcaggtacgggcccatcagcgcggatccgctgagcacccgtagcgggctcacgccgagcagcagcacgtcgagcatccacaggcgcaggtaggtggctccccacagcgggtaccggccgggtcggatcccggcggccagtggccgggccagcaggacgggagcgatccagcgtacggctgcgtagccggccagtaccgcgagtgcccggacggtgccggtggccggcagccagctgtggtgaaccgcgtacgagagagccagtggcgccgtgagcagcagcaggagggagtacagcgccgttgcctggatcagacccgctcgcgcgatccgcgcagggccgtgcctgagcggtggcacgcgagggcactgcgccacccggccgtctccgtcgccccgctgtgcgtacaggcgggccgtaaaggtccggacggtggggttctcgtacaggtcgcgcagcgtcgggccgctgccgtggtcctcttcccgcaggagcgacacggcgcgggccgcgagcagggagtggccaccgaggtcggtgaagaagtcggcctcggccgacacctccgcgggagggacaccgagcgcgcgggcccaggcgtcc

SEQ ID NO: 679 - DNA, 1834 bp, Unknown
  Kingdom: Bacteria, Phylum: Actinobacteria, Class: Actinobacteria, Order: Streptomycetales, Family: Streptomycetaceae, Genus: Streptomyces
acctgaccccggcctcgccgtctcccgtcactccgacggcgggtcccggcgcgcggcccggcccgtgtgccgtgaatgctggcgtgggggagatgaccgccgtccgagggtgcccgccgagcgggtggttcccgaagacctggccgccggaagggcgggtcgccaatgaggcttgtcgtcgatctcaacaagtgccagggctatgcccagtgcgccttcctcgcgccggacgtgttcaccatgcatggcgaggagtcgctcgtgtacagcccgtgggccgacggcgaccagcgggagaagctggcccgcgccgtcgcggcctgcccggtgcaggcgatcaccgcggacggcctgcacgagagcgacgctcactccgccacggccggacaggagacgtccgatgcccactgagcagttccacgagtggctgcgccgcgagggccgcatcgtcgtcgtgggtgcctcactggccggcctgcgggccgccgagaccctgcgcgcggagggcttcgccggatcgctgaccatgatcggcgacgagccgtaccagccttacgaccggccgccgctgtccaaggcggtcctgctcggcaaggcggcgccggaccgcacggacctgccccggcgcctggacatcgacgcgacgtggcgtctgggcgtggccgcgaccggtctcgacctcgcggaccggcgggtcctgctcgcggacggcgacgaagtgccctacgaccggttgctgatcgcgaccggagtgcgcgcccggccctggccgaaggaggaggaggcccagctcgacggggtcttcgtgctgcgtacccgggacgacgcggtccggctgcaccggcggctgaagggagcgccgcaccgggtcttcgtgatcggtgccgggttcaccggctccgagatcgcctccgcctgccgtgaccagggcatcgccgtcaccgtggccgagcgcgcggacgctccgctggtgggcgccctcggcggcgtggtcggtgcggtcgccgcggaactgcaccacgacagcggggtcgatctgcgcaccggtgtcatggtcaccgggctcgagggcaactcggtcggccgggtgcgggccgcccacctgtccgacggcagcgtcgtcgagacggacgtcgtggtggtgtgcctgggcgcgacccgcaacaccgactggctgaccggctccgggctcggcgcggggccgcggggcatcgcctgcgacgcgggctgccgggcgttcgacttccgcggcatcgtcaccgacgacgtgtacgtggccggtgacgtggcccgctccccgcacccgttgttcggctaccagttcctgtcgctggagcactggggcaacgccgtggcgcaggccgaggtggccgcgcacaacatgatcagcgccagttccgaccggcgtccgcacatgtgggtgccggccttctggtcgtcgcagttcggcgtgaacatcaagtccgtgggcgtgccgtccatgggcgaggagatcatgatcacgcagggctcgctcgccgagcgccgcttcgtcggggtctacggctaccagggccgggtcatcgcggccgtgagcttcgacaacacgcggtggctggagttctacgaacggcagatcgagatgggcgcgccgttcccggtggagtacccgacggtggaccgccggcccgagggccgcaaggcgatcccggccgacttccccgacccgtccctgccgacgcacggcccgacggtgaccctcagcggatactcaccggccgaccggcgcatggtcttcaccccggcccgccactgaccaccgcggcgcccggccggcgcccgcccctcccccacc

SEQ ID NO: 680 - DNA, 2597 bp, Unknown
  Kingdom: Bacteria, Phylum: Actinobacteria, Class: Actinobacteria, Order: Streptomycetales, Family: Streptomycetaceae, Genus: Streptomyces
gtgctcggcccgtcggcgggtgccccgccggactcctcgctcccggccgcgccccccgccgccgtcacagtcccgccgatcgggcctcgcccagctccgtgagccggtcgcgcagccgttccgcctcggccgggtcgaggccggggatggtcgcgtcggtggcggcggcggccgtgtgcagttgcacggtggccagtccgaaatgccgttcgacgggtccggaggtgacctcgaccagctgcatccgcccgtacggcacgacggtctcctcgcgccacagcacgccccggctgatcagcaggtcgtcggcgcgctcggcgtagcgccaggagcgccagttgcgcccgagcagcacccagccccaggccatcagcgcgagcggcagcaccgcgaacgccgaccacgccggaccggccagggcgccgggtaccagccccgcggccacggcggccgcgcccagccacaccaccagcagcagccggcgcatccgcagcaggcccggcggcagcgcggtccacaccgtctcgcccccggccgcccgctcgccctccaggctccccgtctccatggggcaagcgtacgtaggggagactgggtccatgactcccacgacggagaccatggtcgggatcggcggtgccgcggagagcaccgacatggtgctcaacatcgggccccagcacccgtccacgcacggtgtgctgcggttgaagctgctgctggacggcgagcgcatcacgcgcgcggagccggtgatcggctacatgcaccgcggcgcggagaagctgttcgaggcgcgggactaccggcagatcatcatgctggccaaccgtcacgactggctgtcggcgttctcgaacgagctgggcgtggtcctcgcggtggagcggatgctcggcatggaggtccctccgcgcgcggtgtggacgcgcacgctgctcgcggagctgaaccgggtgctgaaccacctgatgttcctcggctcctacccgctggagctgggcggcatcacgccggtcttctacgcgttccgggagcgcgaggtcctgcagaacgtcatggaggaggtctccggtggccggatgcactacatgttcaaccgggtcgggggactgaaggaggacctgccggccgggtggtccacgcgcgcgcgtgccgccgtggccgccgtgcgctcgcgcatgggcgtcttcgacgacctggtgctcggcaacgagatcttccgggggcgcacgcggggtgtgggcacgctgacgccgcaggccgtgcacgcctacggagtgagcgggccgatcgcgcgcgcctcgggcgtcgacttcgacctgcggcgcgacgagccgtacctggcgtacggggagctggcggacgtcctgaaggtggtcacccggcaggagggcgactgcctggcccgcttcgagtgcctcctggaccagacccacaacgccctcgacctcgccgacgcctgcctggaccggctggcggagctggagccggggccggtcaaccagcggcttccgaaggtcctcaaggcgcccgagggccacacctacgcgtggaccgagaacccgctcggcatcaacggctactacctggtcagcaagggcgagaagaccccgtaccggctgaagctgcgctcggcgtcgtacaacaacatccaggcgctcaccgaactgctgccgggcacgctggtggccgacatggtggcgatcctggggtcaatgttcttcgtggtcggggacatcgacaagtagggccgtcgcgtccgcttccgggacacccaccggctgcaggagccagccgaagtcgccgagaccgcccggcgcggtgagttccgcggcctcgccggcgctcgcgagggcgcgcacgtactcggcggggcgcgtggaggcgagggcgagcggggggcgtgcgccggtgatgccgagggcgcgcagcgcagcgcgctgggtgagcaggcgcgcgggcgggagggcgcgtgcaccggcggatgcgcccggcgcacgcgactgcgaaggttccggcgcacgcgacggcgagggttccggcgcagacggctccgaggcagtgtgcgcggcgcacgcgtccagggcgacgtgtgccgtgatgtcgcaggaaccgtccggcacgggcggtgtctcccgtccgtcccggaaccccgtgagggtgccgaagagcggccgggcgcccgcgctgtgcgcgtagtccacggcgaccgccaggccccggtccaggcacgagaccgcagcggcccaggcggtgtcccggggcaggccgatctccgcgcgcaggccctcctcggcgggcagcggccaccaccgggccagccactcggcctccacgcccgccaccggctccccgagccgctgcgtcccgtcccgccgtacgagcacgcgccggggcacgcccgcggagtccacctccgccacctccaccggcacgttgtccagccactcgttggcgaacagcagcccggtgacctgccggggcggttcgctcagccactcgatccggtgatcgagcccggccggccggccggcgatctcgaccgcgtacacccgcgcgcgggaggccacccgcgcgggcagcgcggccagcac

SEQ ID NO: 681 - DNA, 2641 bp, Unknown
  Kingdom: Bacteria, Phylum: Actinobacteria, Class: Actinobacteria, Order: Streptomycetales, Family: Streptomycetaceae, Genus: Streptomyces
acggtgacgagcggggggcgctggccgagcccggagccgaagccctcgcccgccgagtctggcccacagccaggcgccccccgctcgtcaccgtgggcagtatccacgccggcaccggccccaacgtcatccccgacaacgccacaccatcgacctgcagaccgccagtgaggacatgagcgagatccccgaggcgttcggcgcgccgttcacctactggggcatcggcggcatcgacgccgaactgtacgccgaggccgccgagaagggcaccgtcacccaggacgtcccggtcaaccacagccccgcctttaccccgtcgtccaacccaccctggacaccggcgtcagcgccatgacagtggccgccctcgcctggctcggcaaccggcccgaacccggcactccggcaagccgtgactgagacgacgctaccgggcagcgcgtcggcgccgcggtgccggaacggggagggtggaaggccggctcgcgggctgggtcgtcagctctccgcccggggcagcgccttaggttcaggcgggagcggcgccttctgtgccagagcaaggtgggccgcgaccttctggaccagaccgtaggccagcgctgtgaccagaagtccgggctcggtcgagagcgcagtggtggcgagtacggaactgacgctcacgttgttcatgccgcaggcgagtgtcactgtggcggaggcctcgtgaggaagccgcaggaggcgtgcggtccggcggccgacgtagaacgccagcaggcacgccacgcaggcgctggtgactgccaggagcagcggcggcagagacgcgaggtggatcagcggaaaagccgtggaggcgttcacataggtcagtgtgagtacggcggccatcgcagcgaggggagccaggcccatggcccgcttctccaccagcggtgggctgagccgtctgcacagcaggcccgccgcgcagggcagcgtcaccgcgatggtcaggaggccgcgcgtgctgaccgtcgcggcctcgacgagggcgtcctggcgactccccagcagaccggtgctgttgagaacgtccagggtgagcggcagcgtcaccggactgagcagggcggagagcacgacgatcccgatcatggccgacccgtcggtgtctccccttctgatccagacggtggctcccgcggcgacaggggccgtggccacgagagcgagggctacggggacgaagtcggcgacgtgcgcggcgccggtcatcgccaggaccgtggcagcggtcggcacgagcacgaagggcgtgatcaggtgcgccgcgagtccgcagaggaggaccttggcctgtcccggaccggtggccggccgtcccggtgtcacctggtaggcggccgagaagaggatcgtcgagagcagcagggtcggcaggcccgtaggcgtgccggcgatgttcacagagggctcgcgcagtgctcgtccggcatctgggacgaagagggcagccgcgtaactcgcgagcgaggctcggccgaggcgagcgttgagccagccggcaaggcggggcaggacagacagctcgggtttcatggtgttccctgactgggggcagtgagcagtgaggcagtggccgcaactcgtcccgggtacgacggctgccgcgtccgcggggcattcgggaagatgaggcgcgcgggcgcgatgggtgacgggcagtcaggcgacagcccacgggaggaagcagcggtgctgtgagcgccacaaggagtgacttcgggtgagcctggtggtggcgccgttgtgtgcgggcggcggccccgaggcaggccgccttcagtacctcaggaaaccggcgctctacacctgcagccggtcgtgccgggctgctggacggtcctggtcagacgcggaccgtgcaggtgctgtgcgggtcggtcttgacggcgagccggcatccgcggtccccgacggggttgtggtccggggatgcggccgggaaggctgctgcttgcccaggcgttcgggcgcgggcgtctccgcaacggcgtgggtgtctcgggaacacgaaggagagggggcctgggcctgcctcggtgccgtatccgcgccgaaggccgctgaggcggaagtcctctgaccggactgcggagccgtgcccacgagatggcgcatcgtcggacagcccccgatcgcggcgagcaggacagcgcacacgaggaacaaggtccaccgtgccctcgtccgacgctgtcgcaccgttcctgcccttccgtcttgatcgcccttttgacgctacaggtgcgggccgaagccgcatgtgtggcgccgccgatcggggaggcggcacggtccaccccaaggccgggcaccaaccgccgcgcgcctggacggggaccgggctcggcgcgcccggcccgcacggcctccacgaccgagtcggtgagagtgcgggcggcggcggatcgccgcgtcgaggtcgaggtcgtggtctacggagccggactcaacatcgtcctgcggggcgagctcggtgatgaggccacccgcctgccggccactggcgcgcgcgtcctcgcctgcgcgatctgctggtcacggtcggcggctggacggtgatcgggctgggactggcgcagatcctgggacttggattcggctcccg

SEQ ID NO: 682 - DNA, 2286 bp, Unknown
  Kingdom: Bacteria, Phylum: Actinobacteria, Class: Actinobacteria, Order: Streptomycetales, Family: Streptomycetaceae, Genus: Streptomyces
ggccggcaggccaccgccggtggcaggcccgcaccggaaccggcgcacggcgttccgatgcagccgcagcgcggcgccggctccatggcccgcgcggtggcgcactgagccgaccaccgagccgccgcagcggcggcagcagagccgcaacagcagcagaaacgtcacgcgacacgacgtgacggaacgacctacgcacgcgccgcaccaccgtccccaggcccggtccgggagccgcaggtccgagcggggtgacgggatcaccaggtcccgtcaccccgctcggccgttcaccgcggccccgaactggcaggcaggcaccgggtatcgcgccgcatatccggcgttttccagcggtaggaagcaccttggtggcagtctgctcagcagcagatacgcaaagtagaggcatgcagccggaggtgcgcgtcccgtggcgtccaatgtcaatcccaccgtcaggcggcgccggctgggccaggagctgcgcaggctccgcgagctcaagggcatgacggccgaggaggtggcggagcggctgctggtctcgcagtcgaagatcagccgcctggagaacggccggcgcagcatcagccagcgcgacgtccgtgacctgtgcggggtctacgaggtggaggaccaccgggtcgtcgattcgctgatgcagatggccaaggactcgcgccagcagggctggtggcattccttcggcgacatcccgtacagcgtgtacatcggtctggagacggacgcggcgagcctgcgggtgtacgacccccaggtggtccccggcctgctccagacccggcagtacgcggaggcgctgatcgccggcgcgctgcccgagacggcgcccgcggacatcgagaagcgcgtccaggtgcggatgcggcggcaggaacgaatctccgccaccgagaacccgttgcgcctgtggacggtcctcgacgaggccgcgctgcgccgggtcgtgggcaacggccgcctgatgcgagagcagttggagcacctggtcgagcagtcgcagcttccccacgtgacggtccaggtgatcccgttcgggatgggcgcgcatccagggctgaacggacagtacgccatcctggagttcccggacacggccgactccagcgtcgtctacatcgagggcgtcaccagcgacctgtacctggagaaggccaacgacgtgcagaagtacagcgtgatgtacgagcacctgcgggcgcaggcgctgaacgtggagcagtcgcgcgagttcatcgagaaggccgcgaaggactacgcgagctgagagcggggcaccgtacaccgagaaccggtagtggcggaagagtcgttggaatatgccatccggtcgagtgaagggccgcttcgcccaacgggcccggcgggtagcgtcgatcacgccaccgggaagcaccgttggcgcaaaccgcgctgtgggttccccgaacgcgtcgtgcggtgacagcaattccacccctcactcgcaatccggagcagaaatggcaattcgtcagggcgccacggcgacgtggaccaagtcctcgtactccacgggcaacggcgcgtgcgtcgaggtcaagtcaccggtcgtcgcgaccatggcggtccgggactccaaggtccacgagggcccggtgctcggcttccccgccgacgcgtggaactccttcgtggcgtcggtcaaggcctgagcggaggatccccccggccccccgcgacgccccgcaccacaaccgaagagcagcacagcaggcgcgagcagcagcacagcgagcgccgcacgcggagccccctcggccggttcaccgtccatgccgagggggctccgccgtgccgtcctccagtccgccgcccaaccctctacgcgccttcagtacggtctacgcgtcgcacgccttcttgatcacgtgctgagcggcctgccaggcgcgggcgacgacgcgaccgacgaacgccccctgcgtcaaccgcccctggggtaccgggccagccagcccggcgccgagccggcggggccgtgcagcgccgggccctgggtcatctccatcgcgaagtcgtccgccaggaccagcagggtcgggcggccctccagctcggccagccaggccggcgggagggccgtctcgccgtgcagggcaccgagcagaccgccggtgagggccccggccgcgcccgaggggccgctctggttcaccgccaggcacagcccgtgccgtacgtcctcgccgacgagcgcgcagtacacagccaccgccaggacaccctccgcggccccctccc

SEQ ID NO: 683 - DNA, 1046 bp, Unknown
  Kingdom: Bacteria, Phylum: Actinobacteria, Class: Actinobacteria, Order: Streptomycetales, Family: Streptomycetaceae, Genus: Streptomyces
cgtcgggtcgtgcgccgtggtgcgtcggcctcgacggtctcgatgctcacctcggtcttcacgccgcccagcgtcgcggtgaccacggcgcacgacccgacgccgcggccggggccgctgcagcgccagtcggtgaggtagtggtcggtgaaccgctcgtggtgagccatgacatcgaggaactcgtagacttgctcgggcgtctgcggaacgtcggtcgacacggtgacggactccatgtgtcccacggtacccgcgggtcggcgccgcgggtacggacgcgacaggacagccggtacggctgcctgagcccaggtctgctcagtcaggactcaccttcctctctcccgtccgcgagtcctgcggtgccgcggtcccgcggcgccgtggcttccagccgggccgggggaccgccgccaagagcgcctgggtgtacgggtgttgcgggtcgctcagaagagtggaggtcgggccgcgttcgacgacccggccggcggccatgacgacggcggtgtcggtgatctggtggacgacggcgaggtcgtgggagatgaagacgtaactgatgccggtccgttcgcggatgtcggcgaggaggttgaggatctgggcctggatggacacgtccagtgccgcgaccgcctcgtccaggacgaggacccggggctcgacggcgagggcgcgggcgatggcgacgcgctggcgctggccgccggagagctggcggggcagcatggcggcgtggcgttcggtgagccccaccgattccaggagctggagggtgcgttcgtgccgctgggccgccgtggcggggaagtgcagggccaggctggtctcgatgacggtgccgatgcgctggagggggtccagggaggagtaggggtcctggaagacgatctggatctcccgtgcgcggcgccgtcgttcggccgagccggcgcgaccggtccggggccggccgcagacgctgatggtgccgccggtgggggtctccaggccgagcagcatgcgggcgacggtggtcttgcccgagccggactcgccga

SEQ ID NO: 684 - DNA, 2163 bp, Unknown
  Kingdom: Bacteria, Phylum: Actinobacteria, Class: Actinobacteria, Order: Streptomycetales, Family: Streptomycetaceae, Genus: Streptomyces
ccaccggcagggacttcttgcgctggcgcaggtcgctccaggtctgcttgccggtggcctccgggtcgccccagatgccgaggaggtcgtcgacggcctggaaggcgaggccgaggtggtggccgtacttctccaacgtgtcggcggtcttgtcgtcggcgccgccgagcaccgcgccgatggagctggcgcaggcgagcagggcgccggtcttgttgccctccatctccaggcactcggcgacgctgacgcggtcgcggtgctcgtaggagatgtcctgggcctggccgtcgatcagggcgcgggtggcggcggtgagccggcgggcggcgcggccggcctcgacggtgcccagctccagcagaacctcgcctgccagggcgaagagggcgtcgccgacgaggatggcctgggcggggccgtgcaccttccagacggtgtcgcggtggcggcgctgttcgtcgccgtccatgaggtcgtcgtgcagcagggagaagttgtgcacgagttcgacggcgaccgcgccgggcacgccggcctcgggggcggcgccggtgacctcggcggagagcaccgcgagggcgggacgcacggccttgccgccgtcgccgtccgcagggttgccggcggcgtcgatccagccgaagtggtaggcggcgacggtgtccatgggaggggccaggcggtcgacggcctcccgcaggaccggagtggccagggtccgtccgcgctccaacagcgcggtcacgtccaccgcggtctgccgagcggccgggggcacagtgggcacagtctctcctcttgtcgcggtaccggcgcggcccgcggcgggctgctggtggaccttcaccggatccctcctcgctgggcggcgccggtctgccccggttgtcggccggggcccctgggggtgtccccggggaaggtgcggtgggccgtctcctgcgcggcgaagagtcggctcgggcggggccggcccagggcgcgcagcgcggcgtcggccgcgctgacgccgctgcggaccgcgctctccatggtcgcgggccatccggtggcggtccacgctccggccaggtacagaccgggtgccttggtacgggcaccggggcgcagccggccgacgccgggagtgggggcgaacgtggccgtgcgctcccgggtcacgaagaagtccttcacctcggcgccgcgggtgcgcggcagcagccggcgcagctcgggcaggtagcgctcgcgcagcacggcgacgggggcgtcgatgtcgtcgtgggcgaccgactgggacagggccaggtactgcccctgcttcagtccggaggcgtcggtgcggtcgaagacccactgcacgggggtgccgagggcggcgacgaagggccgggcgaggaccttgcggtcgtagacgacgtgcacgttgaggatgggtgcggtgccgatgtcgagcagtcgttcgggtgcgtccagggcgccgggcggcagcaggccgtacgcctcgcgctggggtacggcgaggacgaccgtgtcggcccggagcgtctcgccgggaacctggacgctccatgcgccgttgtcatcggtggagacggaggtgacgcgtgtacggacctcggtacggacgcccgcggagtcgagcgccttgcgggcgaggcggtcgtgcagttcgcccagcgggacgcgggcccagccgatgtcggccgctcccgggtcggacagcagcccggtcttgaacaccatcgcggccagccccagtgaggcgtcggaggcgaccgcgttgagggtggcgacccccacgaggtcccacagtgcctcgacggcacgggcggactggccgtgcgcggccagccagctgccgaagtcctgggagtccagggcggggtcggccgggtccagtgccttgagggcgagcgcggcgcggcccacccgggcgcgctcggcgagcgagaggtgcgggtaggtggccaggctgcgcccgaggtgcaggggcacgggcagtgcgtcgcggcgcagtctgccgagccggcgtccctcgggtctggcggcgtccaggacgggcacgtcgagccggtcctgcagcggggcgagggcggcgcccccgatgcggtcgaggaaccagcggtaggcggtgcagcagcgcaggtagacgtgctggccgttgtcgacggtgag

SEQ ID NO: 685 - DNA, 2156 bp, Unknown
  Kingdom: Bacteria, Phylum: Actinobacteria, Class: Actinobacteria, Order: Streptomycetales, Family: Streptomycetaceae, Genus: Streptomyces
gggggcaccggccgcggccggacggacaggtgggtgcgggctgcctgagccagtggtggccggcgccgtacaccgtggccggggtgacctacgcgaccgccgagcactggatgatggcgggcaaggcgcggctcttcggcgacgcggaggcggagcggcgggcgctggccgcggagcatccgtcgcaggcgaagaaggccgggcggctggtgcgcggtttcgacgaggcgatatgggcgcgcgagcgcttcgggatcgtggtggagggcagcgtccacaagttcgcatcccatccggctctgcgggagttcctgctgaccacgggtgaccgagtgctggtggaggcgtccccggtggaccgcgtgtggggcatcggcctggccgccgacgacgaggcggcgtcggacccggaccgctggcgcggcccgaacctgctgggcttcgcgctgatggaggcgcgggagcggttgcgggaggcggtgtgagcggtggcgtgggctgccgcgtgagcgacggtaccggcaaacacacgcaacccggtggcggttgacgcacagaaggggaaggctcacgcccatggtctcggtggtgcagaacgtggcgatcgactgtgcggatgcctacgggctcgcccggttctggagcagggtgaccggctgtccgctgcatccggacgacgggccgggcgcccgggagacccaggtgctcctggcggaggggccggtgctgtacttcaaccaggtgccggagaccaagacggtcaagaaccggatccatctgtgcctgcgccctgacacctcgcgcgatcaggaggtggaacggctgctgggtctcggtgccaccttcgtcgccgatcaccgccatcccgacggcaccggctgggcgatcctcgctgatcccgagggcaacgagttctgtgtgctgcgcggcgagtccgagcgggccgcggcgggcgcctgaggcgcggagacgggcctgggccgaccggtccggccggtggtcgggggccgtggcggggccggcccggtggtgcgggccggccggccgtgcggtgggcgccgtcagaacgtgctggcgctgcccatgatgctggcgaacaccgcgatgcccagcagcggcaggaccaccgtggcgacgatgccgcagaccaggccgcccgtcgcggcacccttgttggtggcctcaccgcggttggccttgccgcgcccgatggcgccgaagatgatcccgaggatgcccaggatgaccccgaagaaccacaggaagaaggtcaggctgcacacgacgccgatgatgcccagcaccagtcccgtggtccccatgccgttgctcggctgcacgggcatgccgtaaccgggggcctgcgggtagccgacgggcggcgcggccgggtaggcgggaccggactgcgggtagccgtagtcggggttggactgcgggtacccgtagcccggcgcgggctgctgcgggggctggggcggcggtccgaatccgtcgggcgcgggctgggtgttggacatggtgtggtttcccctccgttgacagtcaaggcatcgtaatgcccctgctgggcacggtggttgcctcggcctcagcgggtgatcggcgcggtctcagcggtcggcgaggaccgtcgcggacgggcgcgcggcgccgtcgtagtagtacgggtccgaggtgcgggactcgtggacggcggtcgtgatcaggaggacgaacacgacgatcatcgcgatgcccaggacgatcccgatgacgccggtgacgaaaccggcctgcgcctggccgcggttgtcggcctcgccgcgctcggccctgcggcggcccttgatgccgaagaccacggcgaggatgccgagcaccaccgacaccacgccgtagaggcagaacaggcagcaggacaggatgccgagcaccagggccgcgacgcccatgccgttgcgcggggcggggtgcatgccgggccagccgtaggccgggtagccggcgtagccgggctgaccggggtagccggggccgcccgggtagccgtagccgccgggatcggcggggaagcctgggccggtgggcgcgacgggcggcggcggcacggcgaagtcaccggcggggcgggcgtccgccgggatgccggcgccgggcggcgggaagccgggagc

SEQ ID NO: 686 - DNA, 2023 bp, Unknown
  Kingdom: Bacteria, Phylum: Actinobacteria, Class: Actinobacteria, Order: Streptomycetales, Family: Streptomycetaceae, Genus: Streptomyces
tccaggccgtcgggcccggcccgcatcgccgcccaccgcatcccccggccgggcccgacggcctggacacggacgtactggcccagctgaccaccccggccgggacggtcccggacacccgggaccgtcccggtcagcaacttgagtacgcgtactcaggcgccgggcccgcctcccgccggaccatcgaggaatgctgtggtccgaccccgagaacgagccgccgaaggaactgcgcgacatgcaggccatgttgcgacggctcggcgttctcatggcgctggccatggtggtcgcgatgttcgcgatcgggctgaggtgagcgggaccgaggcgcccgccgatacgctgaccgcatgactgaccagccgcgtcgccgactcgtactcgcctcccagtcccccgcccgcctcggactgctccggcaggccgggctggacccggaggtgatcgtgagcggggtcgacgaggacgcgatcaccgcccccacgcccgccgagctggcgctcgccctcgccgaggcgaaggcctccgtcgtggcggcccggccggaggtcaagggcgctctggtgatcggctgcgactccgtgctcgacctcgacggccgtgcgctcggcaagcccgccgacgccgaggaggcgctcgcccgctggaagacgatgcgcggccgggccgggacgctccagaccgggcactgcgtctgggacacggcgaccggccgccacatctcggccaccgcctccaccgtggtccgcttcggcgagccgaccgacgaggaggtcgccgcgtacgtggcctccggcgagcccctgcacgtggccggcgccttcacgctggacggccgctcggccccgttcatcgacggcatcgacggcgaccacggcaacgtcatcggcctcagcctgcccctggtgcgcaggctgctggcggaactgggcgtgggcatcaccgagttgtgggcgccgtcccagaagagctgagaggactcagggggccggtcaggaggccgtgggctcggccggcggagcggccggcccggacccgcgcgggctgccgccctgagaaccgctcaccggcgcgtcccccagcggcccctcctggtcgtacgtcatcaggagcagcacgatcagcgccagtacgacgatcatgaacaggaacgccgcccagcccaccagcccccacgcgaaggcacccagcagggcgtgcaccacggccgcgctgatcagcaggccgcgcccgagcccggccggcctccggccgcgcacggcgacgagcagggcgacaagggcgcacagggcgaggtagaggccgaagacgatgccggcgatcttcgaggacgtcgacatcacgttcgagtccaggccggccagggacatctgctgccgatggacgacctcaccgaggatccagttcaccgccgcgaaaccgagcgcctccgcgaagagcacgaccgccacgacccatgccaccggtctgcgcaccaccggatccacccacttccgaacaccgctccacccggagccctgttaccgccagtacctcagacacgcgaacgctactaatgggtaaacctggggacaagggttctaccgagggcaaagattcattgggccattcgtagggactccacaaagaaacgaaccgcgccgcagcacgctctcacagagaccttgaccacaccgcggggctagggtttcccgaaggagtcctgcgtaccaaggtgcgacaagggctttcgcgggtcgagcgagcctcgaatcacgctccgtgtgggcaagctcaccattggggacgggtcgaagtgccgtgtcggcagtccctaaactcggcttgtttcaaggagggagcctcaatcgtgcgcaaggtgctcatcgccaaccgtggcgaaatcgctgtccgcgtggcccgggcctgccgggacgccgggatcgcgagcgtggccgtctacgcggacccggaccgggacgctctgcatgtccgcgccgctgacgaggcgttcgctctgggcggtgacacccccgcc

SEQ ID NO: 687 - DNA, 4793 bp, Unknown
  Kingdom: Bacteria, Phylum: Actinobacteria, Class: Actinobacteria, Order: Streptomycetales, Family: Streptomycetaceae, Genus: Streptomyces
gcaccggcggcaggagcggcgggcgcccgacgtcccgcgacgtggcgcggctggccggtgtctcgcacaccgcggtgtccttcgtgttcaacggccgggccgagggcaacctctcgcccgccacacaggagcggatccggcaggccgccgcccaactcggctaccgccccgacccgctcgcgcgcggcctgcgcagccgccgtacggccgtgatcggcctggtcaccgacgagatcgcgtcctcgcccttcgcgggacgcctgctgcgcggggccatggaggccgcctggagcagcgaccacctgatcctcaccgtcgacacgggcggcgatgcggccaaggaggacgcggccgtcgccgaactgctcgaccggcgcgtcgacggcatcatctacgcggccatgtcactgcgccgggtccgggttccggaggggctgcaccgtacccactccgtgctggccaactgcctgcccgaggacggctcgctgcccgccgtcgtccccgccgaacgctcagggggcgccggcgccgcccggttgctcctcgatcacgggcaccgcaggatcgccatggtcggcgggctcgacgacatcgcgtcggcggagcggctgcgcggtttccgtgacgcgctgcgcgccgagggcatcaccgtcccgccggagtgggtggtccgtaccggaggcgagatctccggcgggtacgagggcgcggccaggctcctggacggcaccggcgcacagcagaggcccaccgggatcttctgctacaacgaccgggtcgcggcgggcgtcctgcacgccgcgacccggctcgggatcgaggtgcccgcggagctgtccgtcgtcggctacgacgaccaggagcacatggccgcctttctcaccccgccgctcacctcggtcgccctgccccaccgggcgatgggcgagacggccgcgcggctgctcctggaagccatcggcaccggacgcacgccgccggccaccacgcgccggctggcctgcccggtggtcagccgcgcgtcggtgggaccagcgcccatccggtgacgtccgccgtggcggcgccgaccgtgagttcggggacgtcgtccggccgccggtagacgcgctcggtgatcactgcccggtccgcggcgaagagttcgagcagcgaaccgtcgacgaggacgcgcacggtcagccgcgggccgcctggcacgtgcacggtgagggggccggagtcctcgcggcccgtgcgcgggcgctcgccgcggtccagggtgaccgtccccgcggccgggtccaggcgcaccgtcaggtccgcccgcccgcccggggaacgcagcagcgtcaccgtcgtccggtcgcgggcggtgaccgtgaggtcgtacgcgtccgggagcccgaccccgcggcccggccgggtgacgaacggttcgcgggcacgcagcaggtcgagttccggggccgggagcacgcgcaggccgccgtccgggtggacgccgacgacccggggggcggtgaggaccccggcccagcccgctcgtgccacctccgcctgcccgcgggcctcccacgaccagccccacatcagggtgcggtccgcctcctggagcacggcgggcgcgtagaagtcgcgtccgtggtcgagccgccctccggcccgcgccgtgaaccgcagcgagccccggccgtcggggaccaggtccccggtcaggtgcccggtgacgcacggatcgccgtcccacagcgacacggccagcacccaggcgccgtccgccgcgcggaacagctgcgggcactcccagcccacggccccgtcgccgaacacgtcggtggcgaccgggtcggtgccgtccagcaggactccggcgaagcgccagtcggtcaggtcctcgcagtcgtacagcaggacggacggtgtgccgtcggcgtggccggcgccgacgagcgcccagcgccgccccgcgtgccgcaggacgaacgggtcgcggaacatgaccacgtccagcccctcgggcggcgcgggcaccacgggcaccggcagcggcagccactcggtgagccggtcgtcgtccgggtcggcggccctggccaggcagatggtgcccagcccggcgtgctcgtggtcgatgcccgtgtagacggcggtgggggtgcccgcgtcgtcgaccacgcatcccgaccagcagcccgccgcgtccggtccgccgggggtcggggtgagggcgagcggatggtgttcccagtgggcgaggtcggcgctggaggcgtgcccccagtggatgtccgcgtgcaccggggcgtcggggttgtgctggtagaagaggtggtagcggccacgccagcggaagggcccgttggggtcgttgatccactgggcgggcggacggacccggaagcggggcacgtcggggccggtgacggggggagcggcgaggctcaacggttgactcctgcggaggtgatgccctcacggagagggcgctggccgacgacgaacacggcgacggcggggagcatcgagagcacgacaccggcgaggaccacggagacggagccggtgccgaggttgccctggagggagaccaggcccagcgggagggtgtagttctggccggaggtctccaggatgagcgggcggaagaactcgttccagtgatagttgaaggcgagcacgccgacgatggcgagaccgggtgtggccagcggggcgtacaccgagcggaagacgcgccagggcccggcgccgtccagcatggccgcctcgcccaggtccttgggcatgccgaggaagtactgccgcatcaggaaggtgccgaacgcggtggggaaggcggggatgatcaggccgagcagggtgtcggtcaggcccatcgacttcagcaccaggaacaccggcacgatcgtgacctgcaacggcaccatcatggtcgccaggaccaggccgaacagcggcttcttgaaccggaactccagacgggcgaaggcgtacccggccagtcccgccgtgatcatctggccgaccgcgatcagcgccgtgaccagggtggagttcagggcgagcagccacacgtcgagctgctcgaagaccccgcggtaggcatcggcgctgggatggagggggatgatccgcggcggcaggtcgaaggaccgggcgggggtgcgcagcgaggtggagacggtccacaggaccgggcccagggtcagcagggcgcacaccgtcagcccggcgatccgcgcccacggcgcgagggagtgccgggcacggctgaggacgggggttgcttggctcatgggactcaccgggctcactggtagtggacgaagcgccggctgagccggaactgcagggcggtgaccgccatgatcaggacgaacagcagcacgcccaccgcggacgcctcgccgaaacgcagctgctcgaaggccctctcgtagatgaccatgacgaccgtgcgggtggcgtcgccgggaccgccgtcggtcaggacgtacggctgctcgaagacctggagggcgttgatgatgccgaccacggaggcgacgagcagcgtcggcgacagcagcggcagcgtgatggccaggtgcttgcgcagcccggtcgcgccgtccagggcggcagcctcgtggatctcctcggggatgttgttcaggccgccgacgaagagcaggaaggagaagccgaactgctgccagacgtagaccaggatcaccgtggccatcgccgcgtgctccgacgtcagccagggcaccggggcgatgccggccagcccgagcagccagttgacgacgccgaagtcctggttgaagaggtacttcatcaccaccgagatcgacgcggcggacagcaccagcgggaagaagaacgcggagcggaacaccgaccgcagccacaccggcatccgcccgttcagggtgagggcgagggcgagggcgaggggactgagtcaggcgggatgagaaacgcggtagatcgttgaacgatccctcgatccctctattgtcttgtcctcttgtctgcggttgaattccgggcatggcagagcagttgacgtcactggcggacgaccgggtcctgctggggcgtaccagcaccgccgagcgggtctcggacatcctcaggagccgcatcgccgagggctacttccctcccggcacccggctgtccgaggacagcatcggcggcgcgctcggcgtctcccgcaacaccctgcgtgaggcgttccggctgctcacgcacgagcggctgctcgtccacgagttgaaccgcggggtcttcgtgcgcgtgctggccgtcgaggacgtcgaggacatctaccgcacccgccgcctcgtcgagtgcgccgtcgtccgcggcctgggcgagccgccgtacgcgctcgacggggtcgccgcggcggtcgaggagggccggcgggccgcgcgcgaagccgactggaagacgctgggcaccgccaacatccacttccaccgggaactggtcgcgctcgccggcagcgagcgcaccgacgagctgatgcgcagcgtcttcgccgaactgcgcctggccttccacgtcgtggacgacccccggcggctgcacgagccctacctcacccgcaaccaggagatcctccagatcctccagagcggtgaccggcgccaggcggagaagcagctcgcggtctacctggacgactcgctggagaaggtggtcgaggtgtaccggcgacgggtcggccagggcgcgtagcggcccggccgcaccggctcccacggcggggcgcggggtgatgtcggccggcggtcgcgacggcttccggcgccggt

SEQ ID NO: 688 - DNA, 18485 bp, Unknown
  Kingdom: Bacteria, Phylum: Actinobacteria, Class: Actinobacteria, Order: Streptomycetales, Family: Streptomycetaceae, Genus: Streptomyces
gccggcgacgaggggccggtggtccgggaggacaggtcggcggggacgtcaggcatgggcgtggccgccttcggcgtgggcggagcaggaggtgagcgcaccgtagtggccggcggtggcgcgcgccgtggcggcctcgtggacgacctcgccgcccacccaggtgacctcggcgcgctgctgcagcagcgccgccgggtccgcctcgagcgcgtagaggtccgcggaccaggcgacgaggtcggccttggcgccttcgcggacgacaccgtactcggcctcgcggtgccaggcccaggcgccctcggcggtgtaaccgcgcaacgtgtcgtcgaggcccaggcgctcctgcggggtccaggcgtccttgccgtcgagtccggcccgcgtcagcgccgagtagaacccgacgagcgggtccatctcgcccacctgccagtcgctggagagggccacgtgcgcgccggaggccatgagcgagcgcagtcgccaggcgcggtcccagcgggcctcgccgatgttctccatccaggtgccggcgacgaggtccggcgagcagtggcgcggctgcatggcggcggtgacgccgagcccggcgaagcgcggcaggtcctccggtgcgaggcactccacgtgcacgatcccgtgccggcggtcgcgggtgccgttggtgcgggccgcgtgctcgatggcgtccagggcgaggcggatgccgccgtcgccggtcgcgtgggtgtgggtctggaagccgaggcggtccagttcggtgatgacctgggtgagttcgccgagcggcgccgaggggtggccgcggtggccgggccggttggcgtagtcctggagcatccaggcgttgtgcggttcgatgacgtcgtcggcgtagagcttgaccgggccgaacgccaggcggtcgccgctcggggcggcgtcggccgccgcgcgcagccgctgccggaaggcgccgtcggaccccatggggtggaagagcgccgcgatgacgcgcgagctgaggcggccttcgtcctgggcgcgctggaacaggtcgatctccgcgagcgggacctggggttccaccacggtggtgatgccggcggcggtggccatctccaggctgcccagcagcttgcggtagcgccgctcgggcgagtacatggggatgtcgcgctgcagcccggccaggcccgccgtggtcatggcgctggtgtagaagtcggtgacccagccggtcgcgcggccgtcggcgtcccgctccgggcggccccaggggatgtcgccgccgtcgtcgagtcccagtgcgcgtacggcggcgtcgttgagccacaccgagtgctggtcgtaggtggtgacgaagaccgggcgggaggtgagtcctgccaggtcacgggcggcggggcggcggccgtggaccaccgagtagacggcgttctcggcgcagatccaggtcaggtccgggcgggcgtcggcgagttcggcgatgcggcggcggacctcgtcgagggtctcggcgccttcgaggctgacggcgtcggggtcgaagccgaggagcaggtggttgtggctgtcgatgatgcccggggtgaggaggccgccgtcgaggcgccggtgttcacgggcggcgggggcgtcggcctcctcgccgacgaaggcgatgcgcccgccggtgatgccgacggcgccggcccaggggcgggcgtcgtcgaacgtgcgcacacgagcgccggtgatcagggtgtcgagcatggtggtcctcggttctggggcgcgccacgcaggggtggcgaaggcatgccgagacggtgcgcgcattatttgtcatcggcgtcaaagaatgggtcgagtctcatgaggatctcggctactgtcaagggcatggcccgccccaagaaccaggacgaacgccgcgcccacctcatccaggcggtcatcgacacgaccgccagcaccgggctccgctccctctcgctcgccgacgtggcacgccgggcggggctcacccgcggggccgtcctgtactactacgacgacctcgacgccctgctcagggaggcctaccgcgcgggcatggaacgcttctgcgaccggcgggacgcgctgcgggacaccgtcgaggacccggcacggctgctgggcgagacgatccgcgccgggctcccgacggggcccgacgacgcgctgatgcgcctgctgtacgagttcgacgtggtggcggggaactccccgctgcacagcacgctggtcgagtcgatgtacgagcggcaactggccacgtaccgcacggtcctggagcgcggcaccgacgccgggacgttccagctcaccctggacgcaccgacggcggccctgaacctggtggccctggaggacgcctacggactgcacatcgtggcgggcaacggccagatcagcgtgcggcgcgccgtggaggcgatgttcggcgcggcacgggcgttcggcgcgacggccgcgtgaacgggcggggacggggccggggagacggcgaaccgacatggtcgatcgagcgggcgtgctcaccgagcgcatcacgcagcgtcccggccaaccgctcgaagtccgcggcccaccgcggctgacagtccgtcaccaccaccggcgccgactcatcgggaaagggcacgctccccgcgtccagccccgcacaggtccacggcaactggaaaaatgccccgcatgaaggcaccgcacgtccggcccaccctgtccgccacggagatcaccacggaacgcctgcgactgcgccgggcacacgacgccgacgtcgccggcctcgtcgagctccagaccgacccgctggtacgggcccacctcggcggcccgcgcccgcgtgacctcgtcgagcagtacttcgacgagcacggcgtcggcgccgtcgccggcaggcccggcacctacgtcatcgcggaccgggaaaccgaccggctcaccggaaccctcgtactcgaccgccgctcggccgacctgcccggacacgtcaccgaggagggcggggaactggagctgtcctaccttctgcggcggggcagttggggtaccggactggctttcgaggccgccacggccgccctgtgcgccgccgccggcgaactgcccgaccagccggtcctggtggtgacccagaccgccaacgagcgctcgctgcgcctggccgcccgcctcggcttccggcgcgtgggcgccttggaggcgtacggcgcggagcagaccctggctgtggccgacctgcacgccttcgccggctgaccgggcgcgggctgaccgggcgcggccgggcggctgcgcggccaggcgggaggaagtccgcggcactcgcgccgccgtcccaaccaccgagccgtatacggaagacggtcccttgagtccctgcgttcgagcccggcgttcgagcccggcaccgtcgccgcccggcgcacggcacccggcggacgtcggtcagagggaggccagccaggcggcggcctcgtcggggtggcggaatcggtgggtccggagcggggcggagcgggggtcgcggatgcggagcgcgatgtcacggtggcgggtccggtactgggaccaggaccaccacaccgggtgctcccggctcagccagcccgcccaggtctccctgttgccgccgaagagcacctcgcgggtgacggtgcgccgcagggagcggcgcaggacgcggggcatgacgacgcgtctgggatagtccagccatatcaccgtgtcggcccggccccacagcaggtcacggacgtccggatggccgagggagtcggtgatccagcgcggaccggcggtgatccgcgccacgtcctcggccagttcgccgttgacggaccagccggggccgctgaagtacagcgcgtccatctcgtggtacggcagagccaggcgcctgcccagggcacgggcgagcgtggacttgcccgcgccggtggaccccaccaccaagatccgctccacgaatgcaccttaccccggggtcttcggacgggacgccgcgccgaagcgctcttcccggcagatgactgggacgtcatgtccggacgtgcacccctgagcaccccccactcacccaccccggacgtgctctcctgccccacctcgatccccgtgccatgcctacgacatgagcggcccggtgtcgtcccggatccgggcgtggaggtgttcgtcgtgccagccgtcggcgtgcaggagcgcgctgcgcatggtgccctccagggcgaagcccgccttggcggcgacctggcaggaggccgtgttggccacggagtgcgtgatgcgcaggcggtggagtcccaccgttccgaaggcccaccgggtgacggcggcagtggcgtctgccatgactccgcgcccgcggccggcgggcagcagccagtagacgaactcgccgctgccgccgcgcaggtcgagaccggcgaggccgatcaggcccaccggcacgtcgtcgtcctcgcgggcgaccgcccagacggcggcctcctcgctctcccaccgctgccgccagcgcacggtcttctcccgggccgcgtcgagagtcagcctgccggggcggttccagtgctggatgtccgggtcgaggcacgaccgcaccaggaccggggcgtcgtcctcccgccagcggcgcaggcgcatccggccgggcaggacgaagccgggctgcgggctctgcgtcatccggccgggcggcaccacagggcctatggacggtacgagccctgtcggccctccggggccgccgtctccaggttcggtcatcggttcatcatgcccatggatccggtcaccggttcatcagtcccacggaaacgccgtccctctctctcctttctccccctcgcgtctccgctgcaccccggcgcggccgcccccagctcccaccgcgttcctctactcgcggtagaggaacgcggtagactcaggacatggcagcagacgagacgagcatcaaggtgagcaccgccgcgcgggaccggctcgcccagctggccgccgagcacgggacgaccatccggggcctggtcgaggagctggcgcagggcactccgacccaggacgagtacgcggagcgcgccgagctggcccgcgccgaactcgcctccgccctcggcagcgcgccgagtcccgaggccgaggccagggcccgggccctgctggagcggctgggagcagggccgcacagcccccgggccgccgcgtagtggcggccatcgcggtcgttctggaccacaccaccgccaccgccctgtacgacccgaaggatccgttcaacgaggccgtcgccgccttctacgtgcaggcctccggcgggctcggcaacctgtacgcgccggtgctgtcgctgaccgccggtgacgccgagcggcccggcctgttcagctacatcaaggggctgcggttcatccggctggaggcgttcgacaccgacgccgccgtcaccgccaccgaactgctgcgcttcgggcacccctgggccaccgtccacgccattcacgccgcccgcccgtcggccgcccacccgacggggcggttcctcctgacgctgaccccgaaggcgtacgccggcaccggcgtgcaagccgtgcaccccggcgggtgaccgtcccgcccgcccgcacctcgtgaccgcgcgtggcggaggccacaccggtggcggccggcccgcgcgctttggcgtcccgggcggcccgggcgcaggctgaaagcagcgtcgccgtgcccggcttccccacggttccggcttcgggcttcggtgacaacggcgaggaaggagcccgcacgatgacctccacccccaccctgacgacggcgctgccggtcgagcaccgcgcacggctgatgtccctcgcccacgactccttcttcgacgcaggtgcacgtctgttcgaagagggacggcacgccgaccggttctggatcatccagaccggaaccgtcaccctcgacctgcacgtacccggccgacgcgcagccgtcatcgagtcgctgggccgggacgacctggtcggatggtcctggcacttcccgccgtacgtctggcatctgggcgccgaggccgcgagccccgtgcacgcccacgagttcgacgcgcaacccgtcctggcactctgcgcgcaggatccggaattcggccgcgccgtcgccgtcagcgtcggccaggtcgtcgcggaacggctgcgcgcggcccgggcccgcctcctcgaactctacgggccgtacggcagcggcggcagcggcagcgatcgcggctgagcgacaggtccgcggtccgcggctccggccgtcgaccgatgaccgatgccgatgaccgatgccgatgaccgatgagttcttccggcccgaacagtctgccctgtcatcgcccgcaacaggagccccaggaggagcacgtggcccaactgctgagagtccagaacttcaatgtctcgagtgacggcatcgccgccggtgaggaccagagcttcgagcggccgttcgggcatgtcgagcccgagaggctgttctcgtgggccggtgccaccgcgagctggcccatgcgcaccgacccgggcggcagccgcggcctcgacgactacttcacgcgggactacgcacgcggcatcggtgcggagatcatgggccgcaacaagttcgggccccagcgtggaccctggcaggaccatcagtggcgcggctggtggggggacgaaccgccgttccgggcaccggtgttcgtcatgacccaccacccgcgtccttcgttcacgctctccgacaccaccttccacttcgtcgacggcgacccggccacggtgctcgcgcgggcgcgggaggcggccggtggcaaggacgtacggctcggcggcggagtcaccacgatccggcagttcctcgacgcgggtctggtcgacaccctgcacgtggccgtctcgccggtgaagctcgggtccgggctgcggctgtgggaggaaccggacgagctgctcgaccggtaccacctggacgtcgtgcccagcccgagcggcgtgacgcaccacctgttctggcggaagtgactgctcctctccctgagaggggaggggattcctggctcagtctgcctcccggagcggcgctccgggaggtcttgcgccatcagcaccagccgggtccagacctgcccggacgcgcatcacacgcgcggagttccgaacaggccggttccgctgccgagttggcctcgtccggccgagccggccccgcgacccgttggccgtggacgcggtgcgcggtcgcgacggcccggagagacgttcccctcactgttcgggtagcgtgtttgcggccgggaagctggatcttcccggctccttcgcgcgcgccgcgggggaggaacctgatcgcgtgatgtgtgacgcggcggcggtgccgccgtcgggggaagtgagcaacccatggccatggtgggcctgttctggatcgccgagggcgatgtgtacgtgggcgcgaagccctccggtctggcgcccggcgtgcgcctgacccccgagggtgtggtggccctgggcgacggacaggcgggcctgcacctgtgggaggacgtgcgggccctgacggtcgcggacgtccccgtgaagtccctgctgcggcaggtcggcgtggtcaagaacctggccgtggacaccgtggtgaacctcgcgctgtccctcggcccgggccggacggacgaggcgccgccgatgatgacggtgcacgtacggtcgtccggcggggagcacgagctggcggcctacgtggccgcggccgtgggctactccgcgaccgaggtcgaactctcccgagccctcctgtcccgcctcaccgagggcgccgcgaccatggccacgacgctggcggcgatgtcggagtgggggcgcagccgggcgagcggcacgccccgggccgcggagcgggagcggctgctgcgggagtggctggaccggtaacgctggtgggcggtgccgccgcacgcccggccgggaggacttcccagcgggctcccgtctgccggaacgggtttccgccggccgggggcgcagccgtcccggcttgccggaacaacggaggagccgccgcttggcgttcagcagccggagtcggcgatgacgaagtagcccgcggacgtctccttcagtgtgtggatgacggcgacgttgaacaggcccatgttctgctcggagccgttggcgtacgtgtagccgccgctctggtgggcgcggccggcgaggacctggtggtagttgtcggcggtgtagcacttgggtgcggcgccggtcgtcgtcgccgtgaccggtgcggaggaggccccgacggcaccggtggagtcgaccgcggcgacggtgtaccggtaggacgtgccgacggacaggccggtgtcgctgtaggaggtgcctgtcacggaaccgatctcagtgccgtcgcggaagacgcggtacgagacggcgccgctgacggcgttccaggacagtgacgcgccggtgccggtggtcccggtgaccgtgaccgccgagggcgcgggcagggagccggtacccccgccgcccgcgccgtccaggccccagaacttcgcggtgtggtagctggagcagatggtgtcgaggtaataggttccggtggtgccgcactggtcggcgcccgtgccgggatcgacggcgagtccgtgggccatgccggagacggagaagagcgcgacggccggcttgccgtccggggcgtcgtagatgctctcggtggtgccgccggtcaggttctgggtccgggaggcggtctggccgatgccccagacgtcggtccactggtcgcgcagttccgtaccgttgaccggcgcgacggtggtgtcggcggtgccctgccagaccgcgacgcgcggccacggcccggtgtatcccggcgcggaggcgcgggccttgtcaccccactgcctcggcgtgaggttctgctggctgtactggcagccggacgcggcgctctgtgtggtggcgcactgtgccgggagcccggagtcgacggcaccgccggcgaacacgtccgggtagtcggcgagcaggtcggcggtcatgccgccgccggcggacagcccggtgacgaagatccggccgcggtccgagccgtactgcgccgcagcggtgtccaccatctgcttgaccgatgccgcctcgcccttgccgcgcgtgtccttggcggagtcgaaccaactgaagcaggacaggctgttgttggccgtgccggtctgcgggtagaccacggcgaagccccactcgtcggcgaacttctgccagcctgagtgcgcgtggtagtcgctcgccgactgggtgcagccgtgcagggcgacgaccagcggcgcgttggcgggcaggttcgccggcgcgtactcgtacatcgcgaggttgcccgggttggagccgaagtccgtgacctgccggagcgttccggcggtggtcccggcgctcgctgcgctcgcggtgtgcggggcgacggtggtcaggcccacggtgagcacaccgagcgcgacggcggcacacgtgcgcggaaatctgctgcgcaggagggagcggcgctgagaagcgggatgtgggagggaggtgcgcatgcggggactccagtgggaggcggcggagggaggggagccggtgcacccaccggctgacataccggcttactgggagcggaccgtacgaccggcaggccggcccgcgacatgtgagcggcggccaggaaagcggtgacgggcatgggacgcccacccatggtgtccgtggcgccaccgtggcatgaacgccgggaaccccaacggccctctctctccccccacacacacctgaccctgtccggcggatcgtgccgcatatggcgagcgaagccaccttgtgccgcgcaagtgtgtcgtcggcccacgtgtctcgcgcctcggttccttcctaccgttcccgccatggaaagcgccaagaaccccgctggtggctcggcccagcatgccgagccggtcgtcgacgccacggtctccgcccttgccgccacccggttcctcaccggccgcaaggccctggtcaccggcgcggccagcgggatcggccgggcctgtgccgagggcttcgccgcggccggtgccgaggtctatgtggtcgaccgggccgcggaggtcgccaaagaggtcgccgaggcgatcggcggcaccgccttcgtggtcgacctgtccgatcccgatgccgtggacacactcccggacgactccgacgtcgtcgtcaacaacgcgggcctgcagcacatcgccccggtccacgccttccctccggagcgcttcgcgctgatccagcgggtgatggtggaggcgccgttccggatcctgcgccgcaccctgccgcacatgtacgggcgcgagtggggccgggtcgtcaacatctcctcggtgcacggcctgcgggccagcgcctacaaatcggcgtacgtgacggcgaagcacggcctggagggcctgagcaaggtggtcgcgctggagggcgccgcgcacggcgtgaccagcaactgcatcaatccgggctacgtccgcacgccgctggtcgaggagcagatcgccgagcaggcacgcacccacggcatcgcggcggcggacgtcatggaccaggtgttcctggagcgcacggcgatcaagcgcctgatcgaaccggcggaggtcgccgaggcggccctgtggctgtgcaccgagcgcagcggctacgtcacgggcacctcactgccgctggacggcggctggacggcccactgacctgccgcaccgccggcggccggtgcggcgacggcaacggcaacggcaacggcaacggcaacggcaacggcaacggcaacggtgacggtgacgggggcagtgtgggacccggaccgccctgtgccggcgccgcgcccgttctcagcggacctgtaccttcaccatttccgaggtcctccaccgcacggggtggcggccgtgcgcgctggtcagcctgtacatcaccgcacggaactccagcgtgccgcgatgcgtgcccttgacgtgggccgtggcccgcgcctccgcgccgctgtccctggcgaccgtggcgccgcaggtcacccggtgccacgcgtgcccgtgccccgcggtgcgctcctccagacatatccgctggtagacagcggcgtcgtcgctcccgtgcgcgctgacggtgaaggtcttgccgacagccgccttgtggggcgccgagagttctatgtcgcctttggcgtgcgcgggcaccgccgcgagcgccagtgaggccagccccagcgcgccggtcacggccaggcgtcgccggctcagccccttcgttccggtcctcgtcgttgcggtcgtcgtcgttccggtcgtcgttgtcccggtcttcatcgtcctggtcatggacttcccttccgtggatctcccccctacgacatccactgcggatgtgtagtcgatcactcactgcgtgacggccgaccacgagcggccccgaaagcaccctcgcgccccggcctcccgccaaccttccagaggggcgaattgccccacaggttgcgtccgttggctgcgtccgttggttgttccgtcggacgatgtcccggatgccctgggaatctccgcaggcggaaacgggttgctcactgcggcaacggggcggacaacgctccatcgcggggagaggacgggagccgatgagccttcgccagtacgagtacgccttggccgttgccgaggtgggatcggtgacggccgcggcggaactgctgcacgtcgctcagccctcggtgtcccagcagatccgcggcctcgagcgggaactcggcgtggaactgttcgcccgcacgccgaccggccttgtgcccaccgtggtcggacgcgcgttcctgcgcgaggcggaggtcgcggtgagggcgtcgcggcgggcgcgggcgacggcgcgggccggcgccgacgagctggtgggcgagctggtggtcgtggtgcagatgggcttcggcgcacggcagttgccgcgcgcgctgagcgcgctgcgccgccgctacccgcggctggaggtcaccgtcttcgaggagcccagctccgccgagctggaccggctgtgccgccggggcgtggtggacctcgccctgatggcggcgtgcgaccggagccccgccgacgcccatcacctcggcgacgaggagttcgccgtggtgctgggcgccggacaccggcaactcgccgcagatcgggtggcgttgcgcgagcttgcgggagagccgtgggtgaggttcgaccgcgacagcgcgctcgacggcgtactcctgaacgtgctgcgggacagcgatccggccccggccacggccgcccgcgtctcccagacggcgacggccgtgcgctgggccgccgacggactcggggtgaccctcgtcccgacgtccgcggtaccggacggtcacgagcacctcgcgcgcccggtctccccggccgtgtcccagcccgtcatcgccgtggtccggtccaacgcgggccctgcggaaacggccctgctcgaactcctgcgcaaggaggactggtccggccactgaattccgtacgcgaaaccgacgtagccacgtacggaattccgccgtaccggaatgccgccgtaccggaacactgccgtaccggaatgccgccgtagcagaattccgccatgcccgaattccggcggctacatcggccggcgtcagccgcgggggaattcgccgccgtccacgacgatactgctcccagtcacccagctcgcccggtcggacacgaggaacagcaccgcgtgggcgatgtcgtcgggccggccgtcacgccccagcggcgcggtgtcgtcggcgttgacctggccgggcgccacgttcaggcgcgcccactgttcccgcgtcgcctcaccgccgggggtggcgacgcggccgggcgtcacggtgttgacccggattccggacggtgccagttccgtggcgagtccccggctgtagttctccagcgccgccttcgccgcggtgtagtgcaggaacggtcctacgggagtgtggaccgcggccgaggagatgtgcacgatgctcccggaactccggtcccgcatccccggtaccagcagcgagtccagccgcaccgaggccaggaagttcaggtccagcgcgtcctgccattcctcgtcgctgatggccagggcacctttgtgagggctcgccccgcccgcgttgtggaccaggatgtccacgccgccgagcgcctcccgcgcggccgacgcgagcgcctgggctccggcccgtgtccgcacgtcggccgccacgaaggcggccccctccggcgccgtgcccgacgcggaccgtgcggtcgtgagcacctcggcacccgcgtccaggaggtggcgcacgacggccgcaccgattccgcgcgtgccgcccgtgaccagggcccgctttcccgcgagttcccgcgttccagagccgttctcgtatgaggtcatcacaccgttcctctccatcacatattcatccgcccgacgggaaatagatctccgcctgattcctcgcatgaatcctcgcatgaaccctcggacgaatctccgcacgcagcacgcgagttctcgaaagaaatcgcggcggacatgcgcctcatcgggccgtttcacggtacgaccgggaaaggaagagaagcaaagacgaaattacatgaggcgctataggaaacccctatggcagctgctcgacccccgtccggcggccatggcgcggccctgcccacggaggacggcacggaagcctcttcctccgtccgccgccccgcaggccgtactgtcggcacatgagtgggatcgtcgtcgtgtacgagctggacaggtcgaggaccgcgggcgcctccgggggccacgcccctacggacctaccgccggtccgccgcgtgcacgccgcacccgcggcgccgggcaccacctcgtccccagggccgcgcaccttctgcggcaaggacaccttcgccatggagccggccccgtggacaccctccgaacaccccggtgccccgtggtacggcccccggtacgcggaccgggtctgcgaggactgcgacatggcgatggcggaggactgagcggcacaagccgtcccggtgatcccacggaagcggcgcgatcagcctcatcgacggcctgttgatcggggacagcggcgctccgcacgtgatcagcctgccgccacgatccgctcgaccgcggccgtcaccaattggtcccgctccgcctgcgtgaggacgtccggcagggtgagttcttcgacgatcagccagttcagtgtcagcatgagcagtctgacggcagtggcgtcgccggggaggccggaagcctcgtgataggcgacgttggcgtcgatgtcggcccggacccgttcagtgaggaccttgcgcagtccgggacggcgggtggcctccaggcggagttccagcagcgcgaggtagccggtgcggaacgaggcgacgcggtcgacgagttcacgcatcagttcggcgtaggtctcccggtcacggccggccgcccgctggcgcgcgaccgtggcctcgtcgggctggagtcgttcatacaccctggcgccgacctgggtgaacaggtcgtcccggctggtgaagtagttggacgccgtgcccacgggaacggcggcctcggcatccacggcccggaacgtcagtccgcgtgcgccttccctggccagtacctcgatcgccgcgtcgacgagagccgcgcgccgctcgttgttccgcctcaccattgcaatcactccacttgtagtactacgatgaaaccacttcaagtagagtactatccatggggggggaacgttttgcgaaagcttgtgtactacgtcggtgtctcgctcgatggccgtatcgccggtcccggcgacgagttcgacttcttcccgcagggtgacgagcggcaggccgccgcctactcgtcctggacgagcgcgctgtacccggagaccgtcccgaccgcctaccgcgcggccgccggcgtcgccgactcgcccaaccgccgcttcgacaccgtcgtcatgggcctcggtacctaccggcccgccctcgacaacggcatcaccagcccgtacgcgcacctgcgccagtacgtggtgtccagcaccctcgatccggacaccgacccggccgtgaccgtcgtgccggacgacccgctcggcctcgtccgcgaactcaagggcgaggcgggcgccggactggacatctggctctgcgggggcggccggctcgcgggcaccctgctgcccgagatcgacgaactgctgatcaagacctacccggtcgtggccggcaacggaatccccgtggtcgacggtgctttcgatcccaccgtcttcgacgtcgccgaacgcacggccttccccaacggcgtcactctcacccacctcacccgccgccaggcccggtgactcgccggctccgggtcatcgagtcagcctgccgacctcacgcgggccgagcccggtgaactgggcgatgcgcggtgccgggacgccagcggtcagggccgagcgcacgagggcctcccagtcctgcgtagcctccctcccggaacgacaggggtcggcggcggtgtgtcacgccgccaggcgcggataggttctgggcatcagtacgcacacggccttgccgttggggacggacaccaccgtcaccttccgggcgaggcgctggaccatcggccagccgaaccctccggcccgcccgctcaggtcggggaggcgcgcccgcggaggagcggggtccgcgtccgtcacggtcacctccaccgcgtcgggccgcgcgtccaggcccagtacgcaagtcgcgctccgcgcgtgccgtaccgcgttggtgaccagctccgagaccaccagttcgacgtcgtcggccgcgcgcccctcgaccggaggagcgagctgctgcatgaaccgccgggagagggtgcgagccctggcaggggagttcgattccccacgcaggaccgtctgacgcggagcaccggcttcggctccgcctccggttccggtttcggtcccggttccgattccgctcccggttccggtccgggtgcctcgacagtgactgatcacgcgctgcctcccgagatgagtcatgcgtcctggtgcgcccctcgttcgtgtccgccttggctgaccttgcacggggtcagtcacgtagggtgctgtggccgaacaagcccgcgtggcccggcgggagttgggtgagcaggcgctgcaggagcgcctcctcggcgacgtccgcgatcgcggggagcacggcggtgacagccctgcaggcatcgccgttgctgacgccggcgcccgcggccaccgtctcgacgaacccagcggggcgcagcggctcgctcgccgggacggcgtccgtcagccacagggcgtactgccgtggaagccggtcggcgaggtccgtccggtcgtctccgacgaggtgtgcccccagcacccccaggacgctccgcagcgcggacgcggcctcatgacggctgggatatcgcccgccttcctgtacgtgatcgatgagggtatgcgcgggttcttccatgaccactcctgcccactcctgccgttctctgaccgcccctgcgagggtcggacaccgtccggtgtttttcatgggctctttttccccggcccgccacgtgaactcgtcgcctccaggcgactgccacgttcgggtggagttcagtttggcgggatgaggagcgcgctgagccatatggcccacaggacgcgggcgttccacggaattccccgaccgaattcggtctgccggtgcgccggtccgggcgggaggcggagcgggtgtgaaggcgaatggacggctcgtgcactgcctgcagagcccctgggtacgatccttgccgcatgacgatccaggttccgggtgaggtcgagaggcgagagagaagaccatgatgtctgacgcggcagggccggaggccgcccccgcgaagccgcggccaccggtctccgcgctgccggggatgcccggtccgcggttctcggcggccgttcagggacggggcgccgccgacgtggtgccggactggcggcagccgtccgttctcatcgtggaggacgatcccggtgatgctctgctggtcgaggagctgatcgccgacagcgcgctcgacacgcgttctgtttgggtgcgctctctggccgaagcgcgcgccgaactcgcggtctgcacggtcgactgtgtgctgctggacctgcacctgcccgacggccaggggatggaggccctctcccaggtgctcgcggtcgcgggcgcggcagcggtcgtggtgctcaccggcctggccgaggagaagaccggcctggccgcggtggcggccggggcccaggactacctcgtcaaaggccgggtggagccggagctgctgggccggtcggtgcgctatgcggtgcagcgcaagcaggccgagctggccgcggccgccttgcaggccacccagttgcgggcgagggagaacgctcggctcgaacgcggcctgctgccctcacctctgctcaactcacccgaagcactcgacgtggtgacccgctaccagcccggccgtgcgcaggcgctgctgggcggcgacttctacgacgtggtcgaggtcgaggacggtacggtccacgtggtgatcggcgacgtgtcgggccacgggccggacgaggcggcgctgggcgtcgcactgcggatcgcctggcggaccctcacgctcagcggtcgcacaggcgtggcggcgatgaggagcctggagcaggtgctggtagccgaacgggccggcgtggaaatcttcgccacgctcaccgctctggaactggctccggaccggcggcggatgcgggtgctgcgggccggccatcccgggatgctgctgcgttcgggccccgacgtggagtggctggagacggacgggggaccggctctgggcatcgtgccgggactggcacgatggtcgcagcaggaggtggctctcccgcccggagggtccgtggtgctgttcacggacgggctgttcgaaggacgcgtgggagcaggaccggagcgcctgggcgaggaaggtctgctggcgctggcgcgtcggcacgcgaaactctccgaccagcgcttcgtcgacgtgctgatcggtgaggcggagcaactggccggcgacagcggcggcctggacgacgatgtcgccgtcatcctcgtccggtggaccgagcaggaggccgcgccggcagaggcggactcgccgcacgagcacggagaagccgcccctgagcacgccggcccggccgctcgtatccggcaacgcaccggagaacaccagcagtcggccccgaccaccggcctggccgcgaccgagtaggcggcggcgagcgccggtactggctgcaggcggggcggccttcaggcgggcaggccctaaggcggggcggtctgcggcgcggcgggccggggc

SEQ ID NO: 689 - DNA, 550 bp, Unknown
  Kingdom: Bacteria, Phylum: Actinobacteria, Class: Actinobacteria, Order: Streptomycetales, Family: Streptomycetaceae, Genus: Streptomyces
cgggggcgggcgtggttaggtctacctaaccacgcccgcccccgaccctcaggaggcgtccatgtcggctgccgagaaccagccacggccgtacccggtcaccggtgtgaacatgcgcgacctcctggcctcctgtgcggcggccgaggctgtctcgtgcccgccgcgcgccccggagcaggcgcccgcgcgcccggccctccgttcgacggaagagcaccggcgagcggcgtagccctatcggatgacgacgatcttctgtccgatcgtcgcgaacatccacatcgtgtcgccgtccgggcgtgcctcgcggatgccgcccgtctgcagggtcgggtccggttccgtctgcggttcggcgctgtccacggccgcgctgaagccgatgacgacgccgttcacgctggtgaaacgcaccacgtgctcgatgggcacgccgtcggtcccggtgaccgccttcgaccgcgaggtgaccgtgtaggtgcctggcgccgggtcgagaacaccttcaaggtcagaccgggcaccgtcgacccggcgccaggcacct

SEQ ID NO: 690 - DNA, 3297 bp, Unknown
  Kingdom: Bacteria, Phylum: Actinobacteria, Class: Actinobacteria, Order: Streptomycetales, Family: Streptomycetaceae, Genus: Streptomyces
gcgcgaggccggaccgccgcgaaggagccacgacaggagctgatcggccggtagcggccggccgcgtgcgggcggggccggtccgggtcagccgaggtcgatctccgggtagagcgggaagcccgccacgaggtcggtggcccggtgggcgatctcctcggcgagcttcgcgtccaggacgtgctgggccttggagggggagcccttggcggtggtgccgggctcggtggccgtcaggacgcggtcgatcagtccggcgacctcgtccatctcggcggtgcccaggccacgggtggtcagggccggcgtaccgatgcggatgccggaggtgtaccaggcgccgttggggtcggcggggatcgcgttgcggttggtgacgatgccggactcgagcagcgcggcctcggcctggcggccggtgaggccgtaggaggaggcgacgtcgatcaggttgaggtggttgtccgtgccgccggtcacgagggtggcgccccggcgcatcaggccctcggcgagggcgcgggagttgtcgacgatccgctgggcgtactcctggaaggagggctgccgggcctcggccagggcgacggccttggcggccatgacgtgcgggagcgggccgcccaggaccatggggcagccgcggtcgacctggtccttgagggagtcgtcgcacaggaccatgccgccgcgggggccgcgcagggacttgtgggtggtggtggtgacgatctgggcgtgcgggaccgggtcgaagtcgccggtgaggaccttgcccgcgacgagaccggcgaagtgggccatgtcgaccatgagcgtggcgccgacctcgtcggcgatctcgcgcatgatccggaagttcacgagacgggggtaggcggagtaaccggccacgatgatcagcggcttgaactcgcgggcggtggcacgcagggcctcgtagtcgaggaggccggtggccgggtcggtgccgtaggagcgctggtcgaacatcttgccggagatgttcgggcggaagccgtgggtgaggtggccgccggcgtccagggacatgccgagcatgcgctggttgccgaaggcctggcgcagttcggcccagtcggcgtcggtcaggtcgttgacctggcgggcgccggccttctccaggaagggcacctcgacacgcgcgccgagaacggcccagaaggcgacgaggttggcgtcgatgccggagtgcggctggacgtaggcgtggcgggcgccgaagagttccttggcgtgctcggcggccagcgactcgacggtgtcgacgttgcggcagccggcgtagaagcggcggccgatcgtgccctcggcgtacttgtcgctgaaccagttgcccatggccaggagggtggccggggaggcgtagttctcggaggcgatcagcttgagcatctcgcgctggtcggtgacctcctggccgatggcgtcggcgacgcgcggctcgacggcacggatcacgtccagggcggcgcggaaggcggtggactcgtgggagaggggcgcagacatgtcgggggacctccggacgtggcgttcggcgttcacggtacggcccaggcgcacggcacacgttctgctcgggccgcttcccgatggtcggtcccatcttcggatcccggcaccacgccagggcccagcgcgccagtcacggcccgcacatcaccctaccgggcggcccgcccggccacgccgcagcgtccaccatgcgagcggcacgtcagacaccgccggcgtcgacgacgcgccagtggccgacctcctggtaggcggagtcgtggacgggcgagccgtcaccgggttcgagcgcgtagtggtggaggttgccgccccagtaccgcaggatgcggcccagttcgcgcgccttttcctcggccggctgcgcgtcgtccaccgtgacttccagaaggaacttcacgtccgtcgtctcccatcgggcggggggggtcggggcctgtgacctccattgtttcattgagcgaccctttgagacttcggatgccttgtccgcccgtggggcggcacagggcttccggaagtctcaaatacgcgggcaaggcgttgggcgcagagggaccggaggacgcaggaggtccggagggtgcagggatgcaggaggtccggagggtgcagggggtccggtgggttcagaggatcacgtgcgggaggaagcgggcgtactcgtcggtgatcaggcccgaggactcgcggataccgaggccggcggactcgtcctcgacgatccaggcgccgaggacgacgtggttgccgtcgaaggcgggcagcggggcgagttcctggtagcagcagggttcgtcgcgcaggacgggcgcggcgcccggggcgtgcagggtcactccggcgccctcgcggccgagcagcggtttggcgacgtagccggtggtgtccgccagttcgcgcgggccgtcgaggtaggcggggaggaggttgggatggccggggtacagctcccagaggatcgccagcagcgccttgttgctcagcagcatcttccaggcgggctcgatccacagggtggagccggtgccgccgccgttgtcgagggtgtccaggacgtggccggcgaagcggtcggtggtcagccactcccaggggtagagcttgaagatgctgcggatgaaccgcaggccgttgtccacgaagcggccggacagcgggtcccagccgatctcctccatggagatccactcggtgtccagaccggcctgttcggcggtctccttcaggtaggcgaccgtcatcaggtcctcgccgagttcgtcctcggcggagtgcgcgaagtgcagcgggctgcccggcgggagcaggcaggcctgtttccgccaggcggccaccaggcggtcgtgcagggagttccactggtcggcgcccgggaagcggtcctccatccagaaccactgcggcgaggcggcctcgaccagggaggtcggcgtgtccgcgttgtactccagcatcttcgccgggcccgtgccgtcgtagcgcaggtcgaagcggccgtagagggaggggagttcggcacgccggtgccaggcctcggtgacggccccggcgacccgcggatcggtgatgccgaggtcggcgaagcggccggtggtgacgatgtggccggccgcggccaggcacatgcggtgcagttcctcgacgacgtcctccagcgtctccacctcagggagcgtgaagacgtagcaggcgctctcgtcccagtagggcacccaggcgtcgtcggggacgggggtccccgacgacgcctgggtg

SEQ ID NO: 691 - DNA, 10835 bp, Unknown
  Kingdom: Bacteria, Phylum: Actinobacteria, Class: Actinobacteria, Order: Streptomycetales, Family: Streptomycetaceae, Genus: Streptomyces
accttcgaccagccggcgctggccggacggctgcgcgaggccggctggtcgaaggtggcctggcgcaacctcaccggcggcatcgtcaccctgcaccgcggcttcaaggcctgaggtccaaggcctgaggttcaaggtctgaggctcaaggtctgaggttcaaggtctgaggttcaaggcctgaggctctcaagggcctgggccagcccgcccggtcggtcaacgggggctgacgacggcgcagggctcaccgcctggctcaccggcgtcaccgcccggctcgccgggcggtgagcccggctcgtcgagttcgcggcgcagcccgcccggcggcgaccacggcgcgcgcggctcacggacgcccccgccgccctcgcccggaccgaagtcgaaccacacgtacacccgggagtcccgcggcacctcggcgccgggccgcgggtactggcgtacgacgtggtcgacgacggcgaggtggaagtcggggcggtcgggcgcgtcgagcagcaggccccgcgccctggcggtctcgcgcgcgtccacggccatcaggccgaccaggcgcggcacgcgcacttccggcgtcttgggtgtcgggtacacggacgtcaccccccagcggtaccggcaggttaaccgtcgggccgcgccgcccggaaggctcaggtgtctttccgtgacaagtgactacggagagtgactcaatcgtcctgtggtcccagttcgagccggtagcagtgccccgtgcgccggccgacgggtgtcacgaaggtctccgcgaggtgcatgcccaggcgctgggtgaccgctatggaccgcgtgttgcgggcgtcgaccatcgcgaccacgctcggcagaccggccgcgcgcagccggtccagggtcatccgggccgccgccgtgacgtatccgcgtccccagtactcccgcccgagccgccagccgatctcgacctcgcccaccggcccccactcgccgggccacggctgggcgccggtgaagccgatggcccggccggcctcgtcgagcatcgtccagaagcagtagccgcgttcggcgtcgtgccggcgctggcgggcggtcagctcctcgtagacggacagctccgcggaccggccgccgtggtactccatgacgtccgggtcgtcgaagaggcggtgccaggcgacggcgtcctcgtcggtggggacgcgcagccgtacgacgggcggaactcggttcacggggcagcccttcagccaggtgatcagtgctgctgaatagactgcccatgtccagtgccggtcggcacgcagatttcgaacttggggagatcccgccgtgaccgtcgtgactgagccgctctccgatcccctttccgggaacaccgccgatgtcatcgtcgtgggtgcggggccggccggttccaccaccgcgtaccacctcgcccgggccggtctcgacgtgctcctgctggagaagaccgagttcccgcgcgagaaggtgtgcggcgacggtctgaccccgcgcgccgtcaagcagctcgtcgccatgggcatcgacatctccgaggaggcgggctggctgcgcaacaagggcctgcggatcatcggcggcggtgtccggctccagctcgactggcccgatctggcctccttccccgactacggactcgtccgcaagcgcgacgacttcgacgagcagctcgcccggcaggcccagaaggcgggcgcacggctgtacgagcgctgcaacgtctccggcccgatcgtggacgaccgcaccggtcgcatcaccggcgtgaaggccaagctcggcgaggagaagcgcgaggtcaccttccacgcgccgctcgtcgtcgccgccgacggcaactccacccggctctccctggcgatgggcctgcaccgccgcgaggaccgcccgatgggcgtcgccgtgcgcacctacttcacctcgccgcgccacgacgacgactacctggagtcctggctggagctgtgggaccggcgcggcccgcaggaccgcctgctgcccggctacggctgggtcttcggcatgggcgacggcacctccaacgtgggcctcggcgtgctcaacacctcggccgccttcaaggagctggactggcgggagatcctgaaggcctggtgcgcctcgatgcccgaggactggggctacaccccggagaacatgaccggccccatccgcggcgccgccctgccgatggccttcaaccggcagccccactacacgcgaggcctgctgctcgtcggcgacgccggcggcttggtgaacccgttcaacggcgagggcatcgcctacgccatggagtccggcgcgctcgccgccgacgtcatcgtccaggcccactcgcgcgccacgcccgcccagcgcgaactcgccctccagcgctacccgcgcgtcctgaaggacacctacggcggctactacacgctgggccgcgccttcgtgaagctcatcggcaacccgaaggtcatgcagatcgcagcccagcgcggtctgacccacccgctgctgatgaagttcaccctcaagctgctggccaacctcaccgacccgaccggcggcgacgcgatggaccgcatcatcaacggcctgagcaaggtggcgccgaaggcgtgacacaggcacggggatgaccgtgaggccggctcagtcctgagccggcctcagtcatgtcccggggcgcaccggtcaccgcatcgggggcgaatcgggcgaatcgagtgaacgcggaacgaccgaagggccgctgcccccgagcggctgcggcccttcaccctctacggcgctgtacggggctcagagcacccggacggcaccggtgggcgggtcgtacgacagaggcctctccacgacgcccgtggaggagttctgcgctccgacgaacataccgtcaccgacgtacacggccacgtggtacgcgctgccgctgctgccccagtagaggatgtcgcccggctgcaggttggacagggagacctgggtgccgaccgtcgactggtcctgggagacgcgcggcaggctgacgccgacctgcttgaaggcggtctgcacgaggcccgagcagtcgtacgcggacgggccggtggcaccggagatgtacgccttgccgacctgcgccttgacgaacgagatgacggaggcgaccgaaccggtccccgtggacgtgccgacggacacgccggagctgctgctgacggacccgctgccggagccgctgctcgcctgggtggtgagcgtggtgcgcgcggtgctgcgcgaggccgcctgctcggcggcggcggcggccttgcgggcggcggcctcctcggcggccttcttcttcgcggcctcggccttcttcttggcggcggcgaggtccgacttggcctgcttcgcggccttcgcggaggccgcgtcacgctcggcctggagctggtagttcgcggcggtctgctgcgtggcgtccgcggactgggcgacctggttggccaggtcggcggtgagcgtgggcagttcgagggtctgggtgaccggctcggcggcgctcgccgtggaggcggacgcaccggctactgccagggtgccgaggacgccaccggcaactccggcccgcatcgcgatggtcgacgcgctacggcggggcttccggtggctgcgtatgtgagcggtgtgggacatgggaacaaccggtatcaggggctccttcatatcttcaagaaacgtggtctgcgccacatttgctcaaggaggggtgcgaacaccgggcgtgtcgccctttattgacgccgtaacggacattgcgggcacagatgatcatgcctgtgatcatggtctttcgctgttacgcccgaattgccccgcgcctaccatcggttgggaccgttggccaagcccggttctcatggacctctcatcggtgtggcggaggtcacggaacggtcaccgtgctctcgtgcgtccgcgggtcggccgccgacgctcgtcgcggcccgccgccgtccttcgggccccgcccggctccgcccggtcccgtcgtgcggccgacttgtccgttcggcggccagaagtccctgttcgtcactccggccactgctgtcacagagttcccagaagccacatgcgtcgcttgtgaacgggtgaacacgtccacttcccgttccgcggtccccctgatgtgtgaaaacccgccctatatcaaggccttgactcccgctgccactttgcgccggacgccggtcatctgatagtgcagaccccttccgacctgcaaaaacgaggtaaaatgtaaccagtggtgatcactcaggtgcttcgcgtgcgaagatcaccgctcatccggcttcatgatccttcgtcaggtggtggagatcacaaagctggtgtaataccccgtgtcgcagatcacagagtgtcgggcataggatgccctgcagttgggcttgtgacctgcttcacatgttcccgatcttcgccgggacaagcggggctcgtgggacagacgaggcagttgtgaacccggcgaccgccagcagtcagtgccgactgagaggagcgaggagcggtgaacgcatatgcgcccatcctcgtactgggagccctcggggcaggctttgcgatcttctccgtggtcatggccacgctgatcgggccgaagcggtacaaccgcgccaagctcgaggcgtacgagtgcggcatcgagcccactcccacgccggccggcggcgggcgcttccccatcaagtactacctgacggcgatgctcttcatcgtcttcgacatcgagatcgtcttcctctacccctgggccgtcaccttcgacgccctgggtgttttcgggctcgtggagatgctgctcttcgtgctcaccgtcttcgtcgcgtacgcgtacgtatggcggcgcggcggcctggaatgggactgaggggccttataagacatgggactcgaagaaaagctgccgagcggcttcctgctgaccaccgtggagcaggccgcgggctgggtgcgcaaggcgtccgtcttcccggccaccttcggcctcgcctgctgcgcgatcgagatgatgaccaccggcgcgggccgctacgacctggcccgcttcggcatggaggtgttccggggttcgccccggcaggccgacctgatgatcgtggccggccgggtcagccagaagatggcgccggtcctgaggcaggtctacgaccagatgcccaaccccaagtgggtgatctccatgggtgtctgcgcctcatcgggcggcatgttcaacaactacgcgatcgtccagggcgtcgaccacatcgtccccgtcgacatctacctgcccggctgcccgccccggcccgagatgctgatggacgcgatcctcaagctccaccagaagatccagtccaccaagctcggcgtcaacgccgaggaggcggcccgcgaggcggaggaggcggcgctcaaggccctgcccacgatcgagatgaaggggctgctgcggtgagcgacgcgaacggcacccacggtgcgggcggtgcgaacggctccgcgaacggcgtgaaccccgagaaggacctcgccgcccagaacctcccgggcatgcgcggccagggcggtgaggagatccgcgtccagcgcggcatgttcggcgccaacaacggcggcgacacctccggctacggcggcctggtccgctcggtacggctcccgggaccggcggcacgcccctacggcggctggttcgacgaggtggccgacgaactggagggcgccctggaggaacagggcctgcttcccgggaacgccatcgagaagacggtcgtcgaccgcggcgagctgaccttccacatcgagcgcgagcacctgctccgggtcgcccgcaccctgcgcgacgaccccgccctgcgcttcgaactgtgcacgggcgtcagcggcgtccactacccgcacgacaagggccgcgagctgcacgccgtctaccacctgcgctcgatcacccacaaccggctggtccggctggaggtcagcgcccccgacagcgaccggcacatcccgtcgctggtctccgtctacccgaccaacgactggcacgagcgcgagacctacgacttcttcggcatcgtcttcgacggtcaccccgccctgacgcggatcatgatgcccgacgactggcagggccacccgcagcgcaaggactaccccctcggcggcatccccgtcgagtacaagggcgcccagatcccggctccggaccagcggaggtcgtactcatgagcacgcacaccccgtcttccgcgaccccccgcgagaccaccgaaggcaccgtctacaccgtcaccggcggggactgggacgaggtcgtccagtccgcggcccgcgccgacgacgagcgcatcgtcgtcaacatgggcccccagcacccctccacccacggagtgctgcgcctcatcctggagatcgagggcgagacggtcaccgaggcccgctgcggcatcggctacctgcacaccggcatcgagaagaacctcgagttccgcacgtggacgcagggcaccaccttcgtcacgcgcatggactacctgacgtccttcttcaatgaggccgcctactgcctcggcgtcgagaagctcctcggcatcgaggaccagatcaccgagcgcgccaagatcatccgggtgctcctgatggagctgaaccggctctcctcccacctggtgtgcatcgccaccggcggcatggagctgggcgccaccacgatcatgatctacggcttccgcgaccgggagatgatcctcgacatctacgagctggtcaccggcctcaggatgaaccacgcgtacatccgccccggcggactcgcccaggacctgccgcccggcgcggtcgaccagatccgcgagttcgtcaagaagatgaagaagaacctcccggagtacgacaagctcgccaccgggaaccccatcttcaaggcccgcatgcaggacgtcggctacctcgacctggccggctgcatggccctcggtgccaccggcccgatcctgcgcgccaccggcctgccgcacgacctgcgcaagacccagccgtactgcgactacgagacgtacgacttcgacatcccgaccgccgacacctgtgacgcctacggccgcttcctgatccgcctggaggagatgcgccagtcgctcaggatcgtcgagcagtgcctggaccggctgcagcccggcccggtcatggtcgccgacaagaagatcgcatggcccgcccagctcgccctggggccggacggcctcggcaactccctcgaccacatcaagaagatcatgggcacctccatggaggccctgatccaccacttcaagctggtcaccgaaggcttccgggtcccgccgggccaggtgtacacggcggtcgagtcgcccaagggcgaactcggggtgcacgtcgtgtccgacggcggcacccgcccctaccgggtccacttccgcgacccgtccttcaccaacctgcaggccatggcggcgatgtgcgagggcggccaggtcgccgacgtcatcgtcgccgtcgcgtccatcgaccccgtgatgggaggcgtcgaccggtgaccacctcttcttcggagcggggcgtcagcctgggcatgcccgaactgcccgctcccggctacccggacgacgtccgcgcccggctggagaccgacgcgcgcgagatcatcgcccgctaccccgactcgcgctccgcgctgctgccgctgctgcacctcgtgcagtcggaggagggctacgtcacgcgcaccgggatgcagttctgcgcggacgtcctcggcctgaccacggccgaggtcaccgcggtcgccaccttctacaccatgtaccggcgcaagccgtccggtgactaccaggtgggggtgtgcaccaacaccctgtgcgcggtgatgggcggcgacgccatcttcgaggcgctccaggagcacctgggcgtcggcaacgacgagaccaccgacgacggcaaggtcaccctggagcacatcgagtgcaacgcggcctgtgacttcgcgccggtcgtgatggtcaactgggagttcttcgacaaccagacccccgcgagcgtgcgccgcctggtcgacgacctgcgcgcgggacggccggtgacgcccacgcgcggtgcgccgatgtgcaccttcaaggagaccgcccgcatcctggcgggcttccccgacgagcgggagggtgccgccgatgccggcggcagtgcgggacccgcttcgctggtgggcctccgcctggccagaggagagaccgcacccgcgcgcgtggtccatccccgcgagggcggtccgcacgacaccgggcgggacaccgccgtgcaccagccgtcgccgacggagcacctcagctcccacgacgcgccgcaggagacctcggcctccgacccgtcgcaccccgcgggacccgtcgcgaaggagggggagtgatgactgtggcagccgaactcaacgagtccagccccgagaagctgctcgcacccgtgctgtcggccttctgggacgaggaccggtcctggactctggacgtctaccgcaggcacgaagggtacgagggactccgcaaggcactcgccatgtcaccggacgacctgatcgcgtacgtcaaggactccggtctgcgcgggcgcggcggcgcgggatttccgacgggaatgaaatggcagttcattccccagggtgatgggaaaccacactatctagttgtcaacgccgacgaatcggagccgggaacctgcaaggacatcccgctcctcttcgcgaacccgcacagcctcatcgagggcatggtgatcgcgtgctatgccatcaggtcttcgcatgccttcatctatctgcgtggtgaagtcgtccccgtgctgcggcggttgcactcggccgtgcgcgaggcctacgcggcgggctacctgggtacgaacatcctgggcagcggagtcgatctcgacatcaccgtgcacgcgggcgccggcgcgtacatctgcggtgaggagaccgcgctgctggactcgctcgaaggccgccgcggacaaccgcggctccgtcccccctttcctgccgtcgcgggcctctacgcgtgcccgactgtggtgaacaacgtcgaatcgatcgcgtcagttcccgccatcctgaaaaacggcaaggaatggttcaggtcgatgggcagcgagaagtccccgggcttcacgctctactcgctcagcggccacgtcgcgagccccggccagtacgaggcgccgctcggcatcacgctgcgtcagctcctcgacatgagcggcggcatgcgccccgggcaccggctgaagttctggaccccgggcggctcctccaccccgatgttcaccgacgaacacctcgacgtccccctcgactacgagggcgtgggcgccgccggatccatgctcggcaccaaggccctgcagtgcttcgacgagacgacctgcgtggtgcgggccgtgacccggtggaccgagttctacgcccacgagtcctgcggcaagtgcacaccctgccgcgaagggacctactggctcgtgcagctgctgcgggacatcgaggccggcaagggcgtcatggacgacctggacaagctgaacgacatcgccgacaacgtcaacggcaagtccttctgcgccctcggcgacggtgcggcctcgccgatcttctcctccctgaagtacttccgcgaggagtacgaggagcacatcacgggccgcggctgccccttcgacccggccaagtcgacggcctgggccgaccagcacacggaggtgctcgcatgaccgtgaccaccaacgccccctcctcgggaggcgcggcggcacccccgccggacgacctcgtgacgctgacgatcgacggcatcgagatcagcgtgcccaagggcaccctggtcatccgggccgccgagcagctcggcatcgagatcccccggttctgcgaccacccgctgctcgcccctgtcggcgcctgccgccagtgcatcgtcgaggtggagggccagcgcaagcccatggcgtcctgcaccatcacctgcaccgacggcatggtggtgaagacgcagctgacctcaccggtcgccgagaaggcccagaagggtgtgatggagctgctgctcatcaaccacccgctggactgcccggtctgcgacaagggcggcgagtgcccgctgcagaaccaggccgtgtcgcacggcaacgccgagtcccgcttcgacggcaggaagcggacgtacgagaagccggtcgcgatctcctcgcaggtgctgctggaccgcgagcggtgcgtgctgtgcgcccgctgcacccgcttctccaaccagatcgccggcgacccgatgatcgagctgatcgagcggggcgcgctccagcaggtcggcaccggcgagggcgaccccttcgagtcgtacttctccggcaacaccatccagatctgcccggtcggcgcgctcacctcggcggcctaccggttccgctcccgccccttcgacctcgtctcctcgccgacggtctgcgagcactgcgcgggcggctgcgccacccgcaccgaccaccggcgcggcaaggtcatgcggcggctcgccgcgagcgaccccgaggtcaacgaggagtggatctgcgacaagggccgcttcgcgttccggtacgcgcagctcaaggaccggctgacgaccccgctggtgcgcaaccccgagggcgaactggtcccggcgtcgtggccggaggcgctggagatcgccgcccagggcctgctcgcctcgcgcggccggaccggcgtcctcaccggcggacggctcaccgtcgaggacgcctacgcgtacagc

SEQ ID NO: 692 - DNA, 1006 bp, Unknown
  Kingdom: Bacteria, Phylum: Actinobacteria, Class: Actinobacteria, Order: Streptomycetales, Family: Streptomycetaceae, Genus: Streptomyces
ggcgcgctgggaggactgggactggtggctgcagccgaaccccgccgaccgccgcaaggtacgcgtgtgccacctgctggaagacttccccgacgtcaagggcgcctacacctacccgtccctgccgctcgtcggcgacgaaccctccgactacgccgtcgtccacccggcccgcccggtgtgggtgcggccctactgctcggcctccggggccatggccatgaacgtggtcgaccgatagggatggatgagacgtgaaccgaaccatattcgtgctgggggactcggtccccgcgccccgcacggaggacgaggctcccatggcgggctggggccagaagatcgaggacctcctcaccggccccgtcgaggtcgccaactacgcgcgcagcgccatgaccacgcgcaagtacttcaccgaacgcttcccggcgatgctcaaccgcatgaagcgcggtgacatcgtgctgatcggcttcggctgtgtcgaccacatgatccacaacggcacccgctacgtgcccgtcgccgagtaccaggaactgctgcggctgttcgcgatgtacgtgcatcaggagggcggcgtcccggtcctggtcacgccgatggcccggtacgcgttctccgccaccggggaggtgctcaacaccgtcggcgactacccccgggccatgcgggagacggccgaccggctcggcgcgccgctgctcgacctcaacgcgcgcaccacccagctgtgggccgagatcggcccgatgcgtctgcgccagtacttcagctgggtggacgccggtgaacacccgctgcaccccgacggcagcatcgactcgacccacctgaaccacgccggcgcgttcgaggtggcccgcatcgtggtggccggactgtgcaacctcggcgtgctcgacaaggccgacgtgaacgtcgaccggctcatgggaccgcccgtgatgccgccggtgtccggcgagttcaccgtacaggcgcccgactcggccctgtacgg

SEQ ID NO: 693 - DNA, 3022 bp, Unknown
  Kingdom: Bacteria, Phylum: Actinobacteria, Class: Actinobacteria, Order: Streptomycetales, Family: Streptomycetaceae, Genus: Streptomyces
  misc_feature (2732)..(2733): n is a, c, g, or t
caccgaacgttccgtcagcaagcacatcggcagcatcctcgccaagctgaacctgccgccgagcgacagcggccaccgccgggtcctcgcggtgctcgcctacctgaacgcctaatgggacttgccttgccgggtcgtagagactcggtgccgtagccgccagcaggtgggtactttcatcgcctgaagcacatgacttctgaggtcagaccgtgcccctgctggtcggccgggaggccagaccgctgatggggtggcatgcctgccgggcagtggggcgtgagcactggatccattaggccgcgtgccgcgccttccgcaggctgcacgacgaccgaaccaccggacgaggagagcgtgttgctgcgatcgtcccgtgcggcgacgtgtccgtcgccgcacgggtgtagcaggctacacctcaggttcggggggacggtccgatgtgccaaccgggggcgcagggagaaggtgaatggcgtaagagatcccacccctgccgcccatcgggccgccggggcgcacaacaggaggaacccctgatgaagcccgtgctctggctgctgctcttcgtctccacggtggcggcggtctacgtcagcaccttcgcccactacaccggcaccatgagggtcctggccggagtcggcaccggcgtcgtcttcgtcggatcggcgctgggactgtggctgaccagcagcaagaagtgacctcgtagcggcgagagcacctgaggaggggggtgtccggcagcgagccggacacccccctcctcatgcgtgatacggaaacggacgccacctcaggaggtgcagtccgcccccctcccgagcgggaagccatccctgtcgttccgaaaagacaccgttcataggctcttttttatggacacagggccttccttccctcgcctctatggagaagcaactgatgcgctcactcattcgaaccacgcgacggcacaaggtgatcgcagtatcagcagccttcctgctcgttcccctggcggcctgcacaccggacgacggaccgcgaccggccgcttccgcgacctggaccggtggagcagccccgtacgctccgaagaacaacgggaagcgcgacgaacgattggacgagcggctggaccgccccacgatcctggaacttcaggaggacatgaagggcaagcggctgacgtccaaggaactgacccaggcatacctggaccggatccatcgcctcaatccccggctcaatgctgtcgtcaccgtgaacccagacgcactggacctcgcacgcaagagcgacgcgctgcgccgcaccggtgaagtgcgggggccactggagggcatccccgttctcatcaaggacaacatcgacaccgcggtccgccagcccaccaccgccggctccacggccctgttgcactcgaagccggcacaggacgccttcctggtagagaaactgcgcgacgcgggtgcggtgatcctgggcaagaccaacatgccggaatgggccaagggggaaattttcctccgcccagacgaatcaggccgtgcgcggcgactccgctgccgtcgccgcggcgagaccgatgtatgcgtcgcgctcggggacccgggaacgggcgtcctcggcgcgggtgaacccggcgaccgggtaccggccgccgtccgggtactcggccacaccgacctcgttgcgcacaacgggcggcgggccggttctgccgctggtgcgtatctcgtcgtcgaggatccctgacctcaatcggtgcgtccagacctgcagttccagccggcgccggacgtccgcgcacgcctcgggcgcgtccgcttcgtcgcgccagatcttcggacttgccggggcgaaaatggaaccgcgcggtgttctgcggcgaacgccagtaccgcggtgaccggggtggtgccgatgaggaagccgaacgcggcgggacaggagaagacgtccgcgagtcggcccatggcgactggagtgacgacgccggcgatccggccgccgaatcgatcacgcccgcgccgatcttccggtcacggcggtgggcagatccggagcgagaggccgaacacggccgtcgaggccgggccgtggagccaaccgaaggccgtcagcgccgggccgacgaacagcggcgccgggccggcgccgctggccgcgggcatcccgccggtgaccgtcgtccggctggccggtgtggtgcgctcggcgacccctttgaacgaagccgacgggaaaatcctctggcctacgccgataagcccgcggacgagtagcagcatgccgaaggtttgcctgccgttccggtcagcgcggggacccggaccggagcagcagcgtcacgcgcatcggcccgcgggacccgaccggtcggcgacaaagcccgcggtgatctggcacgccaggtacagcagtgcgaacacggtcaccagccgtccccgctcgggcctgctgagccgaacttgggcccgatcagcacaagtgccattctttcagcgcgcccggcccggggttcgtgcgatccaacgaacatcgcggaggtctttcaaggccggagagcaaccggagcgacggtcaagcctcttcaaccggaacggctttcccctcccgcggcagcacatgcagctgcaccatcgccgcgaaccggtctcccgggtcatcgagatcgattccgccgacctcgacgagccggcgcaaccggtaccggaatgtgttcggatgcacgtacgcgnncgtacgcggcggccgacgcggcgccgatgtcgccgaaggaatcgagccagcaccgcagcgtgtgcacgagctgcgactggtgtttggcgtcgtaggccagcagccgcgcgatcggcccggtcgcgacatcgccgcgtgtcgcggagaggtccgccaattcgagcagcagcgcttcgatgtgcgcgtcctcggcggtgatcactcgctttgcgccgccgttggtgagcaacacgcgcaacgcgcggtcggccccgtcgcgggacgcgcgcaggcccgagccgtcgagcgc

SEQ ID NO: 694 - DNA, 11051 bp, Unknown
  Kingdom: Bacteria, Phylum: Actinobacteria, Class: Actinobacteria, Order: Streptomycetales, Family: Streptomycetaceae, Genus: Streptomyces
accgggcccgccgcccgtcgcgccgtcgagcccgccgcccatcgcgccgccgggcccgccacccgtcgcgccaccgcccgacgcggcgccggacccgttcggcgtcgtagccgatgcggtcgacggcatgcgcgaggaactcgccgcactcggtgaccagttccgccggcggctgctcgacgaccgggagacccgccgcagcctcgacggtctgctggccgagctggaccacacgcgcaaggccgccgagggccgcgtcgtgcagccgctgctctacgacctcgtactcctcctcgaccgggtcgagcggcaggacgacgccttcgccggctccgtcgccgcggagctgctggctctcctggagaagtacggcgtgacccggatccccgtcacccggggcccgttcgaccccggcactcaggaggccgtcggggcgatcgccgctctctccccggaacagaacggtgaggtggccgaagtggtgcggcacggctaccgcttggaggagcgcatcgtgcggccgcaacaagtccgggtctacaccgactggtgagcggcagcggtttccggacctcagatcagatgtccgggtcctcggacaggtcccggccgcgggtttcggcggtgcgccagagggcgagtgcggtgaccaggccgcaggccgtggccagggcggcgaggggagtgctggagatgtggcccgacgccgagagccggctgctggcgaagagcggagtgaagccgccgccgatcagcgcggccaactggtagcccatggacgcgccggtgtaccggacccgggtgccgaacatctcggagagcagcgggcccagcggtgcgtacatcgcgttctgtaccacctgaccgatgaccataccgaggatcagcagcggaaaggatcccgtgtcgatcagcgcatagatcgggaaggcgagcagtgcgatgcccaccgcgccgcccagcgacaccacccggcgtccgaggcggtcggacagggcggagaagaacggtatggccaccagcccggtgagcgcggtcgccgtgagcccggacatcacgtcggaggtgctgtatccgacggacgtcgcataggtgagcatgaaggtgctgatcagggccgtcagggcgaaggggccgatgccgacggcgcaggcgaggaccagagcccggggcctgcgcagcacctgggccagcgggatcctgggcggctcgtcggcggcctgctgcttcctggcctccaccgcctgccggaagagcgggctctccgtgatgctgatgcgcacgtacaggccgatgccgagcagcagcgcactgaacaggaacgggatacgccagccccaggccatgaaccggtcctcgggaagcagcgtggtcgcggtgacggcgagggtggacagcaggaatccgatcggtgaacccagctgcatcacgccgttccacaggccgcggcgccgcgcgtcggcatgctcgacgaccatcagcgtggcgccaccccactcaccgccgatggcgacaccttgcacgacgcggaacaggaccagcaggacgggagcggccacgccgatggtcgggtacgtgggcagcaccccgatcaggaagctcgcggctcccatgaggagcatcgtcaggacgagcatggtcttgcggccgagccggtcaccgaagtgtccgaagacggcgccccctacgggccgcgcgacatagccggcggccagtgtcccgaacgcggcgatcgtgccggccgcggagttcgagtcggggaagaacagcgggccgaaggccagggcggccatcgtgctgtagagcaggaagtcgtagtactcgatgacggttccgagcaggctcgacagcgccaccttgcggagcagggcggtatccggtgccgggcctgctttcccggacttctcaaagctgtgcggggacgacgcggagggcgcagctgacatggctgactcccgtgagcggtgcggatggtgtgggttggtgcatgacgagccgaatccgtggtgttcccccggcgggtggcctcagaccttgctctccagaccgaaggcttgccgggcgacgagtccgcgcatcacttccgatgtcccgccgccgatggtttccaggatcgcctgccgccacatgaactcgacgtcggtgcctttgacgagcgcctcggccgatccgaactccatggccgagcgcgcgatctcctgggtgagcagtgtgccggccagtttgtggtaggccgcgggaaccgccgacggctgaccgctgacgatgtcaccgagcagtgccagcgccagtgcctcgacctcggccaccttcacggcgaggtcggacagccgccggcggacgacgggatcccggtccaggcccgcggaccgcacccaggcgaggaggtcctgcagatcgcgtcgcagccgcttcggcgggaactggacgtgccgttcgaccgcgagcgcggatgcgaccacctgccacccctcgttctcacggccgacgcggttggcgaccggcacccgcacaccgtcgaaccggacctcgttgaggcgtccgccgtcgtgcgtcgggatcggggagaccgacacccctggatggtccagtggaacgatcaggacgctgagcccgcgcgacctgctgtccagggggccggtccggcacagcagccagatgcagtcggcccagtgagcattggatgtccagcacttcgcgccgttgatctcgtactcgtcaccgaccagcctcgcccgggtccgtaccgccgccagatcggaaccggcgtccggctccgagtagccgagcgcgaagttgacctgtccgagtcggagccccggaagaagacgtgcgcactgctcagccgtaccgtgagccatgagcgccttggcgaccagtcccggacccatgggaggccgggcgacccgcgcataggccatctcgtcccacaggatgaactcataggcgggcgacagccccatgccaccgaactccaccggccaggagagcgacagccagccacgctccccgagcgcacggtagagcttccgcacgccctcggccgtgttctcaccgcggtggaagtatccgtccaggctcctgtgaccggccaggaagtcgagtacttcgctgcggaactcctcttcctcgcgggtgaacccgaagtccatgtcagtcgtccttgccggcagccgtggtccacttcggttcgcgccgctcgctgaacgcccgggggccttccttcgcgtcgggatgcgcccagtgcatccgcaggagcgcccacccgtactcgcacgcctcggcgtaccccatgtccagtgacttccagatcgcctgctgcgagagggacaccgcggcgggcgagttcttgacgatacagcgagccatctcctcggcggtgcccatgagttgttctggagcgaccaattcgtcgaccaggcccagctggtacgcgcgctccgccggcatgcggtagtgcttgcccatcaaggtcatgcgcagcgcggaaccgagcggcagacgcttggccagcccgatgttctccatggcccccaccaggccgacattgacgtgggtgtccatgaaactcgcccggtccgacgcgaccacgatgtcggagtcgaccacgaagtgcagcccggctccggccacgagaccgttggccgcgcagatgacgggcttccacacccggttctgcttcggtgaccagaagacctcgtcggtcaggggccccgtgccggtgctcatacctcccctaccggcgacgacgttcacgtccgcccccgtgcagaagtgccggtcgccggcgccggtgatgacggccgcacggatccaggggtcgtcccggacctcgctccacaccgccttcatctgcggcatcatcgtgccggtcagggagtttcccttgtgcggtcgattgagcgtgatgtaagcgacgtgttcacgcttctcgaagagcacctcgggcgcttcggcaccctcctcgcgctcgtgctcctgctcctgctcctgctgctcctgcgcatgtgtcattcccggcccctctccgcatacatcgccagtacctcttccgctgttccgcacgcgtacgacggcaacatggagagttgcctgatgcgctgcgcgatgtggccgatcggcccttcgacggagtagcccaccgcgccgtgcgtctgatgggagacgaaagccgcctccatcgcggcccgcgacgccgacagccgcgccgcggacgcgaggccggcggcctgggggtgccggtggtcgatcgcccgagcggctaccttgatcagcttctccgcggcctccagcccgaggccggcgtccacgatcggatgtgagacggcctgaaaggcgccgacggcacgaccgaactgcatacgtgtgcgtgcgtgctcggccgcggcgtccagtacgtgcttcccggcgccccacaggtatcccgcgagcgccatgtgggcgaagtaggtcccctcacgcacacgttccagcgggagaacacgctccagcccgacccgcccccaaggctcgttgcccagggtttccaccggttccaccggaccggccgcgcgcgccagccaggcttgcccgccgtcctgctcgacgaagacgtcggcgatcgcggaccacggcatcagcggtggacatccgaacgagaccagactcgtgcccgcggcgacgggacgtgcgagcgccgcaggcagcgtatgggttgcgaagaaagtccccgccagcggcccgggggcgcaggcacgccccagctccatggccacagcggagatctcgcccgccccgccgccttccccgggcatcgccaacgacagcacgcccagctcggccagcccttgccagaagggccgcgggaacgagccggaaccggcacgtcgcacctcttccgtgcacctgtccaggcagtagcgccggacggactcggcgagggcttcctgctccgcagtgaacgcgacgggactgctcatgcggccgacactccccaccgtgatgccaccacggcacgccggtgctcgcgcaggccgccgagctcggccctgagtgcctgcaggcgaagggtccaaaggtgcaggtcgtgttcccgggtcagcccgatggcacccatgatctgatgagtttcccgcgtcaaacggtgcagtgtggccatcgtgtgcgcggcggcgacagcggaggactccgcgggcgcaccctggaacgcggcctcgtaggtgagccagcgcgccccctccaggagcacgctcaactcggccagccgatgctgcaatgcctggaacgaaccgagggcccgtccgaacaccttgcggtccttggcgtactgcacggtgagatcgaatgccttctgcatcatcccgagcgcctcggcgcagacaccgacacgccaccagttcaccatgcgctcggacgttccgggagccaggtcctgtgcctggcgcggcaccacccgggccagcgggtagccgtacgccgacgggaccggcgtcgcgtcgtgcggactcagctccgcgaccgagcaacgaccagcgccggcgatgagcatccggccggcctcgctgccgtaccgcagggggctggagtcctggcgggcggccaggacgaccgggccctcgggtaccggcagccccagtgcgggcagcaccagaaggtggggcaccgcggtgatcgcgccgagctccgcgctgatccgttcgacggcgagggtggcttccagcggtcccgcgctggagtcgccgaacaggtcgaggaacccgcccgcgcgcagttcggactcgagcacctggtcgtacgccccgcaggcggccagctcccggcaccgctgcgtcccggcgttccggctcagcagcgttcccagggcgtccagcagagcgcgctgcgtatcggatcgttcgaaatccacggctattccttcgggagcttcaggatcagacgggtgatcagattgagctggacttcgtagcttcccgctgcgatgccggcgccgagcgagttgcggaactgggcatcgcccaacgactgctcggccagcgcctcgctgcccatgacgtcgagcgccaggtcgccgacggcccgctcggcctgcaccatcgccgcgcgggcctgataggccagcggggacggctccttcgccttggcccgctcgtcgatgacacggtagacaaggagccgcgcggcctcgcacagggctctggcgtcgccgaactgctcctggatccccgggtcggtgagcaggccggcggcccggcaccagtcggcgagtccgtcgagaaccagcgcggcacgcgcatagcgcggggctccgacccgctcgtacgcgagggtccggcggacgatgtcccagcccttgttctcctcgccgagcaggcagtcccgggggaccctgacgtcggtgaggaacagttcgttgaaggagtgttcgccgacgagcccgtcgatgcgcctgacctcgacgccgggcgttctcaggggcagcaggaagacggagatgccgttccggccgtccgcgaccgaaccggtgcgcgcgaggaggaagcagtagtcggccgcgttcgcgtaggacgtccagatcttctggccgttgaggacgtagtcgtcaccgtcccgtgccgcgcgggttcgcagcgccgccaggtcggttccggcctccggctcggagaagccctggcaccagaagacctcgcctcgggtgatcggcggcagcagcgtcttcttctgttccgctgtgccgtacttgatgatggcggggccgacccagttcacattcatgtactgcggcccgcgcggctctccccgcttccacatctcctcgccgagcacgaagtgctgccacgctccctggccaccgccgccgtactcttccggccagtgcggggtgagccaccccttgtccgccagctcgtgcacgaactgtcgtgagaagtcggtgtacaccgcgctgccgagaccgaacccggaccgctcccaggagccggcgagccggcggtccaggaagccgacgaggtcgctgcgaaatgcggcgtccgctgcgctatgggtgaactccatcagttcctctctgtgacgcggcgacgcgtctccagcaaggcgccgcaggagggcagacatggtgccgactcggttactcctgtcgaaggagaggcgcccgcgaagaaaagtacactctattatgcggtagcgacaaggctcttcatgagagtaaccacgggaagccgtgacatctccgaggcatctgcaatcaggtggcggatgagtgtactcaaagcacgatgggaggggtagcctgcgagcggactcctcgcgcggactgcgacggccgacgaccaaagggagcaacttcgtgggtgatgaactgacactgccgaactggctgcggacgatcggcacccaaccccacggggcgcatcgacgagcactccgggacgacttcggggagctgacgttcgccgaactggtcgacacgatggacaccgtcgccgccggcctgcgctacgccggcctgcgcgcaggcgaccggatcgtgacggccatgaccccgtcgatcccgcacaccatggtcatcctcggtgccatggccgccggcatggtggccgcgccgctcaacgtccgcctgaccgcgccggaagcacgcgcctatctcaccaccctccgcccgagcgtggtgatcgccgaccccacccacgcggccctggcccgcgagaccggccatccggtcatcgaactgccggcccccgtgcgcggacctgtcgcggaccggatggccccgctgacccaccgcggctcagccctgccgcctgtggccgaggaggccccggccatcgtcttcgccaccggcggcacgaccggaacacccaagggcgcgttccacactcatcgcagcctgtggctctggctgaacacctgtgcacacggcaacccgcgcacccccaccgacatcgagctgttcttctccccgttcttccacatcacgctgggaacgaacctgctggcccccctgttcacgggcggggaggtctggatccagcggcggttcgacgccgcctcggcgctcgcggcgatcgaccgaggggccagccgtctgatgggtgcgccgaccatgttcgccgcgctccgcgcccaccccgcgttcgcgacgacccgccgcgagaacgtcacggcgatccgcttcggctccgctccgtcgacggacagcttcgtgcgggacctgctgcgcgacttccccaacgccaggatccgcgccggattcggcgccaccgaattcggctcggtcatggggttcgaccacgaggacctgctcgcaggacggttcaccggcgtgggccggccacttccgggagcggtcgtccggatcctcgacgacgacggccacgaggtccccaccggaaccatcggcgatctcgtggtctcctgcccctggcagacccagggctactacggctcaccgaaggaaaccgctgagacgttccgggcggacggcgtgcacatcggtgaccgtgcctcacgggccgaggacggctgggtacgcatcgccggacgcagaaaggagatgatcaacagcgggggcgagaacgtctacccgcgggaggtggaggacgtcgtcctacgccacccggacgtcgccgacgccatcgcgtacggcctgcccgacgaacactggggcgagcgtgtcgaggtcggcatcgtgaccgtccggaacacgacggtcgatctggaggagatacgcggcttctgccgggcgagcctggcgggctacaagatccccaagagcctgcgcctgctcgactcgatcccgctcaccgcgaacaacaaacccgaccgcaaaagggtgcgcgcgcaggccctggccgaagaggcgggaaccggcgccgacacagagaaggaagcgacccgatgacggccaccgttccgtacgccaccaagccgctgaagctggacgccgggatcgctgccacgccgcggatggtcgaggccgccgtgaccgccgaacagcacggcgtgcaccgggtcctcgtaccggagaccgcccaggaccccttccagcccctcgccgtcgccgcctcccgcacctccgccatcgaagtggccaccggtgtggccatcgcgttcgcccgtaccccgatgaccctggcctccagcgcatggacactgcagcagctctccggcggtcgcgccgtgatcggtctgggctcgcaggtcaaggcgcacatcacccgccgcttcgccatgccgtggtcccggccggcggcccgcatgaaggagttcgtcaccgccacccgcgcgatctggcacagctggcagaccggcgaagaactcgacttccgcggcgagttctacacccacaccctgatgaacccggcattcgaccccggcccgctggagcagggcgagcccgccgtactcatcgcggcggtgggaccgcagatggcggccacggccggcgcggtcggcgacggcgtgatctgccacccgttcagcacggcgccgtacgtgtccgagcagctcaccccacgagtgctggaagcccgcgccgaggccgaggccgggggagggccgtggaccaagcggcccttcgagatcgccggcaacgtgttcaccgtcaccggccgcaccgaggaggagtacgagcacaacctctcgggcatccgcgagcggctcgccttctacggctcgaccccggcgtaccgggccgtgctggagcaccatggctggggcgcgctccaggaggaactgcacacgctgtcgttgcagggccgctggaaggagatggggcaactcgtcgacgacgacgtgctgaacgccttcgccgtggtcgcggagacacccgcagcggcggggcgcctgatccgcgagcgttacgccggggtctaccaccgggtgtcggtgtcgctggccgccggatccgacctgacgctggcgctggacgtcctcgacggcatccgcgatggctgacggcccatcccccgagcacaccgccggcacgccgtgcggcgcggctggccggcgtccggacgtggtggtcgagggccgtcgtacggggggccgggagtcatacgccgcctgctcctcgacggcacaacgccgccgctgacccggagcagacgacctcgtcaggcgcccccgccgttggactgcgggatccccggcgcgagcgcacggaaccggtagaggtagccgccgttgccgccacccacggtgatgtacccgtcggtcgtgcccggcctgatcgccagattgctgacgagcggttccggctggggccgctgcggtacggcgatcgtggcgatcaggtctccctgcgggttccacaccaggatcttcccggcgcccatcaccacctggtacacgtttccggccgcgtcgacggagttggagtcgaagccgccgacaccgacgtcggcggtcatccccacgttgcctgcggcgacgctcttgccgtcgggtgccagcatgaggtggttctctcggccgaggctgtactcgctcacccacaagccggagaagtccggcgtgaacgagatgccgttgggagcggacagaccgccctgcaggacgatcgggccggtgccgccggcgtcgagacgcaccaccctgccgaccgggttccacggcgagccctggtagtcggcgaggtacatgttcccggtcttgtcgaacgcgatgtcgtcgggcaccatcgtccgtccgtccaccggccccgagaagacggtcgtgaagccgctgccgtcggggttgagccgatcgaccttcccgttgtcgaagtcggtgacgtagatcttcccgtcggccggactgaactgcagggaggagaagcggctcttggcgtcggtgtagacagacgtcacggccttcgtacgcgggtcgaaccgcagaatcttgggctgccccgcaggagcggtgaaatcgacgaagtacagatgaccgtcggggccgaaggcgggcccctccagcacggtggcgtgcccgaacaccgacggcgggtcgagcggcgccactttggcgacccgcgtcgcgtgaagcacacgcgctggcgcgccccgttcctcgtccggggccggggcggcgccctggcc

SEQ ID NO: 695 - DNA, 4335 bp, Unknown
  Kingdom: Bacteria, Phylum: Actinobacteria, Class: Actinobacteria, Order: Streptomycetales, Family: Streptomycetaceae, Genus: Streptomyces
gcgacgatcaccagcacgttgacgagcccgggcatcagagcctccatgagcgggaaggggaggccgacggcgagaaccgtcgacgccttcgacgctacggaaattcgtgggcggagtgatcggagcacgggtggatcaagggtggatcccacaccgtccgaactccacccacgggtggagaagcggccggggcagggccctgcgcaccagcaagcggccgtcggcccaccggctccgccgcacccggcgtcggatcgggcatgccggacgtgttcgcgcggctgcggcggagccggtgggccgacggccgcttgctggtgcgcagggccctgccccggccgcttctccacccgtgggtggagttcggacggtgtgggatccacccttgatccacccgtgctccgatcactccgcccacgaatttccgtagcgtcgaaggcgtcgacggttctcgccgtcggcctccccttcccgctcatggaggctctgatgcccgggctcgtcaacgtgctggtgatcgtcgccgtcgccgcgctcgtgatcacgaggcagttccgcgcacgtcggctcgacgccgaccggcgctggtggctcctgcccgcgatcctggcggtcgtcgcgctgcgagaacccgatctgatcgacgcccaccaccacaccgaggcctcgttgctcctcgccgccgaactggtcatcggcctcgggatcggagccgggtgggcctggaccacccgtatatgggtggagccggacggcgccgtgtggaccaagagcaccaaggcgagcgcggccgtgtggaccgggggcatcatcctccgtgcgggtctgttcggactgggggagctgctcggcgtgcaccaggggagcccggccctgatgctcgccctggccgccacgctgctggttcgctcgggcgtcctcgtccagaggacgcacgcactcgcctcggcggacggccggcccccggcgtacggtggcggcaggtcccgacacgcgtggaaggagcgcgtgtgacggagaacgtctggacgcgctggccctctccggaggcgctgggccgcgcgggaatctcccggccccgacgcctcctggggtggggtgcgcggatcctgatggccgccatcctcctctggggtgccttccgcagcagccatgtccagctctggggcgcgctcggcggggcggtgggtgtcctcgtggtgacggccgccggctggggcttcttccggaccacgctcgcacaccggctcgcgccgtcgctggggctcttcaccgttctcctcggcgtcgcggccgccgcgcaggcggggagcttccatgtgcccgctctcgtcatctggtgcgcctgcgctgtcgccgcgctggagaggctgccgctcgcggtgggcacgcccctgacggccgtggcgctcaccgcgttcgtcgtggccagcgacgaccagtggctcaccactggggtcacggcggcaggcctggcactcgcgggctacgtcctgcggctcgacgccgaggcccggggcaatgcccagcggctgctggcccaggagcgggccgcgcgggtggcggaggcggagtcggcggcgctgggggagcgggcgaggatcgcccgggagatccatgacgtgctggcgcacagcctctcggcgcagctcgtgcacctggaggccgcccggctcctcatcgagcggggcgcggaccgggaccagatcctggagcgggtggtcgccgcccgggggatggcccgcgacgggctcgccgagacccgccaggccctgtccgcgctgcgcggcgagctgactcctctggaggacttcctcagccagctcgtggcggcgaacgacggtgcggaggtcaccatctcgggtgaacgcagacagctgcccgccgaggcgtcgcaggccgtgcgccgggtcgcgcaggaggccctgaccaacgtccgcaagcacgctccgggagccaaggtccggctccggctggactacggagagcaccaggtgatgctggacgtgcgggactcgggcggtacgccgggcgacctggccggggccggcggcgggtacggtctgctgggcatgcgggagcgcgccgagctgctgggcggctcgctggaggccggaccgcacgaggaagggttcgcggtgacgttgaaggtgccggtatgaccgacggggccgggaggaagcccgcccgggtggtggtggcggacgaccagacggtggtgcgcgaaggcatcgtgatgctgctggggctgctgccgggcatcgaggtcgtggggtcggcaggtgacggggaggaggcggtgaaactcgtcgctgaggtcgctccggacgtggtgctgatggacctgcggatgcctcgttgcgacggcgtcgaggccacccggcggatcaggtcggagcatccggggacccaggtggtgatcctcacgacgtacgcggacgacgagtcgctgtttcccgcgctcagggcgggagcgcggggctatctgaccaaggacgcgggaggtgacgagatcgtccgggccgtggagagcgtgctgtccggggacgcggggctctcgcccggcatccagcggcggctgctggagcggctgtccgaacccgaccaccggcaggtgtccgctgccgagccgccggacgggctcaccacccgggagtgcgaggtggtggtgctgatcgccgagggcctgagcaaccaggagatcgcccgtcggctgcacgtctccaccgccaccgtgaagacgcacatcaacaacctcttcgccaagacgggactcaaggaccgtgcgcaggcggtgcggtacgcgtacgcgaaggggctcgcgcggccgccggcgagctgagtgacgggaggggcggcgtcacctgatggggtgaagagccgagggaacagaagccgcggatctcccggttctgcccatgcttgggcatgcagcaaagcaacggccgtcctgacgggggcgggggcggtcccgagggcccgtccgggagccacgagggccaggagcagacgcccgaggacatgcgataccgcgatccgtggtacgacgcgctggcatccggctggggtgaaggggagggccggggaggccctgccgggcgggtgccggccgcgcgcggggaggaagagggccgtccggatgccgcggcggcggccgcggtgtacctggaggtgcagcgcagcgcggcgttccaggaagtgcgcggtcgttaccggaggttcgtggtgccggcggtggtggtcttcctcgcctggtacgtggcctacgtcgtgaccgcgacgaccgcgcccgggttgatggcgcggccggttgcgggtgcggtgaacgtggcgatcctcgcggggatcgggcagttcctcaccaccttcctcttcgcctgggcctacgcccgccacgcccggctgcggcgggaccgggccgcgctcgagctgcgctgggacacgcaggagctgaccaggggcgccgtgcggggaggtgcgtcgtgaccggagaccatcagacgctggcgctggtgctgttcagcggattcgtggcggtcacgctggccatcacgacgtgggtgagccgcaggaggcacggctcggcggaggagttctatgcgggcgggcggctgttctcgcctatggagaatggttttgccatcgccggggactacgcgtcggccgcctccttcctcggagtgcccgggctgatcgcgctcttcggctacgacggcgtgctgtacgtggtgggcttcctagtgggctggctggtggtgctgttcctggtcgccgaactggtgcgcaactgcggccggttcaccctcgccgacgtggtggcggccaggatgagcgagcggccggtgcggatcgcggcgggcacgtcctcggtcaccgtgtccgtgctgtacctggtggcgcagatggtgggcgcgggcagcctggtggcgctgctgctgggccggacgggcgcgggcggtgcggcgcaggcctgggccgtgatcgtcgtcggcgcgctgatggtggtctatgtatcgttgggcgggatgcgggccaccacctggatccagatcgtcaaggccgtactgctgctgggcgggaccgtcgtgctgaccgtgctcgtcatgatccgcttccacggtgacctcgaccggctgctgcgggccgcggccgagcacagcggccacgggacggccttcctggcgccgggactgaggtacggcggtgactggaccgcgcgcctggacttcatcagcctcggactcgcgctggtgctcggcacgggtggtctgccgcacatcctgtcccgcttctacaccgtgccgaccgcgcgggcggcacggtgtagaagcggga

SEQ ID NO: 696 - DNA, 1221 bp, Unknown
  Kingdom: Bacteria, Phylum: Actinobacteria, Class: Actinobacteria, Order: Streptomycetales, Family: Streptomycetaceae, Genus: Streptomyces
tgctcggcctcgccgaccggcccaccgccgtgttctgcgccaacgacctgctcgcgctcggcctcctgcaggccatgtacgcggccggtgtcggcgtccccgacgacctcgccatcgtcggctacgacgacatcgagttcgccgccgccgcggccgtcccgctcacctcggtccgccagcccgccgtcaccctgggcgccctggccgccgagctgctgctggaggagaccgagaccgagggcggcccccgggcgcacgagcaccgccgtgtggtgctccagccggaactggtggtccgcagttccaccctgcccggccgctgacccgccccgcggcacgttccacggtcccggggccccggcggcgcaggagcatgtgctcaactgggacgcggccgtagaacctccgtcctgggagaaccgttgaccgtcagctaccaccagcccggcgtcgtcctcaccgaccgctgcttcaccgtgccgctcgaccacgacgacccggcgggggagacgatccagctctacgcgcgcgaggtggccgcccgcgacaaggccggccaggacctgccgtggctgctctacctccagggcggccccggcttcggggcgaaccgtttcatcggcaagcaggcctggctcggccgggccctgcgggagtaccgcgtactcctgctcgaccagcgcggcaccggccgctccacccccgccaaccgccagaccctcccgctgcgcggcggcccggccgcacaggccgactacctcacccgcttccgcgccgactccatcgtccgcgactgcgaggcgatccgccccgaggtcaccggcggcgccccctggaccgtcctcggccagagcttcggcggcttctgcaccgtccactacctctccacccaccccgaaggcctcgacaccgccctgatcaccggcggcctgcccgccctcgacgcgcacgccgacgacgtctaccgcgccgcctacccgcgcatcgaacgcaaggtcgccgcccactacgcccgctacccccaggacgtcgcccgcgcccgcgagatcgccgaacacctcctcacccacgacgtcgtcctccccggcggacaccgcctgaccgccgaggccttccagtccctcggcatcatgctcggcggcacggacggcagccaccgcctccacttcctcctggagcaggccttcgtccccacccccggcggccccgccctctccgacg

SEQ ID NO: 697 - DNA, 2182 bp, Unknown
  Kingdom: Bacteria, Phylum: Actinobacteria, Class: Actinobacteria, Order: Streptomycetales, Family: Streptomycetaceae, Genus: Streptomyces
ccctgcccgcactcggcggcggccgtgtgcacctcggcgaccggctcgccgccgagtgtgggcagggcatcgtgaccgtgcaggcgcagatcgcccggaccgagctgggcgtggagcgggtggtggtgctgccggccgacacacaggtgggtgacgcgggctcctcgtcggcgtcgcggatcacctggatgagcggcggtgcggtgcggggcgcctgccgggccgtgcgggaacgccttgccgagcgcggcgacgggccgctgaccgagctgctgaacgacggtccggtggaggcggagtacacgtacgcgcaccgccggacgcacccgatcgatcccgaacgcgggcagggcgacgcgcacatcgcgttcgcgttcgccgcgcaccgggccgtcgtcgacgtcgacaccgaactggggctggtgaaggtggtcgagctggccaccgcccaggatgtcggcaaagcgatgaacccccttgcggtggagggtcagatcgagggcggcagcgcacagggactgggcctcgcgctgatggaagagctgcacgtgagcggcgggcgggtgcgcaacccgtcgttcacggactacctcatccccaccatcgcggacatgccgcccgtccccatcgacctgctcgaacttccgcaccccgactcgccgtacggcctcaacggcgtgggcgagccgccgaccctgtcctccaccccggccatcgccaacgcgctgcgcgctgcgaccgggcgggaactgccccgggtcccggtgcggccggacgacctcctcgacatggaagggaggtgatgcgggcccgcccccgggtcccccgacggttcgccccggtccgccgacgacacctcatgtctgctcggcgggcgacggtccaccgcaagacggccagaaccttttgggcctgaaccactgggaaggaacagcaccttgatcatcgacacccacatgcatccgacgaacatcgtcgaccaggcgtggcggcacgacggctccccgttcacgggcgagcgcaccctggagatgatgaacggcccgtacatgatcaacggcaagccgcgccgcatcgactacggctgcatcatgccgccgcccgggaacagcgtgtggcaggacgggatgcgcacgggacgcgagggcatccgcgactacatggcgtacatcaccgagctggtgacgacgtacccggaccggttcatcgggaacttcatgtacaacccgcgcttcgggccggagaacggcgcgaaggaactggagttccacgtcaaggagtacggctacaagatgatgaaactgcatgcgaacatgcatgcctaccggcccgaccgggcgctggactggctgcggccggtgctccgcgtctgcgacgagctgggcgtcgtcgtcctgatccacaccggtgacgggccgtactcgatcccgacacagttctacccgatcatccgggagttccggaacgtcaacttcatcctggcgcacttcggggtgcagaccggcggcgtgtactgcttcgaggcgctgtacatgatcctggactcgccgaacgtgtacggcgagtcgggctggctgctgcagtcgcggatcgtggagttcgcgcagcagatggagcgccaccagctcgtcttcggcaccgactcgccgccgaacgagcccggcatgtgggcgcgcgagctggaggtgctgtgcggtccgccgccgcagggcatgcacctgtccgaggaggacctggagggctacctcgggaacaacatggccaagctgctcgggctgaagccgacgccgccgccgcgcgaccaggaagaggcgcagctccggctgaaggacacctacgcctcgctggacacggtgcgcccgccctcggcacgcgcgtagccgcacggacgcggtgttcgcgtcacgggccggtccggccgtaccgggccggccccgtcgctcccctcccccgatcgagaaacgggtgtctcatgcggcgaatcggtcatcttctgcccgtcccctgtctcggcgcggcccggtgggccgccgcgatctgcgctcccgtctccaccgagaccgtgcatccgacggcccgcgcggtcctcccggaggtgctgtacgggcccgcggtggccccgccccaggcacgggagttgctgcgggccgccgagcagctggcgcaggtcggcgcggacgcg

SEQ ID NO: 698 - DNA, 5871 bp, Unknown
  Kingdom: Bacteria, Phylum: Actinobacteria, Class: Actinobacteria, Order: Streptomycetales, Family: Streptomycetaceae, Genus: Streptomyces
cccgaaccggttcgggctgcgccgctccgtcatggcggaggccacggtcgccgtcatcctgctcgccgtcaccacggtgctgacccagaccgagcccggacgcaccgaggaggaggccaaggccgccgcgtcgtcctcgtcgtcctcttcgtccgcctcctcgtcctcggcgggcgcggtcaccctcgacatgccgttcgacaccggcggccagaacggcaagggcgtggtccggctcgacatcgacccggcacgcgtgggcggcaacgagatgcacgtctacgtgcagcgacaggacgggaaaccgttcgacatccccgagatcaagaccgccttcaccctgcccgctcagaagatcgggccgctgtcggtcagccccgaccacatcaccaccgggcactgggcggcgagcggagtacagatccccatggcgggcgcctggaaggtcgccgtgacggtacgcacctccgacatcgaccaagtgaccgtctccaagaacgtgcagatcggctgaaccaccatgaccgaccagtcctccccgaaggccgcctccccggcctcctcgtccgccgtgcccgagcccaggcgggccggtgcctccggcggagccggcgtctcacgccggcggctgctcggcacggccggtgccaccgggctagtcctcggcgcggcgggcgcggccgtcggctacaccgccgcgcccgccggtgccacaccgctgaccgccctgggctccggccgagcggcgtttcacgtgaaacatcagccgggcatcacggacgccctccaagcctgcggtcatctcatcgccttcgacctggcggccggagcgggccgcaaggaggccgccgcgctgctgcgccgctggtcggacactgccgagcggctgatggcaggtgagcccacggcgcacggcgacacggacgtcgcccgggacgcgggcccctcctccctgacgatcaccttcggcttcggccgctcgttcttcgaccgcaccggcctgcagaagcagcgcccggccgccctcgaccccctgcccgacttctcctccgaccagctcgacaagacccgcagcaacggtgacctgtgggtgcagatcggcgccgacgacgccctggtcgccttccacgccttgcgcgccgtccagaaggacgcgggaggcgccgcccgcgtccgctggcagatgaacggcttcaaccgctccccgggcgccaccgcgcacccgatgaccgtccgcaacctgatgggccaggtcgacggcaccaacaacccgaaaccacgcgacgccgacttcgaccagcgcatcttcgtccccgccgacagccggccggcctggatggcgaacggctcctacgccgtcgtacgccgtatccgcatgctcctggacgactgggagaagctgcctctcacccagcaggagaacgtcatcggacgccgcaagtccgacggcgcaccgctcaccggcggcaccgagacgaccgccatggatctggagaagaccggcaaggacggctcctacgtcgtcccggtgaacgcccacgcccggatcacgcgcccggaccagaacgggggcgcggcgatgctccgccgccccttctcctaccacgacggcttcaccccggacggcacaccggacgcgggcctgctgttcatctgctggcaggccgatccgctgcggggcttcgtaccggtgcagcgcaagctggaccgcggcgacgcgctgtcgcagttcatccggcacgaggcgagcggactgttcgccgtaccgggcggtgccggcaagggcgagtacgtcgggcagcgactgctggagggatgaggtccggcgcggcacggcacgtgacccgcgagccgggccgacccgggggcccggccgccccgggacgggagggcctagggttggggacatgtcagcgagctacgcctatctcggccccgagggcaccttcaccgaagtggcgctgcgcacgctccccgaggcggccacccgcgaactggtcccgcacgtctccgtgcagtccgcgctggacgcggtccgggacggcgcggccgaggccgccttcgtgccgatcgagaactccgtcgagggcggtatcaccgcgacactcgacgaactggtcgccggccggccactcgtgatctaccgcgaggtgctcctgtcgatcaccttcgcgctgctggccaggcccggcacccggctcgccgacatcaagacggtcaccgcccacccggccgcccagccgcaggtgcgcaactggctgaaggcgcatctgccgaacgcccggtgggagtcggccgcctcgaacgccgacggggcccgccttgtccaggagggccgctacgacgccgccttcgccggtgagttcgcggcggcacggtacggtctggagcccctggagagggacatccacgacgcggagaacgcgcagacccggttcgtcctcgtcggccgcccggcacggccggccgccccgagcggcgcggacaagacgtccgtggtgctgtggcagcgcgacgaccaccccggcgggctgcgcgacctgctgggcgagttctccgcccggggcatcaacctgatgctgctccagtcccgcccgaccggcgcgggcatcggcaattactgcttctgcgtcgacgccgaggggcacatcaccgaccgccggatggccgaggccctgatggggctgaagcggatctgcctgcaggtgcgcttcctgggctcgtacccgcgtgcggacatcggtacggcggccgtgcgcccgccgctcgccggaacgtcggacgaggagttcgcggcggcggcggactgggtggcgcgctgccaggacggccgtttctaggcagtccttgaccgtgcgtgaccggtcgtacctgcagatcttcgttatccacagaagttatccacaggtcctcttctcgatctggggacaagtcgacagcgaaaggcgactcagtcgacaaatcgcccttcacctcccaaccggatccatcaccccacaggtcacccttcgtccatccgtttcccatggttcatcttttggggcgacgcttttccacccgaaagtgggcgtcgggccggttcgagccaagaattcttcctgcgccgcgcacttctggagtgatcaattccggagtccacagaagtttcgcacagcctgtggataactcaccggggagcgagattcctgtggacaacgcaccgcccaagtccggctccgcacaaggaagtccggtcaacggggccgccaccgcccgccccttccagcgagccgggacgccccgttattgacacaaggcgcaattcctccataacggtgggtacggccatgcagcggtgcggtccggaatactgggtcgtgagcccgaacgccgcaccggtagccttggccacgtgattgaccttcgcctgctccgtgaggaccctgaccgtgcgcgcgcctcgcagcgcgcccgtggagaggacgtcgcgctcgtcgactccctcctgtctgccgacgagcggcgcaggtcgtccggcgtccgcttcgacgagctgcgcgccgagcagaaggcgctgggcaagctcatccccaaggccgcgggcgacgagaaggccgagctgctgaagaaggcgagccagctcgccgccgacgtcaagacggccgacgcggaacgcgacgccgccgacgcggagacccaggagctgctgctccggctcggcaacctcgtccaccccgacgtgcccgtcggcggcgaggaggacttcgtcacgctggagacgcacggcacgatccgcgacttcgccgccgagggcttcgagcccaaggaccacctggagctgggccagctcctcggcgccatcgacgtggagcgcggcgcgaaggtctccggctcgcgcttctacttcctcaccggcgtcggcgccctgctggagctggccctggtgaacgcggcgatcgcccaggccaccgcggccggcttcacgccgatgctcaccccggccctggtgcgtccgcagtccatggcgggcaccggcttcctcggccaggccgcccaggacgtctaccacctcgacaaggacgacctctacctggtcggcacgtccgaggtgccgctggcggcgtaccacatggacgagatcatcgacgccgagcgcctgccgctgcgctacgcgggcttctcgccgtgcttccgccgcgaggccgggtcgcacggcaaggacacgcgcggcatcttccgcgtgcaccagttcgacaaggtcgagatgttctcctacgtcgcgcccgaggactcgcaggccgagcaccagcggctgctggagtgggagaagcagtggctgacgtcgctggagctgccgttccgtgtgatcgacgtggcctcgggcgacctcggcgcctcggcggcccgcaagttcgactgtgaggcgtggatcccgacccagggcaagtaccgcgaactgacctcgacgtcggactgcaccgagttccagtcccggcgcctgtcgatccgcgtccgcgacggcaagcaggtcaagccgctcgccaccctcaacggcacactgtgcgccgtcccgcgcaccatcgtcgccatcctggagaaccaccagcaggccgacggcagcgtgcgggtgccggaggtgctgcgtccctacctcggcggccgggagatcctggagccgtcggccaagtgaccgccaccgtctcccggggcgtcggcgagaggtccggcggcctgccctaccggctgatcgcgaccgacctggacggcacgctgctgcgctccgacgactcggtctcgccccgcacccgtgaggcgctcgccgcggccgccgcggcgggtgccgcgcacatcgtcgtcaccggccgcgcggtcccctggacgcggcacatcctcgacgacctcggctaccgcggcctcgcggtctgcggccagggcgcccaggtctacgacgccggggagcggcgcctgctgacctcggtgaccctggaccggcaactggccaaagtggcgctggccaagatcgaggccgaggtcggcccgctgtacctggcggcgagccgggacggtctggacggcgaggtgctggtggggcccgggtacgccctgacgggcgccctgccggccacgccgctcacggacgcctcggacctgtggagcgcaccgctcaacaagatctacgtccagcacccgacactgtccgacgacgaactcgccgatgcggccctgcggaccgcgggcggcttcgtctcggtcaccatggccggcgagggcatagtggagctcctcccgctcggcctgtcgaaggcgacggggctgtcgctggccgcccggcggctgggtctgaaggccgccgacacgctcgccttcggtgacatgcccaatgacatccccatgttcgcctgggccgcccacggagtggccatggccaacgcccacgccgacctgaaggcggtcgcggacgaggtcacggcctcccacgaggaggacggcatcgcggtcgtactggaacggctgctgggctgaggcgcggcccaggggctgcgtaagaggcggccctggggctgctcaagagtcggtctctgcggaggatgcacggatcgaacgtgcgcggggacgaccccgaccacggctcagcgagccggtgccttgcctctcggccaatcctccgggtgggcggcccacgcgacagcgggtcgcgtgctcgaagcggccgccccgggcggggcgggctcgacggagcgggtagtcactccggagtccgccgcgggccgccctgacgggagccgggcgtactgccgtgcatgggcatcgccccgctcctctcccagaacgtggcgccggttcaccccggcgctgcggacctcaccactgtgccgttgcgacgaccgcggc

SEQ ID NO: 699 - DNA, 2247 bp, Unknown
  Kingdom: Bacteria, Phylum: Actinobacteria, Class: Actinobacteria, Order: Streptomycetales, Family: Streptomycetaceae, Genus: Streptomyces
tcacgggcaccggatgcgacgagctggttggacatgccgccgtcgagcacgaccgtcccggcggcgagcgcctcggcgagaccggtacgggtcgcgccgctcgtgccatgcgtcatgccgtgtgccatgcctcgacgctaaccgagcggagcgcggtcggctgttcgataacctgccggggtggtggggatcgtgggacggctcggcatcggcaaaccgcacgcggtggtacggcggttgacgcccgcgccacgccctcgcgcctccggcgccccgcgccgtcgtgtctccgcctgtctgcttgccgccgccctcgtcctggtcacgggcaccggatgcgacgtcatcggtggttccggtgggggatcgggcgcgtccggggcgccccgcaggaccggggccaaggcgtcgaacccgccgccgggcctgcccgcggccttcaccaccggccagcggctgcgctgggcgtcctgtccggcgccgtcttcggagcgggagaaggacgacgctccgggcggcggctgggagtgcgcctcgatgaaggcgcccctggaccaccggcggcccggccgcggcaccatcgacgtggctctgatccgcaagcgcgccaccggaccggacggtgagcgcatcggctcgctcgtcttcgacttcggcggcccgggcgactcgggcgtcatgggtcttcccgagttcgtggacgactacgcctcgctgggcaaccgctatgacctggtgggcttcgacccgcgcggcgtcggcaggaccgcccccgtccgctgcggcaggacggagttcgaggacggcgacgcctgcgagaagtactccggccggatcctgccgtacgtcaccacctcgcagacggcacgcgacctggacctgctgcgctacctcctcggggacgagaagctgaactacttcggcatctcctacggcaccgaactcggcggcgtctacgcccacttgttcccggagaacgtcggcagggccgtactcgaagcccccgtcgacccgacgcaggaccgcctccaggaggagctgagccaggtcaaggccgtccagagcgccttcgaccgcttcgcgcggcactgcgcgcggacgtacgacgacgactgtcccaccggcggcgaccccgcgcaggccgaccggcgcgtcaccgaactgctggacaggctccgggacgagcccgcccgcaccgacgacggcgaggaactcgacgcggacctcgccgcgcacgccatcgccaaccacctggacctcggcgaggacggctggaagccgctggtgaaggccctcgacgaggtcatgcggcggggcaccggcaacgcgctgctgcgcgaggcgtacgaccacgagccgggcgcccgcgccaagcccccggcagccgccgccaccgcccacgacaagacggccccggacgacaacagcgtgtccgcctacgtcgcgatcacctgcgccgactccagcagccgccccggcgacaccgaggccgaggagatgaccgagcggatcgaggcggcctcgcccgtcttcggcgaagcctggtccagcggcgtctacctctgctacgactggcccgtcgagggcgagcgggccgcccccgacgtccgcgcggacggcgccgccccgatcctggtcgtcgcgggaaccggcgaccccacgacgccgtacgcgggcggcgtccgcatggcggccgagctgggtccgaaggtcggcgtcctgctcaccgtacgggccgagggccacggcacctacccctacacccgctgcgtgaccagggccgtcgacacgtacctcctcgacggcacgcccccggcggccggcacgacgtgcccctgacacggacccgcccccgggccgcccgccgctgaaaaccggtaccgcagtcccgccaccgctgacaggatcgcccgcatgacttcgaggatccgccatatgacgatcgactgctccgacgcctacggcctggccggcttctggtcccgggtgctggacctgcccctgcacgacgacgaccacccgggcgacccggaggcactgatcgagggcgcgggcctgctgttcgtcacggtgccggacgccaagacggtcaagaaccgcgtccacctcgacatccagccgcaggaccgcacccgcgacgaggaggtcgagcggctgctcggcctcggtgccaccctcgtcgacgaccgccgccgggccgacggcaccggctgggccgtgctcgccgaccccgagggcaacgagttc

SEQ ID NO: 700 - DNA, 3859 bp, Unknown
  Kingdom: Bacteria, Phylum: Actinobacteria, Class: Actinobacteria, Order: Streptomycetales, Family: Streptomycetaceae, Genus: Streptomyces
ggaccctcgccgctgcgggccggccacggcccgggacagggcgtggaccgcctcgcgtgtgcggccgggtcgcgtgcggtcgcagcgtgcgggtcacatcgtgtgcggtcgcatgccggctctcggtgatcaaggcgcggaagcggtggcgatcgccgcggtggatcgcgaccgtgagctccaggtggggatcctcgccttcctgggcggggagttcgccaccggctggcgcctcgaacccggcgtcctgcccgacctcgccggcacccggagggccgggtcagcggcggctggagaccgcgtagtactgcaggtcctgcacggtgaccgtgcgccgcgccgggtagcgggtggtgacctcggtgacggtgtcgcccgcgcggcggaccacggctctggtgcggccggggctgagcggcaggccctgggcgtgtacgccgacgggggcctggtaggtgcggggcgtggtgcccacctgggcgaggaccgtggcgggcgcggtcaggaaggtgaggacctccacctggtcgcgcgggggcgccgttccggggcgggggcgcatcaggcggggctggagcgcggcgctgtcggtgccggtgaactggacgcgcgaggtgacgtacaccgtgtcgcggacgatgcgcggccaggccccggtcttgaagcgggtgaggtagtaggaggagatgtccaggtaggtgtggccgttgtgcagcgacggagcgaactggctgccctccgagtagtcgttccaggtggtgagctgcacccagtccgcgccgtcggcgatcgcgtggttccacgtcgagcgcagggtggccgtgttgccggcctcgtcgtagacgccctggttgggccgggcgtcctggacggacacggcctgcatccacttctttcccatggtgtgggcgagccggacgtctccggggacgttctcctggcgggtgtaactgcggttgccccaggaggagaaggcgtagctgatcggggcgaaccgttcggcgttggcgcggaagtccaggaagaccgggacgagagcggtcccgatgccccgctcacgcagccgcgcggtgacctggctccaccaggcggggtcctgcgcctcggccttgaacggggagagcaccaggcgtccgtcggcgagccggtacgcggacggtgacgcggcgagcgtggccagcgcgtcggccagggtccgcgggtcggtgtgcagggaggtcatgtccggcatcagcacgatccggaacccgggatcgacgcggtgcgccgcgcgcagcagcaggtcggcgcgctgccggttggggccggtcagggagaggaggtcgacggtgaatccgtcgagaccggcgtcccgtgcggtcctcacctcccgttccagatcggcgagttgccagttccccggggcgggcgggacgggcaggggccggtcccgcaggagtccgccgtaggccgcgtgcctgccctgctcgccctgcggcgtcaggtagttgcgggtgtagtagtcgcgcgcggcgggctggttgtccagggagagcgggtacggcgggaagtagtgcgcgaagaccaggtgcgggctctcgcgcagtgcccgggtgctcggcaggtcgaacgggagcgccgtggcggcgtccggacggccggtgcggggcccggcgctgccccggtccagtgccagtccggtgccggtgatcacgccgatcagcagcaggccgaccacgacgccgagcacggtgcgccgcccgcggcgtgacggcctgcggtgcggatgcgtgagacgagcagggtggtccgtcatgggatttctccgtcagggtgtcgtaccgcccagcaggtcggcgtcgtgcgactggaggtagaggtcgagggcgtcgtcacgcatggcctgccacagtgcggtgccggcgcgggtgtcgaggaggaccacggactggccggatatcatgccggttcccttggcgggagcgttcatgaacaccatgttcccggggcggaccttcttgttgtcccacagcagggcgcgcaggtccctgtcgctgagccggtcgtcgacgctcacggcggcggtgaggtcgtccagtacatcggccgccttgagggggttggagaaggtcgaggggcgcatgaccttcgccatcagcgtccgcaggaagtactgctggcggtgcgtgcggtcgaagtcgccgcgcgggaggtggtggcgctcacgtacgtaggtcagggcctgggtgccgttcatgtggcggcgggcgccgtccacgacgaggtccacgccgccgacggagtcggtgagtttcttgaagccgtcccagtcgatgacgcccagatggtcgacgcgcaccttggtcagccgctgcaccgtgtcgatgagcagcggcggtccgccccaggagaaggcggcgttgagcttggccttgccgtgtccggggatgtccacccacgcgtcccggggcagtgagacgacgtacgcgccggagtggtcggccgggaggtggaccagcatcatcgtgtcgctgcgctgggcaccgtacttccattcgggggccttggcgtcacggccggtggtcggcaggtcggagcggctgtcgacgccgacgaggaggaaggtctgccctccggcggagggcgccggctgcgccgccgccgggacgttcgtcgggaagacgccggaaacacggtcgaccttcccggtgtagtggtcgacggcccaccagacggcaccgcccaccatgagcacgccgacggcgagcagggcgagcgccgccagcaacacccggcgcgcccggctcctgcggcgcctgggccgcgtccgggtggtgccggggtcgccggtctccttctccggaacgtcagtcgagggatcacctgcgccgggcctctgctgtggaacgccggtcgcgggcgcgccggcgtcgtcggccggggcggagcgcaccgtaccggttccgcctgctccttcgtcccgtcttctcctggcgtccgagcccgccggctcggcgccggccgtgttgtcgtcccccaccgcgcacccccacgatcgatccggtgcggccccttccgcaccgggcgctcactgtagccagcacgttcgatgtccgtgccgttttccgccggagcatggtcgcacaggtccaaccggcgtcctccacaggggatttcgtccgtcgcggcacttctcagtgacgttcacgtaaaccctcccatcgtgcacaagtttgccgtactgttcaccatcgcgccgcatgttcgacggatgaacgttcgcgacatccggcgcctcgtgccgcagaacgtgcctgggggggtacatgtgggatgttcaggccgctgattccgacagatcacgcacggcgcgctcgcgggggcgcgcctcgttgtggatggggcgcaagtcccgctggtaccttcccgcttcactgatcaccgacctcgtcggcgccggcgtgccggtggcggtgctgctctccgccacccggcagccgtgggcggtacgcggcgggatcgtcgcggggctcgcctgggcgggcgtccagttgttccgctcgcgctacgcggcccgggccatcggcgagagccggggcacgctgccggtgctgcacgactggttcatcctgctgggcgtgctcgcggtggggcatgccgcggcgggggtccggctggcggcggtgctgtgtctggcggcgctgctgccctgcctggtgctgacgctggtgtgccgcaaggcggtgcaccggcatctggcggcggtacgccgcgaggcccaggcggtgatcaaggtgctggtggtgggcgagcccgccgcggtggacggggtcaccgcgcacctcgccgcccgcaccgatcacccgtacgtggcggtggg

SEQ ID NO: 701 - DNA, 2606 bp, Unknown
  Kingdom: Bacteria, Phylum: Actinobacteria, Class: Actinobacteria, Order: Streptomycetales, Family: Streptomycetaceae, Genus: Streptomyces
acccccgtccgcatgcacgaccagcctgccccgcccgtcccgccagcgtcctgccatgccggggccgccttcccgctccgccgcgaaagttcccgaccgacggtatccgtaggggagcaggcctgccacgggccctcgacggcccgcgaggcggctccgccgggctgggcgcggctgccgtcgcatgaggtgggtgatcgctgggcaggaagcgcgcatgaccggactcggcgctgtcttccgaccgcaactgcctcccgagcggctgcggtcgatcgcccgcctcgccgacgaggcgggtcttgaggagctgtggctgtgggaggactgcttcctggagggcgggatctccacggccgccgccgcgctcgcctggaccgaacgcgtccgggtcggcgtcggcctgctgcccgtgccgctgcgcaacgtcgccgtcaccgccatggaggcggccacgctgcaccgcctcttcccgggccgggccatcctcggtgtcgggcacggcgtacaggactggatggggcaggtcgcggcgcgggccgagtccccgctgaccctgctgcgcgagtacctgggggcgctgcgcgccctgctgggcggtgagcgggtcaccaccgacggccgctacgtccggctgaccgacgtggccctggactggccgccgcccgcggcgagcgaggtcccggtcctcgccggtgccaccgggccgcgcacgctgcggctgtccggtgaggccgccgacggcacgatcctgacctccaccacctccgtggacggggtccgccgggcccgtcggctcatcgacgaggggcgcgaggcggcgggccgcgacgcaccgcaccgtgtcgtcgtgaacctcctcaccgccaccggccccgacgccgagcaccgactgcacgccgagctggccgccgaggggctgcaggccgtgcccggactgggtgtcgccggtgacgcgccggcggtcgccaaggccgtcgaggcgctcgccgacgccggtgccgacatggtggtcctccagccgacggccggtgaaccggacccggagggcttcatccgtttcgccgcccagcaggtgcgcccactggtgtcctgacagcggccgatggtgccctgacagcggccgacgacggcgagaccggccggggcctgcagccggggcctgtaaatgaggcggcggcgcacgcccgtacctgggatgatcaccgccatggcagaccgtcagcaccgctccttcgaggacctcgtggccgaaggggctgccgtgcccaccgagggctgggacttctcgtggttcgcggggcgggccaccgaggcgcggccgtcctggcagtacgccgtgtcgatggccggccggctcgccggtgccgacgccgtgctcgacgtgcagaccggcggaggagaggtgttcggcttcgccctcggccgggccgcgcgcgtccccgcgctgctggccgccaccgagggatggccgcccaacgtggccaaggccaccggcctgctgcacccgcacggtgtggtggtcgtcgccgcggacgcggacgcgccgctgccgttcgccgggggcgccttcgacctcgtcgtgagcaggcaccccgtccgcccgcagtggacggagaccgcccgcgtgctccgccccggcggcacgtacttcgcccagcacgtggggccggccagcgtcttcgaactcgtcgagtacttcctgggaccgcagcccgaggaggtccgtgaggcccgcagtcccgagcgggagcgggcggacgccgaggcggccgggctcgacgtggtggacctgcgggccgagcggctgcgcatggagttccacgacatcgcggccgtcgtgcacttcctgcgcaaggtgatctggatggtccccggcttcacggtcgaggcgtacgagccccggctgcgggagctgcacgagcggatgacggccgacggcccgttcgtggcgcacagcacccgccatctcttcgaggcccgcaagccgcgctgagcggttcgcggcggtcggcgggcagtcacagttttcacatcgttatctccgttccctcccgtcactgctccgtctggcgtaagttcagaccaacgaaattcgcgtgagcaaagctgcgcgagtggcatcgcgcagtggagggggctgcgcggcgccgtggcccctgatggcggccaccgcgccccgtccggccgtacgcgacccggagcgccgtcggcgtcaagcgggtgtgaacgacggggtcgcccgggaggggtacgcgaggacaactcgccgcgcgcccctcagatggcgcaaaccctgcggatccggtctcattcggcccgatttccctgtgaattcgctgtgatccggccatgatcgggcagggaatggcaggttccgcgctcgctctcgcgtcgccgggcgattccggagagtagttgtggcgcgctgatgcacgcagcatcacttacgaagggttatggtggaaaccccccctcgggccggtccgtctcccccccacggaccggcccgtttttcttgccgtctcttcccgcctcttcccgcctcttcccacgtcctcccgcccctccctgttcctttccgcggcgcatgcgcccgcgcaccg

SEQ ID NO: 702 - DNA, 645 bp, Unknown
  Kingdom: Bacteria, Phylum: Actinobacteria, Class: Actinobacteria, Order: Streptomycetales, Family: Streptomycetaceae, Genus: Streptomyces
tcctcggagaaggagtacgagtagaacatcgactcgacgtcgcaccgggctcccgggtaccggttccagtaccaggtgccgccgacatcgtcaccccgctcgtagacccgtacccggagccccaggtcgtcgcgcaggcggtgcaggaggtacatgccggagaacccggcaccgatcacgatcgcgtcgtacttctgagtggtccgcatggtgcgccaccccccttctcccggcgacgctgccgggggtaggccatgtcgatcaccagcagcatcccggagcctgtgacgtgcgtcatgggacaggtggcgcgggtggagcgccatctgtcccgtccagggggaagaagtgtccggagtcctgcagtcgccgcaggacgagagcgaggaagagacgcggacggccgtacggctcggtgaagctgaagcccatgtagcgctcggcgcgctcgacccggtgggtcaccgagttgtggtgccggtgcagcaggcgtgccgccttgcgcacggactcggtggcggcgaccgcctccaggcagaccagcatgtcctcgccgtactcgtcgaccaggcggttgagccggcgtacgtcggggacccgtgcgatccgctcggcgctcagggtctcggcgagcacggcgtgtcc

SEQ ID NO: 703 - DNA, 3147 bp, Unknown
  Kingdom: Bacteria, Phylum: Actinobacteria, Class: Actinobacteria, Order: Streptomycetales, Family: Streptomycetaceae, Genus: Streptomyces
  misc_feature (2636)..(2637): n is a, c, g, or t
ctccggaggggtggcgccggtgggcggacgaggcgttccacccgccgcagccatggcggcagttgctcggcgcggcggtccgctccgctgcgagcgcgccgggcgtcggcgaggaccacagctaccggcgtccgtcccggcgttcggccggtctgcccggcgtgatcctgccgagcctgcgccgtacgccgccccgggtctgcgtcgtgatcgacacctcagggtcggtgagcgacgcggaactgggcagcgcgctgctggaggtggcggccatctcgcgggccgtgggcgggcggcgcgacctggtctcggtgatctcctgcgacgcggcggcagggatcgccgtgccgctgtgccgcgccgagaacatcgaactggtcggcggcggagggacggacctgcgctccggtttcggccgcgcgctccgttcccggccgcgcccggacgtgatcgtcgcgctgacggacggtcagacaccgtggccctccgcgcagccgccgtgccgtaccgtcgtcggcctcttcccgccttcgggccgtgccgtggacgaggaggaccccgattacgtcccggacaccccgccgccctgggcgcgtgtcgtcaccatcgggtgaggggccgtgcggaggagcgccccggtgtcaccggacgaagcgtgaggcgcccagattcaccaggtgaccgacgaggctgatctcgacaccctccgccgtggaccgtggaccgtggaccgtgggtcgtgggagccgccccgggggcgtcagtaggcgcgcgccaccacggccacgttccccggctggtcgtcgcgctcggggaccgagccgtccgcggcgaccaggcagcgtacggacacaccctgttcggccagccgggcctcgccctccgggcccagcgcggcccacgggatccgcgcccacccgctgcccgcggcctccacggcctccgcggccgtcgacacatcggcggtacgccgctcacggcgctcccgggactgcgccagcagcagcgcctggtcgtccgcgagcaccttgggcaggatctccggcagcgccgcgatctccgtcggctccttcgtcccggcgatccggcgcaccaggacggcgctgccgtgcgccaggtcacgcggcccgacctcgatccgtaccggcacgcccttgagttcccagtcgacggcgcgccgcccgaacggcgtgtcggtgcggtcgtcgacgtgcacgcgcacgccggccgccttcagccgttccccgatcgcgcgcacctcggcgagtaccgtgtcgtcgcccttgacggccacgaccaccgcctgcaccggggccagacggggagggacacgcagaccgtcgtcgtcaccgtgcatcatcaccagcgcgccgaccatccgggtggtggagccccaggaggtctgccacacgtactcctgcgtgccgtccttcgacaggtaccgcgtctggaaggccttggcgaagttctggcccagttcgtggctcgtggccagctgcagcgccttgccgtcacccatcatgccttcgagcgtcagggtgttgatcgcgccggcgaaccgctccctggccgtcttgcgtcccggtacgacgtccatggcgaggatgttctccatgaagtcgccgtagacctcgcggtggatgtgcgcggcgtagtcgcgggcgtcctcgtaggtggcgtgggcggtgtgtccctcctgccacaggaactccgtcgtccgcaggaacacacgcggacgcagctcccaacgcaccacgttcgcccactggttgatgagcagcggcaggtcgcggtagctctgcacccacttggagaagtagtcgttgacgatcgtctcggaggtggggcggacgacgacgggctcctccagctccttgccgccgccgtgggtgacgacggccagctcgggagcgaagccctcgacgtgctcggcctccttcgtcaggtacgactgcgggatgaagagcgggaagtacgcgttggcggcgcccgcctccttgatccgggcgtccatctgctgctgcatccgctcccacaggccgtacccgtacggtcggatgaccatggtgccgcgcaccggtccgttgtcggccagttcggccttgccgaccaggtcctggtaccagcgggggaagtcgtccgcccggggagtgagcacgggtgcctttgccatgcgccgcaggctatggcgcggtccgcccgcacgccagcagattacgtcgtccgtcgcggctgctgtcggtgccggcgccgttgtcgccgtgggcgtcgatggcgccgtcgccttgcggcgagtgacatgagtcacaggttaagggcccttaaggggcaagatcaccgcatgcgcgttatgtggcgaactgtcccagttgacgcccggtttgagcgtcggtcaagctttcggcgtcttgaggccccccattccgcagtcggggctgcttcctcctccggagtattccttcgtggaacgccatgcctaaggagtccgatacccagtggaatcccagccctgcgagaactgtggattcgcgcatggctccgcgtcggagcatgcctttctctgcccggcccgttcctccggaaaccctgtctccttcggcaaccctgcctcctccggaaaccctgtctccttcggnnccgcggcggcctggcgggggccgcgggaacaggacatcgaactcttcgactcgaccgtcccgctgccgaaaatacccgcgcccgcgcccggaaacgtgcccgcacaccggtcgaaggcgcggccgaggacacggtccagggcccgagcgaaggacccgtcgcagagcctgacgctcgcgctgaccctcgtcgtcggcctgagcgccgcgctgacggtctacctggtcggcggcagacccggtgaggcgcgggcgcgggtattttcggcagcgggacggtcgagtcgaagagttcgatgtcctgttcccgcggcccccgccaggccgccgcgggcgcggagacgttcccgaggacaggatttccggagacgacagggtttccgaaggagacagggtttccggaggaggcagggttgccgaaggagacagggtttccggaggaacgggccgggcagagaaaggcatgctccgacgcggagccatgcgcgaatccacagttctcgcagggctg

SEQ ID NO: 704 - DNA, 5139 bp, Unknown
  Kingdom: Bacteria, Phylum: Actinobacteria, Class: Actinobacteria, Order: Streptomycetales, Family: Streptomycetaceae, Genus: Streptomyces
gtccggggcggggaggcggtcggaggggccccggtcgccgccgaagccgccctcgccgcggacgaagatctggttgcgctgggtcaggagcggttcgccgtcctcgtcgaggagggtggactcctggacgacgacggcggcgctgcccttgtcgtacacggccgggatccgggtgagcgtggtcgcccgggccgcggtgggcagggggcggtgcacggtgatctcctggccgccgtgcagcacggcggccaggtcgatgtccacgccgggtgtgtcgaacacctggaagcccactcccccggtgccgccggccaccacgccgaaggtgggcagcacctgcaggccctgctcgtgtccttcgtggacgtagcggagttcgcccgggtcggtctcggggacgcccgcgcccagggccaggtggtagaggcgcacgtcgcggtcgtcccagaccgcggcggcacgtacgggcggggcggaggtggccttgtcggcgtcgatcggcatgggggtgggtttccttcgtgctcggtcggcggcggcgccggctcgtcgtgcggtgcgcgaaccgtgctcagtgcgcggctgtgctcaatgcgaggctgtgctcagtgcgaagccggcccggttcgcggccggactcagttcgagaacgtgccggtggcgtagcggctgcggaagtacagcagcgggcgcccgtcctcttgggcggcgaggtcgaggacctcaccggtgacgatgtggtggtcgccggcctcgtggacgtcggccaggcggcagtccacggtggccagggcgccgtcgaggcggacggtgccgtgctcggtgacgctccagggcacgccggtgaacttgtcgggtccgctgcggcccagtgcggcgcaggtgggctgctggtcctcggcgaggatgttgacgcagaagcggcccgcgcgctcgatcctcggccagctggtggacgacctgccgacggccagcatgaccagcggcgggtcgagggagagcgaggcgaaggactggcaggcgaagccgacgggctcgccgccgtccaggcccgcgaccaccgtgatgccgctggcgaagcggccgaggacgtcccggaagacggccgggtcgatgtgcggtccgttcagccgttccactggtggccccagaagctgtcggcggtgatctccttggcgacccaggtggcggggtcgacgaccagaccgtcccagccgtactccacctggaagccgccgggcgcctgggcgtagaaggagaccatgtggtcgttggtgtgccggccgaggctggaggcgatcgggatgccggcggcgttcatgcggtccaggccgtgaccgacgtcgtcgagggtctccagctccaccatgaagtgcacgatgccgggcggcagcgcgcccgggtacaggcccaggctgtggtggcggccgttggggctcaggaagtgcatccagtggaagtcgcgctgctcggcggcggtcgggacggcctgcggcggcagcttcatcgagtcgcgcagctggaagccgagcacgttctcgtagaagccgagggcggcgtcgatgtccggcaccggcaggacgacgtgaccgagaccgaggtcgccggtgacgaagcggttgccgtacggcgtgccgagcggggtgtggtcctgggcctggccccagtagatctccagcgggttgccgcaggggtcggtgacgtggatcaggccgcgtacgcggcgctcggcgagttcggcggcgtcggcctgcttgacggggaagccggcgtcctccagctcgcgggcggcctcgtcgagggcggcggcgccggcgacctcccagccggccgcgagcagccggtcgctgtcgccggtcttgatgacgatgcgctggatgcggtcgtccatgcgcaggcagagggtgtcctcggtggtgccggacgcctccaccatgccgagcaggtcgagggcgtaggtgcgccattcggcgagtttggtggtctccagacgcaggtagccgagagcacggatgtccatgggtcgcctttccgggccaggtgggagacggagtctcctgggtcagtgcgagaagaagtcgagggcgaggcggttgaactcgtcggcctgctcggcctgcgcccaatggccgcagtgcgggaagacgtgcaggcgggcgtcggggatgttcttgagggcgaccagcgcgccgtccagggggttgacgcggtcctcgcggccccaggtgagcaggacggggtgggtgatccggtgggcctcgcgccagagcatccagtcctcggcccaggcggggttggcgaaggcggcccccatgcgggcgccgccgagccgggtgtcggggtcggtggccgaggcccagcggtcctcgaccagttcgtcggtgacgatcgactggtcgtacgccatcacgctgaggaaggaacgcagttggtccttggtcggctcgggggcggcgttgaactcgaagagccgcttgatgccttcggtggggtcgggggcgaagaggttgacggagatgccgccggggcccatcaggaccagcttgccgaccttgtccgggtggttcagggacatgcggacgcaggtgccgccgccgagggagttgccgacgaagtgggctcgggcgatgccgagttcgtccatcagagcggccacggcgccggcgctgtagctgaagtagtccttgtcgagctcgggcttgtccgagcggccgaagcagggctggtcgaccaggagggtgcggaagtgctcggcgaagacggggaggttggcgccgaagttggaccagccggaggcgccggggccgccgccgtgcagcatgatcacgaccggtgcgccggcgtcctgggggccggcctcgtggtagtgcagggtgagtccggcggccttcacggtgcgggaggtcgattcccgggtcagttctgccatctggggcacctctcaggccatggagtcgtggatgtcgatgccgagcgcggcctgcccgaacatcaccagagcccgctcggggtcgttggcggcgtggccgcggccggtgtgggcgtcgcgccaggcgcgctggacggggccggggccggtgcgcatggcgttgccgccggagttctccatcagcagatcgagggcggcgacggagcgctcggtggcgagcacctggtcacggcgggcgcgggtgcgcagggccatggtcagctcctcgccccgcgcggcgaggtcgtacatctcggcgatgttccgggacagctggagccagctcgcgtcgaggtcgctggcggcgcgggcgatgcggacctgcgcgaacggatcctcgacgaccttctgcccgtaggagacgcggaaccgcttcacggtggcctcgatgtaggactcgtaggcgccctcggcgatgccgacgatcggggtggagatggtggtggtgaacacggcggcgtacggcagccggtacagcggctcggggttgatctcgtggccgggcacctgcagtgcggtcacgggaccgaagctgagcgcgcggtgttcggggacgaagacgtcctcgacgacgacgtcgttgctgccggtgccgcgcaggccgacggtgtcccacacgtcgtcgatgcggtactcggagcgcgggatcaggaaggtgcgcatgtcgaccggggtgccgtcggcgtccgggacgaggccgccgagcagcgcccagtcggcatggtcgcagccggaggagaagtgccagcggccgctgatgcggaagcctccgtcgaccacggtcaccttgccggtgggggcgtaggaggagcagatgcgggtcttcgggttctcgccccacacctcctgctgagcccgcgggtcgtacagggcgacgtgccaggggtggacgccgaccacggaggcgacccagccggtggagccgcacgccttggcgatctccttgaccgccgcgtagaagacggcggggtcggcggcccggccgccgaagggcttgggctggagcagctggaagaagccggtctcctcgatctccttgatggaggtctcgggcacgcggcgcaggttctcggcctcggccgcgcgctcgcgcaggccgggtgcgagggcgcggatcgcggccagtacgtcttcggccatgaacttcccctttcgggtggtcgtggtggcggaagtgccaggaccgtacgccccgctgttccggaacgaaatacctggctcccgctgagcgggaaggagcggcggcccgggggccgccgtgtctgctgctactgcttttgctgttactgctgctgcgcgaggtgcgcggcggcgaggtgcgcgaagaccatggcggagccgatcggcgcgcccggaccggggtaggcgggtccggagacggaggccgtggtgttgccggccgcgtacaggccgggtacgcaggtgccgtcctcacgcagtacgcgggcgtgggtgtcggtccgtacgccgcccttggtgccgaggtcgccgaggacgatctggacggcgtggtagggaccgttctgtaggggaaccaggcaggggttggggccctggccggggccccggtcctggtcctggtcctggccctgggcgaagaagaggtcgtaggggtcctcgccgcggtggaagtcggcgtccgcgccgtcggcggcgtagcggttgaaggtgcgcacggtgctttccagggccgccgggtcgagtccggtgcgggcggcgaggccgtcgatggtgtcggacgtgtgccacaggcccgcctcggtgaaggccttgcggtcggcggggacgacggtgatgccgggcagttcgtcgccgaagcggccgtcgaagatccaccagaccgggtcgccgggggtcgttccggccttggcggcgagcatctggcggcccatgcggtcgtacggcagtgactcgttggcgaagcggcggccggagccgtcgacgaagatgccgccgtgcaggccgagggtgaaggcggcggagccgtcggggaagcgcagcgaggggcaccaccaggcctggtcgagcagggcggtggcggcgccggcctcgacggcggcgaggagggcgtcgccggtgttgccgccgggtgcgcccatcgtccagtcggcgccggacaggccctgccaggtgcgcctcagctcggcgttggcctcgaagccgccggcggc

SEQ ID NO: 705 - DNA, 3060 bp, Unknown
  Kingdom: Bacteria, Phylum: Actinobacteria, Class: Actinobacteria, Order: Streptomycetales, Family: Streptomycetaceae, Genus: Streptomyces
ctcctcggtgaggaccggcgcgtccagctccaggccggccagcgaccaggttcccgtgcagatgtacgcgaaccgctcgccggtggcgggcaccgcggccaccgcggacgccgtgtcgtgcgaggcgaccgtggtgaccggcaccggtccggcgagcccggtctcctccagcacaccgggccgcagcagccccgccggatcgcccggccggcgcagcggcgcgaacaggccgaggtcgatcccgagccggtccgcgacctcgtacgaccactgccgcgtgcgcgggtcgacgagctgggtggtggaggcgttggtcagctcggtgccctcctcgccggtcagccagtacgtcagcaggtcggggatgagcagcagccgccgggccgccgcccagcgggccgtcgaacgggcggccaccaactggtagacggtgttgaacggggcgtactggatcccggtcgccgcatacagtccgtcggccggcagtgtcgcccacaccttctcggcgacgccctcggtgcgtgcgtcgcggtagtgcaccggattgccgagcagcgcgccgtcggcgtccagcagcccgtggtccacggcccagctgtcgatgccgacggagtccaccgcacccgccgcccgcagtccgtccagcactcccgcgtacagcccgagcacgtcccagtgcaggccctcgggaaggcgcaccggacggttggggaagcggtgcgcctcggtcagctccagggtgtccgggccgacgcggccggccatgacgcgcccgctggaggcgccgaggtcgaccgcggcgtacgtccgtgtctgcgtgctcaccgcaggaaggcggcggcgacgccggcgtcgaccgggacgtgcagtccggtggtgtgggtcagttcgccgccggtcagcgcgaagacggcgttggcgacgtgctcgggcagtacctcgcgcttgagcagggtgcgctgggcgtagaactcgccgagctcgtcctccgggactccgtagacggcggcgcgctgcgcgccccagccgcccgcgaagatcccggagccgcggacgactccgtcggggttgacgccgttgacgcggatgccgtgttcgcccagttcggcggcgagcaggcggacctggtgggcctggtcggccttggtggcggagtaggcgatgttgtggggtccggcgaagaccgcgttcttggaggcgatgtagacgatgtcgccgcccagtcgctgcgcggtcatcacccgggccgcctcgcgcgagacgaggaaggagccgcgcgccatgatgtcgtgctggaggtcccagtccttcgcggaggtctccagcagcggcttggagatcgagattccggcgttgttgacgacgaggtcgacgccgccgaaggcgagcacggcggcccgaaaggcggcgcggatctgctcctcgtcggtgacgtcgacggtgacggcgagggccctgtcgccgccgccgagttcctcggcgacggcggccgcgttcttggcgtccaggtcggcgacgacgacgcaggcgccctcggcggccagccggtgggcgatggcccggccgatcccgctgcccgcgccggtgaccagcgcgatacgggtggccagcggcttcggctccggcatccgccggagcttggcctcctccagcgcccagtactcgatgcggaacttctccgcttcctcgatcggcgcgtaggaggagaccgcctcggcgccgcgcatcacgttgatcgcgttgacgtagaactcgccggccacgcgggcggtctgcttgtccttgccgaaggagaacatgcccacgcccgggacgaggacgatcgccgggtcggcgccgcgcatggcgggcgagccgggctcggcgtggcgctcgtagtaggcggcgtactcctcgcggtacgcggtgtgcagttccttcagccgggcgacggcctcgtcgagaggggcgccggcgggcaggtcgaggaccagtgggcgcaccttggtgcgcaggaagtggtcgggacaggaggtgccgagcgcggcgagcctcgggtgctcggcgcgggacaggaagtcgagtacggcctcggagtcggtgaagtgaccgacctgcggccggtcctgcgaggcgagcgcgcggacgtacggtgcgagggcggcggcgcgctcacggcgctcggcctcgggcagcggctcgtagcccgcggtcatcgccccgaacggctccggcctgccgtgcgcgtccagaaaggcctgggcggtgcggatgatgtacacggagttgcgctcgcactccttcgaggtgtcgccccaggcggtgatgccgtggccgccgaggatgcagccgacggcctgcgggttggccgccttgacggccgcgatgtccagtcccagctggaagccgggccgccgccagggcacccacaccacacggtcgccgaagcactcggcggtcagcttctccccgtcggcggcgcaggccagcgcgatgccggagtcggggtgcaggtggtccacgtgcggggcgtcgaccagtccgtgcatcgcggtgtcgatggagggcgcggcgccgcccttgccgtgcaggcagtagtcgaacgcggcgaccatctcgtcctcgcgctccacgccggggtagacgccggtgagcgcccgcagccggtccagccggagcacggcgagcccggccccggtcagggtgccgagatcaccaccggatcccttcacccacatcagctccacctcacccccggtcacgggatcggtgccggtgcccttcgcggacgcgttgccgccggcgtagttggtgttacggggatcggcaccgagccgatgggaacggtcgaggagagcggaggcctcggggtgaacagccatgtctgtccagtcctttcaaacagagaagaagtggagcgcccccgaaggggcgcggggaaccgcgcgatcaaccacgaacgagccgcacccggcaacgcaccgaaacccggcacccgcgccgccgcagccaggagcccggcacccgcgccgccggagccaggagcccggcactcgcgctgccggagccaggagcccggca

SEQ ID NO: 706 - DNA, 14886 bp, Unknown
  Kingdom: Bacteria, Phylum: Actinobacteria, Class: Actinobacteria, Order: Streptomycetales, Family: Streptomycetaceae, Genus: Streptomyces
  misc_feature (158)..(300): n is a, c, g, or t
cgtctgggcccagaccccgccccccgagccgtcgggcaccacccagtacctgccccacggcgaggacccccgcaccacacagttcgtgggcgtggacgacctggtcacccactccgccgaggaacagcacgagccggacgccttcgcccacctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacatgggcgggtacccgccggccgagccgccctccgtgcccggccccgcaccggcccccgtcgccggccagggcccgatggggccgtacgcccctgccccggtcggtacccggaccgccaccgagacgcccgccgccgcgcccgccccggccgcgaagaagggcggcaaggcatcgggtctgctgaagtcgagcgccgtgatggcggccggcacgatggtctcccggctcacgggcttcatccgctccgcgatgatcgtctcggcgctgggcgtcggtctgctcggcgacaccttccagatcgcctaccagctgccgacgatgatctacgtcctgaccgtcggcggcggcctcaactcggtcttcgtgccgcagctcgtccgcgccatgaaggaggacgacgacaacggcgaggcctacgccaaccggctgctgaccctcgtcatggtggcgctgggcgcgctcaccgtcgtggcggtcctcgccgcgcccctgctgatccgtctcctgtccccatcagtggcgggcgacccggcggccagccaggtcggcgtcaccttcacccgctacttcgtgccctccatcttcttcatgggcatccacgtggtgatgggacaggtcctgaacgcgcgcggcaagttcggcgcgatgatgtggacccccgtcctgaacaacatcgtcatcatcgtgacgctcggcacgttcatctgggtgtacggcaccgctgcccactccggcatgggcgtggcgaacatcccgccggagggccagcagctgctcggaatgggcatcctgctcggtctggtcgtccaggccctggcgatgatcccgtacctgcgcgagaccgggttccggctgcggctgcgcttcgactggcggggacacggactcggcaaggcagccgccctcgccaagtggactctgctgttcgtgctcgccaaccaggccggcaacgtcgtcgtgacccggctgtccaccgctgcgggcaagacttcaccggtggacggcaccggctacgccgcctacgccaacgcccagctgatctggggcctgccgcaggccatcatcaccgtctccctgatggccgccctgctgccgcggatctcccgctcggcccacgagaacgacaccggcgccgtccgcgacgacatctcgcagggcctgcgcaccacggccgtcgcgatcgtgccgatcgccttcggcttcgtctccctcggcatcccgatgtgcaccctcatcttcggctcctcgggcaccggtgaggccaccaacatgggctacatgctgatggccttcgccctcggcctcatcccgtactccgtccagtacgtcgtcctgcgcgccttctacgcctacgaggacacccggacgcccttctacaacacggtcatcgtggccgcggtcaacgcgggcgcctccgcgctgtgctacttcctcctcccggcacgctggtccgtcatcggcatgtccgccgcgtacggtctcgcctacgccatcggcgtgggagtcgcctggagcaggctgcgcaagcggctcggcggcgacctcgacggctcccgcgtcctgcggacctacgcccggctgtgcatcgccgcggtaccggcggcactcgtcagcggcgcggcctgctacgagatcgggcacacactcggccagggcgtcgtcggttcgttcgccgcactgctggccggtggcgccctgctgctcggcatcttcttcgtcgcggcccgccgcatgcggatcgaggaactcaactcgctcgtcggcatggtccgcggacggctgggacgttgaggcgggggtaggcgcacaaccatcgtccgtcgccgtgtgtcgtgcatagcgccggactgtgggcacaattggtctcggcgtcggacagcgcgatggatggggaggcaggagcgacggtggcggaacggagcacggctgccgtcgacgtggcagacaacagcggtgacgagccgctgaccgcggaggcggaccagtccacggccgacggggtggcccagaaccgggagcgggacacggacatcgaccaggcgcaggggaacggcgggaccgaacgtcccgggaagaagaccacaccgcccgaactgcacagcggtcacaaactggccagacgctaccgtctcgaggaatgcgtcacccgactggacggattcagcagctggcgtgcggtggacgagaagctccgccgcgccgtcggtgtgcacatcctgcccgccgaccactcccgtgcccgctcagtcctggcagcggcgcgctcctcggcactgctcggcgacccccgcttcgtccaggtcctcgacgccgtcgaggagaacgacctcgtctacgtcgtccacgagtggctccccgacgccaccgaactgaccaccctgctggccgccggaccactggagccgcacggcgcctaccagttggtcagccaggtcgcctccgcgatggccgtcgcacaccgcgaaggcctggcccacctgcgcctgaatccgaacgccgtgctgcgcacctccaccggtcagtggcgcatccgcggcctcgccgtgaacgccgcgctgcgcggtatcagctccgagaccccgcagcgctcggacacggaggcgatcggcgcactgctgtacgcggcactcacccagcgctggccctacgagaacgacgcctacggtctgtccggcctccccaaggacatcggtctcatcccgccggaccaggtgcgcgccggtgtccaccgcggcctgtccgagctggccatgcgcgctctcgccaacgacggcgccaccgcctcgcgtcacgagtccccgtgcaccacgccggaggagctggtgaaggcgatcggtgagatgccgcggatccgcccgccggagcccgcgttcaccgcgccgccggagtaccaggggacgtcgtaccagcagggcacgtacggccgcccggcaccgcgtcccggcgtcacccagccggtgccggccccgccgcctcccttgcagagccggaccggcaaggccctcaagtgggccgtctcggcgcttctcatcgccgctctgggtctgggcagttggcagctcgccgacgccctgatggaacagggcggcaagtccaccaaggacagccagacgcagacgcaggacggcaacgacaagaaggacgagcagccgaagcccctccagccgatccagatccagggggcgcaggaattcgtcgccaagggcgacgcacagcaccccggtgacgtcggcaagacgtacgacggcaacccgtcgacgtactggaagacgagcaccttcgtggaggggccgcctctcgcgcccttcaagccgggcgtgggcatcgtctacgacctcggctcggtgcacgacctcggcaacgcgttcgtgagcctcctgtacggcggcgaccacacgacggtccagttgtacgcggcggattccctggcgccgggttccctggactcgatgcagaagatcggtgaggccacgaccagcggtgtcaccgccgcggtgaaggtcgccaagccggtgaagacccggtacgtcctcgtctggctcaccgccgtgccgtactcgggcgccgacgcgagtacgtacagcaaccccggctacaagcaggccatcaccgaagtgaagttcaggggctgacgtctcaccgacggggagggggtccgatggcggacgacagcgcctaccgcgacgcgagcgaccaggacctcctgtcccgccacgtggagggtgaccggaacgccttcggtgaactcgtacggcgacaccgcgaccggctctgggcggtcgccctgcggacgctgggcgaccgtgaggaggccgccgacgccgtgcaggacgccttcgtctccgcctaccgcgccgcccacaccttccgcgggcaggccgccgtcaccacctggctgcaccggatcacggtgaacgcctgtctggaccgggtccgcaaggcggcctcgcgcaagacctccccggtggacgacaccgagcgcctggagcacctgctggagccgcacgagtcggcctccgcacccgccgagaggaacgacgtgcagcggcagctcgtcgaagcgctgggcacgctcccggccgaccagcgggccgccctggtcctcgtggacatgcagggttaccccgtcgccgaggccgcgcggatcctcgacgtgccggtggggacggtgaagagccgttgtgcccgcggcagagcgagactgctgcccctgctcacccatctccggccggacggctccggcgacggcgaggaaccggaggccggacggaaccggacgcagcgggcatccgtcccaccggcagcgggtcctccgggcgggggcgcgcggaagacggggccaggcgattcagctgctgtgaagggcggaggtgggcgagcgtgacatccacgacggacacggccgggcacccggacgtctcggagatctccgacctcaccgaaggactgctccctccctccaggaccgaggaactccgtcggcacctggcgacgtgcccctcatgtgccgaggttcggacctcactggaggagatccggagtctgctcggcgcgttccctgtcccggagaagatgccggacgacatcgcgggccgtatcgacgccgctctcgccgccgagccctccttcaccgccctcgccgccgccgtcacggaagcggacgaggaacgaggtgagggtggaggcgaggacgacgggatcgatgtttcacgtgaaacatcgacgacgcaccggcccgcaggcaacgtccgcacttctcgcaccggcccgggacgcaagccccggccacgccgtggacgccgtggggtcgccgtcctgggcgccgcctgcgccgtcgccgcgctgggtgtcgctgccgtggtcctcaccccccagcacgacggcacaggagccgacaccgctgctcgcgcccagtcgagcgcggccacgcggaccttctccgaaggaacccttgagagccaggtgacccgcctcctcgacaaggcaccgcgtgcgcagagcacgccccgcaccccgcacagcttcggtgcgaacgccgaggccggcaccggcaccggcaccggcaccggcaccggcaccgaccagccgaacaccctgaagagcgacccggccgccccggttccctcatgtgtccgccagggcatccacagcaccggtaccccgctcgccgcccagccgggtacctacgacggcaaggacgcctacctcgtggtgctgtccgacccctccggccccggctcccaggtcaccgcctacgtggtggacgcctcctgcgtccacagcccttccaccgcggccagggttctcctgtcgcacccctacacccgttcctgagcgcggcttcctcgaggcagccaccttgcctccacgctgtgtgcatttccctgcgtcgcggcctccgtgtgcccggggacgccgggaatgcacgccccttaggatccgttgggtggggtgagagcaccgagagaagctccaccggccgtaggacacagtccagagacgaggaatcaagccgtgagcgacgtccgcaacgtgatcatcatcggctccgggcccgccggctacacggcggccctctacaccgcgcgcgcgtcgctgaagccgctggtgttcgagggcgccgtcaccgcgggcggtgcgctgatgaacaccaccgaggtggagaacttcccgggcttccgcgacggcatcatgggccccgacctcatggacaacatgcgggcccaggccgagcgcttcggtgccgagctggtgccggacgacatcgtctccgtcgacctcgccggtgagatcaagaccgtcacggacacctcgggcacggtgcaccgggccaaggcggtcatcgtcaccaccggctcccagcaccgcaagctcggcctgccgaacgaggacgcgctctccggccgtggcgtctcctggtgcgccacctgtgacggcttcttcttcaaggaccaggacatcgccgtgatcggtggcggtgacaccgcgatggaggaggccaccttcctgtcgcggttcgccaagtccgtgacgatcgtccaccgccgtgacaccttgcgcgcctccaaggcgatgcaggagcgcgccttcgccgacccgaagatcaagttcgtctgggacagcgaggtggccgagatccagggcgagcagaagctctccggtctgaagctgcgcaacctcaagaccggcgaactctcggacctgccggtgaccggcctgttcatcgccatcggccacgacccgcggaccgagctgttcaagggccagctcgacctggacgcagagggttacctgaaggtcgagtcgccctccacgcgcaccaacctgaccggcgtcttcggtgctggtgatgtcgtcgaccacacctaccgccaggccatcaccgccgccggcaccggttgctccgccgctctggacgccgagcgtttcctcgccgctctcgcggacaacgagcagcaggccgagcccgagaagaccactgtctgaacccccgaccgccccaccgcacgcacgcgaagaaactcgcaggcgaagaaactaaggagcccgccgtggccggcaccctgaagcaagtgaccgactcctccttcgagcaggacgtcctgaagagcgacaagcccgtcctggtggacttctgggccgcctggtgcggtccctgccgccagatcgccccgtccctcgaggcaatcgccgccgagtacggcgacaagatcgagatcgtcaagctcaacatcgacgagaacccgggcacggccgccaagtacggcgtcatgtcgatcccgacgctgaacgtctaccagaacggcgaggtcgccaagaccatcgtcggcgcgaagccgaaggccgcgatcgtccgcgacctggaggacttcatcgccgagtgacgcgcgccgccgggagcggcggtgcgatgtttcacgtgaaacatgaaggggccggcctgtcagggccggccccttcggtgtgccacgggctcacagcggcgggagcgcgattcacagaggtcggagcgcgggctccttctgcaccgctccgaggagccggtcgagggccatctccacgtcttccttccaggagagggtcgatcgcagctccaggcggagccggggatgagcgggatggtgccggaccgtcttgaagcccaccgccagcaggtggtccgccggaagcacacaggcgggttccttccagcgggcgtccccgaaggcctcgacggccttgaagccgcgtctcaggagatccttggcgaccgtctggaccagcacacgccccagcccctgcccctgatagccgggcatgacgaagccggtcatcagctggaccgcgtccggtgacaccgggctcgtggggaacgccgtggagcggggcacataggcgggcggagcgtagagcacgaagcccaccggcacgtcgtcgacgtaggcgacccgaccgcacgaaccccagtccagcaggacggcggagatccacgcctccttctcggaggcgggcgtgcccgctctcaccgcggcctcgccgctgaccgggtccagttcccagtagacgcacgcacggcagcgctgaggaagatcatggaggttgtccagtgtgagcggcaggagcctacggcccatgaaggctgatcctcgcttccttcgcccgcagcgtcacgagcggccgtccctcacggacgggccgtcgggtggatgcgtcatacccgaatgcatcgtatccgcgatgtgattccgcggacaccgagtacaagcaaaggcgggccgtgtaccggtgatcctccggttcacggcccgccttgcggagttcctggtctgccccggccccgcggagggctcaggcgtccgtctcggtctccgccgggtcgccctccagtagacccttctgcagcacccggccctcgccgggagccagcgtgccgaggatgcgttccagatcttccatggaggcgaattccacggtgatcttgcccttcttctgtcccaggtcgaccttcacccgggtctcgaagcggtcggacagacgcgtcgcgaggtcggacagggcgggagagacccttgccccggcacgggggcccttggcgcgcggcgaagcctgcggccgcgagcccatgagcgtcacgatctcctcgacggcccgcaccgagaggccctcggccacgatccggtgggcgagccggtcctgctcctcggagtcctcgaccgagagcagcgcccgcgcgtgtccggcggacagcactccggcggcaacccggcgttgcaccgccggggacagcttcagcagccgcagggtgttggagacctgagggcgggagcggccgatcctgtcggccagctggtcgtgggtgcagtggaagtccttcagcagctggtcataggcggctgcctcttccagcgggttgagctgagcccggtggaggttctccagcagggcgtccagcaggagcttctcgtcgtccgtggcccgcacgatcgccggaatggcttccagtcccgccttgcggcaggcccgccagcggcgctcgcccatgatcagctcgtagcgctcggcaccgacctgccggaccaccaccggctggaggagaccgacctccttgatggaggtgaccagctcggccagcgcctcgtcgtcgaagacctcacggggctggcgcgggttgggcgtgatgaagtccagcgggacttccgcgaaatgggcgcccatcggcggtgggggcagcatggccaccttggcggcggccactccgcggtcggacgtcagtaccgggccggggcttgccaccgggcctggcacgggggtcctctccgtgggagcggccgggatcagggctccgaggcctcgccccagtccaggcctccgtcgctcgctcactggatcccctccaccatgctcgggtcgctctgtgcgccggtatgggcgtgcgtggcgtcatagctgatgcccacacccctcaatgcgatttctcgtgccgcctcaaggtaggagagggcaccgctcgatcctggatcgtaggtcagcaccgtctgcccgtagctgggggcctcggagatacggacggagcgagggatgctcgtccgcagcacctcctcgccgaagtggctgcgtacctcgtccgcgacctgggacgcgagacgcgtccggccgtcgtacatggtgagcaggatggtcgacacgtgcaacgtggggttcaggtgtccgcgcaccaggtcgacgttgcgcagcagctgtcccagcccctccagtgcgtagtactcgcactggatcgggatcagcacctcctggccggcgaccagggcgttgaccgtcagcaggccgagcgagggcgggcagtcgatgaggatgtagtccagcggctgctcgtaggcctggatcgcccgttccagtcggctctcccgggccaccagcgacaccagctcgatctccgcaccggcgagatcgatcgtggcgggggcgcagaagagaccctcgacgtcaggaacgggctggaccacctctgccagaggcttgctctccaccagcacgtcgtaaatggacggcacttcggcgtgatggtcgatgcccagcgcggtggaggcgttgccctgcgggtcgaggtcgaccaccaggacccggccgccgtgcagagccagcgaagcggcgaggttgacggtcgtcgtcgtcttgccgacgccgcccttctggttggcgaccacgatgacgcgggtctgttcggggcgcggcataccctcgccggcgcggcctagagcctcgaccgccagttgggcagcgcgaccgatgggagtgtcgtccatcgggggcggtgtttcacgtgaaacattctcccccgtcgactcggtacggggaccggggaccggatcggtcatcggtcccgcgatgttggcgtcggaccgcaaggattcactctcctcgacttcaggctcgggataagcagagcctcccatgccatcggggtgacgaaccagtgaggcctggcgttctgtggagaaatccgcctctgtggacaactctgtgccctctccgagtgaaccgagaggcttgcggtcacgcggttgggccgcaacgcggccacggttgatgatgccgtgcagcagtgagcgacgtttcacgtgaaacacgatgacaacaattcgccctttttgtgagcgacactccgccgcgcgcctgtcggcaaggtccccccggcgcaagtgagcccggcggagtgaacggctcaccgcctccggcgggctcgccccgtccgggccgccttggcacgcttggccgcgaagcgcacgccgcccgggctctcgccgacctccacacggaccacggtggacagcggatccaccaccccgtcacccacctgcaggatggaggtctccaccgcgccgagcttgctcaacgcggtgcccgcgctcttcagctcctcctccgccgtgtcccccttcagggcgagcatctcgccgtagggacgcagcagcggaattccccaggtggccaaacggtccagcggagccaccgccctggcggtcaccacatgaaccggcggaagcttgcccatcacctcctcggcccgcccccggacgacggtgacgtggtcgagccccagcagctcgacgacctcggtgaggaaggtggtgcgacgcagcagcggttccagcagtgtgatcttgaggtcctcccggaccagggccagcgggatgccgggcagaccggcaccggagccgacatcgcacacggtcaccccttcggggacgacctcggagagcaccgcgcagttcagcaggtggcgttcccacaggcggggcacctcccgcgggccgatgagccctcgctgcactcctgcctcggccagcagctcggcgtaccggaccgcatccgcgaagcgatcaccgaatacgtcacgtgcctgctcgggcgcaggggggagttccgctgcctccgtcacggggaccgtccttccgtaccgcatcagcgcgatcagcgccgaccaccagaactaccaggctgacaaagttcggccccgcctgcgggcagacggggccggtggaacgtgggaccgctcaggcgggcagcacgacgacgaagcgctgcggctcctcgccctcggactcgctgcgcagccccgcggccttgaccgcgtcgtgcacgaccttgcgctcgaacgggctcatcggcttcagccgcaccggctcaccggtgctcttggcctccgccgcggccttcgcacccagctcggacagctcggtgcgcttctgggcacggtagcccgcgatgtccagcatcagacggctgcggtcgccggtctcccggttcacggccagccgcgtcagctcctgcagcgcctccagcacctcaccgtcccgtccgaccagcttctgcaggtcacggctgccggcgtcactgatgatcgagacagaggcccggtcggcctcgacgtccatgtcgatgtcaccgtcgaggtcggcgatgtccagcagaccctcgagatagtccgccgcgatctcgccctcctgctccaggcgggtcagggcgtctgcaccctcggcagcggcggaggtggtgccttccgtcacgggatgggctccttcttacttcttggacggggacttgggccgctgcgggcccttgcgctgaccggactgggccttgctgcgggtgccgttccccggcttggagtcgggcttcctggcagcagcgggcggggtgtcctgcggcgcgtcggtcttcgtctcggccttggtctcggacttggtcagcgacgggggctgctcggcatcaccggcgtcaccggcgcctgctgccttggcaccgccctggcgctgggccttggtctgccgcttgggctgctgacgccggggagcggcgccggccgtggtggtggccgtaccgtcctcggtctgcacgacgacggcgctctcgcccttgatcaccgtgccgtcggactgggccgccaggccggccttgttcagaccgttcatgaacttgcgctcgaactcgttgcggtcgcggcccttggagacgatcgccttgacgatggccttctcacgccggttgcgggtcttgccgtggtgcgtgacgtgcttgtacagacgctccaggtaggcggcctgggccttggaacccggggtcgggttgttgtggatgacgtacatctgctggcccatggtccacacgttggtggtcagccagtagacgaggacaccgaccgggaagttgataccgaagacggcgaacatgaccgggaagacgtacatcagcatcttctgctgctgcatgaacggcgtcttcaccgtggtgtcgacgttcttggtcatcagctggcgctgcgtgtagaactgcgacgccgacatcaggacgatcatgaccgcggtgacgacacggacgtcggtcagcgtggcgccgagctgggcgaccttgtcggcgctgtccgtgaacttcgcggccagcggggcaccgacgatgtgcgccttacgggcgctggccagcagcggctcgttgatgacgccgatcgtcttgccggtcgcgatggcgctcagcacgtggtagagggcgaagaagaacggggactgcgccaggatgggaaggcacgaggagagcgggttggtgcccgactccttgtacagcttcatcatctcttcggactgacgctgtttgtcgttcttgtagcgctcctggatcttcttcatctccggctggagcgtctgcatcgcgcgcgtcgccttgatctgcttcacgaaaagcgggatcaggcagatgcggatcagaaccaccagggacacgatggacaggccccaggcccagccggtgtcagccccgaagatcgccccgtacaccgtgtggaactggacgatgacccaggagacgggccaggtgatgaaactgaagaagctggcaatcgtgtccactaatcatgctccttgggcatgggacgaggtcttcgcggccgggctggacgggaggtccccgtcggtgaccggctcggcggcggagggcccgcccttgcgcgcacgccaggcggcacgcagcatttcgtgccaccgcggacgcttgcgcggaggaacgtggtcaacaccacccagcgaccacgggttgcaccgcaggatgcgccaggccgtgagcgccgttcccttgaccgccccgtgccggtcgatggctgtgtagccgtagtgggaacacgatgggtagtacttgcacaccggcccgagcaacgggctgatggtccactggtacagcttgatgagagccagcagcgggtacttcatcgcgcgccccctcccagcagtcgttgaagggcggcatccaggtctcgggccagctgtgcgtgatcggcgtcgcccgctccaggtagcgctcgtacgactaccaggctaccggggggcagaagtgcgacccggtcgcgcatcagatggcgaagtctgcgcttcaccgtgttccgtacgacggcgccacccactgccttgctcacgacgaaacccgcacgcgtcgggggagcgctctccccaggcgcgtgcgggtccgtggcaccgctacgaaggtggacgacgagcagcgggcgtccggcccggcgccctcgtcgtaccgcggtcgcgaagtcctcgcgccgcctcagccggttgtcggtgggcagcacgacgtcatgacctgatcgggatcaggcggacaggcgggcgcgacccttgctacggcgggacgcgagaatcgcgcggccggcacgggtgcgcatacgcagccggaagccgtgggtcttcgcgcgacgacggttgttcggctggaaggtgcgcttgctcactcgggggctccagaaagaatcgggtagtggcgggtgccgtcttggctgtcaccgtgcgcccacgagtagctcgcagtcacgcccgtgtgcaccgcttgaccgatcaccttgacgcgatcagtgcccttcggaggcaggcggcagcagccatcgacaactcgacctggttacggtacgcgcggctaggccatccggtcaaaccgcacagcggcagtccagacttgtccacagcctggggacaacaacttgaacggtacccgccgcgctgactaccgtgggcggactcccattcgttcccttgtcccccgtttacatcccgacccgtcccgaaccacacgttcgtgggaccccgtgagagagcgtgccctgtggctgacgtacctgccgatcttgccgcagtgtggccacgcgtactggaccagctcctcggggaaggccgcggccagggcgtcgagacgaaggacgagcagtggatcctccgctgccagccgctcgcactcgtcgccgacaccgcgctgctcgcggtgccgaacgagttcgcgaagagcgtgctcgagggccgcctcgccccggtcgtgagcgagacgctgagccgtgagtgcggacgcccgatccgtatcgcgatcaccgtcgacagctccgtcggcgagacgcagccccccgcgcccccggcgccggcgccgcgctacgaggaacaggaactgcccaccggccagggcggatacgagagctacggacgccaccggtccgacgcccaccgcccggaccgcaccgaccttcaccgcagcgaccgctccgaccgctccgaccgctcggagcg

SEQ ID NO: 707 - DNA, 8679 bp, Unknown
  Kingdom: Bacteria, Phylum: Actinobacteria, Class: Actinobacteria, Order: Streptomycetales, Family: Streptomycetaceae, Genus: Streptomyces
ggggtggcctcggccgaggcccacgagccgccgtacccggagcggttctcggtgccggaggcgtcggcccggctgatcaacgaggtgcgggcggcgggcggccgggtgatcgcggtgggcaccacggcggtgcgggcggtggagtcggcgaccggggccgacggggtggtccgggcggcggccgggtggaccggtctcgtggtgacgccggagcgcggtgtgcggggcgtggacgggctgctgaccgggctgcacgagccggcggcctcgcatctgctgatgctggaggcggtcgccgggcgggcggccgtcgcccgcacttatgaggaggccctgcgcgggcactacctctggcacgagttcggcgacgtgcacctcatccttccggaggagagcactcacccactgcgttgcgatggcaaccaatcgtgaggaagccgctcccgcgatgtgaggacgcgcatagggcgcacatcacgtacgaaggggcataggagagaacgctcccctgatgaacgggacagacatccctgtctgtcccgttttgtcgtttcctgatccactacctggcttcgtacgtcacacctttgctctcagattttgcggccgctaagaattgctctcgtcgctcaacgccgcgggtttccgcccacggcgttcgtgtgggaaggaccccctcccgcagtccggagagcgacctccgcgctactcgaagaggtccatttcgccatgcccgcaaacttccgtctgctccgccatagtcgtgccctgacccgcacccacaaggtcgccgtcgccggtgccgccaccctcggtgccgccgctctggccttcaccgccgtccccggtggcgcccacaccaccacgtccgccgacgccgtcgcggccccggtgcagttcggatcgcagccggtcaaggccgtccaggccggcgtcaccgaccagctcgccggcagcagcgtcaagatccaggccatcgcggccaagcaccaggccgccgtgaagcacaaggccgaagcgaccgccgccaagcacaaggccgaggccgccgcccgccacaaggcgcaggccgcgcaccaggccaagaaggccgcctcccggtccgccgcgcgcccgcagatgcagacggtcgccgccaccaccagctacggcaacaacctcgacggctggatccgcaagtcgctgtcgatcatgaagcagcacaacatccccgggtcctacagcggcctgcaccgcaacatcatgcgggagtcctcgggcaacccgatggccatcaacggctgggacgtcaacgcccgcatgggcatcccctccaagggcctgctgcaggtcatccagccgacgttcaacgcgtaccacgtccccggcacgtcctcgaacatctacgacccggtcgccaacatcaccgccgccgccaactacgcggcccaccgctacggctcgatcgacaacgtcaacagcgcgtactgacctgcgggggtcggcgcggacctctgacggcacagcgcggaagggcggcacccggtgtgggtgccgcccttcgtcgcacggcgcgcgacccgcggctcacagtccgcgcggcgcaggcgtcatgcgcgtcacttgcgcatgacctccggctcgtgccggcgcaggaagcgcgccaccaggaaaccgcagaggacgccgagcacgatcagcgcggccatgtcgatcccccaggccgaggccgtgtggtcccacagcgggtcggtgctggtcgggtcgtcgaggttcggggagatcttgttcaggtccagcgtggtgccggcgcccgccaccgcccagcgcgacggcatcaggtacgacagctcgttgacgccgagcgtgccgtgcagcttgaacaggcagccggtgaacacgacctggatgatcgcgaacatcaccagcagcggcatggtcttctcggcggtcttcaccagcgaggagatcaccaggccgaacatcatcgaggtgaagcccagcgccatgatcggcaggcacagctcgaacagcgtcgcgttgccgaggatcagccccttgccagggatgtcacggctggagaagccgatcaggccgaccagcaggccctgcagcaccgtgatcacaccgaggacgacgaccttggacatcaggtacgccgaccgggacaggccggtggcccgctcccgctcgtagatcacccgttccttgatcagctcgcggacggagttcgcggcgcccgcgaagcacgcgccgaccgccaggatcagcaggacggtggtcgccgtgccgttcggggtgggcaggtgcgtcctggagttgatcgggttgaccagcaggcccttgtcgtggtcgatgagcaggctgaccgcgccgagcaccgccgggaggatcaccgtcagcgcgaggaaacccttgtcggaggcgatgaccgacacgtaccgccggaccagcgtcagcaactgcgaaccccagccctgcggcttgggcggcttgatggcctgcggcgggggcatgctcaccgactgcggggcgaccgagtcgatgtccgcggcgtacatctggtagtgctgcgagcccttccagcggcccgcccagtcgtagtcgcggtagttctcgaaggcggagaagacgtcggcccagctgtcgtagccgaagaagttcagcgcctcctcgggcggcccgaagtaggcgacgctgccgcccggcgccatcaccaggagcttgtcgcagatcgccagctcggccaccgagtgggtgaccacgaggacggtgcggccgtcgtcggcgaggccgcgcagcagcgtcatcacatcgcggtccatgcccgggtcgaggcctgaggtcggctcgtccaggaagatcagcgacggcttggtgagcagctccagggcgaccgagacgcgcttgcgctggccgccggagagcgaggtgaccttcttgtccttgtggatgtcgagcttcagctcgcgcagcacctcgtcgatgcgcgcgtcgcgctcggcgcccgtggtgtcggacgggaagcgcagcttggccgcgtacttcagcgccttcttgacggtcagttccttgtgcaggatgtcgtcctgcgggaccagaccgatgcgctgacgcagctcggcgaactgcttgtacaggttccggttgtcgtagaggacctcgccctggtcggcgggccggtagccggtgagcgccttgagcagggtggacttgccggaaccggacggtccgatgaccgcgatcagggacttctccgggacgccgaaggagacgtccttgaggatctgcttgccgccgtcgaccgtgaccgtcagatgccgggcggagaaggacacctcaccggtgtccacgaactcctcgaggcggtcgccgacgatccggaacgtcgagtgaccgacgcccacgatgtcgctgggaccgagcgtggccgagccgcccttggtgatcggctggccgttgacgtacgtgccgttgtgcgagccgaggtcgcggatctccatgcgcccgtcgggcatggcgtggaactccgcgtggttgcgggagacctgcaggtccgagacgaccaggtcgttctccagggcgcggccgatgcgcatcacgcggccgagcgagaactggtggaaggtggtcgggctgcggtctccgtgcaccggcgacgcccccgcgccaccaccggggccctgctgctgcgggatcgaaggctgctgctgtgcctgctgcggctgctgccagtcggcgtgcgggctctgctgcgcggccggcggctgcggcgcctgctgaccgccccagccggcccccgcgccctgcgcctgcgcggcgtagggctgctgctgcggctgggcctgcggcgtcgggacggccacggcggcggccgagaggttcaggcacgggccgtcggtggcgttgccgaggtgaacggccgagccggggccgagctccgtctgctggacccgctgcccccgcacgaacgtaccgttggtgctgccgtggtcctcgatcacccaactgctgccgttgtggcggaccgtggcgtgacgccaggagaccctggcgtcgtcgaatgcgatgtcaccctgcggatcgcggccgagggtgtaggccctggacggatcgagcgtccaggtccgtccattggtttccagtacgagttccggcactccaagccccactgagttgtcccccgaattacccccgtcgcggggagtctagggatgtcgaacatcgtgaggaactattccaggctcagccctctgaccgaaagccgggccttgtcatgagtaggtaacgcacgctcgccgcggagggcgcccgcgcgctcgaaatccggccggagggtggcattcccgcccgagcgggacactcggcgaaccctccggtggcggcactcggtgccggaggcgcggtcactgcggcctacgtcgtgtccggcttcgggcggggagggggacggagggcgtgcagagggcgtgcagaggcgcacgccgccgtcgagatcgcgccactgcgggcggcctgcgggcggtcctgaccggacggagggcggctggcaccgggtgacgcgaagaaggtgggtgccgtggcgcgtggcgtcttcgccacgggctcgccctgcggggtgcctcctccggacggtggggcaccgtgggactgaggggcaccgcgggacggaaggccgtcgcctgacggaagaccgacgccggacggaagaccgtcgccggactgtccgccaggcggacctgaggggcaggaggcactgggtgccggatacggtggaatcaccatgagcgcttcgcagagttccgatgacctcacgcttctcgtcaagatcttcgggaaggacaggccgggcatcacggccggcctcttcgacaccctcgcggcctactccgtcgacgtggtcgacatcgagcaggtcgtcacccgtggccgcatggtgctgtgcgcgctcgtcacccagccctcccccggcctggagggcgacctgcgggccacggtgcacagctgggccgagtcgatgaggatgcaggcggagatcatctcggggcggggcgacaaccggccgcgcggcctcggacgctccctggtgaccgtgctcggtcatccgctcaccgccgaggccaccgcccagatcgcggcgcggatcaccaagaccggcgggaacatcgaccggatcttccggctcgccaagtacccggtcacggcagtggagttcgccgtgtccggagtggagacggagccgctgcgcaccgccctggcgacggacgcggcggccctgggagtcgacgtggcggtcgtcgcggcgggtctgcaccggcgggcgcagcgcctggtcgtcatggacgtggactcgacgctcatccaggacgaggtcatcgagctgttcgcggcgcacgccgggtgcgaggacaaggtcgccgaggtgaccgcggccgcgatgcgcggggagctggacttcgagcagtcgctgcacgcccgcgtggcgctcctggcggggctggacgcctcggtggtggagaaggtgcgcagcgaggtgcgactcacgccgggcgcgcggaccctgatccgtacgctgaagcggctcggttaccaggtcggcgtggtctcgggcggtttcacccaggtcacggacgatctgaaggaacggctcgggctggacttcgcccaggccaacacgctggagatagtcgacgggaagctgacgggccgggtcacgggcgagatcgtcgaccgggccggcaaggctcggctgctgcgccggttcgccgccgcggcgggcgttccgctggcacagacggtggcgatcggtgacggtgcgaacgacctggacatgctgaacgcggcgggtctgggggtcgccttcaacgccaagccggtcgtccgcgaggccgcgcacaccgcggtgaacgtgcccttcctcgacacggtcctgtaccttctcggtgtcacccgcgaagaggtcgaggcggcggacgcccacgaggaacgctgagcgtgctgagccctacgagcagcgctcagcgtcacgagcgcgctgagcgccaggcacagggctgagtcgagtgccaggcgcagggctgagcgccacgaacggcgctgaggccccgcgcgcagccgccggaccggaccggccaggcccgcctggaccgcaccccggacgcgggcatcaacctgggccgcaccctggacgcgggcatcagcctggccctggacctggaacggcttcagcctggacctgaggccgagacaagctgtggcccgatccgccgcctcgacctgagcccccgctagtgcttggctcggagcccggagctgagccctgggcctgagccggggcttggtcctgagtttcgagtcaatgtttggccctgagccggagccccaacttggccctgagcttgagccgcaacttgccctgcttgagccaatgctcggccctgggccgggccaatgctcggcccgtgggcttgagccgcggccggaacctaggcccgagccagagccagcccagggcctggcccctggggcctagccgaggcttgggcctggcctgggccgaggcttgggccttgggccagagctggaacctggacccaagcccgagcctgccccccggcccgagcccggagccgggacctgcacccgcgcctgcccctcgacccgagcccggagccgggacctgggcccgcgcctgcccccaacccgagcccgagcctgcccctccgcactaatcgaaaccgcccctggatctcagacaagccaggcccggcccggccacagcacgggcaggtcggttactccgacggcgcccagtagtcggccagcgtggccacgcccggctccagggccttccaggagccgtcgaaggagatgacggcgaaggccgcggccgggaagccacggcggctcagccgctcgcgggcgtcgccctcggccgcaccggacagcacctcggtcagcccctggatgccggggttgtggccgatcaggatggcgttgcgcacctcgtccggcgtttcgttgagcacggtgatcaactcgccgggcgaggcgtcgtagatccgctcctcatagacggttttcggccgctccggcagctcgtggacggcgagcttccaggtctcacgggtgcggacggcggtcgaacagagggccaggtcgaacacgacaccggtgtcggcgagcttgcggccggccaccgccgcgtccttgcggccccgctcggccagtggtcgctcgtgatcggccacttgtggccagtcggctttcgcatgccggaagaggacaatcctgcggggttctgcgacgctcatggaacccagcttcgcacgaaacaggccatgaggcgcagggagttgacaggcgggcgccgcgcgtggcgggtccggtacggaccggcgtcggcgctcgcgggcggggccgtcggctcagcggccgagcacctcctgcgcgcgctgcaggagctgggcgatcgcggggtcgccggtggccgcatgggcgttcgacgggttgagtatgagggcgagcagggcgacgaaggcgagggccggcagggccagagcccaccacggcaggcggatctcgacgccgcccgtggtcgccgggtggctccgggtgtgcgtacgggccgacatgttcgcctccactggtcgccgctgactccgagtgctccgcggaccgccgctcgcggtcacaactcgaaggtacggaaccagcgcgccgaggcctatccggtgatccacccactggaccctgacccgcaccccctaggggatggggggctagccctaccccgtggccgtgacggaggcgcacgaagcgctccgggcaggatgccgaaggcggacagcgggccggagccggccagggtcagggagagatgacggtcgcgacgacggcgatgatcacgaagatggcgaagaacgagccgaagaccagcagcatcttcttgtggctgtccttcgggttcgggtcgagcacaggctgcatgaccccagtttcgcaccctcgccccgcacgaaggcgccgggggcgcctcagcgcgtcacctcgtcctccacggtgcggtcgcggcctgccacccagcccaccaccatctgggggaccatgagcgcgcacatgagcgcgatgggcaggccccagccgccgctgctctggttcaggacgccgaccaggagcggtcccgggatggagatcaggtagccggtgctctgggcgaaggccgacagctgggccacgcccgcgccggtgcgggcgcgcatgccgaccatggtgagggccagcgggaaggcgcagttcgagacgccgagcagcacggcccaggcccaggcgccgccggccggtgccaggtacaggccggcgtatccggcgaggccgcacactccgagcgcgaggacgatggggccctggtggggcagccgggtggccaggcgcgggatgacgaaggccagcggcacgcccatgaccatggtgacggcgagcagcagtccggcggtgccggcggagactcccgcgtcacggaagatctgcgccatccagcccatggtgatgtaggcggcggtggcctggagtccgaagaagacggccagggcccatgcggtacggctccgggtgatccgcagcgccggcgtctgctcgcccgtggacgccgcgcccgcggacgcctgctccgtctcctgcggtgcttcctgccgtacggcg

SEQ ID NO: 708 - DNA, 10424 bp, Unknown
  Kingdom: Bacteria, Phylum: Actinobacteria, Class: Actinobacteria, Order: Streptomycetales, Family: Streptomycetaceae, Genus: Streptomyces
ccctcctgaacgcggacttccgcaccgcagaggccggccacctgctcatgctcgaccgcccgcgcgaggtcgccgacgcggtcctcggggcggccccgcaccccagccggcacagccgctgacacgcacgcgcgcccgccccccggaagaggagcgggcgcgtggccggtgcgggcgtgggtcagtgacggcgacggtaggagtcgacgtagcccttcgcgggcgagccgacgccggtgacgtcgtcgtaacccttgacggcctggagcgagctgtccttgccgaggctgcggacggagacgctcagaccgccggtggcgtcgatgccgttgacgaagtcgacgcgcgcgaccgcgaggtccttgccggtcggcttgtccacgacgtcgtggtacagcttcgagccgtacttcgagtagatcgacgggttggcgaagccgatcgccttgccgccctgcgcctgctgggcgagggcctggacggccgcgatgaccggcgcggccagcgacgtgccgccgatgcggtactcggcgtactgctgcgacccgtcggggaaggtctgcgtctggccgacgaggaagccggtgttcgggtcggcgatggccgcgatgtccgggacgacgcggttgccggcggcgttgttggcggtggccagcgcgcccgggacgacgcccttctggtagtacggctgcggaacggtcttgctggtgccgccgcccgcgcccgaggtgtaggcgccggggaaaccctcccagctcttgccgtcggccgacagggtcgccttgtcggtgccccagccggtctcccacaggtacttgtcgcccttgccgacggccagcgaggtgccgccgaccgcggtcacccacgccgagttggccggggtgtcgacctgcttcgtgccggtgttggcgacctcgtcgccgttgtcaccggaggagaagtagaagccgatgccctccaccgcgccgaactggaacacctggtcgtaggcggcggccaggtccggcgtctggttggcctcgatgtcgccccaggagttggagacgatgtcggccaggtggttgtcgacgaccttgctcagcgagtccagcaggtcgtcgtcgtagcaggaggcggcgcccacgtaggtgacgtccgcgtccggcgcgaccgcgtgcacggcctcgacgtcgagggtctcctcgccgtaccagccggcggccccgcactcctcggtcttcgtgtactgcgcggggagcacctggtgcagctggctcgtcctccacgccttgtcgccgttcttcttcgcgtacgcggccgcgtcgaaggcgatggtcggggaggcgtaggcgtcggtgatggcgacgcggacgcccttgccggtgtacttgcccgcgccgtacgccgcgcgcagctgcttgcccgtgtagcccttgacggcgtacgggatcttctcgccgtaggcggacggcagcgtcttggcgacgttcgagccgtagtacgtggagaacggcccggagttcttgaacaccgcgtccggcggcggcagctggtccttgtggtcggacttgtgcggggcgttgtccaggccggtgacggtcaggaccgtgctccgcaggctcgccggcacggacgccgtcctggccggcgcgcggtaggtcttcgcacccttggcgaagttgtgcatctgggtgccgaacgccttctcggcggcggcgacgtcacccgagacggcgacgtagtgcgcggtgaccgaagtgaccttcagacccgccgacttcagccacgacttgacggcggacacctgagcctcggtcgcgccgaagcgcgcctgcgcctgctcggcgctcaggtacttgccgtactgcggggaggacgggtcggcgaccgccttggcgtactcggccaggcccgcggcgtcgcggccggccaggtacacgcgggcgttgacctgggcgctgtccgaggtggcgcccttgtccgccttggccgtcgcccacgcgggcttggtgcccgcgatcgcgttgcgggcgtccgggtggcccgcggcgtgggccgcgggtatgccgagcaccagcgcaccggcgaccatgggcagtgtcgctgccaggctcactccggtacgcacggtggcgcggttggatctcatataaccccctgcgatgcggatcgcatgtaacgcaatgagtggttggacctcgcgtgacccgcgtgacggccgcggcggttcggcccctgaatggatcacacgatcgagtgccactcttcccgaagaaccgttcatgccaggggaatgggcaggccaagagaagcccaaggaaccgtcaggagcggtgcatagcacatgaattgcgctcttcgttccccggattccggtcgcccgtggtcaggaaacgggcgtcggacgaacgcccggcgctgcctgacgggccgtcgcaccacgcttcttgagcatgtccgccatgagcgcgatctccgactgctgcgcgtccaccatgccctgggccagccgcttctcggcacccaccgtgcactggacggcgcacgcctgcgccatgtggatcccgccccggtgatgggccgtcatcaactggaggtagaacacctcggccggccggccgcggagcccgccgagcctgcgcagctccgtgtcggtggccataccgggcatgagcgcgccgtccgcaccggttccgtcggccgcggcgccgcccgcccccattcccatccacgccatcgggggtttcgccgacaccttcgccagcccccacaggtcgagccaacccagcagcatgccgcgctggttggcctgggtctgcgcgatgtcgtaggcgaggcggcgcacttcggtgtcgtccgtgcggtcgcggacgatgtacgacatctcgacggcctgctggtggtggacggccatgtcccgcgcgaaaccggcgtccgcggaatcggcggccggtgcggtgagggcggccggtgcggtgagggcggccggtgccgtggcggccgggccggcccccgggcccccggacccgccgcgtgcgccgtcgacgctggtgccgtccgcgcccgcggtgaacccggaagccaatcgccccggcggccaccagcgccgtggcgacggcacccgcgaccagcccggcgaccctcactggcccacgccacccgtgcaggcggctcccggctccggcgtctgggggccctggacgaacgcggcgaagaacgcgtccacgttcgggtcgtgggcgcccgtgaccgtgcgctggtgcgcccacgccgacagcatgatcgggtccttctgaccggccaccggactcatcagcgtgtacggcgtcctgcgcaccttcgccgcgagcgcgtccacgtccgccttgggcgccttggcgttgtacgtcacccagaccgcgccgtgctccagggcgtgcacggcgtgctcgttcttcagcggcgcggtgtagacgtcgccgttgcagttctgccagacggggttgtggtcgccgccgaccgggggctccatggggtaggtcaccggggcggtggtgtgggtgcggccgagcgtgccctgccaggtccgcacgccgtccgcaccggtgacgaagtggccggaactccccttgccgccccggccgttcttgccgttctgctcgtccttggcgctcttgtcggtcatgccgctcggtgccggtgcggccgcggacgtgctcgcccgcgcgaccggttcctcgtcgccggaccgcgactggacgagcaccacaccgccgacgaccaggcccgcgacggcgaccacgctcgccgcgaccacgagggcgcggtcgcggcgctgccgggaccggtcggcacggcgcatctcctcgatgcgcgccttgcgctgcccggcggcggtgctgtccggcttgtcggcggagcccatggcggagtccttcgtgtcacggtcggatggagcgctggcgggaaccgacgtcgggagcagacgtccggaacagacagcggagcgaggagcgggtgcgcgctgatggtaatgggagcggtgggactcgtgggagacccggaagcgccagaggcgaacgcgcgccggagatgagaggcagaagtgagcgccagataagttgaaccgctgatgcgtattatctaggcttgccgcatgcggctgctgcgctccaccgacatggcgctgcgcgtcctgatgaggctcgccgtcgcgggcgagtccagccccacgacccgggaggtcgcggcggacatgggcgtgccgtacacgcacgccgcgaaggtcgtcgccgaactccagcaccgcgggctgctcgccgcgcgccgcggccggggcggcggtctgaccctcaccgaggcgggccgcggcgcgtcggtcggcgcgatcgtgcgcgccctggagggcgagggagacgtcgccgactgcgagggcgcgaacccctgcccgctgaactccgactgccgcctgcgcggtgccctgcgccgggcccaggaggcgttctacgccgctctcgacccgctcaccgtcgacgacatggtcgccgccccgacgggtccgctgctgctgggcctgccgagcgcgcgccggtcggcggccgactgacgccgaccggtaccgggttctggacgccgaccggtacggggatctgaccgggaccggcggcgaggcgaacgcgaaaagccggccggaggtggtcgggggaaccacctccggccggcagctttcatgccgggccggaccacaccggaccggaccagagcggtccgcgccgcgttcgggcagcgcagccgccacggccggcagcagtcagtcagccgtcagtcagccgtctggccgcctcggtggcctccttggccagccacaggtccgggccgaagacctcgtagtggatgtcggccgcggccacacccttggcgaggagctgctcgcgcaccgcgcgcatgaacggcagcgggccgcacaggtaggcctgtgtaccggccgggacctcgacgtcggcgaggtcggcgaagccgggccggccggcgcccgccgcgtcctcgtcgtactgctcgtagaagaaggccgtacgcgcgtccgccagcttggccgcgtacgcctcgtggtcgttgcgcagcgcgtgcgtggcgggggagcggtcggcgtggacgacggtcaccggggcgctgtggccggcgtcggcgagctgctccagcatggcgatcatcggggtcacgccgatgcccgccgaggcgagcagcagcggcgcgctggtgtcctccaggacgaggtcgccgtagggggcggacagctggaggacgtcgccctcgcgcacgtgggcgtgcaggtggctggagacctcgccgtcgggggtcgtggcgttggcgctcacccgcttgacggcgaactgccgctccggggagccgggggccgcggtcaggctgtactggcggatctgccgggcgccgtccgcgagggtgacgccgacggagacgtactggccggcgcggtagccgggcactggggcgtcgtcgacggggcgcagcttgaaggtggcgacgtcggcggtctcgtcgatgcgctcgacgaccttccactcgcgccagccggtctgctcgctctgcgcgtacagccgcttctcgatggcgatgagggcgttggccatcagccagtagacctcggtccaggcggcggcgacctcgggggtcacggcctcgccgaggacctcggcgatcgcggcgaacaggtgttcgtggacgatcgggtactgctcggggacgatgccgagggaggcgtgcttgtgggcgatgcggtgcagcatcaggtcgggacgctggtccgggttgttcaccaggtacgtcgcgaaggcggcgatggagccggcgagggcctgcttctgggcgccggaggcctggttgccgcggttgaacaggtcgcgcagcagttcggggtgggcgtcgaacagcttggcgtagaacagctcggtgatctcgccgatggcgccgccgacggcgggcagggtggcgcggacggtggctgctgactgctcggacagcatcgttggactcctcgaaggctcgaccggatcgctcgacagttcgatcgctcgactgctgtgaacggtagtgaaacttgcatctgagatgcaaattaaacgggcgtggtctcgctcacgtttccttcacatgccgtgcacgcgggtaccgcttcggccattacgagggggccgctcaggaggcaagatgggcggcagggcagcacaccccgaagaggcggcgcggccgggcgcacagaagccggacgatcaaggtccgcaacgcgcgtgaaacgctgatgtggtgtgatgctcgcgtgcccgaccgcctcccgtgacgacatacggacacaggcggcctgaccagcaaggatggggaagcggaagatggacaagcagcaggagttcgtgctccggacgttggaggagcgcgacatccggttcgtacgcctgtggttcacggacgtgctgggcttcctcaagtccgtggccgtggcccccgccgagctcgagcaggccttcgacgagggcatcggcttcgacggctccgccatcgagggcttcgcgcgcgtctacgagtccgacatgatcgccaagccggacccgtccacgttccagatcctgccgtggcgcgcggaggcccccggcacggcccgcatgttctgcgacatcctcatgccggacggctccccgtccttcgccgacccccgctacgtcctcaagcgcgccctcgcccgcacctccgacctcggcttcaccttctacacccacccggagatcgagttcttcctgctgaagaaccgcccgctggacggctcccgccccacgcccgccgacaactccggctacttcgaccacacgccgcaggccatcggcatggacttccgccgccaggcgatcaccatgctggagtcgatgggcatctccgtggagttctcccaccacgagggcgcgccgggccagcaggagatcgacctgcgctacgccgacgcgctctccaccgccgacaacatcatgacgttccggctggtcatgaagcaggtcgcgctggagcagggcctccaggcgaccttcatgccgaagccgttctcggagtacccgggctccggcatgcactcccacctctccctcttcgagggcgaccggaacgcgttctacgagtccggcgccgagtaccagctctccaaggtcggccgctccttcatcgcgggcctgctgcggcacgcggcggagatctcggcggtcaccaaccagtgggtcaactcctacaagcgcatctggggcggcagcgagcgcacggcgggcgccggcggcgaggccccgtcgtacatctgctggggccacaacaaccgcagcgccctggtccgcgtcccgatgtacaagcccggcaagaccggctcggcccgcgtcgaggtccgctcgatcgactccggcgcgaacccgtacctgacctacgccgtcctgctggccgccggcctcaagggcatcgaggagggctacgaactcccgcccggcgccgaggacgacgtctgggccctctccaacgccgaacgccgcgccatgggcatcgaacccctcccgcagaacctcggcgaggccctcaccctcatggagaacagcgacctcgtcgccgaaaccctcggcgaacacgtcttcgacttcttcctgcgcaacaagaagcaggagtgggaggagtaccgcagcgaggtcacggcgtacgagctgcggaagcacctgccggtgctgtgagcgcccgcggcgcacagagtgcgggcccgcgcccggtccggggcgcgggcccggtgcgggttcgttgccgtccgcgctgatcctcagggctcacggacgagggacctgccccagactgtcgcacgcatgtgtgtactcaacgattcgggagaacggtatggggccctcagaactccggcgcgcggttgaggcaggacgggcgaccgcttccggtctgggccttcaggtggatgaggtgaacgtcatccatgactccgaccgtgtcgcgctgcgtctggccccctgtggtgttctggctcgggtcgcacctctggcgcatctggccgattccgagttcgaggtagaggttgcccgccgtctcgccgatgtcgacgctccggtggccgagcttgagcctcgggtcgagccccgggtccatgtgcgggatgccttcgccatctcgttctggacctactacgaaccggtcggatcacagatcgcaccggccgactacgcagacgtgttcctgcggcaccatgccgccctgcgccggatcgatctggatgcaccacatttcaccgaccgagtcgccgtggcactgagagaggtgaacgaccggaagcagtcccccgagctggccgatgccgatcggaaactcctcagcgacacactcaggggactcagcgccgcgatcagcaccgagagggccgacgagcagctgttgcacggcgagccgcatccgggcaatctcctgaacacgaggggtgggccgctcttcgtggacctcgccacctgctgccgtgggccgatcgagttcgacctcgcccatgcgcccgaagaagtgggaaaccactacgcgggagccgaccacgacctgattcaccggtgccgcgccctgaactgggcgatgttctccgcctggcggtggcgtcgagacgaccacatgccggaccgggaccactggcgagtggccgggctcgaccaggttcgtgccgcactcgatcgctgcggaccgggcctgaccgaactggaggcataggggctgccgggtcccgatccgctgcggagtgggtgacatcccgacgcggcgcggcggtcgaacttcgccggctcgcgaggccgttcgctccgctgggccgccatcggtctcacgcccccgcgccgcccggggtcaggatttccatgaggtggccgtcggggtcgcggaaataggcgcccttgcggcctgtcgtgtgcttgctgtggtagatctggccgatttcctggcatgcgggatcgccgtagtgcgggattccgccgtgctggatgcgggcgagggcggcgtcgaactcctgctcgctgaccgtgaacgcgtagtggtgcggctcgaagtcgtccagtcggtcgtagtccaggctgacctggttggccagcgtgaccggcgtgaagtgcgccaccggcgggccgactctcaggccgaggattccggccaggaactgcgccgaggcttgcgggtcacgggcggggacgatggtgtggttcagttccacgggcatggtgactcctcttcgggacgggacgggacggggcggctgcggctgggctgcggctgccgtgtcatacgtcgatctgctcgaagatgtgcgggtacgacacgatgtcgtcggggaactcggccgccatgcgctggaactccgggttgccgaacgccgtggcgagtgcctcggtcgactcccagaccgcgatgttcatcaggagtcggctgtccgccgttcccttgtgcatccgcagggagacgaagcccggctgagccttcatgaactccgcctgccgtcggaagaggctcaggaacgcatcggtcctctcctgcgggacgaagaaggtgttggccaggacgatgggtccggtcttctccttgaactgcgcgaacatcggcgtcttcgggtccaggctctgcagctcggccatttccggtacttcctctcgctcggtggaggggtactgccttctggaaccgttccatcgtcccggcgtgagcaggccgtgaagtcagccccagctcccgttccgacgggcgacttcggtcggacggcgcgaagccgtgtcacacctggggatgacaccggaccctgaggggcgcgggaactgggagcccagttgagcctccggctcgcacgctccgtcagtgctggtccatgaagggcacgggcccgggtcagggcgtcagtacaaccctgccgaacacctcacccgcgtccatccggcggtgggccagcgccgcctggtccagcggcagcacctcgtgcacgaccgtgcgcaggtccccgcgcgcggcatcggcgaactgggacgcccgcacggcctgccggtccgctccgggcacggtgtcggagctgaaagtggcgaacgacagcgacttgcggaaggcgtcgaccagacgcatgccgaagtccgccggcggctgcccgcccaccacaccgacagccacgaaccgtccgttggggttcagcttgtccaggaaaaggggaagctcggggcctgccacgacatcgatcaccacgtcgaagcccaccggcgcgtccgggccgccctcgccggtgcggtccaggacatgggtggcgcccaggtcccgcaggcgggcgccacgctccgccgacgaggtggtgaccgccaccgcgctcgcgccgcgcccggccgcgagctggaccgccgtgatcccgatgctgccggccgcaccgcgta

SEQ ID NO: 709 - DNA, 3311 bp, Unknown
  Kingdom: Bacteria, Phylum: Actinobacteria, Class: Actinobacteria, Order: Streptomycetales, Family: Streptomycetaceae, Genus: Streptomyces
gccgggccaccgccggggcgctgcccgcgaccaggaagacgcagccgacgcgttcgccgtcggcctcggcgatccacccggcctccctgtccgggtcgtgccccgccgcgtactcggcgacgatgcccgcgaccagggcctcgaactcggtgttccagccgaactgccggtcgtacacctcgccgtgcgccatcaccacccagcccaggtcgccgggacggtcggcgcggcgcacggtgatccgcggccggtgctcctgctgtgacatggcctgctcccgatggctcgactggtgcgttccgatgtccgttacggcatccggtccggcgcactgacacgactgtttcagtgacgctaggctagccccatgtcccagcaagcgggagccccctccgcacggcagaccgagcttctcgaggccgcctaccggtacgtgctcgcccacggcctggccggcctgtccctgcgcccgctggccacggccatcggctccagcccccgggtgctgctgttcctcttcggcaccaaggacgatctggtgagggcgctgctggcacgtgcgcgcaccgacgaactgacggtcctggaacacttcaggcaggccggacggcccgtcggactggccgacgccgccgaacgggtctgggagtggctcgccgccgccgagcaccgcccgctgctgcggctgtggaccgaggcgtacgcccgttccctcgtcgagcccgacggggcgtgggccgggttcgcccaggccaccgtcgacgactggctcgaggtgctggcggcctgtcagccgcgggcggagagggacagcggggaaggcgccgcccgccgcaccctggcgctggcggtgctccgcggggccctcctggacctgctcgccaccgacgacgagccccgggtcacggcggccgtccggcaccagctggccactctgcgcacctgaggcgtccggcgtgcctgcgggacagcggtacgtgggcgggcggcgcggtccggggcagggccggggcccgcaccgcacggagccgcccgcctcccgcagcacggggctcggggccgatgctcaggtgtccggcgggccggaccccgggggtctggccgccccttacaggtacttcttcaactcccgccgggccagcgaccgttggtgcacctcgtccgggccgtcggcgagcatcagcgtgcgcgcgcccgcgtacagttcggccagcgggaagtcctggctgacaccgccggcgccgtacagctggatcgcccggtccaggatgccggccaccgcgcgcggtgtggcgatcttgatggcctggatctcggtgtgggcgccccggttgccgaccgtgtccatcagccaggccgtcttcagtaccagcagcctcaactgctcgacctggacacgggcgtccgcgatccagttctgcaccacgccctgctgggccagtgccttgccgaacgccgtgcgggacaccgcccgtcggcacatcagctcgatcgcccgctcggccatgccgatcagccgcatgcagtggtggatgcggccaggaccgaggcgggcctgcgcgatggcgaagccgccgccctcctcgccgacgaggttcgacgccggtacgcgcgcgtggtcgaagaccacctcggcgtgaccgccgtggtagtggtcctcgtacccgaagacctgcatcgcccgcttcaccgtgacgccgggcgtgtcgcgcggcacgagcaccatggactgctggcgccggatgtccgccccgtccgggtcggtcttgcccatcacgatgaagatcttgcagtcggggtgcatcgcgccggagatgtaccacttgcggccggtgatcacgtactcgtccgagccgtccgtggcccgctcgatgcgcgtcgtgatgttggtggcgtccgaggaggccacctccggctcggtcatcgcgaacgccgagcggatctcacccgcgagcagcggctggagccactgcttcttctgcggttcgtcgccgaactgggccagcacctccatgtttccggtgtccggtgccgcgcagttggtcgccgtgggcgccaactgcggggagcggcccatgatctcggcgagcggcgcgtactggaggttggtcagaccggcgccgtactcggcgtccggaaggaacaggttccacaggccctgccgacgggcctcggccttcaactcctccaccaccggagggttctcccacggcgaggcgagccgggcgcgctgctcgtgcgcggtctcctcggccgggtacacgtactcgtccatgaaggcgaggagcttggcgcgcagttcctcggtgcgcgcgtcgaacgcgaagtccatgacggatcagccctcccggaggccttcgtggaatgtggtcaggccgtgctggatgaagacggggaccagatcgccgatgcggtcgaaaccgcggccgaccgtctggccgagcgtgtaccggtagtggatgccctccaggatcacggcgagcttgaaccaggcgaacgccgtgtaccaggagaccgcggatacgtcgcgccccgagcgcgcggcgtaccgctcgatcagctcggcgggcgaggggtgcccgggggcctcggcggtggtggacaccggggagtcgggcatgcccagcgggctgcagtacatgacgagcaggcccaggtcggtgagcgggtcgccgagcgtggacatctcccagtcgagtacggcgcggatccggtcgtcgggaccgatcagcacgttgtcgagccggtagtcgccgtgcaccacggcaggggcgggcgaggcgggcagcgcgcggccgagggacgcgtgcagttcgtcgatgccggccagctcgcggttgcgggaggcgtccagttgcttgccccagcggcgcaactgccggtcaaggaagccctcggggcggccgaagtccgcgaggcccacctcgtccggatcgaccgcgtgcaggtcgacgagggtgtcgacgagcccgagcaccgccgcacgggtgcgctcaccgccgagcccggcgagctggcccgcggagcggtacggggtgccctcgacgaactccatcacgtagaacggcgcgcccagcacctcctcgtcctcgcacagcagtacggtgcggggcaccggcacgcgcgtcggatgcagcgcgctgatcacgcggtgctcgcgcttcatgtcgtgcgcggtcgccaggacgtggcccagggcgccctgaccgggcggctgatcgagggcggacggtcgaacctgacgtacgcggtcaccgacggcaccacccggtgggtcgtacgccggcctcccctgggccacgtcctggcga

SEQ ID NO: 710 - DNA, 1416 bp, Unknown
  Kingdom: Bacteria, Phylum: Actinobacteria, Class: Actinobacteria, Order: Streptomycetales, Family: Streptomycetaceae, Genus: Streptomyces
gggtgtgtggttgtagccggtggcgacgaccacggcggcgccggtcagctcccggccgccggtggcgtgcagcagccagccggtgccgtcggcggcgcgttcgacgcgggagacctcgacgccggtcacgatctccagttcgtggtgctcggcgtacttctccaggtaccgcaccacgtcgtcgcgcgccacccaccggccgaaccggcgcggcatcggcagaccgggcagcgcggagagccggcgcgtggtgtgcaggcgcaggcggtcgtagtggccccgccaggaggatccgacgcgatccgtccgctccagcacgacggcgcgtacgccccgcgcgcgcagcgcgtacgcgacagcgagacctccgggacctccgccgatgacgtagaccgggcggtcggtgcgctccggggcgagggcagcgggagcggtggcgggagcggaaccggcggcagtggacggggagtcggccatgagcgcgagcgtaatcacgcccctggttgatgggtctcggtcaagaccggaattggttgcggattgatcacgcgtgatcacaggcggcgcggtaggccatggaagcggtggcccgtggaaagcccgtggaggtcgtagcccagggaaagcccgtgaccgtggcagcccatggaactcggatgtggtgaccccgctcattcggccagaatggccggatggccgagatacgcgagaagtcccttgccgaccccgcccccgagctgcgtggccacggcctccggctccgcatctgggacccggcgtccgaggccgacctggaggcctggctgcgcgggcggtccgacccggagttccggcgctggaacacaccgctgatcctggaacgggacctggccgacgcgcgcgaatcgctcacctctcacgtgcagaacgccgtcgacggcacgggcatgccgttctgcgtcacggacgaggcgaccggcgagcggctcggacacgtcagcgtcgccgtcatcagccgtccgatgctctccgggcgggtcggctactgggtgctgcccgaggcgcgcgggcgcggtgtcgccacgctggcgctgctcctcgccgggcgctgggccttcactgagttcggcctgcaccgcctcgaactcgaccacgccgtcggccacgaggcgtcctgccgcgtcgccgagcgctgcggctacctgtacgaggggaccgcgcggggcgcgatgtgggaggcgggacgctacgacgccttccgggactgccacttgcacgcccgcctggccacggaccccgagcccgcaccgcccgcgccgcccgcgtcgcgctgacctttgccgcccgcaccgcgcaccgcccgcaccgtccgcaccgcctgcaccgcgctgacccatgccgcccgtgcgtcggcaccgcgctgacctttgccgcccg

SEQ ID NO: 711 - DNA, 1803 bp, Unknown
  Kingdom: Bacteria, Phylum: Actinobacteria, Class: Actinobacteria, Order: Streptomycetales, Family: Streptomycetaceae, Genus: Streptomyces
gggtgttctccggtgcggcaggccgcgtccgggatcggcacggccgggaacctcaggcgccgggcgctcccacgcgcaggccgtccatcaccaggtcgaggaggcggctcgcgcgggactgccagtctccgtggggatcgagctgccagatgccggcgatggcgaggacgaagtcttcggcgctcacgccgggcctgatggtgccggcctcctccgcggcgcggagcagcagatcggccgcggtggccagcggggtgtgtcccggcttcgccgggctgccgggtccgctggtggcctggcggatcgcgtccgcgagtccggccttggtcatcgcgaaccgggccaggcggtccatccattcgcgcagcgcccggtcgggagggcggcattccagcagctctgccgcgctctcggagacctgctgcatctcgtggcggtagatctccaggacgagcgcctcgcggttggggaagttgcggtagaacgtcccctgccccacgcccgccttcctggcgatcaggctgagcggggcgtcggcacagcgggtcagttcggccaccgccacttccaggatggtctcgcggttgcgttgcgcgtccgaacgcagaggtgcgggcttcttctgctgcactcgtcctcctttcgggcacgccgtcgaactcggccttgctaagcggacagctgtccggtacgttcttccataacggacagctgtccgcttgtcgtccaccatagcggtgggcagtgctttttcgccacgtacagtgccctcttcctgcttccagagaccttgccctgcaacgcgcagtcttttccggattcaccgactttcaggccgacatcccgacgtgtttccgccgcacacgcgaaagaagctgatcatggacccagccacctcgtcgacgcacagcccgatcaccctgaacatcaacggcgagaagcacgcgctgtccgtcgaccaccgcaccacgctgctcgacgccctgcgtgagcggctcgatctgaccggcaccaaaaagggctgtgaccaggggcagtgcggtgcctgcacggtgctgctcgacggccgcagggccgtgtcctgcctccagttggcggtcgcggccgaggggcgtgagatcaccaccatcgagggcgtggccgaaggcgagcggctgcaccccgtgcagcaggccttcctcgacttcgacggctaccagtgcggctactgcacacctggccagatctgttcggccgtcgccgtgatcgaggaacacgcggccggctggccgagcgccgccaccgatgacgtgcgccccgaagccggaccgcccccgctgacccccgaggagatcaaggagcggatgagcggcaacctgtgccgctgcggtgcgtacgcgtcgatcgcccaggcggtcgcccgggccgccgcggccacacggtccgacggcaaggcgtcggccggggagaacgtcgaggagcacaaggaggccgtggcatgagggagttcggttacgacagggcccaggacgtcgccggtgccgtcgcactgctggacgccgacccggacgcccgtgcctgccgcgtcgacctgctgctgcgggccgtccgcgtcgccgtggacctcggcgcccacgccgtgcactgcttcagcggaaccgttccgcccggtaccgacgaggacaccgcctggaagcggctggccgagtcgctggcccccgtcgtggacgccgccaccgccgcaggcgtcccgctcgccgtcgaacccgaacccggtcacctcctcgccaccctcgccggcttccaccggctgcgccgcgccct

SEQ ID NO: 712 - DNA, 6511 bp, Unknown
  Kingdom: Bacteria, Phylum: Actinobacteria, Class: Actinobacteria, Order: Streptomycetales, Family: Streptomycetaceae, Genus: Streptomyces
cccccggcaccgcccccgacgaagcggcccccctcgacctcgaaccccagcgccagcacgtccatgcgcaactcaacgcgcgattcaccatgaaaccgcccaaactgtaaacacgtcagaccgccggaccgaccaccgaccgaccgtcgccccgtccaccgatccgaccgccgaccgaccgtcgaacgctcagaggagcgccaccccgcacactccaactcttgtcaacatccgttcacccgaaggccgttgagcagtcacgtcacaccaaacccctaccgaccggtaaggcctaggctcacaccatgcgccgagcgaagatcgtctgcaccctggggcccgccaccgacacatacgaccagatcaaagccctggtcgacgccggaatggacgtcgcccgcttcaacctcagccacggcgaacacaccgaacacgaagcgcgctaccagcacgtacgcacagccgccgacgaaaccggccgcagcatcggcctcctcgccgaccttcaaggcccgaagatccgcctcggccgcttccatgaaggccccgtactcctcgaacgcggcgacaccttcaccattaccgtcgaagagggcatcgaaggcgaccgccaccagtgcggaaccacccacgccggcctcgccgacgacctcacccccggcgaacgcatcctcgtcgacgacggcaaagtcgccctcgaagtcaccgccatcgacggcccccgcgtccacaccaaggtcaccgagggcggcatggtctccgaccacaaaggcctcaacctccccggcgtcgccgtctccgtccccgccctctccaagaaggacggggacgacctgcgctgggccctgcgcaccggcttcgacgtcatcgcactctcgttcgtacgcagcggacgcgacatcctcgacgtccaccgcatcatggacgacgaaggccgccgcctccccgtcatcgccaagatcgagaaaccccaggccgtcgaagccctcggcgagatcatcgacgccttcgacggcatcatggtcgcccgcggcgacctcggcgtcgaaatgcccctcgaacaggtgccgatcgtccagaagcgcgccgtgaagctggccaagcgcaacgccaaaccggtcatcgtcgccacccagatgctcgactccatgatcgacaactcccgccccacccgagcggaagccagcgacgtcgccaacgccgtcatcgacggcaccgacgcggtcatgctctccggcgagaccagcgtcggcaaacaccccgtcgccacggtccgcaccatggcaaagatcgtcgccgccgccgaggaagacctcctcgcgaaagggctgccgcccctcaccgaccacaacaaaccccgcacccagggcggcgccgtcgcccgcgcggcagcggagatcggtgacttcctcggcgcacggttcctcgtcgccttcacccagtcgggcgacaccgcccgccgcctctcccgctaccgctcacccatccccgtcctggccttcacccccgaaccggccacccgctcccagctcagcgccacctggggcgtcgaaacgttcctgggaccgcgcgtcgactcgaccgacgcgatggtcgaccaggtcgacgagcttctcctcaagtacggccgctgcgagaagggcgacgtggtcgtcatcacggcaggctccccgcccggggtaccgggctccacgaacctggtccgagtccaccacatcggcgaggacgaccggccccggtaggggagctgtcagtacttggggccgacgtgggcgtccatgagggctacggaggctttgcgggcgacggagatggtcacggcagcccggctctggtggagtgacttccactcgacgccgagtttgtcgagggtgtcggtgaagagctggatgatgtcggtcgatgtgttggtgaagaagtaccggggatattcgtagcgcttgcgctcaccgccgacgaggcgagtcgtccagttggtgatccggcagccgtcggagtggatgagcccccggacgaactcccaggggtgcgcatcgacgatctcctgctgccagggttcgagcgcgatgcggcgttcgtgctttctgccgggcccgtgctgcgggaagaggccaggccagtgccgggagtagctggtgaccatggcgcatccctgtttctgcaccgagtacacgccgacgccgggccgcaccgccgtgatggcgtcccggcattcctgcagaagcccgggccaggcatcggcgcatgcgatccggaggtagtagccggctcgggggtgccgactgagacacccgtcgccgaggtagaggcccagcaggtaggcatacgccacatcgtccgcaggcggtcccgggtccgtacgggacatgcggggcagtggctcgagacggctgtgccaggagcggatcgccgcgcgggagacgccggtctgcttgctgaccgagttcaggctgcggccctgggcgaccagggccagagtgtgcttgcgtgtgctgaggtcgtacatgtgaacactctcagggagtgatcgtgacgccacgcagcaaaaagcggatgttcacgagaacgtggacatccgcttgcgaaacatgaccttggaaaccaaggaaaagtgccccgggtcggactcgaaccgacactgtatgggttttgaatccatcgcctgctgccaattgggctaccggggcccaacgaatcgaaggtaacccccgacccgctgcctgaccaccttaccgcagctaggtaggctcttgggagcagtatctgcctcccccggaacaaggagcgcccccgtgaccggccccgagtcgccccagcccgttgacgccgccgacgacgacaagtcgcacgtcccgccgctgacgacccgtgtcgtcatcgccgaggatgaggcgctgatccgtctcgatctgaaggagatgctggaggaggagggctacagcgtcgtaggcgaggccggcgacggcgagcgggcggtggagctggcccgtgagcaccgtccggatctggtgatcctggatgtgaagatgccgaagctggacggtatctcggcggcggagaagatcgccgaggagagtatcgcgccggtgttgatgctgacggcgttctcgcagcgggacctggtggagcgggcgcgggatgcgggtgcgatggcgtacctggtgaagccgttcagcaagagtgacgtggttccggcgatcgagatggcggtgtcgcggttcacggagctgaaggagctggagaaggaggtcgcggacctctctcagcggctggagacgcggaagctggtggaccgggcgaagtctgtgttgcagacggagtacgggctgtcggagccggcggcgttccgttggattcagaagacgtcgatggatcgtcggatgtcgatgcagcaggtggcggaggctgtcattcaggacagtgaggagaagaaggcggcgaagggcgggaagtcgggaaggtccgagcaggactgaccggcgcgcccggttgtcgggtacgtacatggggcgaggcccgcatccctgatcggggatgcgggcctctgccgtctgtcgtgggtggttcagtcctcgccgaggtaggccttgcggacggattcgtcgtggaggaggtcttgtccggtgccggagaggacgatgttgccgacttccatgacgtgtccttggtcggcgagggagagcgcggcttgggcgttctgttcgacgaggaggatggtggtgccctgggacttcagttcgacgatggtggacatgatcttctgcatcatgatgggggagaggcccatggagggttcgtcgagcatgaggagtttgggctgggacatgagggcgcggcccatggcgagcatttgctgttcgccgccggagagggtgccggcggcttgtttgcggcgttcgccgaggatggggaagaggtcgtaggcgcgctggatgtctttttcgatgccttctttgtctttgcggaggaaggcgccgagctggaggttttcggcgatgctgaggcgggggaagatgtgtcggccttcgggggagtgggcgagtccgagggcgacgattttgtgggcggggacgccggtgaggggtttgccgtcgaaggtgatttttccggcgctgggtttgaggaggccggagagggtgcgcagggtggtggtcttgccggcgccgttggtgccgatgagggtgacgacctggcctgcttcgacgctgaaggagatgcctttgacggcttcgatcttgccgtaggcgaccctgaggtcttcgacctcgaggagtgcggtcactgggcttctcccttggtgctgttcgccgtgttcgcgtccgcttctgtgtctccgtcttcagcggctgtggcggtgtccgtgtccgcgtccgaggccggggttgtcgcggcgggcgtgtcggcggctgcttcggccgcttcgacctcggctgcttcggcgtcgccgggggcgccttcgaagggttcgccgaggtaggcggcgacgacgcgttcgtcggcctggacgatgtcggaggtgccttcgatgagtttttcgccttggacgaggacggcgacgcggtcgcagaggttgaagatgaaccgcatgtcgtgctcgatgacgaggacggcgatgccttggtcgcggatggcgaagacgagttcttcggtggtgcgggtttcttgggggttcatgccggcggtgggctcgtcgaggaggaggagtccgggttcgctggcgagggcgcgggcgatttcgagtttgcgttgttcgccgtaggggaggttgcgggcgaggtggtcgcgtttgtgggcgaggccgatgaactcgaggagttccatggctcgttcttcgctggctttttcggcttttttgaatccggggccgcggacgagtgcggaccagaggccttctttggtgcgggtgtggcggccgatgagtacgttttccaggacggtcatgttggcgaagagccggatgttctggaaggtgcgggcgattccggcctgggtgacgaggtggggtttgggtgggaggacggttcttttgtaggagacggttccttcggtggggacgtagaggccggtgaggcagttgaagaaggtggttttgcctgctccgttgggtccgatgaggccgacgatctcgccgctgttgacggtgaggtcgacggagcgtacggcggtgaggccgccgaagcgcatggtgacgtcacgggcttcgagtacaggtgtcgtcatcgttcttacgcccctgccttgatgacggcctggtctccggtcagcgtcttttgttcgggtacgtcgagttgtccggtctcgtggaattcgagttggcggcggcggttggcgatgatgccttcggggcggaatcgcatgaggaggacgagggcgatgccgaaggcgaggagttcgtagttcttgaggaactggagtttttcggggatgaggtagagcatgctggcgccgaggagggggccgctgacggtgcccatgccgccgaggacgacggcggcgaggaggaaggcggagttgggcggggcggcgccggcgaactggtagggggtggggacgacggagtagctgacgtgggcgctgacggtgccggcgaggccggcgagtgcggcgccgagggcgaaggcgatgagtttgacgcggaagccgttgatgcccatggcggtggcggcggtttcgtcttcgcggatggcgacccaggagcggccgatgcgggagtcggcggcgcgggtgaagacgaggacgacgatggccgtgaagatgagcatgagcaggaagtagttggcgaatcggccgagggtgaaggagccgatgtcgtgggcttcgccgaagttgaatccgaagatttcgaggtcggggatgttggcgatgccgttggggccgttggtgatgtcggggcctgaggagccgtcgaggttgttgacggcgatgcggaagatttctccgaagccgagggtgacgatggcgaggtagtcgccgcggagtcggagggtgggggcgccgatgaggacgccgaagacgagggaggcgcccatgccgacgaggacggcggcccagaaggggagttgggtgccggagaagcgggagtattcggagccggagacgagggcggctgcgtaggcgccgacgccgaggaaggcgacgtagccgaggtcgaggaggccggtgaggccgacgacgatgttcaggccgagggcgacggtggcgaagatgaggatgttgacgccgatgttggcgttgtggtcctcggtctgggtgaaggggaagatcgccgcggcgaggaaggccatggaggtggcgaatcctttgtgccgggcgttgagggtggagaagcggtcggtgaggccagcggtgaagagggcccaggcggagaagacgacgaggagtccgaagccgctgaaggtctcgccgtactcgtcgtcgggggtgctgatgccgtaggtgaagacgaggagtccgagggcgagtgcgagggtgatggtgacgcgttcggcccaggcggggatgggggtggggc

SEQ ID NO: 713 - DNA, 1283 bp, Unknown
  Kingdom: Bacteria, Phylum: Actinobacteria, Class: Actinobacteria, Order: Streptomycetales, Family: Streptomycetaceae, Genus: Streptomyces
cgtcgtcttgccgacgccgcccttctggttgcacatcgcgatgatcttcgcgggtccgtggtcggtcagcggcccggggatcgggaagtacggcagcgggcgtccggtcgggccgacgcgctcacggcgctggcgggccgcgtcgggcgcgagcgtggccgcgtactcgggatcgggctcgtactcggcgtcggggtcgtagaagtgcccctcgggcagttcgtcgtagtcggcgaactggttgtggggcgcgccccttccgtcgccggccatggcgttcacgtgatggccatccatgctctggtgtcctggctgggtcaccagcggaaaccggtgaccctggtgggctgcgaaggtgcgcacagcgacggagccgacagcctcgagccccgtggagctctggccccgcgcaggcattcctggttgaccacccccgggagtaaatgtcgactcattcacaagtcgtcttacctccttggtgaccagggaacttctagacaggtcagcgtggcaccatgccgacggttggcgactctatggcgtgtcgggcgtccgcagcaacacaatccgccggacccggctcgatgtgtcggcaatgaaacatccctctgtcaagggcgtacgaccgtcgcacagcaggtttcaccggggtgtgaatcggtcgaatggttgcgttcgaggcgagttggccgtgtgcggcgaagtgaccatacacacatccggccggaccttgtggggcaaggtccggccgggtgcgtggcgttgacggaacgagttgacgtatcgcctttttccgtcaggtgacttggtcgattcctcgacgcccggactcagccgagcagggtctccagctcgacgtggtccaggccgtgggcctcggcgacctccttgtagacgaccttgccgtcgtgggtgttgaggcccttggcgagcgcggcgtcgcggcgcagcgcctccacccagccgcggttggcgagttcgacgatgtacggcagcgtcgcgttggtcagcgcgtaggtcgaggtgttggggaccgcgccgggcatgttggcgacgcagtagaacaccgactcgtggaccttgaaggtcggctcggcgtgcgtggtcgggtgggagtcctcgaagcagccgccctggtcgatcgcgatgtcgacaaggacactcccggccttcatccgggacaccagctcgttggtgaccagcttcggggccttggcgcccgggatgaggacggcaccgacgacgaggtcggcgtccaggcaggccttctccagctcgaaggc

SEQ ID NO: 714 - DNA, 1763 bp, Unknown
  Kingdom: Bacteria, Phylum: Actinobacteria, Class: Actinobacteria, Order: Streptomycetales, Family: Streptomycetaceae, Genus: Streptomyces
ccctgcggcgtcggcctcggccgagccccgcaccgacctggtcgccctgcgccaccgcggcgccggaacggatctcgcgcccaatgcctgaccagtcgcatgaccagttgcctgaccagcccggccggcgcgtgtccgagctgctggatctggaccggcggcacgtgtggcacccctacgggcccatgcccggccgtcaggaaccgctcgtcgtggagtcggcgagcggggtccggctgaagctcgccgacggcgcgggcgagctggtggacgggatgtcgtcgtggtgggcggcgatccacggctaccgccacccggtgctcgacgaggccgcccgcgagcagttggcgcggatgagtcacgtgatgttcggcgggctcacccacgagcccgccgtccggctcgcgaagctccttgtcgacatgtcgcccgacggtctcgaacacgtcttcctgtccgactccggctcggtctcggtcgaggtcgccgtcaagatgtgcctgcagtactggcgttcgctcggccgcccggagaagcggcggctgctgacctggcggggcggctaccacggggacacctggcagccgatgtccgtgtgcgacccggagggcgggatgcacgagctgtggtccggcgtgctgccgcgccaggtcttcgcggacgccccgccggccgagtacgacgaggcgtacgcgacccacctgcgtgatcggatcgaacggcacgcgggcgaactggccgccgtgatcgtcgagccggtggtgcagggcgcgggcgggatgcggttccactcccccgcgtacctgcgggtgctgcgcgaggcgtgcgacgcgcacggtgtgctgctggtgttcgacgagatcgcgaccgggttcggccgtaccggtgcgctgttcgcggcggaccacgcggcggtgacgccggacgtgatgtgcgtgggcaaggcgctcaccggcggttatctgaccatggccgcgaccctgtgcaccgcgcgggtggccgacgggatctcgcgcggcgaggtgccggtgctcgcgcacgggcccacgttcatgggcaatccgctggccgccgcggtcgcctgcgcctcgatcgacctgctgctcggccaggactggctcgccgaggtcaagcggatcgagaccggcctgcgggactgtctggcgcctgcggcggatctgccgggcgtgcgggacgtgcgcgtgctgggcgccatcggggtcgtccagctcgaccacccggtggacatggcggcggcgaccttggccgccgtgcgcgagggcgtgtggctgcggccgttccgggacctggtgtacacgatgccgccgtacgtcacggacgacgcggacctggcacggatcggccgcgcggtgtgcgcggcggcgcgagagggatgagatgccggtactggtgatcacgggaacgggcacggaggtcggcaagaccgtcacgacggccgccgtcgccgcggcggcgctcgcggccgggcggtcggtggccgtgctcaaggccgcgcagacgggcgtgggcccggacgagcgcggcgacgccgacgaggtcgagcggctcgccggtccggtgacggcacatgaggtcgcccgctatccggagccgttggctccgggtacggccgcgctgcgcgccgggcggacgccggtgcggccggaggaggtggccgaggccgccgccaagctggccaccgagcacgacctggtgctggtggagggggccggcggcctcctccaccagcaccaggtcgtgct

SEQ ID NO: 715 - DNA, 2132 bp, Unknown
  Kingdom: Bacteria, Phylum: Actinobacteria, Class: Actinobacteria, Order: Streptomycetales, Family: Streptomycetaceae, Genus: Streptomyces
gccggcctcgatcagccgtccgccctcgttgaggtaggaacgcaactggagctgggtggcgttgccgggccctgcggcgcccgagtagtgcacgaccgtcctgaagtgcttcagcacgccgagcgcgtcgggcacgccctgggcggcgacgtcccagacgacggctcggtggccgttcgcccgcagcgcgtccacgtacgcgcctgcccgggtggccggggtgccctcctcggcgacgacgagggtgtcggcgggggtacctgtgcgggcggcggcgcgggcgtcggctcgggcatcggcctgcggcaggcgggccacggtgtaggtgaagtgctcgctcgccgtcggctttccggccccgggcccgcttcccgtgcggccggtgaaccacacctcgaccttgtcgcccggggccgcgccgtggacgcgggcccggtactcgtcgaagtagaggtggtccgccccgccgtaggtcgtgccgcccttccacggccgcagggcttcggtccgggtcggcccgccgtcgacgcggtagcgcagttccttgtcccgcacggacctgcggacgacgacggagacctcctggtcggcaccgcgcgcgtacgacgtcgtgaacgcggccggcgtgaagtcggcggcacccaggccgaccggtgaactcggccggtcgggatgggcggcggtctccgcgacggcgagcgcgaagggaacgttcttctcgaactcccgttggatcagcttctcgtcgtcggggaagctgaacaccgaccggcagtcggcggcgttccaggcgtcgtccgggtcggcgtcggacgcggtctcgcacgtcgacatctcgggcgtgaacatggccgtgccgttgacgttgcccgcgtggccgtccgcctcgccgttggtggtgtacagctccgaggagacctgggagcggtagccggggatcgccgggtcgtccggggtgccggcgagcgccttgtagaggacgtcgtccggggtcggtgtcgccacctgccagccgacgccgtagagcaggagttcggccgcggagtggtagttgacggcgtaccggaaacggatgcgcttctcgaaccggtcgagcgcccgcgtctcgggctcgctcgcgggggcagggccacggtaggtctcaccggcgggctccggtgacgaaccctcgtcgtcgtagccccatttgtaggggaagttgcggttgaggtcgacgccgtcgccggcggagatgacgccgtcaccgttgatgtcccggaggttcttgcgccacaaccgggtgctgtcgtccttgaaggtgtagtcgtagccgtcggggttggcggagaggacgaaccacagttcggtggtgtcgacgagcttcctgatccggcggtcggtgcggtagtggtccaggtagtagtgcatcagccggcgtgtcatctccggcgtgatccactcgcgcgcgtgctggttggacatgtacagcacggcgggcctggtgccgtccttcgtccgccgcgcgtcgccggtgagcttcagggcgaggatgtcctgcccgcgcaccgttgtgccgatggagacgaccttggtgaggccggggtgggtccgggcggtgctgaggatctcctcgcgcaggccggccttgccgctgtagggacggaacacgccctggccggccgtgcccacccgccgctgggccgtggctgtgagcgtgtgctcggtgagccggatgccctgcttgcgcagcttcccggcctgtgcgtccgtgaggtacagctcgacggtgctacggcccttggccggcgcccggttcccgagttcgtgggcgtcctggccggccttcagcagcaggggcacctgccgcgcggtgacgtcggcgcggaagaccttcacctcgtccgggcccggacggggtgtgctcggtgtgcttccgccctgcgcctgggcgacgggcgcgaggccggctccgcccagcaggagcgcgccgaccgcgaggatcgatctcgctctgcgtctcatgccgcgtctcatgaaaccccctgacggtggtccgccgcagcggcggaaggtggttgccaggttcatgtcagttctgggtcgggtcaagggtgcctcttgagtcgggggtacgtgcccacgaagggcggggt

SEQ ID NO: 716 - DNA, 4509 bp, Unknown
  Kingdom: Bacteria, Phylum: Actinobacteria, Class: Actinobacteria, Order: Streptomycetales, Family: Streptomycetaceae, Genus: Streptomyces
cgcaggttgccggccgcgccggccgcgtccacgtacgacagcgcggtggtcgcctccaccgtgcggtcccgggtggtgtcgaaccgcaggtaggcgccgccgcgcccggtccgtgcgccggcggtgacggtggcgccgttccaggtgccgtacgcggtgaagggccggtcgaagcgggtgatcgtgtagacggtgtacgggagggtgtccttgcagaagccgcggccggtgatcgcggtgcgtacggtgcggtcgtccaggacctccaccgtcgaggcgaccatccggtgcagcgcctggccggcgtcgagcaggacgttggccttgtcggtggccgggaaggtgtagcgctggacgccggtccgggccgtcgcggtcagttcggcctcgatgccggagtccagcgcgacgcggtagtagccggggctcgcctgctcgtccgcgtggcggaagccggccgcgtacttggcgtagtcggtctgtgtgacgtcaccggtggtgggcagcaccggcaggtcgccgccgatgcggcagccgacgccggagagatggaccagggagaaaccgcggatacggctctgggcgtagtcgtagccggtgctgtgaccggtgtccggcgagaactgcaccatgccgaagggcacggtcgcgccggggaacgtgttgccttcgttcgcggtgccgatgaacgggttgaccaggtcggtcagccgggcgtcgcgggggccggcggcccgtgcggacgcgggggcggtggacagcgcggacgccgccaccgccgccgctcccacgcacaggcgcagactccgggtccatctcatgcaggaagacctccgagggagacgtcattgcctgcatgatcacgtctgatggccggtcagccgggcatccggcgggtgtcgcgcgcgacgcgtcgcggatcggcgcccgcggatcagcgcccggtgatcagcgtccggggccgtccggggatcaccgtccgcggggcggcccgcacccgggccgcgtccggtgggcgcggtgtaccggccgacgggccgggagccactgtcgtgtgctccggccggcgcgggatcccagtggagccgcgagatcccagtggagccgcgagatccaagtggagccgcgagatcccggtggagccgcgagatccaagtggaccggacgcccgtggggcgcgcaccatgggggcgtcgcttccgtgtcgtgcgggcctcccgcacggctcgcctctcccgcggaagggaagtgaaccggatgcccaaggtctcccggcgcaccgccacccagggcggcgactacggacccgtcgtcgagcagtccgaggacctcgacccgtacacggtggacttccgcatcttccgcgaggacgtcgacctcacaccgctgctcaaggagctgccggacggccgctgccagtgcccgcactggggttacgtcttcaagggcgagctgcggctgcgctacccggaccacgacgaggtgtaccaggccggggaggcgttctacgcaccgccgggccacgtcccggtccacacggcgccgggcaccgagtacgtgcagttcagccccgccgaggacgcgcgccgggccagcgcgatcaccttgaaccacttcccgccgctgaccggctgagcggcccgcggcgccggggcaggcgccgggcccgggagcgtgtccggagaggccgggcgcgggctacggcacgcgctggcccttgcccagggcgatcactccgcccttggagacggtgtacagcgcggcgtcccgctccgggttgacgccgatcgtcgcgccgggcggcacctcgacgttcttgtccaggaccgcgccgcgcacgaccgcgccgcggccgacgtggacgttgtcgtgcagcaccgagccctgcaccaccgcgccggggtcgacccgcacgcccggggagagcacggagcgcgtgacctgcccgcggatcaggcagccggcgctgatgatggactcccccgcgatgccgcccgcgttgaaccgggccggcgagagctggttggagtgggtgtagatcggccagtcccggttgtacaggttgaacgccggacgctcggcgatgaggtccatgtgggcgtcgtagtacgcgtcgagggtgcccacgtcccgccagtagccctggtcgcggctggtctcgccgggcacgtggttggcgctgaagtcgtacagctgggcctcgccgcggtcggtgagctgcggcaggatcgaaccgcccatgtcgtgcaccgatctcgcgtcctcggcatcccggtgcagcgcctccacgagcaccttggtggtgaagatgtagttgcccatggaggcgaagacgtagtccgggtcgtcgggcaggccaggagggtcggctggcttctccaggaaccgctcgacgatctgcccgtccgaggccggggtgatcacgccgaacgacgaggactccgcgcgcggcacccggatcccggcgacggtcacgcccgcgccgccctcgacgtgctgccgcagcatctggcgcgggtccatgcggtagacgtggtcggcgccgaacaccgcgacgtactccggctgttcgtcgtggacgaggttgagcgactgcaggatcgcgtcggcgctgcccaggtaccagcgcgggccgaggcgctgctgcgcgggcaccggcgtgacgtagttgcccagcaggctggacatgcgccaggtcgtggtgatgtgccggtccagcgagtgcgacttgtactgggtcagcacgcagacgcgcaggatgtcgccgttgacgaggttggacaggacgaagtcgaccaggcggtacgtgccgccgaaggtcaccgccggtttggcgcggtcggcggtcaggggcatcaggcgtttgccctctccgcccgcgaggacgattccgaggaccgaaggtccaccacgacgcatggccgctcccctcacccggttgaaccactactgccctggctggaagtgggctaagcctggccgaggatctcctcgtacagccgtacggtgcgccgcgcgacggcgtcccagccgaactccgtcaccgcccgccgccgccccgcctcgcccatgcggcgcgccgccgcggggtcggcgagcacggcgtccagggcgctggccaggcccgcctcgaaggcgtcgtcccggccggcgtcccggtccttctcgtgtccgtctccgcggtcctgtccgtctccgcggtcctgtccgtctccgcgtccgccttcgtcgcgctcttcgtcgtgatcgtcgccgcccaggtcgacgaggagtccggtgcggccgtcctcgaccacctccggtatgccgccgacccgcgaggcgacgacgggcgtgccgcaggccatcgcctccaggttgacgatgccgagcggctcgtacaccgacgggcagacgaagacggccgcgtgcgtgagcaactgcaccacgtccgggcgcggcagcatctgcgggatccagtgcacaccggcgcggacctggctcagctcccggtacaggtcacggaactcccggtcgatctccggtgtgtccggggcgcccgcgcacagcacgacctgggccgccgggtcgatgtcgcgggcggcgcgcagcaggtgcggcacgcccttctgccgcgtgatgcggccgacgaacagcacgtaggggcggtccgggtcgaggccgatgcgcgtgaggacgtcggtctgcggggcgggccggtagagggcggtgtcgatgccgttgtggatgacgtggacgcgggcggggtccaggtccgggtagcagccgaggatgtcgtcgcgcatcgccccggagacggcgaccacggcgtcggcggcctccatcgcggtgcgctccgcccagctcgacagggcgtaaccgccgccgagctgctcggccttccaggggcgcaggggctccagcgagtgcgcggtcagcacgtgcggcacaccgtgcaggagcttgccgaggtggccggcgaggttggcgtaccaggtgtgggagtgcagcaggtcgcagccctcggtggcggcggtcatggcgaggtccacggagaaggtccgcagggcgtcgttggcgccgtccagggcgggccacgggcggtggcgtacgacgccggacacccgctccgccggggagccctcgccccagcagtgcacctcgaggtcgaccaggggccgcagctcccgcgccaggaactcggcgtggacgcccgcgccgccgtacacgtccggcgggtactcccgggtcagcagtcccacgcgcacccgcaaccccctgagtccggcggcaagtccccttcatggtcacccggatgcggcacggtgggaagagcgcgggactcgtgtgaagcaacagtccccgcagatgccgccgccggggacgcggtagtagagacagcagctgcgccgccggaatccggtggtgcgtggggtgccggaggcgtccagggtgcctgggccgtcgggggtgttcagggtgcccgctccggcgagtgcggggtgggcgagcaggcgtacggccaggtcg

SEQ ID NO: 717 - DNA, 1467 bp, Unknown
  Kingdom: Bacteria, Phylum: Actinobacteria, Class: Actinobacteria, Order: Streptomycetales, Family: Streptomycetaceae, Genus: Streptomyces
ccacacggacccggcccggcagccgtccaggaacgcctcgccgccggtgacctcggcgaccccgtgatggatctcgtacccctcgacccgctcgccgagggcttcgcccaccggccgggcgagggtcttgccggcggcgaaccggacccgtaccggcagcagaccgagcccgtcgacgtgcccgcggcggctctcgacctcgtcctcgatgtgctcgccgagcacctggaagccgccgcagatcccgagcaccggccgcccctcggccgccctgcgcgccagggcgccggcgaggccgcgctcgcgcagccagtccagcgcccgcaccgtgccccgagtgcccggcaccaccacgaggtcggcgtcggccagttcctcgggccggtccacgaaccgcacgacgacgcccggttcggcggccagcgcgtccacgtcggtgaagttggacatcagcgggaccgcgcagacggcgacccgcagcacgtcctcgccgatcggcggcgcgaccgcggactcccgcacggcgccccgcagggacaccctcccccgagctctcgactccgctcgaggagggggaacccccatgccgtcctcctcgtcgatgccgagcccgtgccggaacggcagcacgccgtacgtccgccggccggtgaggtcgcgcagcatgtcgatgccgggctcgaggagcgagacgtcaccccggaacttgttgaccaggaacccggcgaccagctcctggtcctcgggggacagcagggccacggtgccgaagaaggaggcgaagacaccgccgcggtcgatgtcgccgacgacgaccaccggcagccgcgcgccccgcgcgatccccatgttgacgatgtcggtccggcgcaggttgatctcggccgggctgcccgcgccctcgcagatcaccgcgtcgtacgcgccgcgcagttcggccaggcagtccagtaccgtcccgagcagcttctgctggcgtccgccgtggtaaccgcgggcgctcatctcaccgaccggcttgcccagcagcacgatctgactgctctgctcgccgcccggcttgagcagcaccgggttcatcagcgcggtcggctcgatccggcaggcctgcgcctgcatggcctgcgcccgcccgatctcggcgccctcccgcgtgacgaaggagttgagggacatgttctgcgccttgaacggcgccaccttgacgccctgtcgcaccagccaccggcagatcccggcggtcacgacgctcttcccggcgtcggaggtggtcccggcgacgagcagaccgccgccccgaccgctgctcatgacgtacgtcccttcgtcagacggttgcacagcagcttcgcggcggcgcacgtgccgagcgcgagccagctcacgcgccgtgagagccgtacggcgcgatcgatatcgcccacctggacggcgcgcccgcgctcgttgagcaccggccggtgctca

SEQ ID NO: 718 - DNA, 1490 bp, Unknown
  Kingdom: Bacteria, Phylum: Actinobacteria, Class: Actinobacteria, Order: Streptomycetales, Family: Streptomycetaceae, Genus: Streptomyces
gctcgcggccgtcgcgtccggtctgacctcgctgaccgccggtgcctcgcgcatcttcgagggcggcagcgtgaaccagacggttgtggagatggagcggggattcctcttcatcatgtccatctccgacggttcgtcactcgccgtacttgcccaccccgaagcggacatcggcctcatcgggtacgaaatggcgcttctcgtggaccgcgccggcacggtcctgaccccggatctgcgtgcggagctccagggaagccttctcaactgaaggacagacggtgcgtcgcggcgtcccggggccgtaaggtttcgggacgcggcttccactcggtggggtgcccggcgcagtcggaggaggagtaagagtggcaacacacccaggcggttcgtcttcggacaactggtcgtacggccccgtgcagggccacggcgacggccagacgaacccgtacgcctacccctccgccccctaccaccagcagccgtacgcgccgcagggccccggcccttcgccgtacgaccagccgccggcgccgcgcatccagccggtgcagccgcagcgacgcacccctgagccggcgcccatggcgtcgaacaacccactggtccgcccgtacgccatgacgggcggccgcaccaggcctcggtaccagctcgccatcgaggccctggtgcacaccaccgcgcaaccgcaccagatgcagggccagttgcccgaacatcagcggatctgccatctgtgccgcgagatcaagtcggtggccgagatctcggccctgctgacgattcctctcggcgtggccaggatcctcgtcgccgacttggcggaggcgggcctggtcgccatccatcagcccggcggcgacgagagcgccggcggccagccagacgtgacactgctcgaaagggtgctcagtggacttcgcaagctctagcggagggccggtttcccccagtcgttccaccacctccgcgaagatcgtggtggcgggcggcttcggcgtgggcaagaccacgttcgtcggcgccgtctcggagatcaacccgctgcgcaccgaggccgtgatgacgtctgcgtcggcgggcatcgacgacctcacccacaccggggacaagaccaccaccacggtggccatggacttcggccgcatcaccctcgaccaggacctgatcctctacctgttcggcacgcccggccaggaccggttctggttcatgtgggacgacctggtccgcggcgcgatcggcgcggtcgtcctggtcgacacccgcaggctcgccgactgcttcccggcggtcgactacttcgagaacagcggcctgccgttcgtcatcgccctcaacggcttcgacggcaaccagccctacggtcccgacgaggtccgcgaggcgctgcagatcggccccgacaccccgatcatcaccacggacgcccgccaccgcgcggatgcgaagtccacgctgatcacgctggtcgagcacgcgct

SEQ ID NO: 719 - DNA, 810 bp, Unknown
  Kingdom: Bacteria, Phylum: Actinobacteria, Class: Actinobacteria, Order: Streptomycetales, Family: Streptomycetaceae, Genus: Streptomyces
  misc_feature (229)..(323): n is a, c, g, or t
ggcacgcgggcgtccgtgacgtgcggggctcggggtacctggggtgcgcatcatcaagccccactgtgtcccaagaaggtgagaaacggatcccgacttcactgagattttcctgtgaaacccccgttcaccgcacagtgtgccccgcatcgcccttcttgtcccggcacccggcgcgccccccgacccaccccgtacgcgcgcgggcgcggcggaggaatcgccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatgaggcctgacctccgcgtgcccgcaggggtcgcggaactacccaccaggggcggtgacttacatgctctttgcggccgacaagggagacatcaacaccatcatcggcgggatcgctcccaactggggccccttcggcagcctgggcaacgaggcgaaggtgatgatcgaggtcgtgatggcggtggccatcctgctctgcctcggcatcgccgtctggggcgcggccaaacagcggatcggcgcgaccgccctgcgcgacaccttcagcgcggaacagggcaagggtctgatcatcgccggcctcaccggcgtcttcatcatcggctccctcggcacgctgttcaccatcgtgtacggcatggcggtgtagaccgtgcgacccatgtgaccggcgcacacccgcgcatgccgcgcacgctgcaccgcccgtaccgccggccggccccttggggcgcgaccggtgcccccgctgcccccaccc

SEQ ID NO: 720 - DNA, 4448 bp, Unknown
  Kingdom: Bacteria, Phylum: Actinobacteria, Class: Actinobacteria, Order: Streptomycetales, Family: Streptomycetaceae, Genus: Streptomyces
gccgccggccggcggcaagctgcgcgtgcaggcccgcatccagctgcccaacgtcacgggcgccgccgccaagggctactggcccgccttctggacgctgggctcgccgttccgcggcaactactggaactggccgggcgtcggcgagctggacatcatggagaacgtccagggcctgaacaccgactgggcgacgatgcactgcggcaccaacccgggcggcccctgcaacgagacgaccggcatcggcggttcgacctcgtgccccggcgcgacctgccaggccggtttccacacctacgcgatggagtgggaccggtccaccagccccgaggagatccgcttctccgtcgacggcgtcaccttccacaccgtgaaggccgatcaggtcgacgcgacgacctgggcgaacgccacgaaccacggctacttcgtcatcctgaacgtggccatgggcggcgggttcccgggcgcgttcggcggcggcccggacggcggcaccgagcccggccactccatggcggtggactacgtgcaggtgctccgctcctcgggcggaggcggcggcaccactcccccgcccaccggcaaccgcgacgcctacaaccccgtacaggcggagtcgtacgacggccagagcggggtgaacaccgaggcgaccaccgactccggcggcggccaggacatcgggtcgatcgcgaacggcgactgggcgctctacaagggcgtgaacttcggttcgaccggggcgacgcagttctacggacgggtcgccagcggcgcggcgagcggcgtcagcgggctggtcgaggtgcgcctggacagccggtccaacgctcccgtcggcagcttcgccctggccaacaccggtggctggcagtcctggcgtacggtcccggcgaacatcagccgggtgaccggcacgcacgacgtgtacctcaccttcaccagcggccagccggccgacttcgtcaacgtcaactggttcgacttcggccactgagcgccgtatcgcaccaccgccttcaccggggtcccgcgcagctcgcgcgggaccccggcccgtttcaccgcagctccgcccggaaggccaccggcgtctgacccgtgtgcaggtggaagaacttcgagaagttggccgcgtccgggaagccgaccgcggcgccgacgcggccgatggggagcccggtgtgggcgaggaggcgcttggcctccaggaccacccgcttgtcgatgaagcccttgggtgtctcgccggtggcggcgcgcacggcgcgcacgagggtgcggcgggagtagccgagggcgtcggcgtaggcgctgacgctgtggttggtggtgaagccctgttcgaccgcgtcacggaacagggtgaacgtggtgtcggcgtcggcctgctgccgtgcggcctccgcggagctggcggcgagatgggcgagccggagcaggaacgcggtcagcgagtgccgcaggaccgcggtgtgcaggctcagcggcagggtgtcggtgtcctcgtactcgcggcgcagttgggcgagcgcggcctcgagcgcctcgcgttgggccgcgtcggggtggagcagcggcggcaggtcgtagcggtacaggccggtcgcctcgacggtggcgcggggcaggaagccgggctgcatggtgaggacggttccgcggtactcgtccgtgcgggagaagcgatggacctgtccggggcggatccacagcacgtcgcccgcggcggcccggtactcggcgaagtcgaccatgtgccggacggggccgtcgctgaagagcatgacgacgtggaagtcgatgcggtggacacggtggagaggagcctcggagtgccaggtgtgcccggcgcccatgggacctatctgcagtccgacgccgccgaggctgaggtcgaccgggaaggggaaggtccggatcccctcgcccgcaccgccgcccccgtcgccgctcccggcgcctccgccgctcccggcgcccccgatgccactgccggcgtccccgatgccactcccggcgctgctccccgcgcgcgccgccgcgccgctctcgccgtcggcgccgtcctgggtgattgcgtccgccatgtccttctcgtaccgccttgaccgcccgcccgccgggccgggtgatccaaccgtgtcccactttcaccacaggctgacacacagagaccttccggcaaaaaagtctgacttttaagttcgaacacgtccggcagcaatccagcttcttccgaggacttcttgaagatgagcgagcagacaaccgtccccttcgagtggaccgacctcgaccggcgcgccgtcgacaccgcccgcctgctggcggccgacgccgtgcagaaggtcggcaacggccaccccggcacggcgatggccctggccccggccgcgtacacgatctttcagaagctgatgcggcacgacccgtccgaccccgagtggaccggccgtgaccgcttcgtcctctcccccggccacacctcgctgaccctgtacacgcagctcttcctcgccgggtacgagctgggcctggacgacctgaaggcgttccgcacctacggttcgaagacgcccggtcaccctgagtacgggcacacggccggtgtggagaccacgaccggcccgctcggccagggcgccgcgatggcggtcggcatggcgatggccgcccgctacgagcgcggcctgttcgacccggacgcgcccgagggcacctcgcccttcgaccacaccgtctgggcgatcgtctccgacggcgacctggaggagggcgtctccgcggaggcctcctcgctggccggccaccagaagctcggcaacctggtcttcctctacgatgacaaccacatctccatcgagggcgacaccgccaccgccttctccgaggacgtgctcaagcgctacgaggcctacggctggcacacccagcggatcgagccggacgagaacggcgacatcgacgtccacgccctctacgcggcgctgacggccgccagggcggagacgtcccgcccctcgatcgtggcgatgcgcacggtcatcgcctggcccgccccgaacgcgcggaacaccgaggcctcgcacggctcggcgctcggcgcggacgagatcgccgccaccaagcgcgtcctcggcttcgatccggagcagtccttccaggtggaggagtccgtcctcgcgcacacccggcgggccctggaccggggcgccgaggcgcacgcggcctgggacaagcagctcgacaagtggcgcggcgcccagcccgagcgggcggctctgctcgaccggatcgtggccggcaagctgcccgcgggctggcaggacgcgctgccggtgttcgaggagggcaagtcgctggccacccgggccgcctccggcaaggtgctccaggcgctcggcgaggtgctgcccgagctgtggggcggctccgccgacctggccggctcgaacaacaccaccatcgacaagacgtcgtcgttcctgccggcgggcaacccgctgccgggtgccgacccctacggccgcaccgtccacttcggcatccgcgagttctccatggccgcggagatgaacggcatcgccctgcacggcaacacgcgcatctacggcggcaccttcctggtgttctccgactacatgcgcaacgccgtgcgcctgtccgcgctcatgcagctgccggtgacgtacgtgtggacgcacgactccatcggactgggcgaggacggccccacccaccagcccgtcgagcacctcgcgtcgctgcgcgccatcccgggcctgaacgtggtccgcccggccgacgccaacgagaccgcgatcgcctgggcggagatccttgagcggcacgccacccgtccggccccgcacggcctcgtgctcacccgccagggcgtgccggcgtacgcgccgaacccggacgcggccaagggcggctacgtcctgaaggacgcctccaccggtactccggacgtggtgctcatcgccaccggctccgaggtgcagctcgccgtggccgcccgcgagacgctggaggccgagggcatcggcacacgggtggtgtcgatgccgtccgtggagtggttcgaggagcagccgcgcgagtaccgcgagcgggtgctgccgccgtcggtgcgggcgcgggtcgccgtcgaggccggcatcggcctgacctggtatcgctacacgggtgacgcgggacgcatcgtctcgctggagcacttcggtgcctccgccgacgccgccaccctgttcgccgagtacggcttcacccccgagaacgtcgtcgccgcggcccgcgcatcgctggccgccgcgcgcgcatgatccgcacgcaacaaggaagatgatcactgtgagcgaagcaaccgcgaccgccggagcgctgaagcgcctgtccgagcagggcgtgtccatctggctggacgacctgtcgcg

SEQ ID NO: 721 - DNA, 4467 bp, Unknown
  Kingdom: Bacteria, Phylum: Actinobacteria, Class: Actinobacteria, Order: Streptomycetales, Family: Streptomycetaceae, Genus: Streptomyces
gtccctgctgctggccgccgcgagggcggcggccagcagcagggacaggggacggaagcgcatgacgcggcccctcctccttcggacgggtcgcgcaccacggatcacacaagccgcagggacagtagcgcgcgccggtggtacagcggaagaccgcgtactcccccggcgcacgccggccactcacatgggtgggcgcgggccaagttgcttgacatcgttgtcggttgcggcggtagagtcatgtacagaccatccagacaacgttgtcgcaccacggtcgcccactcaagccagcaccacccacccggaccaggcgtcttcccccctttcgcctgcccggcccgcggacccggcggccacgactcacgtgccgccgggtccgcctgagcgtgtttccgtgccgggcgcgggcgcttccgccgggagaccgctggactccgaggcgcggacgcgcaccgggtcgaggtgcagttcgtgcgggcccatgcagtccgcggcgagggtggcgacgagcgcaccgcaggcgcacgccatgttgcgtccgccggtcccgaggggcccgcagcagccaaagtgggcgcccaaggagggcccggccagccggaggcccggcacgtcgtccgggtgcacgatcacggagttcctgggcccggcgggcaccatgccggtcatccggggcggcatgagcagcgcccggtccccggccgccggggccggcccacggggcgtttcgaacggcgcgccccacggttccgggtcgagcgcgaagtggccgcgcggaacagtggaagcggcgaggccggttgcccggtcccggtccttttcatgggtggagacgtcggggacggcgtcgaggagccggagttccggcgtgagccgtgctccgcaccggttgcagtggaagaccgtcatgcgcaccgttgtatcgcggtccgggtgcgcgcgagggccgcacccctttcgtcgggggtgcggccctctactgccctgccgtgccgcttacttgcggatcaggctgcgcagcacgtactgcatgatgccgccgttgcggtagtagtccgcctcgccgggggtgtcgatgcggacgaccgcgtcgaactcgacgccggtgtcggtggtgaccttcaccgtgcgcggggtggtgccctcgttcagctcggtgacgccggtgatggagaaggtctcctcgccgctcagaccgagggaggacgcggtgtggccctcggggaactgcagcggcaggacgcccatgccgatgaggttcgagcggtggatgcgctcgtaggactcggcgatgacggccttgacgccgagcagcgcggtgcccttcgcggcccagtcgcgggacgagccggagccgtactccttgcccgcgaggacgacgagcgggatgtcctgctcgatgtagttgcgcgaggcgtcgtagatgaaggcgaccgggccgccgtcctgggtgaagtcgcgggtgtagccgccctcggtgcccggcgcgatctggttgcgcaggcggatgttggcgaacgtaccgcggatcatcacctcgtggttgccgcggcgcgagccgtaggagttgaagtcgcggcgctgcacgccgtgctccgtgaggtactggcccgccggggtgtcggccttgatggcgccggccggggagatgtggtcggtggtgaccgagtcgcccagcttggcgagcacgcgggcgccggtgatgtcctcgaccgcctccggctcctggcccatgccctcgaagtacgggggcttgcggacgtaggtggactcggcgtcccactcgaaggtgttgccggtcgggatcggcagcgactgccactgggcgtcgccggcgaacacgtcggagtaggacttggagaacatgtcctcgccgatggcgttggcgacgacgtcgttgacctcggcctcgctcggccagatgtccttcaggtggaccgggttgccgtcctggtccacaccgagggcgtcctcggtgatgttgaccttcatggagccggcgatggcgtaggcgacgaccagcggcggggacgccaggtagttcatcttgacgtcggggttgatccggccctcgaagttgcggttgccggacaggaccgaggtgacggccaggtcgtggtcgttgaccgccttggagacctcctccggcagcgggccggagttgccgatgcaggtggtgcagccgtagccgacgaggttgaagcccagcttgtccaggtacggggtcaggccggccttgtcgtagtagtccatgacgaccttggagcccggcgccagcgtggtcttcacccacggcttgcgggtcaggcccttctccaccgccttcttggccaccagcgcggcggcgaccatgacgtacgggttggaggtgttggtgcaggaggtgatggccgcgacggtgaccgcgccgtggtccagctcgtaggtcgtgccgtcgggggcggtgaccgggaccgggttggacggggcgccgttggggtggacggccggggcgtcggaggccgggaaggactccacgcccgcctcgtcgacgctgtcgacgtagttgcgcacgtcctgcttgaactgctcggcggcgttcgccaggatgatgcggtcctgcgggcgcttgggaccggcgatggacggcacgacggtggacaggtccagctcgagcttctcggagtagtccggctcggcgttcgggtccagccacaggccctgctgcttggcgtacgcctcgacgagcgcgagctgctgctcgggacggccggtcaggcgcatgtagttgatggtctccgcgtcgatcgggaagatcgcggcggtggagccgaactccggcgacatgttgccgatggtggcgcggttggcgagggaggtcgcggcgacgccctcgccgtagaactcgacgaacttgccgaccacaccgtgcttgcgcagcatctcggtgatggtgagcaccaggtcggtggcggtggtgccggcgggcagctcgccggtcagcttgaagccgacgacgcgcgggatcagcatggagaccggctggccgagcatggcggcctcggcctcgatgccgccgacgccccagccgaggacgccgaggccgttgaccatggtggtgtgcgagtcggtgccgaccagggtgtcggggtaggccttgccgtcacggaccatgacgacgcgggccaggtgctcgatgttgacctggtggacgatgccggtgcccggcgggacgaccttgaactcgtcgaaggcggtctggccccagcgcaggaactggtagcgctccttgttgcggccgtactccagctcgacgttctgctggaaggcgtcgttggtgccgaacttgtcggcgatgacggagtggtcgatgaccagctcggccggggccagcgggttgatcttcgccgggtcgccgcccagctccttgacggcctcgcgcatggtcgcgaggtccacgacgcagggaacaccggtgaagtcctgcatgatcacgcgggccggcgtgaactggatctcctgcgacggctgggcctgggagtcccagtcgccgagggcgcggatgtggtcggcggtgatgttcgcgccgtcctcggtgcggagcaggttctccagcaggaccttcaggctgtaaggcagtcgggccgagccctcgaccttgtcaagccggaagatctcgtacgactcgtcgcccacctgcagcgtgctgcgggcgtcgaagctgttcgccgacacgacagtctccttcattgatgtgcgcgtaccaccacgatcctgccgccaggccatctcggccagtccgctaaggcaggcctaagttaggcgacccttaccggggtggcggcggtggcgctcctcggcagatatctcgatgtcgagataactctagtacatggggggcggaaggtcatgcgcggccggtgactggtctctcgcagccgccgcggtcgacaccacggaggccgccacggccgtctgggctccccacgcctctgccacgccgccggcgagagccggaccaggcagactcgccacgccgaggtcacggcatcgagcgtgttcgcccgggagaggtggtcgcccagtgaacaccgccggcgtcagcgccggctccagttcctccggcgaccccgtcatcgacggcatccggcccgtgcacggtcgggacaacgcgacatgccctctcttccgccatgcgatgccatgaccgcacgtcccgctgtggggcgtctacggcgtgaccggtgccgcacccgcgccgagcgcgaccagcaccgagccggtcacctggcccacgccatgggtacgcacgggcaccaacgcgggccggccgacgcagaaggcgatcgtcggggcgcccacgggtacggcgccgggcccgggctcggccagcagagccccgccggtgtcggtccgtaccgccaggatcggcccggcgccgcggcccgcgccgggcagcagcgccatcggcccgaagcccgt

SEQ ID NO: 722 - DNA, 2228 bp, Unknown
  Kingdom: Bacteria, Phylum: Actinobacteria, Class: Actinobacteria, Order: Streptomycetales, Family: Streptomycetaceae, Genus: Streptomyces
ccgggtgatcgtcgccacccggctcaccctgcggctcgggctgtccgcgacggcgatcggcctgctcggcgggctgctgctgggcctggcgccgagcgtgctgggccggcgcgcgggccgggcggtgaccggcgcggtcggcgtgctggtcgccttcccaggactgctgttcgtgctcttcctcgccaccatcttcggcatcggcagcaccggcgcggtgctggccatcggactggcgctggtgccgaccctggcccggttgatccagaacctggcgacgtccgtcgccggctcggactacgtcgcgaccgcgcggatcctgggcgtcagccggttccggatcgtcatccggcacgtgctgccgaacatcgtcgagccggtcgtgctgttcgcggcgcaggccgccaccgggtcgctcatcgccttcgccgggctgtcgttcctcggcctgggcgtgcagagcccggactacgactggggccggctgctcaacgaggggctgagccggatctacgtgaacccggcttcggcgttggccccgggcgtcgcggtggtgctggccgggctggtgttcggactgctcggcgaggcggtcgcgcagaccggcggacggcgcacggcggcgcgcgcggtaccggccgagcagacctccgtcgccgtggacgccgatggggcactcccgcggactccggcggacgtcgacggtgacgccctgatccaggtcaatggtctgcgggtctccttccccggcgggcggaccgccgtccgcgacgtctccctgtccgtcacggccggggaggccgtcggtctggtcggggagtccgggtccggtaaaagtctgaccgcgctggcactggcccagctggtgccctaccccggccacgtccaaggcgccgtacgcttcgacgggcacgaactgctcgcggacccgcgcgctgtccagcgaccgcacccgcctcggcttcccggtgaccaccgcccgcctcgcggcggtacgcgaccgcaggaccgccctcctcggggtcgacgaccccgaccaccgcacgcagcggcgcatgctgatcccgagcttcaccctgaagcgcgccaccgccctgcggccccggatccagtcgatcgtcgacgggctgctcgaccggatgaccgagcagggaccgcccgccgaactcgtgcgggacttcgccctgcccgtgccctccatggtgatctgcgaactgctcggcgtcccctacgccgaccacgagttcttcgaggagcagtcccgacggctgctgcgcggcccggacaccagcgacgtgctggacgcgcgcgaccggctggaggcgtacctgggcgacttggtcgaccgcaagcagaaggaaccgggcgacggagtcctggacgacctggtcgagcagcggctgcgcgagggcgaactggaccgcgcggaggtcgtcgccctggcgatcatcctgctgatcgccggccacgagaccaccgccaacatgatctcgctgggcacctacaccctcctgcagcaccccgaccggctggcggaactgcgcgccgaccccgcgctgctgcccgtggcggtcgaggaactgatgcggatgctgtccatcgccgacgggctgctgcggctggcggaccaggacatcgaggtggcgggcacgaccatcagggccggggacggcgtggtcttctcgacctccgtcatcaaccgcgaccagagcctctacgaggccccggacgacctcgacttccaccggcccacccgccaccacgtcgccttcggcttcggcatccaccagtgcctcggccagaacctcgcccgcaccgagctggagatcgccctcggctccctcttcgcccggctgcccggactgcggctggccgcaccgccgcaggagatccccttcaaacccggcgacacgatccaaggaatgctggaactccccgtgacctggtaagaggctgctcccatgcgcatcgacatcgacaaggaccgctgtatcggcgccggccagtgcgccctggccgccccgggtgtcttcacccaggacgacgacggcttcagtgccctgatccccggccgggaggacggcggcggcgaccccatggtccgcgaggccgcccgggcctgccccgtccgagcgatcaccgtgaccgagaaggacggcgtggccgagccggcggggtgaggcgggcgccggtcgcgacgacggcggcgagaggacgacggcggcgag

SEQ ID NO: 723 - DNA, 2962 bp, Unknown
  Kingdom: Bacteria, Phylum: Actinobacteria, Class: Actinobacteria, Order: Streptomycetales, Family: Streptomycetaceae, Genus: Streptomyces
tcgcgaggccgttccaggcggcgacgaccttgtcgtcccggcccggtgcgggccgctcggcgcgcgcctcgaacaggcggcggcggatcgcgtcgatgcgcgcggcgtcgtggacgccctcctggagcgggagctggaggacggaggcaccctcctcgaaggtgccctcctcggtcacgccgaagtactgggcggcgagttcggcgtcctcgtcaccgaggacctcgcgcaactgctccggcgtccacacgtagtaggcgccctccacgtgccgtccctgcccgtcgtcgctgtcggcatcgagcgcggaggcgaacccgccctgctccgtgcgcagttcgcggaccatgaagtcggcggtctccagagccacacggcgggccggttccgagccggtggtgcgccacaggtgggcgtagacgcggcagagcagcgcgttgtcgtacagcatcttctcgaagtgcggcacggcccagtcccggtccacggagtagcgggcgaagccgccgccgagctggtcgtagatgccgccgcgggccatccgctcgcaggtgtcccgggccatctgcagggcgccctcggcgccggtgcgggcgtggtggcgcagcaggaactcgatcaccatggacggcgggaacttcggcgcgccgccgaatccgccgcgctgcgggtcgtactcgcgggtcagcccgagcagcgcctgccccagctcctccccgcccggtgcccgcgtaccgccgtagccgatctcccgctgggccaggtcccgcacgatcttcccggcgacatcggtgacctcctcacggcgggtctcccaggcctgctggacgccctgcagcacctgccggaaggacggcatgccctgccggggcgcgggcgggaagtaggtaccgaagtagaacggctcggcgtcgggcgtcaggaacacggtcatcggccagcccccctgcccggtggccgcctgcaccgcctccatgtagacggcgtctacgtcagggcgttcctcgcggtcgaccttgatgttgacgaagtgctcgttcatgtacgcggcgaccgcttcgtcctcgaagctctccgctgccaggacatggcaccaatggcagctcgaatagccgacgctcaggtgcacgggcacaccacgccgccgcgcctcctcgaacgcctccgacgaccagggccaccagtcgacgggattgtcggcgtgctggaggagatagggcgaggtttcctgagccagtcgattcggcatggtcccatcctgcccgacaggggcgacaggccgcagaacgacctgcgcttcatccccggaagaccccgtcgtcgccgcccgccccctcagcgccagacgggggcgagccgggagaagtcccaggcctgctttcccttcacacccggctggacgatgcagtgctctaggactgctccagcgatctgccgcctctccgccagctcaccggacttccagcgtccgcgcatctcctccgtcatgcgcggccctgccggtgatccggagagcaggagtcgttcaagagcctcatccgcaagtggaccgctgatgctgcaccgctgacaggaccggcacgagtagacgtaggggctcctgcggctcctgcccttctgcgcacacagggttccgcggcacagcctgccatccgtccgttgcgcaccgcagcgcaggaagccggtggccaggtgccgtggagcggggcgtcgctcgcctccgcgtcggggagccccgctacccctgtgcaggtacaaactgccgggtgagaacgtcgcgcacaccgcgtgccaccggtccggcgccacgatgggctcccatcgccccagtacgggttcccccgtctccggcaccagcaacagacgccccctgttggaccggtatccacacaccctgggcgctgtgatgatctgtgtgacggtctgcgcattgggcctgccaccccgcgttcctgtgacgccgaggtcgaaccagtcccgggcgatcgcccggaccgcctttccggcgacccgctcgccgatcgcctgctcgaccaacgctgcctcctgggggtgcctggtgatcctgtcctcccgccatccgaagggcctgggcccactgtgcggcacgccctcgatggcacgggcccagtgccagttcagcacccgctcgctcctgcgccgtgtttcggtgaccgccgcttcgagtgaccgcaccgcctgcagcaggccctcttgcgagtacgggtccctgaagccacccggatcgaggtacacccgaccgggcctgcttgtcagtgcggcgaagaatcgggccagatcctcgggacgtcgatacaggcgatcgtccgcaacgcagacgacgccgtgtacctcctgaccctcggctgtgcgcccccgcaccagatcctcgagcaagcgatcgaacccgggccgcgccacgccttccttcgacgcggtgcgcccgttgtcgacgtaggtggccatcacccggcagccgtgctcgtgcgcggtgcgctcattgatccgcagctgatggcggactccatgaccgtccctttgccggaaatcctcggatgtccgggcgtaggacgcgacatcgaggagttcgctccgccagcgcgtatggacctcgttcacattccccccttccgaccaccagatcgacattcacaaaaacgagcgagacctacgaaggtcacgacaacggcgccactgatcgccaccccctcgcgctcgcgctccgctcgaaggacactcgtaggcaaaggagttgtggccggagggggacgggacatgcgggacgctcatcggggtgaggccgaacggctgctggcccgggccgtggaggaggaggtgcgccggtcgggcgggcgggtggacggcggtgtcctgctgtcgcgtgccaaggccgcgctggactcgctcgcacggccggcgcaggaggagtacgaggcgtacacgcgggcgctggacgaggcgg

SEQ ID NO: 724 - DNA, 924 bp, Unknown
  Kingdom: Bacteria, Phylum: Actinobacteria, Class: Actinobacteria, Order: Streptomycetales, Family: Streptomycetaceae, Genus: Streptomyces
gtgcccgccccgctcttcgtgttcatgccgccagtctgtccggcacacgggcacacgtcacggggccgggcccccgccccggggtgtcgtcagccccacccgcaccggcgaggcgaacggagactatgcctgcccgagccccagcaccttcgcctccacggcggggtcgagtcccaccgggggcaggtcgggtcgctggggcgcggtcccgccgatggcgcgcagccacgtccaggtgtcggcgaccgtctcggcgaccggacggcagcgcagccccgcggccacggcccgggagacatcggcgccgtgcagggcgtcgtgcccctcggtgcccgggggcatccacaccgggagctgcgtccacggctcgatgcccgcgtcgaggatcacctcggggtccgtccagcgcagctcggcgtcggcgccggtcgccgccacgcaggcctccagcagcgagcccatcgtggcgtgaccctgcgggctcatcaggttgtacggcccgctcaactcccgctccaccgacccgaggatccactcggccaggtcacggacgtcgacgtactgcaacggcaggtcccgcgggccgggcgccaggacgggaccgccctgggcgatccggccgagccaccagggcagccggccgatgttctcgtacggcccgaggatcagccccgagcgcaccagcaccgcacgatcggccccgaacgcgtcgatcgccgccagctcaccgcccagcttgtcgcgggcgtagtcggtcgcgtccgcgtccgcgtcggcgccctcgaccagggccgcctcctcggtgtacccggcgggcggcgcccaggcgtacaccgagcacgtcgacacgtacacgtaccgcccggcgcgctcccgcagcagccgcgccgcgtcgcggaccgggcggggcgcggccgaccaggt

SEQ ID NO: 725 - DNA, 5361 bp, Unknown
  Kingdom: Bacteria, Phylum: Actinobacteria, Class: Actinobacteria, Order: Streptomycetales, Family: Streptomycetaceae, Genus: Streptomyces
acccgtcccatggcagtgatccacatgctccggcgaagccgacggcaggaactgcagacaccggatcgagcgacgctcgacccgtgtcccgcttcgcgaaggcgctgctcgcacgcggtccggccggatccggcctgcccggtgccgggcagcgccgacggagcgcccggggccgccgccggggcgcgaaggctgcgcgcggatcggccccgccgaccgcgcacagcccttcacccccctgcatggcccacccctaagccccgtacaccttcggaacgaaggagatcgcggcctactgcccgcccttttgcacgaatgagcgaacgaagtcctcggcgttggactcgagcacatcatcgatttcgtcgaggacgtcgtccacgtcgtcgctcagcttctcgtggcgttccttgaggtcttcggccgcctgtgcgtcctgcgcctgctcctcgacctcctcggtcgtgtgcgtcgccttctgctggccgccgccggtgtccttcgttgccataaccctcaccccgctcagttcgcccgacatggtcggcattaccgccgatcggtgatgatcagaccctacaagccgggtccgacatcggccccacggtttccgcaacctccgggggccacctcgatgattcccggaccgggggatttccaccctgtccgggcggtccggtccgggtacccgctcagctgccggacaggaccctgaccaggtcctccgcggtacggcagcggtcgagcagttccttgacgtgattacgcgttccgcgaagcggttccagggttgggacgcgctggagcgagtcgcggccgggcaggtcgaagatgaccgagtcccaggaggccgcggcgacgtcgtcggcgtactgctccaggcagcggccccggaagtaggcgcgggtgtcctccggcggcttcctgcgggcccggtcgacctcggactcgtccagcagccgcttcatgcgcccgcgggccaccagacggttgtacaggcccttctcggggcgtacgtcggcgtactggaggtccacgaggtgcaggcgggcggcgtcccagtcgaggccgtcgcggcgccggtagccctccatcagttcccgcttggcgacccagtccagctcgccggccaggctcatcgggtcgttctccaggcggttgagcgtgtcctcccagcgggcgaggacgtccttggtctgctcgtcggcgtcggcgccgaagcgttcctcgacgtacttgcgcgacagctcgaagtactccatctggagctgcaccgcggtgagtgtccggccgctgcgcagggtgatcagccgcttgagcgacgggtcgtgcgagacctggtgcagggtgcggacgggctggtcgacggcgaggtcgacggcgatgaagccgtcctcgatcatggacaggaccagggaggtcgtgccgagcttgaggtaggtggagatctccgagaggttcgcgtcgccgatgatcacgtgcagccggcggtacttctccgcgtccgcgtgcggttcgtcgcgggtgttgatgatcgggcgcttgagcgtggtctccaggccgacctcgacctcgaagtagtccgcgcgctggctgagctggaagccgtgctcgtgaccgtcctggccgatgccgacgcgtcctgcgccggtgacgacctggcgggagacgaagaagggcgtgaggtggcgcacgatgtcggagaaagcggtttctctccgcatcaggtagttctcgtgcgtgccgtacgaggcgcccttgttgtcggtgttgttcttgtagaggtggatcggctgggcgccgggcagctgcgcggcccgttcggcggcctcggccatgatccgctcgccggccttgtcccacaggacggcgtcgcgcgggttggtgacctcgggcgcgctgtactcggggtgggcgtggtcgacgtagagccgtgccccattggtgaggatgacgttggccaggccgatgtcctcgtcggtgagctggctggagtcggcggcctcgcgggcgaggtcgaagccgcgggcgtcccgcagcgggttctcctcctcgaagtcccagcgggcccggcgggcccggtgcatcgccgccgcgtaggcgttgacgatctgggacgaggtgagcatggcattggcgttggggtgaccggggacggagatcccgtactccgtctcgatgcccatcactcgccgtacggtcatgcggccctccttgcccggcggcgccctcggtcgagggcggcgctcaagtaccgctggtgctcggttgcctgtgcggtgcccgtccccgcactgcgcgacccggcggtacgaacgagcctagaacgcctttgcgctggtggggagatcatttgcgtcattgcctggtccatgcggtggcccctggaaagcagtcggctgcgggtacccggtgagggcacccgcagccgccctgtttttacaggtactgaccggtgttcgccaccgtgtcgatggagcgtccggtgtccgcgccctgctttccggtgatgagggtgcggatgtacacgatccgctcgcccttctttccggagatccgggcccagtcgtccgggttagtggtgttcggcaggtcctcgttctccttgaactcgtccacacatgcctggagcaggtgggagacgcggagacccttctggttcttctccaggaagtccttgatcgccattttcttggcgcggcccacgatgttctcgatcatggcgccggaattgaagtccttgaagtagaggacttccttgtcgccattggcgtaggtgacctcgaggaagcggttctcctcggattcggcgtacatctgctcgaccgcggtctggatcatggcaccgaccgtggcgcccttgtcgccgccgtgctccgagaggtcgtctccgtgcagcgggaggcgctcggtgaggtacttcgcgaagatgtccttggccgcttcggcgtcgggacgctcgatcttgatcttcacgtcgagccggccgggccgcaggatggcggggtcgatcatgtcctcgcggttggaggcgccgatcaccaccacgttctgcaggccctccacaccgtcgatctcggcgagcagctgggggacgatggtgttctccacgtccgagctgacgccggagccgcgggtgcggaagagggactccatctcgtcgaagaagacgatgacgggggtgccctcgctggccttctcccgggcacgctggaagacgaggcggatctgccgctcggtctcgccgacgtacttgttcagcagctcggggcccttgatgttgaggaagaagctcttgccggcggcctggccggtgacctcggcgaccttcttggccagcgagttggcgacggccttggcgatgagcgtcttgccgcatccgggcggcccgtagagcagcacacccttgggcgggcgcagttcgtgctccttgaacaggtccgggtagaggtagggcagctcgaccgcgtcccggatcatctcgatctggttgccgagaccgccgatctgctcgtagccgatgtcggggacctcttcgaggacgagttcctcgacctcgctcttgggcacgacctcgtagacgtagccggacctgggttcgagcaggagggcgtcgccggcgcggatggtgacgtccagcagcggctccgcgagccgcaccacccgctcctcgtcggtgtgcccgaggacgagggcgcgctcgccgtcctcgaggatctccttgagggtgacgatgtcaccgacgcgctcgaactccatggcgtcgaccacgttgagtgcttcgttgagcatcacttcctggccgcgccgcagctcgtcgaggtcgacgctggggctgacgttcacccgcagtttgcggccgccggtgaagatgtcggcggtgccgtcctcgttggactgcaggaagacgccgaagccggcgggcggctgggcgagccggtcgacctcttccttgagggccacgatctggtcgcgggcctcgcggagcgtgttcgcgagccgttcgttctgtgcggacacgccggccaggttggtctgcagctcgacgatccgctcttcgagaatcctcgtgtgccgcggagagtcggcgagcttgcgtcgcaggacggcgatctcctgctcaaggtaggcgatctgcccggccgggtcgtcggaccctcgtcccgggcggatgccgcggttcatgtcgtcgtcgtgggctgccacggtcctcacctcctccaaggggagctggacgcttccagaccctacctgggtgggtgtcgattgaaacccctagatcacaaagactgtcggggtgtgtccgatcttcacccttgcgctctccctcacgccaggggaatacccaccgaacatgattggaaagcggacggaggtagggtcgagatgttcaacacccgtcggagctggcctgattcccgcccggtacgacgtgaaacggcaggagagatgagcgtgcagcagctgaccgcggacggtggcgaggagctggaggtctggatcgaccaggacctgtgcaccggtgacggcatctgcgcgcagtacgcgccggaggtgttcgagctggacatcgacggtctggcctatgtgaagggcccgcaggacgagctgctgcaggcgccgggggcggcaacgcccgtgccgctgccgcttctcacggacgtggtggactcggcgaaggagtgtccgggcgagtgcatccacgtgcgccgtatttcggacagggtcgaggtgtacgggccggacgccgagtgacggttcggtcgccgatcgtggtcgccgtggtgttccgcgcggcggtcaccggctgattccacgccgtcgccgctgtctgattcctcacagcggcgcctacctgtccgcggcccggccgacgggcggcgaacggaccgctcagacactgctcctccgcccggataccgcgtgtccgctcagacgctgcgcgtccgctgcggtgcggagcggacgaacgcgccgctcttccactgccacttcgcgctgcccttgaggtcggggcagcaattcggtacgtcgggcgaggagtagccgagcagggtggcggtgacctcgcccgcgtgcacggcgaagtccgtgacggtgtaccggtccttgggatcgacgagggtggccacgacgcggggcgtgcgcgtgccccgggcgtaggtgaggacgtagacggcgtcgggcggggtgcccatggaggcgtcgcagtgcacgacggcgacggtctccggggtgccgtcgtggtcgaggtccccggcggccttcttggcgacgacggccttcagggggccgcactggatcgggaaggcgacgccggtggtggtggggggtgcggcggtcacgggggcgctctgggtg

SEQ ID NO: 726 - DNA, 3581 bp, Unknown
  Kingdom: Bacteria, Phylum: Actinobacteria, Class: Actinobacteria, Order: Streptomycetales, Family: Streptomycetaceae, Genus: Streptomyces
tcgcgcggttccccgcgccccttcggggcgtcccgtcgtccggggtgtgatgttcaccgcttggggcggggggactgggcagttacattacccgcgagtagcatgagtgctgagcgcgcgctcagtgctgcgcgtcgcagcagtgccatcccgcaccctggaggagagccatcgtgcctcgtaccgtcagggacgtcgtcttcgtcgacggcgtccgcaccccgttcggcaaggcgggcccgaagggcatctaccacgagacccgcgccgacgacctcgtcgtgaaggcgatccgggagctgctgcgccgcaaccccggcctcgacccgaagaaggtcgacgaggtcgccgtcgccgcgaccacgcagatcggcgaccagggcctgaccatcggccgcaccgccggcatcctcgcgggcctgcccacctcggtccccggctactcgatcgaccgcatgtgcgcgggtgcgctgaccgctgtgaccacggtggccggctccgtcgccttcggcgcgtacgacgtcgccatcgcgggcggtgtcgagcacatgggccgccacccgatgggcgagggcgtcgacccgaacccgcggttcgtcagcgagaagctggtcgacgagtcggccctgttcatgggcatgaccgcggagaacctgcacgaccgctacccgagcatcaccaagctgcgcgccgacgagtacgcggtccgctcgcaggagaaggccgccaaggcctacgcgaacggcaagatccaggccgacctggtcccgatctccgtacgccgcaccacccccgaggggggcgagaccggctggggtctggtcacggcggacgagcccatgcgtccgggcaccacgctggagaacctggccggtctcaagacgccgttccgcgtgcacggccgggtcaccgcgggcaacgcggccggtctgaacgacggcgccaccgcctccgtgatcgccagcgaggagttcgcccgcgagaacggcctgccggtcaagatgcgcctggtctcctacgccttcgcgggcgtggagcccgaggtcatgggctacggcccgatcccggcgacggagaaggcgctggccaaggccggtctgtccatctccgacatcggtctgttcgagatcaacgaggccttcgccgtgcaggtgctggccttcctggagcactacggcatcgcggacgacgacgcgcgcgtcaaccagtacggcggcgccatcgcgttcggccacccgctggcctcctccggtgtccggctgatgacgcagctggcccgccagttcgaggagcagccgcacgtccgctacggcctgaccaccatgtgcgtcggcttcggcatgggcgcgacggtcatctgggagaacccgcacttcgagggggacaagtgagcaccaccgccgagctgttgaagcaggcctcggacctgttcccggacgaggtcgtcacgcaggcgcacgtacgccacttcgacctgcccctgggcgcgggccgtttcgcgctcatcaccctggacaacggcctggaccacaccaagccgaccaccttcggaccggcctcgctcgcgaacctggacaccgcgatcgaccaggtcgagaaggaggccgcggacggcgagatcaccggcgtcggcatcaccggcaagccgttcatcttcgcggtcggcgcggacctcaagggcgtggagctgctcaagcagcacgaccacgcgctcgccatcggcaagggcggccacgaggtcttcaagcggctggcgaagctggccgtgcccaccttcgcgtactacaacggcgcggcgatgggcggcggcgtcgaggtcggcctgcactgcacctaccgcacggtgtccgcggccctcccggcgttctcgctgcccgaggtcttcctcggcctcgtccccggctggggcggctgcacgctgctgccgaacctgatcggcgccgacaacgccgtcacggtcatcatcgagaacagcctcaaccagaaccggcagctcaagggcaagcaggtctacgaactcggcatcgcggacgcgctgttcgagggcgcggacttcctggagcagtcgctgatctggacggcgtcggtcctcaagggcgagatcgccgtggagcgtcaggcgatcgaccgcggcgagggctgggaccaggccgtcgcgcgcggccggttcatcgccgactccaaggtgcacggcgcggccccggccgcctaccgcgccctggacatcatcgccgccgccaaggacggcgatctccaggccggttacgacgccgaggaccaggccctggcggacctgatcatgagcggtgaactgcgcgccggcatctactcgttcaacctggtgcagaagcgcggcaagcgtcccgcgggcgccccggacaagaacctggcccgcccggtcaccaaggtcggcgtggtcggcgcgggcctgatggcctcccagctggcgctgctgttcctgcgccggctcgaagtgccggtcgtcctcacggacatcgaccaggagcgcatcgacaagggtgtgggctacgtccacgccgagatcgagaagctgctgggcaagggccgcatcaaccaggacaaggccaaccgcctcaaggcgctggtcaccggtgtcctggacaaggccgagggcttcgcggacgcggacttcgtcatcgaggccgtgttcgaggagatgggtgtcaagcagcaggtgttcgcggaggtcgaggcggtcgccccggcgcacgcgatcctcgccaccaacacctcctccctctcggtgacggagatggcgtcgaagctgaagcaccccgagcgggtcgtcggcttccacttcttcaacccggtcgcgatcctgccgctgctcgagatcgtccgcggcgagcagaccgacgacgcgtcgctggcgacggcgttcgcggtggccaagaagctgaagaagaccgcggtgctggtcaaggacgccccggcgttcgtggtgaaccgcattctcacccgcttcatgggcgagatccagaacgtcatcgacgagggcacgccggtcgaggtcgccgagaaggcggtcgagccgctgggcctgccgatgtccccgctggtcctgctcgaactggtcggcccggcgatcgggctgcacgtctcggagaccctcaacaaggcgttccccgaccgcttcacggtctccccgaacctcaaggcggtcgtcgaggccggcaagcgcggcttctacgtctacgacagcggcaagcccgaactggacccggaggtcgccgcgctgctcaagcagggcgacaccgtcctgaccgaggagcaggtacgggcccgggtgctcgacgcggtcgcgcaggagatcgggctcatgctggaggagggcgtcgtcgccgaggcccaggacatcgacctgtgcctgatcaccggcgccggctggcccttccacctgggcggcatcacgccgtacctggaccgtgagggcgtcagcgagcgcgtcaacggcaagcggttcctggcggcgggcgtggcgtcggtcccggcgtgaggcgcgaacacgtgtgagatgtgagaggggcccctgctcggcgggggcccttctcacatctcac

SEQ ID NO: 727 - DNA, 6938 bp, Unknown
  Kingdom: Bacteria, Phylum: Actinobacteria, Class: Actinobacteria, Order: Streptomycetales, Family: Streptomycetaceae, Genus: Streptomyces
ggcgagggccggtgaggtcgcgccgaagcccgcggccagggcgaggccgccgatccaggcgccgcccgcgttggccaggttgaaggcggcctggttggcggaggaggccagggacggggcggcggacgccttctccatgaccatgagctggagcggcgagccggtgacgaaggccgccatgccgagcagggtcaccgccagggccgcgctccactcggcccgcatcagcagcgggaagaggaacagcacgaccgccagcgaggccagaccgccgaacagcgtgccgcgcagcgagtggtcggcaaggcgtccgcccagcaggttgccggccgtcgcgcccacgccgaacagcgccagcagcacggtcacgctggactcggcgtagccggcggcgccggtcagcatcggggtgatgtagctgtacgcggcgaacagcgcgccgaaaccggcgacggtggtgagcagggccagccagaccggcagcgagcgcagggccgccagttcgccgcgcagcccggaggccggggcggcgtgggcgtggtcgcgggggatgagcagggcgagggcggcgatcgccgcgacgccgatcgcgctcacgccgaggaacgtggcccgccagcccaggtgctggcccatgagcgtggcgaccgggacaccggcgacgttggccacggtgaggccgaggaacatcagcgacaccgaacgggccttgcgctccggcggcaccatgccggtggcgaccaccgcgccgacgccgaagaaggcgccgtgcggcagtccgctcaggaagcgggcggccagcagccagccgtggccgggggcgagcgcggagagcgcgttgcccacgacgaacaggaccatcaggccgatcaggacgtgccggcgggacatccgcgcggtgagcgcggccagcagcggcgcgccgatgaccacgcccagcgcgtacgcggacaccaggtgtccggcggtggggatcgagatgtgcaggtcgtccgcgacatcgggcagcaggcccatcatcacgaactcggtcgtgccgatgccgaaggcgcccacggcgagggcgagcagggccaggggcatgaaagacctttcgaggtgggttccgtacagcgtgcgacttgtatgttcagctgcggaacaaagtctctcaggcctggtattccggcaggttacgagccggttgccgatgtggtgaccttcacacgcgccgcgatcggcaggtggtcgctgccggtgcgcggcagcgtccaggagcttaccggttccacgcccctgaccatgatctggtcgatgcgggccatcgggaacgacgccggccagctgaacccgaacccgctgcccgccgccccctgcgtggagcgcatctgcgaggtgaccgcgcccagcgaacggtcgttcatcgtgccgttcagatcgccgagcagcaccacccggggcagcttctcgtgcgcgatcgccgcgcccagcgcgctcgcgctgtggtcccgctgctgagcggtgaacccggcgttcatcttcacccggacggagggcatgtgggcgacgtacaccgcgaccgcaccctcgggcgtcgccaccgtggcgcgcagcgcccgcgtccagccgaggcggatgttcaccggccgcaccgcgctgagcgggtacttgctccagacccccaccgtgccctccacggcgtggtacttgtacgtcgacgccagcgccctctcgtagacgggcaccgccgacgccttcagctcctccagcgcgagcacgtccgcgccggacgccgcgacctcccgtgccgtgccggtcgggtcggggttgtcggcgttgacgttgtgcgtggccaccgtcaggtcaccgccgccgccggtcttgtcggtgatcagaccgccgaagaggttcagccagacggcgacgggcagcaccagcgcgatcagcgcggtcgccgacttccgtaccagcgcgacgacgagcagcaccgggacgaacaggccgagccacggcaggaacgtctcggtgagagagccgaggttgccgacgcggttggggatgtgcgagtgcagcagcatcaccagcgccagcagcaccgccagcacggccgtcacgatgccccggcgccagatccgccggtcgccgcgccagccgcgcagcagacggtccatcaggcgccgaatccggttcttcgcctgctcgggctccgagccgccgtcgtccgtctccgtcaagtacgcctgctgcgccataccgccgcctcactgcctgctgtgccaccgttcaccccgtgggctacgaccctaggggatgatcggttccgttcctgccgtccatgacggccgtacgggcacgaggacgaacgagtcggcgcggtgagttccggttggagcgctcccggcgtggtctgtgacgaaacgggcacatttcgcgggagcggcacgctcaggacggagtggccggcccggcctcccgagggaggggccgcagtccttcgaggaccgtgtccacgatctgctccgccagtccctcgggcaggtccgcgtcgggccgcatgacggtgcgcaccagcatcgggccgacgatgaggtcgttgagcagttcgacgtcgacgtcggcgcgcagctcgccgctctgctgtccgcgccgcaggacctcgatctggagtctgcgccggggttcgacgaccgtggcgtggtaggcgcaccagaccttcgggctggacttcatctgggcgtagacgttgtgcaggatcgccgaggagcggctcaccagcccgcgccggcgcagttgctccaggagggcgacgaggtcgtcgcgcatggacgtgccgggcaggtcggcgtcgggcggctcggcggcgcgcacgacgtcgacgaacaactcgtccttgccgctccagcggcggtagatcgtggccttgccgacgccggccgtgcgggcgatgcgctcgatggagagttcggcgagcggcacgccgtcctccaggagcttcatcacgccctcgacgatggcgcgttccaccgcctcgctccggggccgtccccgtacggggaacccgggtgcggtctggctgtcggcgaggctcacctgagacgtcctttcgtcgtaccgggtcattgtccccggtgacccgcggtggtcccgcccaccgcgggccgtccgcccccgtcgactgctccgcccccgtgttccgtacgtcgtcctgctcgttgcggtggttctagtcggccgaggccaccagttccggttcctgccggtcctcggtgtgcttcggcgtgcggccgggcaggaacacggccaccacgaccgcgccgaccagcgcgaccacggtgccgcacagcgaggtgacgtgcatggcgtgcaggaaggcgtggttggccgggtcgaccagggcctgcccgcgcgggccgagcttcgccgcgatgccgagcgtggcctcgatggactcgccggccgtgtccctcaggccgggcgggagcatgccgagcttgccctcgatggagtcgcggtaggcggtggagaggaccgagccgagcaccgcgatcccgagcgcgccgccgacctggcggaaggtgttgctcagcgcggacgccgaaccggccttctcgcggggcagggcctgcatgatgaccacgctggtcggggtcatgatgtgggccatgccggtgcccatgaggaagaagacgacctccaggacccagatcggcgtgtccgcctccaggccggcgaacgcggccagcatgccggccagcacgacgagaccggccgtggtggtggccttgttgccgaagcggtcgacgaccagccgggcccgcggcgcgaagatcatctgcgcggcggccagcgggatcatgagcaggccggactgcagcggggagtatccgcgcacgctctgcatgtagaagacggagaagaacgtgacgcccatcagggcgaagaagaccagcgcgatggcggccatggcggccgagaacaccttgttcttgaagtaggtgacgtccagcgacgggtggtcgctgcgcttctcgaacacgatgaacgcggcgaggacgagggcaccggcgatgatggtcgcgagcaccgtcccgttggtgaagtcggccagctcgccgcccttgatgatgccgtagacgagcaggaccaggccgaccacggacaggacgacgccgatcgggtcgagccggccggggcgcgggtcgcgggagtcgggcaccagccagaccatcagcaccaccgcggcgatcacgatcggcacgttgacgaggaagaccgagccccaccagaagtggtccaggagcaggccgccggtgatcgggccgatggcgatggcgaggcccacgccgccggcccagatgccgatggccttgggctgctcctcgcgctcgaagacgttcatgaggacggcgagcgtggccggcatgacgaacgcggcgcccagggccatcagggcgcggtaggtgatcagctggcccggggagccggactcggcggccagggcggagccgatgccgaagacgacgagaccgccgagcagcaccttcttgcggcccacccggtcaccgatgaggccggcggtgaacagcagtccggcgaagacgagcgtgtaggcgttgatcgcccactccagctcgctctgggtggcgccgagcccggtcggggccggtgtcgagatcgtcttgatggcgacgttcaggatcgagttgtcgagcaccactatcagcaggctcagcatcagcacgccgaggatcgcccaacggcggcggtgcaccgcttccggaatccgggagccggcggcggctcggtcggcaggagtagtcatgtctccgagcgtaggacgatttcgatacgagaccgtatcgtatcgaaatcttttactcagatcttacgaccggtggagaacgggtcgggcgcgagtggggcgcggcgcgcggcaccggggggtgctctggtccaccgcgcgcggagatgccaccatggaggggagtccggggacgccgtcagggcgcctcgagatgactgaaggagccgttgcaatgacgcagcttccggctgcccagcctgcacagaagagcacctccgacggcagtggcaagacgctgtacggaggaaagggcacccgccgcatcaccgtccgcgacatcgccctcgccaaggagcgcggcgagaagtggcccatgctcaccgcctacgacgcgatgaccgcgtccgtcttcgacgaggccggcatcccggtgatgctggtcggggactcggcgggcaactgccacctcgggtacgagacgaccgtgcccgtcaccctcgacgagatgaccatgctgtcggccgcggtcgtgcgcggcacccagcgcgccctgatcgtcggcgacctgccgttcggttcctaccaggagggtccggtgcaggcgctgcgctcggccacccgcctggtgaaggaggcgggcgtcggcgccgtgaagctggagggcggcgagcgctcgcacgagcagatccgcctcctggtggagtccggcatcccggtcatggcgcacatcggcctgaccccgcagtccgtcaacgccatgggctaccgcgtccagggccgcggcgaggaggccgcccagcagctgctgcgcgacgcgaaggccgtgcaggacgcgggcgcgttcgccgtcgtgctggagctggtccccgccgagctggcggccgaggtgacgcgggtgctgcacatcccgaccgtgggcatcggcgccggccccgagacggacgcgcaggtcctggtctggaccgacatgctcgggctgaccggcgggcgggtgccgaagttcgtgaagaagtacgccgacctgcgcacggtcatgggcgacgcggcgcgcgccttcgccgaggacgtcgtcggcgggacgttcccgctggaggagcactccgtccactaggacaccgggcccgccggatcactggcgtgcgcccactggaccactgcggtgacaccgaggagccccggccgatcttcccccgtcggccggggctccttcctgccgtgcgccggcgtgcgccggcgtgcgctgtcgtgcgcgaggactacgcgtgctcgcgccagccgttggtgatcggcagcctgcggtccttgccgaagcccttcgcggagatcttggtgcccggcgggtactggcggcgcttgtactcggcccggtcgaccatccgcagcgtcttgacgaccagctcacggtcgtagcccgccgcgacgatctcgtcggcgcccttgtcccggtccacgtacagctccaggatcgcgtcgaggaccgggtagtccggcagcgagtccgtgtccacctggccggggcgcagctcggcgctcggcggcttgctgatggagttctccgggatcggcggggtctggccgcgctcggccgccgcccggttgcgccactcggcgagccggaagaccgacgtcttgtacacgtccttgatcgggccgtacgcgcccaccgagtcgccgtacagcgtggagtaacccaccgccagctccgacttgttgccgggggcgaggacgatgtggccctcctggttggagaccgccatcagcagcgtgccgcgcagccgcgactgcaggttctcctccgccaggccggtcagcccgagcgagcccatgtacgcgtcgaacatcggctcgatcggcacggtgcggaagtgcaggccggtgcgccgggccagctcggccgcgtcgtccttggagtgctcggaggagtacttcgacggcatggagatgccgtacacgttctccgcgccgaccgcgtcgcaggcgatggccgcgaccagggcggagtcgatgccgccggacaggccgacgaggacggaccggaagccgttcttctgcgcgtacgcccgcaggcccacgaccagcgccgtgtagacctcctcgtcgtcgcccaggtggtcggcgaaggcgcccgtgaacgcgggcgccttcgccgaccacc

SEQ ID NO: 728 - DNA, 4910 bp, Unknown
  Kingdom: Bacteria, Phylum: Actinobacteria, Class: Actinobacteria, Order: Streptomycetales, Family: Streptomycetaceae, Genus: Streptomyces
gtgctttccaggttcccgctcggctttcgcttcgcgtttccctttccggcggttccgactctatcagatcctttttcgatccgattccctgtcggcgggattgtctcgggcttttcgggctttcgctcgtcggcctttcgacattcactacgttagccgattcccgtcccgattcataatcgggctccgctggttcgaattcgggcgtgcgagcacgccacaatcgaccccggcgaaggggcggtagctagatagtgggttggccgctccggctgcaggcgatcgccgtacccggttcagcggcttgggctacgttacgcaccttgccggggcgagtcaacttcggcgccgcttgggcacgtgggcgcggtacgggctcaccgtcgggtcgtcggcgacccagtagcgccaggggtggacgtccccatctccaccctcgccggcgacgccggtgcgtgggccgttgcacacctggtcggccgggacgggggtgccggtcaggatacggatcggggtgtggcccgcggcgcaggcgtccgtgccgtccagtgcccggtcgacgcccagggcggtggccagccgggcggggcccttggcgagttccttgtcgttgcgggccgagggcctgcgggtgcgcgccagctcggcaccctcgacgatctcgccggcccggagcaggaccccgctcgcccggccctccggtccgcacaccaggttcatgcagtgccacatgccgtaggtgaagtagacgtacacgtgtccgggagggccgaacatcaccgcgttgcgggccgtccggccgcggtaggcgtgggaccccgggtcgttcgggccgtcgtaggcctcgacctcggtgaggcgcagcgcgatcgggccgtcgggcgtcgtccggacgaggagtcggcccaggaggtcgggggcgacgtcgaggacgggacggtcgaagaagtctctgggcagtggcgtacggtccgaaggcgcgatcatgcggtccgagcgtagtccagacgggtgggtgtcaagggctggtcaaggatccctccgcttgccagggtgtggacgcggaaccggtcgaggccggatcgcgtaagtaggaatcagtgatccacaccggatagggagagacatggcgttcaggaagctgctcgcgagcctcggagcgggcggggcgtccgtcgagacggaactgcacgaggtcaacgtcgtgccgggcggagtcgtgcagggggaggtgcggatccagggcgggtccgtgaaccaggagatcgagggtctgtcggtcgggctgcaggccagggtcgaggtcgagagcggcgacgaggagtacaagaagaacatcgagttcaccaaggtgcggctcggcggcgcgttcgagctgcaggccggagcggtgcacgcggtgccgttcggtctggagatcccctgggagacgccggtcacgatgatcgacgggcaggcgctgcggggcatgcacatcggggtgacgacggagctggcgatcgcccgcgcggtggactccggtgacctggacccgatcaacgtccacccgatgccggcgcagaaggcgatcctggacgcgttcatccagctgggtttccgcttcaagcacgcggacatggagcgcggtcacatccgcgggacgcggcagcggctgccgttctaccaggagatcgagttctacccgccgtcggagtaccgcggtctgaacgaggtcgagctgagcttcgtcgccgacgagcacgcgatggacgtggtcctggagatgggcaagaagcccggcctgttcagcgagggcagcgacacctaccgctcgttccaggtgggcctgcacgactaccagcagaccgactgggcggcgtacctccaccagtggatcgccgaggtcggcagcaagcgcagctggttctagcaagcgctgcagctggttctagcaagccctaggctcggtaccgactacaggaacgatcaggaggtaccgaggtgaccgagctgaagcggcggccgctcccccatgacttccatccgcccgtgccgtcgttcacggtcacgagcgacgacgtccgggaaggggcggcgctcaaggacgcccaggtgcagtcggcggggaacacctcgccgcagctgcgctgggagggtttcccgtccgggaccaagagcttcgccgtgacgtgctacgacccggacgccccgacgggcagcgggttctggcactgggtgctgttcgacatcccggcctcggtgaccgagctgccggcgggtgcgggcggcgggaagttcgaggggctgcccgagggggccgtgcacgcgcgcaacgactacggcacgaaggacttcgggggcgccgcgcccccgccgggggacggaccgcaccggtatgtcttcacggtgtacgccgtcgatcaggagaagctcggtccggacgcggacgcctctccggcggtggtgggcttcaacctgcggttccacacgctgggccgggcccagctgatcggtgagtacgaggtgcccgccgggggctgagccgcccgccgtgcgttgtcgcgttcaccgaacgtttgcccgcctctggtcttggaagtgaccggaggcgggcatttttattgcgttgtccatcccggcccgcccgtccagagttggtccgggcccgccggggggtgggcaggtgcacacgggaggtgggccggatgcgggacacgctggtgctgaacgcgagcttcgagccgctgtcgacggtgacgttgaaccgagccgtcgtgctggtgctgcaggacaaggccgtcgtcgagcaggcccaccccgaactgcgcatgcggggagccgaggtggacatcccggtgcctcgggtgatccggctgtgccggtacgtgcgggtgccgttccgaagacaagcgccgtggtcgaggcgcggggtactggtgcgggaccggcaccggtgcgcgtactgcgggcggcgggccacgaccgtggaccacgtggtgccgcgctcgcacggcgggcaggacacgtggctgaacacggtggcctcgtgcgcggaggacaatcaccgcaaggcggaccggactccggaggaggcggggatgccgttgctgcgggcgccgttcgagccgacgccggcggatgcgatgttgctcgcgctgggcgcggacgaactcgccgggctgcctgagtggttgggccgggaggccgcctgacgcctcgcggcggagaccacagcggaacggccccgcgcccctggaatgcaccaggggggcggggccgttgcgttccggaggcgctccgtcagtcgatgaagggcttctcgcggcgttccgaggggccgttcctgccgtcgttctgggccgggacggtgttgccgccgctgttgccgccgccccccgaattgccgcccagggatccgaagttgcccatggcgccggagaggcccttgagggcgtcgccgatctcgctggggacgatccagagcttgttggcgtcgccctcggcgatcttcggcagcatctggaggtactggtaggagaggagcttctggtccgggtcgccggcgtggatggcctcgaagaccgtacggacggcctgggcctcaccctcggcgcgcagcgcggcggccttggcctcaccttcggcgcgcaggatctgggactgcttctcgccctcggcgcgcaggatctcggactgccggacaccttcggcctggaggatggcggcgcgcttgtcacggtcggcgcgcatctgcttctccatcgagtcctggatggaggtgggcggttcgatggccttcagttccacgcggttgacgcggatgccccacttgccggtggcctcgtcgaggacgccgcgcagggccgcgttgatctcctcgcgtgaggtgagcgtgcgctccaggtccatgccgccgatgatgttgcgcagcgtggtgacggtgagctgttcgatggcctggatgtagctggcgacctcgtaggtggcggcccgggcgtcggtcacctggtagtagatgacggtgtcgatgttgacgaccaggttgtcctgtgtgatcaccggctgcggcgggaacggcacgacctgttcgcgcaggtcgatgcggttgcggatggtgtcgatgaacgggacgacgatgttgaggcccgcgttgagcgtgcgcgtgtagcgaccgaagcgctccacgatggccgcgctggcctgtgggatgacttggatggtcttgatcagggcgatgaagaccaacaccaccagaatgatcaggacgatgatgaccggttccatcgacggctccctgtccccttctccgcctcggcgctttcggaagatcttattgggctcttgcggctgttgaagatcttgctggtcgagtctgacagaccgtcgtctgcctcgtggggtgttcggtgcaggtcacatcacgatggcggtcgctccctcgatgtcgaccacgtcgacttcggcgcccgcctcgtagacgcggtcggtgtccagcgctcgggcggaccagatctccccggcgagcttgatccggccgccggtgccgtcgacgcgttcgaggacgagggcctgcttgcccttcaacgcgtcgataccgctcgccagttgcgggctctgccgggcgtgccgggccgcgatggggcgtacgacggcgatgagagcgacggagacggcgaggaagacgatgacctggacgacggtgccgaagccgaagccggcggtgatcgcggcggcgaccgcgccgatcgcgagcatgccgaactccggcatcgcggtcaccacgagcgggattcctagcgcggccgcgccgacgagccaccacacccatgcgtcgatgtcgttcacatggtcatggtaggaccgcgggtcgcgcggcggacagggcgcacggggggcggctcagggcaggggccccgggatgtggtcggcaa

SEQ ID NO: 729 - DNA, 3509 bp, Unknown
  Kingdom: Bacteria, Phylum: Actinobacteria, Class: Actinobacteria, Order: Streptomycetales, Family: Streptomycetaceae, Genus: Streptomyces
cggccgttctccccgaccgctccgcgtccgcggcgctggattccggccgttctcgcaggtcgtccatgctcgcgtcggtcggcggcgccatgcccgcgaccgcgcgcccctcctctgcgggggcggcgcgttcgttcccgtgcgccccctgcggattggccggttgtatgcctctttgtgaaaacccgtattcgctgcgtgaaggttgggcgtaggctcgggcatatgcgaagtgcggtttccgtggtgggcggagtgcggcagggggcctgaagcgggacgcgggtggaagcgcgcgtgcgcgcaggggcgggaaggagcagtgggggcgggatgaacgacggcacgatcactcttccctggctcgtcgtccggcaggacgacaacggcaaccgctaccgcgtgggcaggtacgccacccgcgccgaagcgcagaagatcgccgacagcctcgaccatcgcgggcacaaacagctctactgggtcgagtgcctgggacagcccggcggcgccacggcgaacggcggcaccggcagctgacaccaggcggctgacactaggcggctgacacccggcagctgacggtcagtccctgggcgggctgcttccgtacgggccttcacacaggccccgcacgactcccgcccgactcccgtaggctccggccatgaccgaacggatcgtggtggtgggcgccgccctcctggacggcggccgtctgctcgccgcgcgccgcagcgcgcccccggaactggccggacgctgggaactgcccggcgggaaggtcgagcccggtgaactgccggaggccgccctcgtccgcgagctgcgcgaggagctgggcgtcgacgccgagaccgtcgcgccggtcccgggcgcctggccgctgagaccgccgtacgaactgcgggtgtggacggcccgtctgcgccccggctccgccgacccggaacccctgcaggaccacgacgaactccgctggctgcccgcgtccgagatctggaccgtcccgtggctggaccaggacgtgcccgccgtacgcgccgccctcacccacctggcagccgcaccgccggcctgacccgccaccgccggtcgaccggtcaccactgccgtcgcccccccggcgcctccccacccttcctgtagaccttccgccgggcagccgcccgggtaccgcttccggaagggcggtaccgggcgtcggataccgggtatgtcccccttaaccccatgaaaccggatatggggggctcgctggctggcccgggaagtgatcggcgtgatcggcaccgaaggcgacagcgccgagtggaccttctccgcggaccccggcgcggtgcgcaccgcccgtgccgccgtccgcggccagttgcgcacctgggagctggacagcgtcggtgacaccgcggccctgctggtgagcgagctggtcaccaactcgctgcggcacgcccacggccccatcggtctgcggctgctgcgtcctgccgggctgccgcacgtgctggtggtggaggtctccgacccgctgcccgacccgccccgcgaacgtcccgtccatcccgacgacgagagcggacgcggcctgcaactggtcgccgcctcctcccgccgctggggcacgcggccggacgcgaccggcaagacggtctggttcgaactggccgtaccggtccgcggcgccgcggcgcgaacacccggcggcgccggcggccccggcgggcccgacggttcgggcagtccggacggctccccggctgggaggaacggaccggtggccggtggcgtacgtccgtgacgaagggtgaccagtggtgcggagcgggccgtccgccgcgcttcccgaaggcactcgtgcgcggcggttgtccgcagtggggttcgacggggtgttgcctggttagaagacaggttgtgttgtcacaggacgaaccgggccggaccaaaaagcatcgggatggtcctgtgatcgtgaacaccgtgttgtgcggcgccgtagtgctggatactgcgggcagccgcccccggtgaccggtaccggacgcggtgagctggaggggacggttcgcgtgagcgagataccagcgaaggccacggagtccgaggacccgtcggacggcgcgaggacggggtccgcgggtggcgggaccgccgggggacccgagggacccggtggacccgcgggggtcgaggggccgccgcccgtggacgcgatgtggcagagcagtcctcccggctccatctacgactacataaaggtcgcgtccttctccatcggccccgacgggcacgtcgaccagtggagcctgcgggccgagcagttgttcggcattccggccgagcgggccgtcggtatggaccccatcgaggcgttcatcgactccgatttgcgcgagcagggccagcgcaagatggccgagatcctcgacggacgcgaatggaccggtgtcgtgccgttccgtctccccgacccggaggacggcggcgtgcggccgggcgggacacgcggcgccgggaacccgcgcggcacaggcggccggggccgtcgggacggcggcggcacccgcggcctcgccgaggtgtacgtcatgcccacccgcaccgccgagggcgacaaggccgccgtctgcatcgtcgtcgacgtccgcaccctgcgcagcatcgagaccgacctcgccgcctcgcaggcgattttcggccaatccccgttcggtttcctgctactcgacccggacctgcggatccgccgcgccaaccagcgcttcgcctccatcttcggcggcgcccccgacgaccaccgcggcaagagcgtccacgactacctgccccgggccgaggccgaccgggtctcggccaccctgcgccgggtcctggagaacggcgagtccatcacggagatgcacgtcaccggcttcgtaccgggctccgacgaacgccgccactggtccatcaacctctaccgcgtgcacagcggcagcggacgccccatcggcatcgcctggctcggcaccgacatcaccgcccgccgggccgccgcccgcgaagccgccgccgcacggcgcaatctcgcccttctcaaccaggccggcgcccgcatcggcaactccctggacctggagaccaccgcccgcgaactcctcgacgtcgtcgtccccggcttctgcgacctcgccaccgtcgacctctaccagggcatgctcgccggtgacgagaccccgcccggcctcgccgacggcagcgccgaactgcgccgggtcgccttcgccagcgcggtctccggcgccccgctgtccgccaccggcgcccccgtcgaactgggcgccgtccaccactacgccttcaactcgcgctgcgcggacgccctgcgcaccgcccgcccgcagatcgtgcccggcgaggacggcggcctcgtgcactccacgctggccgtgccgatggtcgcccacgacaccgtcgtaggactggcgcagttctcccggaccaagggcagcgagccgttcggggac

SEQ ID NO: 730 - DNA, 7473 bp, Unknown
  Kingdom: Bacteria, Phylum: Actinobacteria, Class: Actinobacteria, Order: Streptomycetales, Family: Streptomycetaceae, Genus: Streptomyces
cggcagtggcggtacggccgccccggcgacccgcgaggtgcggccggccggctacagcgcccacggcaaggacctgacggtgaccttcgagggcggggtgtgcgccgactaccgggtgtcggcgaaggaggactccgggcgggtgaccgtcacggtgaccgagacgcctcggcagggcaactgcatcatgatcgcgaaggtgtaccaccggaccgtgcacctggaccggccgctcgacggccggtcggtggtcgggccggacggccgggcgattccctcccgggcggcgggcgccggactgccccagtcggggacgccggtgcggtgagccggggcgggaagcgcaggaaggcggcagcccttgcgggggctgccgccttccgttcgcttcccgtcgcggcggggccgcggctcagctgaaggagtcgccgcaggcgcaggaacccgtggcgttcgggttgtcgatcgtgaagccctgcttctcgatcgtgtccacgaagtcgacggtggcgccgcccaggtagggggcgctcatgcggtccgtgacgaccttgacgccgccgaagtccttcacgacgtccccgtcgagggaacgctcgtcgaagaagagctggtagcgcaggccggagcagccgccgggctggacggcgacccgcagggcgaggtcgtcgcggccttcctggtcgagcagggccttgaccttcgccgcggcggcgtcggtcaggatgatgccgtcggtgacggtggtggtctcgtccgatacggacatctacatctctcccgggttgtacggagactgcttgccgacgagtgcaaccggcaaggccgcggattcattccgggccgggcacttgattgttctcttgtccatgctcgtccccttcatgctcgcacacccgtcgaagagggggcagggccctgtggacaaccggagcggcgccggggcgggcggctgcggggcggcgccgggcggacggtgggcggctgcggggcggcgcccggcttcacggcacgccgggattcacgtcacatcgacatgatggacatcgtcaaagtgacgtgaagcggttatgatagataacgtcaattcgacgaaaagtagaaagggtgtgtgtcgtgaccaccgcccagccccaggagctcgacgttcagccgacgcccctcgccctgctgctgctcggccgtgaggccgacccgaggagcgagcgcggcgtcgagtgtcccggcgacctccccgccccgtccgacccggacctggtggcgcgcgcccgcgcggccaaggagaagctcggggacaaggtcttcgtgctcggccaccactaccagcgcgacgaggtcatccagttcgccgacgtcacgggcgactccttcaagctggccagggacgcggcggcgcggccggaggccgagtacatcgtcttctgcggtgtgcacttcatggcggagtccgcggacatcctgacgaccgacgcgcagaaggtcgtcctgccggacctcgcggccggctgctcgatggccgacatggcgacggccgagcaggtcgccgagtgctgggacgtactggccgaggcgggcatcgccgagcaggtcgtgccggtgtcgtacatgaactcctcggcggacatcaaggcgttcaccggccggcacggcggcaccatctgcacctcgtcgaacgcgaagcgggccctggagtgggccttccagcagggcgagaaggtgctgttcctgcccgaccagcacctgggccgcaacacggcggtgcgggacatgggcatgtcgctggacgactgcgtcgtctacaacccgcacaagccgaacggcggactgagcgccgaggaactgcgcgccgcgaagatgatcctgtggcgcggccactgctcggtgcacggccgcttcagcctggactcggtgaacgacgtccgcgcccgcatccccggcgtgaacgtcctggtccaccccgagtgcaagcacgaggtggtctccgcggcggactacgtcggctcgacggagtacatcatcaaggcgctggaggcggccccggccggttccaagtgggccatcggcacggagctgaacctggtccgccgcctggcgaaccgtttcgcccccgagggcaaggagatcgtcttcctcgacaagacggtctgcttctgctcgacgatgaaccgcatcgacctcccccacctggtctgggccctcgaatccctggccgagggcaacctggtcaaccgcatccaggtcgacaaggagacagagacttacgccaagctggcgctcgagcggatgctggcgctgccgtagagggcctcgcgcaggcatggggaaaggggcgcttcccggcggcttgcagcagccgggaagcgccccttcctgttcctccgccgaggggccggccgtgcccatgagggtgcggcggcgttcttgaaatcccctgccgctgccaggcgcgaggaccctgcgtgccgcggccggcatagccctcggcgcggtctaggcgcccaccgcgcccaccgttctggccaccggcacgtcggcacgcccccgggccgtggttcgccgggctgcacgctggagcagcggcgcccagccgccctgcacagatctcagccgaacagcgccagcccggtcaccaccgcaatcactgcgctgaccccggcaaggcaggcccataccagcctcaggtggtccggggtgaatcgagggccgggcgcgccgcctggcgtgaccgtcgcgatgacgtcgtagaccctgagggcaagattgcggtagtcgagggctatcagtgatccgagaatgaaaatccccagggaccagacgaagtgaagcatcgcacctccaagtttcggggcgtggacgggcggccgcacgacggcgcacccaagcggctctacgcatcccgccttcgcttgccctgttcgtcattggcccacccggccgtcgatcctctcgcggaggaggtcggcgtggcctgagtgccgggcgtactcggtgatctgcgccaccaggatctcgcggagcgaagcctcacccgtccgcgtgccgaggtcggtgaagccggcgatgaaacggtcggtcacctcggcctcggcccgccactgccgccaggcgtccgccacgaccgccggggaggcgatcgcgccgttccagtcgccgtctcggtcctcagcggtgcggtagatccgcggcgagtcctcgcctgccatcctgcggaagtgacgttcgtcctcggccatgtgacgcaccagccccagcagcgacatcgtggacgggggcacggagcggcgggccatctgctcggcgtccaggcccgcgcacttcatctcgatggtgaggcggaagtggcgcagactgtccagcagcgccccgcgttcgtcgactatctcgacatcgctctcgcgcgggtcctcgtccgggtcgacccacatgtccgtgtagacggtggaaggggtccaccgggtcaccgtcaccgctgcttcttcgttttcttcgttgcgctcgctcgacgtcatgatcgcatcgtgggggccatcgaggctctacgccaccacttatcaggcctccggcaaccgtgctcccctgctcgccgcgatcctcagtgcgtccgccagggccgccgccagttgtcctcccgcgaagcgcaactccccctcgctcgtcgcctcgtccgccagcagtggtctcgcctccgtcaggacgaactcggccgagtcgagcaggtccgcctccaactcgtcggccaggcgggacaggcggctgtgcgggtcgtccgtgctcaggtagcacggggcgccgtccggtctcgtccacggcagcagccgcagtggcgtgccgtcccgtccgtcgaggatcatcgcgtcgctccctccggtgaggtccgggcgtttcgctgcgggcccggatctcctgtcgttaccttctgtgtcgtcatcgtcgcgctgagacacatggccacaacaggaccgtcgcgtcccagcgttgaggacgggacgacccaaccaggaggcacaccgatggcgttcaagccgcagaccctcaccccctacctctccgcccgccactacttcggcgccgagcagcgtcgccaccgcgaggccgccgggctctcgttgctccagctcgccgacatcctcaactccagcaagagcaccctcgcccgcatcgagaccgccgagttgatgccaccgcccgacctgcccgaccggctcgacgccgccttcggtaccgacaagcacttccgcgggctctacgaactcgccaagcgggaggcccaccccgaccagtaccgccgcttcatggacttcgaggcccaggccgacgtcatcgagaactacgggacgcaggccctccccggtctcttgcagaccagggagtacgcgcagacacagctcgccctgcgggaggaactgacgccggagcaggtggaggggcgcgtcaacgcccgtatgtcccggcaggaaaggactcgctcggcccagcctccgctgcggtgggcgatcatcgacgagtccgtgctccggcggcccttcggcagccgggaatgcatgtacaggcaattggcctggctgctcgaacagatggatactccggagagcaaggtccaggtgatgcccttcagcgcgggtgcgcactatctgatgggtggcgcgctgaccctgctgacccttcccaacggctcaaccgtggcctacgaagagggcatcgaggtcggtcatctctatgaggaccgggactcggtgaagaagtggcgacggcactacgaagtgctgcgcgccaacgccctctcgccgaacgcctcggcggagctgatccgacaggcgatggaggactacaagccatgcgacacagccccgagctgatctctgcccgctggcgccggagcagctacagcaatgccaacgggggcgagtgcgtcgagatcaccgaggacttccccggcaccgtccccgtccgcgacagcaagaccccgcacgggcccgtcatcgtcgtcccgaccggcgtatgggacgccttcgtccgcgccctcaaggcgtagcgggcggaccgtacgcgaacggccggactcccgagggagcccggccgttcggcgtacgtggcggggtcagacgcccgccggttccagttcctcccgctccgtctccgcgtcctgcccctgcccgcgcttcgccgcgcgcttcttcgcgcggcgctccttgcggagttccagcatggtgtagagggtcgggaccaggaggagggtgaggagggtggaggtgatcaggccgccgatcacgaccaccgcgagcggctgggcgatgaagccgccctggccggtgatgccgagggccatcgggagcagggcgaagatcgtcgcgagggccgtcatgaggatggggcgcaggcggtgccggccgccttccaccacggcctccacgacgccgtgaccctgcctgcggtactggttgatgaggtcgatcaggacgatcgcgttggtgaccacgatgccgaccagcatcagcatgccgatcatcgccgggacgcccagcggcgtgccggtggcgatgagcaggccgagtgcgccggtggcggcgaacgggatggagaccagcaggatcagcggctgggccagcgagcggaaggtcgccaccagcagcatgaacacgatggcgatggccgccagcagagccaggccgaggttcttgaacgcgtcgttctggtcggaggtgacgccgccgatctcggccgtggcgcccgccgggaggtccagggccttgatcttcgactggagcttggtgctgaccgcgccggtgttgtcgccggtcggcttggcggtgacggtcgccgcgcgctgtccgtcgatgcgggtcatggagaccgggccgtcgacgagcttgacggtggcgatgtcgccgagctttaccgggccgaggcgcaggtcgcgcagctggtccagcgtctcggcgggcttcgccgacttgatgacgacgtcgcgctcggtgtcgtccaggacggccttggcggccgtggtgccgcggaccgactgggcgacggccgcgccgagcgtctgctcggtgaagccggccgctgccgccttgctgttcgcccgtacggagacgcgcggcacgctctgcgagaggtcgctggtgacgtcgctgacgtcgccgagtccggcgaccgtcttgcggacctgctcggccgcggtgctcagggtgcgtgcgtcgggcgccttgacgacgaccttgaggtcctggtcgccgaagccgtcaccggcgttgacggtggtggtgccggtgccggacagcttgtgcagtccggcctcgatgtccttgcggacgtcctcggcggacgcggagtcctccagcatgacctggtaggaggcgtggttggcgtccgtggacccgccgaaggcggccatgaagccggaggagccgatggtcacctggtagtccttgacgcccttggtggcggcgagcagcttctcgaccttcttcgcctgagcgtcggtggccgcgaggctggtgccgggcttcagctcctgcttgacgctgagcaccttctggtcgccggcgtcgaagaagttggtcttcagcagcggggccaggccgaaggtgccgaccagcacgaccaccgcgatcagcacgctggtgaggcggcggcgggtggcgaagcgcaggacgggcacgtagaagcgctggaggcggctgttggtctccttctcctccgcctcgcggcgggcctgctccgggtcggccggcatgttcttcggggcgcgcaggaaccagtacgacaggacgggcacgaccgtcagcgacaccagcagggaggccagcagggccaccgtgacggtgatgctgaacgggccgaacagctcgcccaccaggccgccgaccaggccgatcggcaggaacacggcgaccgtggtgagcgtcgaggacgtcaccgcgccggccacctcgcgcacggcgcccaggatggcctcgcggcgctcctcgccgtagccgaggtggcggcggatgttctccaggaccacgatcgagtcgtcgacgacgcggccgatggcgatggtcagggcgcccagggtcaggacgttcagcgagaggtcgcgggtccacaggacgatcagggtgacgaccacggagagcgggatggagaccgccgtcaccagcgtggagcgcagcgacgccaggaagaccaggatgaccaggacggcgaagagcagaccgagtgcgccttcggtggtcaggccctcgatggacttggagacggccgggccctggtcgctgaccgtggtgatcttcgcgtcggagccgaggctcttgcgcagctcgggcagcttgtccttgacggcgttcgagacggcgaccgcgctgccgtcgtggtcgagggtgacggcgacggcgaggctgggccggccgtcggtacgggtgatggagtcggccttggcgggctgctggcggacggtggcgacgtcgccgagccgggccggtgccttgccgg

SEQ ID NO: 731 - DNA, 1296 bp, Unknown
  Kingdom: Bacteria, Phylum: Actinobacteria, Class: Actinobacteria, Order: Streptomycetales, Family: Streptomycetaceae, Genus: Streptomyces
ggccgccgttgtacgggccgtacgggccgtcgctgctgctgccgccacggcggcggccccagccgctgccgccggagacctgcttgagcgccgggcgcacgtccacgatgtagacgatgctcgcgatcacaccggcgatcggcaggaacgacaggatcgagaacaggtagctgacgacgagcgccaggccgaggatgatcagccagaacaccttgttctgcttgccggccgcgcggaacgcgtcctcacgccggatcgcggcgtcgcacagcccgaacgcggccaggaccatgaggaggatcttcaggatccccaggaatcccgcgaagcccaacatcagcatgccgtcccaccgcctgttctctccgacgcctacgccgccaccgtacccggagaacgggccgggcaccccaagggtgcccggcccgtcccggcttcccgccgtccctacttcgcgggcggcgtggtcttccgggcgttggcggtggtggtcgtggtccggcgcgcggccggggccttcttggcgggcgccttcttcgcggcggcctccttcgtcgccggcgcggccttggccccggcgggcttctcctcgctgaccacgaccggctcggtcctgggctgcgccttccgggccttgggctcgaccgcgacggcgagttcctcgacgtcctcggcgatgtcctcgatgccctcggcggcctggccgcgccaggtccgcacggcgtgctcaccgtgctcggcgaccttctcgtaggtctcgcgggccttgacggcgtactcggcggcgacgccgaccccgcgcagggcgaggtcctgggcgctctcgcccagcttcttcaggtcggcgtcgaagttcgtgctgagcttcttcaggtcggagtccagcgagttcaggaactcggtgaccttggtctggacggtcgactgcgtctccttgacgcgggcgccggcctccttggcccgggcggcggcccgctcctggacggccttcgggtcggtgttgcgcacggcgtcgatgcgggccggtgcctcggcggccagctgctccaccaggccgggcaccttcctggcctgacgcagggccaggtccgcggtgccggcggcgaagtagagcggagtggggtcgctgaaggtcttgcgcaggtcgtcggcgatggccatggtgatgatcctcccggatcgctttcggctgagggttgtggtgtgccgcggtccaccggccgccgggtcctcacgggccccgggatcagccggccgtctcccgcggaccggtgtcgctgccgccggacgcggggg

SEQ ID NO: 732 - DNA, 685 bp, Unknown
  Kingdom: Bacteria, Phylum: Actinobacteria, Class: Actinobacteria, Order: Streptomycetales, Family: Streptomycetaceae, Genus: Streptomyces
cccccgggcaggcccggcggcgtcggtccgggtgccggacttctcggcctcgccgccctcggcgacggtcttgcgcacgaccaccggcgggatcggccgggatccggggatgttgatccggatgcgggtcgtcagcgtggtctcggtcttgcgttcctccggccgcgtggccgaacggcccgcgtccgcaccgtcgtcggagggcgccggcacaccgtacggcggggtccccgaagggtaggcggctccaccgcgcccgtggggcccggaggacggagtgtcagtttcacgactcaaggcaggttctcccggtttgctccgccgcccgtcacgacctcaactctatgggggtcccccctgcacgagcgcagtcgagcgtttgggggaggctcggcggcgcgcaccaccatactggccacttcaggcccttttcccgggaccgccggggaaacccacaccggacccgcacggggacttgggaaagaagtagtacgtcactcgccaagtcggacgtcgcggccgttcggttgccgtccaccgccccaggtggcgcagatcacagccacagccatgccgccgagcaggaagaggtaagaaccggcaccggcggcgaagaagaagtcgccttccgggcggctggcggtgagcagcatgacggcgaccagccagccgcccggaaggcgac

SEQ ID NO: 733 - DNA, 678 bp, Unknown
  Kingdom: Bacteria, Phylum: Actinobacteria, Class: Actinobacteria, Order: Streptomycetales, Family: Streptomycetaceae, Genus: Streptomyces
ccttcgccccgttcgccccgttcggctcgttcggggccttcggccgcttccgccgggacgcctcgtgcgcgcagggccgccgtaccgccctcgggagtgccttcgacgatccgtacggcgtcccgcagggcacgccgctgttcctcgctcatcatcccgaagaaggcgacgagagcggcggcggcgttgtcgctctgggaccaggcgtcgttcatcagcgcggcggcgtaggcggcccgggtggagaccgcctcatatcgataggcccggccttccgcttcccgccgaacccagcccttctgatggagattgtccaaaacggtcatcaccgtggtgtaggcgatggaccgttcctgttggaggtcttccaggacttctcgaacggtcaccgggcggttccacttccacacccgcgtcatgaccgcgtcttcgagttctcccaaggggcgaggcacacctcagaccatagtgggagatgagggctatggcgtgccgaacctgcccctacgccgcaaatgcgaacaaaaagggcgtacggcgcgcagcgcgacgggggcgtccgtgctgcgggccgtacgccgggtcaggcgtcggtggaggcgccgcccgcggtggaggccacggtctggccgccgctcgcagacgtcatggcggcgtcgacggccgcgtcctccttgg

SEQ ID NO: 734 - DNA, 3077 bp, Unknown
  Kingdom: Bacteria, Phylum: Actinobacteria, Class: Actinobacteria, Order: Streptomycetales, Family: Streptomycetaceae, Genus: Streptomyces
cgggtccgtgacgtcgaggacggcgtcgatccggccgctcaccaggtgttccgtgagggcggcggtgtccacgagcggaccgcgcgcggtgttcacgaggagcgtgcccggacgcatcagagcgatcctgcgggcgtcgagcagatgccgggtctgcgcggtgtccggcgcgtgcagcgtcaccacgtcgctggtcgcgaccagggtgtccaggtcggtgcgggtggcaccgagcagctccgcctcggcgtcgccgacgtacgggtcgtacaggagcacctcggcgtcgagggtgcgcagcagctgcgtgacgcggcggccgatgcgcgaggcgccgaccacgccgacggtgatgccgcgcgtgccgagccagtggtgccggtccaggtcggcgtcggtgcggtgggtgcgccgggtgcggaagagatgggcgagcgggaaggcccgtttggcacccaggatgatcgcggcgagcgtgaactcggcgaccggcacggcgttggccgccgccgcggaggagaccgcgatcccccgctcgtaggcctcccggctcaggaacgtcttcacggtgccggccgcgtggatcaccgcgcgcagccggggcgcgcggtcgagcacggcccggtcgacgggcgggcagccccagccggtgagcagcacctcgcagtcggcgagggccgcgtgcgcccgcggactggcgaactcctccacgactgagggaggccggatgtccgcggtctcctcgaggcgggcccgcacggcgggcgggaagacgtcgtccacgaccgcggagtccatcgcgagaaccgtgcggggccgccgcgggggcggtgtggcatcggcggccgtggcctcgaccggtgcctcgtcagtggtacgcaccctgcctccggacagtaaacgtattctatggcggtaccgaacgctagggagcccgccgctcgaccgtcaaggtcaggaagagaaaatgacagcgggattgtcccatatcgcggtgaaatcccctacagaactggcctgttcgcaacctctgggcagcccgttcggcgccgtttcacagctcgtcagatccgcagatctattgacgatggggttaaccgcttactaacttgccgccgcagaaaccagttcctgcgccaaccggccgaacaggaccgctccatgactgtctccgtaccaccgaccgccgtcgaccgcgttccccgcaagaccctctggcagcgtctcaagcgtgacaaagtgatgctgctgctgtgcctgcccggcttcctgtacttcgtggtgttccactacgtaccgctgctcggctacatggtggccttccaggactaccagccctacctgggctacctgcacagcgcctggaacggcttcaccaacttcacgacggccttcgccgaccccgacttctggtcggcgaccggcaacacgctggagatcgcgctcgtccagctcgtcctgttcttccccgtgccgatcgcgctcgccctgctgctcaacagcatcgccagtgaccggctgcgccgcttcgtgcagagcgtcgtctacctgccgcacttcatcggctgggtgatcatcgtctcgatcttccagcagatcctgggcggcgcgggcgtcgtgcccgacgtgctcggctccctcggactgccgcgctacgacatgacgaccgacccgaacgccttcccgtggctgctcgcgctccaggtcatgtggaaggacgccggctggggcaccatcatcatcctggcggcgctgctctccatcgaccgcggcctgtacgaggcggcggccatggacggcgcggcgcggtggcgccgtttctggcacgtcaccctgcccggcctctccccggtgctcgtgctgctgctcatcctcaacctcggcaacatcctcaccgtcggcttcgagcagatcctgctccagcgcgacgccgtcggccccgacgccggtgaagtcctcgacacctacgtctacttccacggcatcagggacaaccagtggggcacggccgccgccgtcggcctggtgaaggccgtgatcggcaccgtcctcgtcatcggcgccaacaagttcgcccaccggctcggtcatgaaggggtgtaccgcggtgctgaccgttgagacgtccgctgtgaagacgcgccgccgcgggaccgcccggcccgcacccgcggcgggggaactgcgcccgtccggcgcccgcccgccgtggatggagaaacccacccggctcggcctcgtcctcaagggcctcgccctcgtgatcgtcgtgggcctggtggcgtacccgctggtcggcgtgatcggcacgagcttcgcctcgcagagcgacatcatccactccaacgggctcgtcctgtggcccgaccacccgagcctcgacgcctaccgcaccgcgttcaccggcggacgcgtgacccgcgcgctgctcgtgagcatcggcgtcaccgtcaccggcaccgcctgcagcctcctcgccaccatcggcatggcgtacgggctgtcgcggcggggcatcgtcggcggccggttcatcctcatgaccgccctgttcacgatgctcttcaacgccggcgtcatccccaacttcctcctggtgaagcagctgggcctctacaacaccttcgccgcgctcgtcctgcccaccatggtcagcgccttcaacctggtcgtcatgcgggccttcttcatgaacctgcccgaggagctgtacgacgcggcgaaggtcgacggcgcgggcgacttccggaccctgatccgggtcgtcctgccgctgtccaaggcggtcatcgccgtcgtcggactgttctacgccgtcgcctactggaacgcgtacttcaacgccctgctgtacctcggcgacaacgacaaatggccgctgcccatggtcctgcgcaccttcatcctccagggccagaacctcgacaccgcggcggccggcgaggtggtcgccccgcagcaggccgtgcagatggccgtgctggtcatcgccgtcgtaccgatcctgctcgtctaccccttcctccagcggttcttcaccaagggcgtcctcaccggcgcggtcaagggctgaccgc

SEQ ID NO: 735 - DNA, 2850 bp, Unknown
  Kingdom: Bacteria, Phylum: Actinobacteria, Class: Actinobacteria, Order: Streptomycetales, Family: Streptomycetaceae, Genus: Streptomyces
cgtcccggcaggcctgccgggcctccaggacagccgcctccgcggcctccacgtcggtcaccgcgtcggcgggcaggtgcagcagatagcgcccgctctgcgcgatgagcggggtctcccccggcttctggctgtcgctggtgacgaaggaccgcacccggctgacgacgctgcgcagcgcggacgcccaggtgtcgggcagaccctgcggccacagcgtgtccgcgagctggtcgcggctggtgccggcggaacgctccaggaccagccgggcgaaggcgacctgggcctgagcgctcgacaggtgccggggcggttccgcctcgtgctcgatggtgaccagtcctacgagtcggatcaacacgtcgacattccccctacggcagatcaggaaccgggcggggaaaccggctgtcgaatcggcagcgcgccgtcacattctcgccattccccgtgatgtcgacgcgaccttcgcaggggcgttccggccatgtcaatcaagcccgggaacataccggccggaatgagtggaagcccaagttccacggcggagagaggggattctccggtggttctccgcgcgtcctccagggtctttcgagcaacttccgagcgcggtcgagcggaattcgagaagtactccgggtcccgtgttgcgtccgtcttgcggagcccgggctacaaattctctcatgaataggccggttgccggcggactgaatcagcctgaggagactcacgtgaacgcacccggaggttgggaacgcctcgagccgaaactggacgccacgctcaggcgcgtagccgcgctggagtcggtccccgaccgccgcaacagcttcgtcgcctacaccgtcgagcgggacagtgcctacgccgacctcgacgggcgccggctgctgatgatgtccggctacagctacctgggcctggccggtgacgagcgcgtggtcgccgccgccaaggccgccgtcgacctgtacggcaccggcaaccacggcgtgcgggccctggccggctcgatcccgctgcacgaggagctggaggccgaggtcgcccggttcgcggaccgcgaggcgtccatggtcttcggctccggctacgcggcgaacgtcggcacggtcggcggcatcgtcggcgccggtgacaccgtcttcatcgacaagtacgaccacgcctcgatcgtcgacggctgccggctgtccggtgccaccgtcacccgcttccgccacaacgacgtcgaccacctcgaccggcggctggccgccgccccgcccgacggcgtccgcctggtcgtcgtcgacagcgtctactcgatggacggcgacatcgccccgctgcccgaactgcgcaaggtgtgcgacgagcacggcgcgctgctcatggtcgacgaggcccacgcgctcggcgtcatcggcgccaccggccgcggcatcgaggagcacttcgaccaccgcgtgaaggtcgacatcaagctcggcaccctctccaaggccatcccgtccatgggcggctgggtggccggtcccgccgagctgatcggccacctgcgctacgccgcacggccgttcctgttctccgccgccctcgccccggcccagaccgcggccgccctggagagcctgcgcatcctgcagcgcgaacccgagcgcgtcacccacatccagcacgagtcggcccggctgcgcgccctgctcaacgccgagggcctgcgcacccaggacagcgagaccgcggtcctgccgctgatcgccggatccgacgacgccgcctacgacctggccaccgcctgccgcaagaacggcgtcatcggcatccccgtggtcacccccgcggtccccaacgacctggccaggctgcggatcgcggtgaccgcacggcacacgcccgaggacatcgacctcgccgcggaggcgttcgtgaagtccgcacgcgagtgcggcatcctttcggcctgacggagacgagaccgacgatgactgccgctgcctctgcgcgaaaccaggtggtgatcaccgggatcggcgtggtcaccccggccgggtgcacacccgaggccctgtggagcgcgctgcgtaccggccgctccaccgccgcccagctcacccacttcgacgcctcccggcaccgggtccggatcggctgccgggtcagcggcctggacaccgacgcgcccgacgccctggtctccgccaaggacgcacggcgcatggaccccttcgccctgtacgggaccacggccgcgctcgccgcccaccgggacgcgggcgcaccggccgccgagccgggccgcaccgccatcgtcgtcggcaacgcggtgggcggccgtgccaccagcgaccgtgagtccgcgcacttcagcgaggcgggtccgcaccgggtcaacccgctcatgccgttgctgaccatgccgaacgcggccgccgcccagatcgccatgcgcctgggctggacgggcccggccaccaccatcgccaccacctgcgccagcggcgtcgacgcgatcggccacgccgccgacctgctcagggcaggccgggccgacgtggtgatcgcgggcggctgcgagtccacgctgacgcccgtcaccctggccgcgttcggcaacctcaacgcggtctccggcaggaacgacgatccggcgcacgcctgccgccccttcgaccgggaccgcgacggattcgtcatgggggagggggccggcttcgtcgtcctggagcggctcggcgacgcacgggcccgcggcgcgcgcacctacgccgagatcgccgggtacgccgccacctccgacgcccaccacctgtcgatgccgctgcccgacggcgccggcgccgtcgccgcgatgaccgg

SEQ ID NO: 736 - DNA, 3839 bp, Unknown
  Kingdom: Bacteria, Phylum: Actinobacteria, Class: Actinobacteria, Order: Streptomycetales, Family: Streptomycetaceae, Genus: Streptomyces
ccggtgcggccggcccgcgcgggcgacgccccggacggatgtcgacggcgaacgccttggtctcctggatgtgcgtgttcgggtccagggacaggtgcaccagctcgttggccgcgtcgcccgtgctgcggccgttcggaccccagtggtagggcagccccacctggtgcagggtgcggccgtgcaccgtcagcggcggcacgcggtcggtgaccagcacccgcgcctcgaccacaccccgggcgctgacgatcgtcgcccacccggtgtgttcgagcccgcgctcggcggccagttccggcgacacctcgcagaagaactccggctgcagctccgccaggtacggctgccagcgggacatgccgcccgcggtgtggtgctcggtgaggcggtaggtggtggccacgtacgggaacacctgcgagcccggctcgtcgccgctgggctggtagcggttgtccggcagggtcggcatgagctgccgtaccgggttgcgctggcggccgtagagcaggttcgggaagggtgagtcctgcggctcgtagtgggtcggcagcggcccgtcggtgagcccggagggcacgtacagccacgccttgccgtcggcctgcatgatgaacgggtcggtgcccgagagcgcctccggaccggtggcgtccggcggtggccggtggtccggtgccttgtccttcttgaagtcggggatgtcgtggccggtccactcgccctcctcggcgtcccaccacacgagcgccttgcgctcgctccacggcctgccgtccggatccgccgacgcccggttgtagaggatgcgccggttggcgggccacgcccagccccactccgaagccacccagtcctgttccgtaccgggcttgcgccgcgcggcctggttcaccccgtcggcgtagacaccgcagtagatccagcagccgcagacggtggagccgtcggccgcgagctgctcgtaggaggccagcggacggccctcggcgtcgcggccgttgatctccgcgagcacctcttccgcgtccggctcggcccgctcgcccttcgtcgcgtagtcccacgtcaggtcgagcaccggccggtccatcgggtcctgcgagcccgcgagcttgtcgcggatgatccgtccgaggtggtaggtgaaccacaggtcgctgcgggcctcgccggccggttcgacggcctggtggtgccactgcagcagccgctgcgtgttggtgaagctgccgtccttctcggtgtgcgcggcggccggcaggaagaacacctctgtgccgatgtcctcggtgcgcagctcgcccgtctcgatctccgggccgtccttccaccaggtggccgactcgatcagcgagaagtcccgtacgacgagccagtccagcttggccatgcccagccgctgcagcttggcgttgccggaaccgaccgccgggttctcacccatgaggaagtagcccttgcagaccccctccagctgggccatcaccgtctcgtaggtggagtgcgagccggtcaggcgcggcaggtggtcgaagcagaagtcgttgtccgccgtcgccgcctcaccccagtaggccttgagcaggctgaccaggtaggcgcgcatgttgccccagtagcccttgcgggccgcctcgccgcgcacgaaggagtccaggtcctcgtcgcggtgggcgtgcggcatcgggatgtacccgggcagcaggttgaacagggtcgggatgtccgtcgacccctggatggaggcgtgcccgcgcagcgccatgatgccgccgccgggccggccgatgttgccgagcaggctctgcagcacggcggcggccctgatgtactgcacccccacggtgtgctgcgtccagccgaccgcataggcgaaggcggtggtccgatcgcgcccggagttctccgtgaccagttcgcacacctgccggaacagctcctgcggcaccccgcagatctgctccaccacctccggcgtgtagcgggcgtagtgccgcttgagcacctggaagacgcaccgcgggtggctcagcgtctcgtcccgttcgtactcgccctcgccgatgtcggggccgcccgagccgtgggactcgccgcccgccgcctcggtcagcgaacggccgccgccggtgcgcttgtcgtactcctcgtcgcgctgcccggaggccgcctgcatctccgtgccctcgtactgccagctggtgttgtcgtagcggcggctgtccgggtccagtccggagaacaccccgtccaggtcctcggtgtcgcggaagtcctcccgcagcaccaccggcgcgttggtgtaggcgacgacgtagtcacggaagtacgcgtccgtgctgagcacgtggttgatgatcccgccgaggaaggcgatgtccgagcccgcgcgcagcggaacgtgcacgtccgcgagcgcgctggtccgggtgaaccgcgggtccacgtggatcaccttggcgccgcgcgccttggcctccatcacccactggaacccgaccggatggcactcggccatgttcgagccctggatgacgatgcagtccgagttctgcaggtcctgctggaaggtggtcgcgccgccgcggccgaacgaggttcccagactgggaacggtggaggagtgtcaaacacgcgcctggttctcgatctggatcgctccgagcgccgtgaagagcttcttgatcaggtagttctcttcgttgtccagcgtcgcgccgcccagactggcgatgccgagcgtgcgccgggtgcgggtgccgtcgacctcccactgccagcccgcgcgccgtgcctcgatcacccggtcggcgatcatgtccatcgccgtgtccaggtccaggcgctcccactcggtgccgtgcggacgccggtacaggacgtagtgctcgcgggcgcttccggtggtcagctggaggctggccgagcccttcgggcacagccggccgcgtgagatgggggagtcggggtcgccttcgatctgcgtgacccgctcgtcctcgacgtacacgttctggccgcagcccacggcgcagtaggggcagatggacttcaccacacggtcggcggaggcgacgcgaggggtgagccgcgcgctgggcccgctcttggccgcggccccgcggcccagggggtcggtgcccgtcagctggcggtagaccggccaggagtcgatccaggtgcgtacacccatggcgtggtcctccttccggtgcggcgctgcgcggtgcggcgccctcgcggtacggcgcggttgctgcggagtacccctcactcatccggtgaaacagggtcggtggccggccttccggccgcggtccgtgccgtcagccggcgcgggcgcgcagccgctcgcgctgcggtacgaccgtgtaccggggatcctcggccgaggccacgcccgcgtggaacaccccgaaacgcagcgcggcccagcccgtgagcagcgccgccacggcggccacccccagcgcacgggcgccgcgcccccgcccgcgtgcaccgcctgcgcccgcgtacgccgccagtgcggcgccaccggcggtcagcagttccgccgcccgcagcagccggtgcgggcggccctgctcgaacggctcggccgccagacccatcccgcgtttcatcacgcggaacgcgcccagttccagcgcggcacccagcaccgccatacggcacgcgggacccgtctgccgcagcggcgcgcagacgagcgccagtccggccgccgcgctcgccccggaccccgcgaagacgaagggcagttcccggtagccctcgtgccaggacggcaccgccgtgtccgagagcagcacggcggtgccgtcctggca

SEQ ID NO: 737 - DNA, 578 bp, Unknown
  Kingdom: Bacteria, Phylum: Actinobacteria, Class: Actinobacteria, Order: Streptomycetales, Family: Streptomycetaceae, Genus: Streptomyces
tgcgcagcgccgccgcggtggcggtcggtccgcgcttgtcggacatgtcttcgcgtacgttgagcgcgtccgtgtccgcgcggatcaggtcccagtcccactcggggatgccgagcatctcgcacaggacgtcgttgggcagggcggcggcgtagtcggtggcgaagtcgaagcgccgctgaccgcgcagggcttcgagccggtcgcgggtgatctcgcggatccgtgcctccatcgcggccacccggcgcggggtgaacgcactggagaccaacgcccggtaggtgccgtggtcgggtgggtccatggcgaggaagaagctggtcttgacggcgtgcgggccccatagttccggttccagtgagatgccgaaccggttggagaaccgctgcggtctgcgcagcgcgtcgacgacgtcggcgtggcgggacagggcccagaagtcccgttcctcgttgcggtacacgggagcgtgctcccgcatccaggcgtagaacggataagggtcctcgtggatccggaagtcgaaggggtcgtagccgttcgggaaggcggaggtgggggcggagtcgggggtg

SEQ ID NO: 738 - DNA, 1966 bp, Unknown
  Kingdom: Bacteria, Phylum: Actinobacteria, Class: Actinobacteria, Order: Streptomycetales, Family: Streptomycetaceae, Genus: Streptomyces
ggccctgcgcgaggccggccgggcgctcggtgtcgcgctgaccggcgcggtcaacctgctcgacccccagtccgtcgtgctcggcggggcgctggcccacctcgctccctggctgctgccctcgctggaggcggaactggaccggcgcaccgccggtcctgcctgccccgtgtccgtctcgcggttcgggcccgagggcccgctgctcggcgccgcgcacgcggtggtacgtgccgttctggacgacccggcggcagtggccgaacgcgcctgaaacctggtgcagttcactcgtccgagtggccgggttatccacaattcgccgcgcgtccacggatccttgccgggcccttctgcccaacccctgcgcgccgtaccgtgattcacgcgaggcgccgccttcgggcccacgacggcgccccgcacccacccggtggcatcaccatgcgccgaggtgtgcgacaccaaccggacacgcggccgggctccgcacggagcgcccggctgtgcgcgagactcaccgccaccgacggacattcccccacgaaaccgtgcgaacaggaaccacagcccgctacgagacacggaccacttcgcaacccgaacgccgccgcaccccgtccccgccaaacgccggcctctccgcaccccgagcgtccacgagaagcgagatcccccacacgagaaaggtcgtcgcccatggaccgggcaggatcccagcccagccgacggcgcatcctgaagggcgccgccctcgccgccgtccccgccgctttacttcccgccgcccgcgccaccgcgcggccccggcccagggccgccgccgactacccggccaccgattggcagccggcctcgagcgccaactacaccgcgtccgaccggcccaccagctactccctcgaccgagtgatcatccacgtcacccaggagacctacgccaacacactggccatcttccagaacccgcagaagaaggtgtccgcgcactacgtcgtccggtccgccgacggccacgtcgcacagtgcgtccgcgagtcggacatcgcctggcacgcgggcaactggggctacaacactcgcagcatcggcatcgaacacgaagggtgggtggacaagcccgcgtacttcaccgacgcactctacgaacagtcggcccggctcacctccgcgatctgcgaccggtacgggatccccaaggaccgcgcgcacatcatcgggcactacgaggtgccgggcacggaccacaccgacccggggccgaactgggactgggtccgctacctgagaatggtcaacttcgactgacccgagcccgtccgcccgtccgcacggcgcccggccgcccacggacccaggggcgggcccaccggtccaccggtccacgtccgcgctgcgcgtgcggcgggcccccgggcggagcacgctggaagcccgcacccccgggggcatgccaccggcgtgcggcgcgagcggacggaccggcagccgaaggaggtcccagtggcgtacggcgatcccggacggcccatgggcgagacctcggccgccatgctggaggcgctcttcaccagctcaccggtgggactgcacctgctggaccccgagctgcgggtggtgcggctgagcaccgcggcgcccgtcatgcggggagaatccgccgacgacctggccgggcggccgatgcgcgaggtctaccggatggtcgaggacaacgacctggaggccgcgctgcgcgaggtgctggagaccggcgagcccctgtggcagcggctcgtgcgggcgcgcgtcgaagggctcgacccgcctggaggcgaagaagcagcgccgccgggaaggccgtgagcagggccgccgccgcgttccgatcatcaccgaggccgagttcctggcccgccgcgaggccgtctcgcgcgtgatggtcgtccgccagcacggcgaccgtacgcagatcggcgtcctggag

SEQ ID NO: 739 - DNA, 1241 bp, Unknown
  Kingdom: Bacteria, Phylum: Actinobacteria, Class: Actinobacteria, Order: Streptomycetales, Family: Streptomycetaceae, Genus: Streptomyces
ggacgctgcgccgcgccgccctcgcggcgagcgcgctcgtcctcgtcctcgccggcggcggcttcttctacggcgcccaccagttgcgctccgcctcctccgccgagaacaccgccctgagcgacaacgaggccaccacccgggtcgccggtgacgtcggcaacgacctcgcgcgcatcttctcgtacaccccggacggcctcggcgccaccgagcgctccgcacggtcggtgctctccgggaaggcggcccgccagtacaccggactcgtcggccggatccgcgcggacgtcgccaagcagcgggtgaccctgagcacccaggcggtacgcgtcggcgtcgtcgaactccgcggcgaccaggcccggttgctggtcttcctcgaccaggtgtcccgcagggacaaggccagggcgacggccgcggcggcccagctcgcggtcaccgcccaacgggagggggaccagtggcggatcgtcgacatccagacccgctgacggcgcacgcacgacgggagcacctcatgaaacgcacggtccgcacgctgtcgtccggaccccgcgccctgtacgccctggccctcgccctcaccctcctcgcgggcgggttcgcggcgtgggccggctgggactggtacgacgcggcgcacgacgactcggctgcgtacgcggtccagcgggatgcggcactcgccgccggtgaacaggccgtcgagaacctgaacaccctcgaccacaacagcgtcgaccgcggcctcgatctgtgggagtcctcgaccaccggcgacctgcacaaccaactcgtcgcggggcgcaaggagttcacggcaaaggtgaagacggcgaagaccgtcaccacggcccgggtgctctccggtgccgtctccgaactcgacgaccgggccggccgggcccgcgtgctcgtcgcgctgcgggtgacggtgaaggcgcccgacggccagagcaccgacaaggacagccgcatgctcggcgaactcacccgcaccggcggtggatggaagctgagcgccctcggccaggcacccgtgggcggcacatcagccggctgacccggcccggcgccgcgacgacggccggcccgcacgagaggacgacacccgatgccgacgacccggcaccacatcaaccaccagcgccgccgccaggcgcgcgaactgcgccccgacaacaccgccttgacgagggagacggtggtccctccggccgccgacgatgcgggag

SEQ ID NO: 740 - DNA, 12336 bp, Unknown
  Kingdom: Bacteria, Phylum: Actinobacteria, Class: Actinobacteria, Order: Streptomycetales, Family: Streptomycetaceae, Genus: Streptomyces
ggtgtctgccgcttcgcggggaacaccccgcgaagcggcagacacctggtccgggtggcggaatggcagacgcgctagcttgaggtgctagtgccctttatcgggcgtgggggttcaagtcccccctcggacactcactcgcctcgctggagcgatacggaatcgaaggcctcgacctgacggtcgcggccttcgttgcgttgtcgtaactgagagtgatgccgagagcgtcgtagagtgcccctttctggttgatgtcggcgacttgaatacgttgtgcgatgccccctgcgctctcggtgagtgcacggatcgggtcggggcggaagggtgattccttcttccggcttcggggggcggcgggcagggcgtcgagcttgctctgcgccgcgtccttgagggcggcctggtagtggccgagccgccggccacattccttgatcgccttgatcgcctggcgggctcggacctgctcgggggcgtgcatctgtttggtcgaacttcgacgccgggaaatggatcgaccagctgcacgagagcggaaaggacctgccgacggaagtgcaggacgatttccaggactggtactacggacccaacagtgtccagtggcgtgccaagggaacgtccgacggccgggggaacgtcacctacaccgtcccccggtggaggactgttgcaggtcaagcgggaaggcctgatacgcctgcatgccgtgggcctggctcgagacttcaacgtcgtgggcagcgcggacttcccgttgtgtgggccgaactacccctgctgtgggcgactgcaaccgtagtctgtcctgacgcgtagggacctgaggggatcgcagggactgctggcagacacccttgcgacccccgcatccgttcccatttcgtcgtgtatgggtgatatcggtagcggcgcgttgtcgaagagattcgatgtgaccgtgcccgcccacgtcaaggtcgtccgatgccacaccgtcagcacgtgggacagcgaatccctctcgctcgtgttcgacggaacacggcagacggccgatcaacttctcggtcactacggctacggactcgcgaacttgacatggaatgacgacgcgatcctcgtccatgacgaccagtgggggatggacaggtgcttcccgagtgggctgaaaggaaagtgctcgtacctcaaattccgaacagacatcggctattgcgtcgccgtcgcggaaaagctccccaatgattccgttcggttgagcttcgctgtcgacaaactttaggggaccggtaggcgagttgtggcgtggtcgcgaacgtactcgcgggctcaaatgccgctcacctccgacgacgggagccgccccggcatattcaggccccggtcgcgcgctgcccgcatgcccggtgcgatcgaaatgccggtcaggtccagtctgcgaggtcgcccacgaagtcgtcgtacgagcggttgctgccgcgcggggaggggatcaggcgacgggccagcgcctcgcgggccaccgccgggccgtcgctctcccggaacaccggcaggccgagcccgcgcttgagttcctccttggcgtccctgatacgcccggtgtccttgtccaggagctttgggggcaccttccaccgcgggcgcacatgcgggaaggcgtcagggaacagcagcagccagctctcgctctcccaggcggcgagcgcgagagccgtgccgaaccgcgggcactggcgggccagttcgtcggccagtgctttgcggatccggtcgtagccggcgtcggcgtacccgtccaggtcctcgtggacgacgaagccgagcagctcggcgcgctcccggagggccttcgcacgagccttcccggccagggtcttaacggcggcggccagctccgcgccggacttcctgcgcagccgcaccgggtcgttgatgcggaccagtttggcggtctggctcaggtcgggccggttcgcccgtatcagctcggcgaggatctggcagtcgttctggtcctcaccggccagcacgatgacgccccgcgtctggcccttggacgcccgcccgcggccctgtcgcccgcctgaggtcacagttcacctccggtgaggtcgccgccgaggacaccggagaaccacagctctccgaggggctgttcgccggtctcctcgacgatggccgtcacctcgtccacggtcagcgcggggatgatcgacgcaccgtcgtcgtcgcggtcgcacaccacgaactcctccggccgcagccggttgaccagcgcgggggagtgggtggccacgatgaactgcgtccgctcggcggcttcgcgcagccgctgcacgacgagttccagggcttgcgggtgcagcccgtggtcgatctcctcgatgcaggtgaacgccggtgggttcgggtcgtagagcagggcgagcaggcccagcagacggaccgtgccgtacgaggcgtcggcgagcggagtcagtcggcgcaggccgcgttcacgcaggacgacggtcaactggtctgtggagccgccgacctcctcgaactcgatgttctccaactgcggcaggacggtctgggcgtcggcgaccaaatcgttccagacctcctcgcggccgctcaggtggatcaggaaccccgccagattctcggcatgcggcgagagcgtggcgaagtccgcgccgcgcagccgtgtcggctgacgggccgccgccacgtcgacgtcgaagacccggaacgacgacagccggtccgcgacccgggtcacctcgtcgccgccgtctgcgggtccgagccggggcagcgtggacagaccgctgctgagcctgcggataccgaaactgccgctgtccttcgtctctcccgcccgttcatcgacgacacgggcttcctcgccggcgatggtgatgcgccggccacgtccctgcttgcgcttgaacgcgaagctctcttcacgggacagggtgtagcgcgtgcctttgccgtcccggttcgacggcagggagcgacgccggatgacgaggttgtactcgtccggtgcgttgagcgatgcgttgctggtccaggtcgccttcagctggatgcgcatcgaggtcggtggcctgctcccgccccagaaagccacctcgtcgaacccgccgcgcgagtccagcgccggctggaggtcggtgcggatgatgtcggcgaggaagtcgaagaccttcagcacgttggacttgcccgcgccgttcgggcccaccagcacggtgaggggaccgagcggcacggtcacgtcacgcagactgcggaagttctcgacgtgcagttcgaggaggcggccgggcatggaaaacctatcgcgtgggtgcggtgggcgttccgctcgcgatcggtacgtatccgaccgcgagcggaatttcgtggctcagcgtagccgggcgggctgacatcggttggcgtattcggcccggccattgcgccgagggccggcccgtgtccagggttgcccacacggtcttgccgggaccgccacggcggtccgtgacgccccagtcgtctgtcagggcggtgacgaggagcagcccgcggccggattcggcgcaggggcccgccggaggggcaacggtgggccgacgctcgccgcgggtgtccgagacctccagacggagggcaccgcctgcctcggcggccagccgcacgtggaactcccgccccgggacccggccgtgccgtacggcgttcgcgctcagctcggcggtgatcagcgtcagcgtctcgttgacctcactgccgtaggggcggccccaggagtccaggcagtgcgcgacgaacagccgcgccagacacgcgccacgcggagtggaggtgaaggacatggtgaattccattgtggtcgcgggcgcgacgggtgggcagtaccgggatgaggaagcgtgcgtgccgccggcgtcccgtctgtgatcggtgtctcaccagaggtgacgtctgtacggcgggctgctgtacgcgacggggagcgctcgtacgggccgcccgaagatgcggacggtggctctctctgcaggagtcgaggcgctcctaggagttgagatggacaccgatccgcacgaacgcctgcacgagcggggccggtggtaccgcgggcgacatgacctgtgagccgaagtggacgatcaccaggtccaggcccggcgagacgaagagccgctggccgtggatgccgctggccatgtaggagccgtagggatcgttcaggatccaccacaggtcgtggtaggagagcgtggccggtgagtcgaggggcgcggccggaaagcggacccggcgggggtagccgtcggggacgccgctggtgatcgtgcgggccacttcctccgggaccacctggcgctcgcccaccgccccgccgcagcgcagcatctcaccgagcctggccacatcgcgtgccgtcgcgctgaagcctccgcacgcggcctcgacgccctcgccgtccaggatgtagtacgcgtcctcctccgcgccgagcccggcccacagcagctcgctgaacagggccgacgtggtcgcccccgtgacgcgacggagtacttcggccagcgcctccacattgccgttctcgtagcggaactcctctcccggcgccccggtggcgtgggcggtcagcaggtgctcgcggatgctggtggggccgctgtagccgaacggccgcatccgggcggcgatcaccgcgaagtaccgctgggcctcgatcgccttgtcgaaggggcggcccgcgtagctcacgcgcgtgcccatgtgcagcaggtcctgcacccgggcctcgccgaaggccgtgccggacagttcggggacgtacgcggcggcccgggccgtgcggtccagcagtccctggtgggcgagtgtcgccgccagcaggccgaggtaggacttggccgccgaggcgttgaagtgcggggtgtgcgccgtggcgccgtgcggatagcgctcgtagacgacctggccgcggtgcaacaccaggaacgcgtccgtctgggccgcggcgaacagttccggcagcttcagcgggcccgggtcggtggtggcgaggtcgagtgcgtcgaggtcggcctcgttgcgcggcagctgacgagcgggagccggaccccgccagacccgccggctgggggagagctcacgcccgtgggacgtgaagcggcggatccaggccgggtccgtgtagccgcggctccacagcagatcactcagcggggctgtttcggacatgggtcactcctgtctcccgtcaggtctgctgtccgcgttgccgtgcagagcgttgaccccgcggccacctgacgcctaggttgccaaatcaaacgagcgctaacggacagtctgtacggcaacatacgcccacttcaatactccagaccgcaggagtgcccgatggccaagccgcagccccgacccaccccacgcctggacgccgccgagtcgccaccgtctgcgcacaccgaccgtcggcgcgcctggctgatcgccgcactgatcgtgacgttcatgctcgtcagccacgcggacaaggccgtgctgggcctcgcggcggtgccgatcatggacgagctgcacatcagcaacggcacctacggcctgatctccagctccttcgccctgctgttcagcctctccggactggtcgtcgggttcgtctccgcgcggatctccagccgggcgctgctgctcgtcctggccaccgcgtgggccctcgcgcagctgccggtgctcttctcggcgtccgtgccggcgctcgtggcggggcgcgtgctgctgggcgcggccgagggaccggccgcgcccatgtccatgcacgcgctgtaccagtggttcccggaggaccgcaggggcctgccgtccgcgctgcagatcagcggcgccgcgctggccacgctgatcgccgccccggtcctgacctggctgaccaccgctttcggctggcgctcggccttcgcggcgctcgcggcggccagtgcggtgtggagcctgctgtggtggaaggcggggcacgacgggccgtacggccaccagcccgcgcagggctccgcgcccgccttcgcgggtccggcccggctgccgtaccgcaggctgctgctgaccggcacggtggcgggaagcatcgcgggggcgttcggcgcttcctgggccctggccctgagccaggcgtggctgcccgcctacctgcgcacgcagctcggcatgtcaccgggccgggcggccacgctgatcagcggtgtctcggcgttcagtttcgtcctcctgctggcggtgtccccactggtcgacgcgttgaagcgacgcggcgtgtccagccgctggtcgaccggtgcgccgcaggggatcgccgtggccgtcgccgcgctcgccatggcggccctccccctcgccggctcacgggccctgctgctggtgctcatcacgctggcgttcggggcgcacgccatcgccttcccgctgcactacatgacgacggcagccgtggtgccgcccgcgcagcgcggagcggtgttcggcatcgtcgcggcgaccgggaccctgcccgggctgatcgcgccgtacctgaccgggcgcctgctggacgcggcgccctcacggggcagcggatactcccacgcgttcctgctgtcggccgcggtgatgctggtctgcgcgctggtcgcgctgatcaccatccggcccgagcgggacgcgcggcggctgagccccgtacccgccgggacgggtgagggagtgccggctcaggccggcggctcgaagccgctggcccagtagcggccgtgcagcgccaggtcgaggagcatgcgcacgacctcctcggccggcaggggcggggtgtcctgctcggcccaccagcgcagcacctcgacctgctccccgacccagacccgggccagcagctcggcgtcgatgcgcggctggacgccgttgcgttcggcgcgggcgcggaactcctcggccgtgacgcgtgcgcaggcgtccacgaacatccgcagcggtttcccgtcgccctcgccgcgcagcacgatccggtacagatcacgctcctcgcgcgcgtgccgcagcatctggagcaccggcttgcccgtgaagccgacggcgctgtcggcgaccgccggcgccaggcgctcggacagctcgtccagcaggtcgccggtcacccgtgcgaagaggtcctccttgtcgcggaagtgagcgtagaaggtggcgcgggccacatccgcgcgttccgtgatgtcctccacggtcagcgcggtgaagccccgctccagaaccagctccaccagggccgtgcccagggcccggcgtgagcgtctggtccgtctgtcctcggccatgcgcctccccctctcgatcgtcgcgttccgagcaccgcgctgcgtgcgcgccctcctgcgcgctcagtctaggagactcttgacacttcagtaattactgaacaagctgtctgcaattgagcgtcatgtacatcggctgcggatcggagcacatcttcatgaacctcggcacctatctctcgcgcagcgctcgctactggcccaaggccccggccctcgtctgcggggaccgctcctggaccttcaccgacctggaccgggcggccaaccgcctggcgcgcgcgctggctgcccggggcctcggtcccgacgacgccgtggcctccctggcgtggaaccgcagtgagctggtcgaggtggagttcgccctgtacaaggccggggtgacgcgggcgccgatcaacgcccggctcggccgcggggagatcgagcacatcctgcgctacgccccggtacgcgtcctcgtccatgacgccgcgcaccgcgaggacgccctcgccgccctcgccgcggccggcacggactgcctgcccgtcctcctggatgacccgggcgaggcggaggccgcaccggcgggcgggatctcctacgccgacctgctggccgagggcgacgaggcgccgttccacgtcgaggtcgacgaggacgccccctgcgtactcaacttcacctccggctcgaccggcgcgctcaaggccgccgtccagacgttcggcaaccgcctcgccaacatgcgcaagcagctcatgtcggacgagtcccgcccccggcccgggacccgttacctcgcctgcggccccatcacccacgccaccggcatgggcctgctggccggcgtgttcggcggctccaccacccacgtcctgcccgcctggagcccgcagagcttcctggagacggtcgagaaggaacgcatcacggcgaccttcctggtgccggccatgctgaacacggtgctcgctcatcccggcgccgccgaccacgacctgtcctccttgacgagcgtgcgcatcggcggtgcgcccgtgtcgccccaacgcctgcgggacgccgtggagttcttcggcccggtcgtcgctcaaggctacggcctcggcgagaccaccagcgtggtcgcgggcctgaccggggaggagatcgcccgcgcggtgcaggaggaccccgagctgctgcagtcctgcggccgtgcggcctacgacaccgagatacgcgtcgtcgacgaggcggggcgcgaactcgggccgcgcgaggtcggggaggtcatcgtgcgcggtccggactgcgtacgggagtactggcgggagccggaactgtccgcggagaccttccgggacggctgggtgcacaccggggacctcgcctggatgcgggaggacggctacctcttcctggtcgaccgcaagaaggacatgatcatctcgggcggcttcaacatctactgcaccgaggtggagaccgccctgtacgagcaccccgccgtgcaggaggcctgcgtcgtcggggtccccgacgaacggtggggggaagccgtcaaggcgctcgtcgtcgcccggcccgcccacccggtcaccgccggggaactcatcgagttctgcgcgcgccgcctcgaccggttcaagaaaccgcgctcggtggacttcgtcaccgaactgccgcacaaccgcaacggcaagctcgaccgcaaggcggtccgcgaaccgtactgggccgacgccgcccgtcgggtgaactgacccgggaatccgcgagaccaggagccaccgatgaccttctcactgcaccctacgcccgccgaaccgcagctcgccgccctcgtcggcaagctgcgcgactatctggagggcgaactcgccgcctacgagcgcgaccattcgatcacccccgccacccgcctgacccgcgccgacctgcaaccggtctggcggcgcagccgcgaactcggcttctacggcatccacctgcccgaggagtacgggggacaggacctcacctacacccagttggccgcgctgaaggaggagatcggggccagtggccgcgtcctcgggcactgcgtgctgggcgacatgggcggaccgctgcgcgccggtgacatcctcaagcacgccaccgaccaccaactgcgcacgtacctaatgccgttggtgcgcggcgaacgcgcctgctgcttctccctcaccgagaccgacgccggatccgacgtgcgctccatgcgcaccaccgccgtccgcgacggggacgtctaccggctcaccggccacaaggtcttcagctccgccggcccgttcgccgacttcgcgatcgtcgtggcccgcatggcggacaccgccgaggacacctactccgccttcctcgtcgacctggacagtcccggctgccgggtggcggacggggcgaccccgatgtccggcgagcacatcgagagcgacatcatcctcgacgactgccccgtaccggccgccaacctgctgggcaaggagggcgacggcctgcgcatcgccctgggccgggtgaccgtcaaccggctgctgcactgtccctccgtgctcggtgccacccgccgcgccctgcagctcacccttgaccgggcccggcagcgcacggtcgccggcgggcggcccctgctcgccctgcaggccatccagcacaagctcgccgacatggccaccgagttctacgccgcacgctccatgacgtacgcggccctggccgcgctggacggcggcgccgacgtgcgcaccgaggcgttcatgtgcaagctgcacgtcgccgagtcggcgttccgcatcctcgaccaggccgtgcagatccacggcaaggagggcctcacccagggcaacgagatcgagtacctcttccggaagatccgtatgttccggatcctgaccggcacgtcggagatccagcggaacggtatcgcgaagcaactggccgggctcggctgaatcacggcggggacgccccctgcgaggaacgagaagcgaggacatgagcagaggtgcacagggcccggacgcatgcggcccggcctgggacgacgagcaggacttcgccgacgcggaccgcggtttcatcgcccgcctggagccgtgcgtggtgcgggacaccgacggccggaccgtctgggacaacgacgcgtacgccttcttggacggcgactgcccgccgaccgcccacccgtcgctgtggcggcagagccggctggtggcgcggcaggggctgtacgaggtcgtacccggcatctaccaggtgcgcggcctggacctgtcccacatcaccttcgtcgagggcgaccgcggcgtcatcgtcatcgacccgctgatcagcgcggaggtggcggccgcggccctggccctgtaccgcgagcaccgcggcgaccggcccgtcaccgccgtgctgtacacgcactcgcacgtggaccacttcggcggggtgcgcggcgtcgtcgaccccgaggacgtggcggccgggacggtccccgtgatcgccccccgcggattcctggagcacgccgcaagcgagaacgtcttcaccgggacggcgatggcccgccggtccggctacatgtacggggccgcgctgcccaagggcccggccgggcagatcggctgcgggctcgggcagacgacctcgctcggcagcatcgggctgatcgctcccacgctcgacatcacggcgaccggacagtgcgagaccgtcgacggggtccgcatggtcttccagctgacccccggcaccgaggccccggccgagatgaacttccacttccccgacctgcgggcgctgtgcgtggcggagaacgcctgccacaccctgcacaacgtcctcaccctgcgcggtgcgctcgtgcgcgaccccagctcctgggcccgctacctcaccgagacgctgcgcctgttcgccaccgacacggacgtcgtgttcgcctcgcaccactggccgacctggggccaggaacgggcggtgcggttcctggaggagcagcgtgacgcgtacgcgtacctccacgaccagtccgtgcgcctgatcaacaccgggctcaccggtgccgagatcgccgaggaactgcgtttcccgcccgcactggagcgggcctggcacgcgcgcggctactacggctcgctcagccacaacgccaaagcggtctaccagcgctacatgggctggttcgacgggaaccccgcgcacctgtggcagcacccgccggtggaagccgcccggcggtacgtggagttcatgggcggcgccgacgccgtcgtggcgaaagcccggacctcgtacgagtcgggagacctgcgctgggtcgcggaagtgctcaaccacgtgctgttcgccgaccccgaccatgccgaggcacgcacgctgcaggccgacgccttcgaccggctcggccagggagccgagtgcgcgccgtggcgcaacttctacctcatgggcgcggccgaactgcgcgaaggcgttcgcggtacgcccgcccgcaccgcgtccgacatcctcaccgcgctgacgacggagcagatcttcgggtccatggccgtgcgtgtcaacgggccgcgcgccgcagcggccggacggatcctgctgcgctgggagttcaccgaccccgacgagacgtggacgctgctgctgtccaacggcgcgctcacccccatgccgggtgacgccccgcgaggcgagaagccgcaggtcacgctgaggctgtcccgggccaccctcgacgcggtcctgggccgagcgacgaccttcccgaaggccatcgccgaaggcgccgtggccctagacggggacgccggagcgttcagcaccttcggcaccctgatggaccggcccgaccccggcttcccgatcgtcaccccgtgagtccgggtccgagtccgagtccgcggcccggccggcgggcaggcgccgggcgcggtcgctgatcgcgtgtccgcgcgcggcgacgaggtgaggtgcggggagacctgggccggtccgatgccgccgaggggaccgggga

SEQ ID NO: 741 - DNA, 2620 bp, Unknown
  Kingdom: Bacteria, Phylum: Actinobacteria, Class: Actinobacteria, Order: Streptomycetales, Family: Streptomycetaceae, Genus: Streptomyces
cgagccggcggaccccggcaagcccgccacgcccctgccccgcctcaaatcccgcgcccccggcctcaccacggcctacaaggccgccaccaccgccctcaagaagaacaacctcaccggcacccgcgcagcggtccacctcgtcctcgaccgctccgcctccatgcgcccgtactacaaggacggctccgcccaggccctcgcggagcggaccctcgccctcgcggcgcacctcgaccccgaggcctcggtccacgtcacgttcttctccacggaggtggacggcaccgccgacctcaccctcaccgaccacgagggccggatcgacaagatgcacggcaccctcggccgcatgggccgcaccagctaccacgtcgcggtggacgcggtcctggcccacctcgacgagcacggcagcgccccgcgggcccccgtgctggtgatcttccagacggacggcgcccccgacgccaagacccccgccacccaggccctcacccaggccgcggcgagccaccccggcgtcttcttctccttcgtcgccttcggcgagcacgacaacaaggcgttcgactacctccgcaagctgaagacgggcaacgcgtccttcttccacgccggccccgcgccccgcgagctgtcggacaaggagctgtacgagggcgtcctcgcggcctggcgcccgtaacgcagcgcagccaccgcacgacaccgcgcgccgcccgcttcccagcacgtagaacgggaagcgggcggcgcggccgtgtcggctacgatttcaaggttcgtagacgaatcggacggccgcgaaggccgcccgccgtcaccccacgtagcgacttgggagcagcccgcgatggctcgacacctcatcaccagcgcccttccgtacatcaacgggatcaagcacctgggcaacatggtggggtccatgctcccggcggacgtctacgcacgctatatgcgccggcgcggacacgaggtgctgtacatctgcgccaccgacgagcacggcaccccggccgaactcgcggccaaggaacagggcgtcccggtcgccgagttctgcgcccaggcgcacgacgcgcagaaggcggtgtacgacggcttcgcgctcgccttcgactacttcggccgcagctcctctcccgagaacgtggagatcacccagcacttcgcgcgcaggctgcacgagaacggcttcatcgaggagcgttcgatccgccaggtgtacagcccggccgacggccgcttcctgccggaccggtacgtggagggcacctgcccgcactgcggctacgacaaggcgcgcggcgaccagtgcgagaactgcacccgcgtcctggacccgacggacctgatcaacccgcgcagcgccatctccgggtcgacggaccttgaggtccgcgagaccaagcacctcttcctgctccagtccaagctgcagcacgaggtcgaggagtgggtggcccggcacgaggccgactggccgcagctggcctcctccatcgcccgcaagtggctgaccgagggcctgcacgaccgtgcgatcacccgcgacctggactggggcgtcccggtcccggcggacacctggccggaactggcggccgagggcaaggtcttctacgtgtggttcgacgcgcccatcgagtacatcggcgcgacgaaggagtgggcggacaaggaccccgggaaccgcgactggaagtcgtggtggtacgaggccgacgacaccgtccgctacacggagttcatggccaaggacaacgtccccttccacacggtgatgttcccggcgacggaactcggcgtgcgcgagccgtggaagaaggtcgactacgtcaaggccttcaactggctgacgtactacggcggcaagttctccacctcgcagaagcgcggcgtcttcaccgaccaggccctggagatcctcccggcggactactggcgctacttcctcatcgccaacgcgcccgagtcggacgactcctccttcacctgggagcacttcacggccacggtgaacaaggacctggcggacacgctgggcaacttcgtcaaccgcgtgctgtccttctccaagaagcgcttcggcgccgaggtcccggccggcggcgcgccgggcgaggcggaggcgcgcctgggcgaggagatcgcccggctgctcgccgagtacgaggagcacatggaggcgctccagttccgcaaggccgccgcggccctgcgcgccctgtggtcggccggcaactcctacctggaggagaaggccccctggctggagatcaagaccgaccaggacggcgcggccctgaccctgcgcacggcgatgaacctcatccacctgtacgcggtggtctccgagcccctcatccccaccacggccaaggcgatgcgcgccgcgttcgccctcgccgacgacacggcggcctgggtcaccccggccgaggcgaagtccctgaccgccctgcccgcgggcacccccttcacggtccccccggtcctcttcgccaagctcaccgaggacgacctggccgcctacaaggagcgcttcggcggcgaaccgcagtagtcccgccccgcccccggcgcgggggcggaaacggcgaggcggtccgga

SEQ ID NO: 742 - DNA, 1956 bp, Unknown
  Kingdom: Bacteria, Phylum: Actinobacteria, Class: Actinobacteria, Order: Streptomycetales, Family: Streptomycetaceae, Genus: Streptomyces
gaagcggcgcggtgcgggcaccggcgccgcttcctcctggtcctgcggcagggatacggacggcagttcgccggtcgtggccgcatcggggacgggaacgtcctccggtgccgcgaccggatcggagacggaaaggtcctcctgggccgctgccggatcgaggacgggaacgtcctccgaggtcgttgccgcaaggccgtcgtcggccgcgctgccggcgttccactgggtggcgtcgtacgcgccggtgtcgaaggtctgcgtgccccagtcccactgctgggtctgctcggccgggggcgcggtgggcgcgccctggagccaggcgttcgcgtcccactggccggtggcgtcgacgggcgccggctgctgcggtacggcggacaggtgctggtacccgctggaccaggcggtcgtgtcgtaggcgccggtgtcgtaggcggcgtggtgctgcgccgcgtacgcgtcgtagttcagggtgtggtggctgcccgtggaccactgggtggcgtcgtacgtgccggtcgtcccggcgtccgccgcagcggcgtcgacggtggggaggtcaccgaagagcgggtcggccgggaaggccgccgtgctgggggcgccggtgtgaaaaccggtggcgtcgtggtcgccgtacgtggtgaagtcaccgtaggcggcttcctgtccgctgtacggcgcgtagggcgccgaggcgtcgtcggaggccggggccgggggcgtaacggtccccgacgggtgacggtcgttcaccaacttctctttcgcctcgacaacaggggctgccagagcagtgcggtgactgtacccggcggtacgcgggcgcgacaatcttcggcaggtttcccgatcacgggaaacgggcaatcggccgtgattcggcggaccgcggacacggccttgggtctgtgttcgaggcgatgttcgaccctgatgggtcaattacggtccgggcgacgccctcgatccgcgggcggtcgcgggtcaggccacggtgagtcctccgccctgcgccgtcgacgggtcccccggccgtacggtgtccagggcctgccgtatgccgctggcgaccgcggggtgcacgggcagggcgagatggccgatgccgctcacccggacgttctccgcccggaggtccggatgctcgatgcaggccgactccagcgggtccatcaggtggtcgaggtcgctccagaagctgacgaagtgtgtgcggcagccgggcgcggggccggacagctcctctatcagctccgaaccgggccgcatctgtcggacgatggggtgcgcgttggccaacggcgcgacccgggtgccggcgtgcggtgtgcccagggtgacgagggtgcggacgcgcgcgtcgccgccgagccgctgcacgtagtaacgcgctatcagtccgccgaggctgtgcccgacgacgtcgacccgttcgctgccggtgcgctcgcagatctcctccatgtgccggccgagcagttccgccgcggtacggatgtcgcaggtcagcggcgagtagttgagggactccacccgctggcggccgtgctgggcgaggttgcggcgcagcagcacgaagaccgaacggttgtcgatgaagccgtgcaccagcaccaccggcagcttggcctcggccggcagctgggcggcggcacccggcgcggtcggcggagcctcggcggcgcggcgctcctggacgatccccgacgggtagaggaggacgtgcccggcgaggatcgccagctccagggccgtcgccttcagcaggcccaccgacactccggcgatcctgcccgggagcaggcgctggcagaacgggaggaggggatctgcgacgctggtgaccttcatggccgacctcctgtcggcacgcgggaggacggctccgtcccccgtgtgccctcgtgggcagtcgcggcagcggcctgggacggggcgcgggcgggg

SEQ ID NO: 743 - DNA, 6515 bp, Unknown
  Kingdom: Bacteria, Phylum: Actinobacteria, Class: Actinobacteria, Order: Streptomycetales, Family: Streptomycetaceae, Genus: Streptomyces
gaaggggcgggagggacggacacggcggcggccgcgggcgaagtgacggataccgccggcggtgccgaagcgcccgcctccgattccggcgaccggaaccccggctcggcaccggacaacaacgggcgatagcgtccgttcatgcccgcagagcatcccgtggcgcgaccggcagcgcatcccgaagtccccgcaaaagccatcaccgtccgacgggcccggaccagcgatgtcccggccgtgcgccggctgctggacgactacacccgtgagcgcatcctgctcgacaaagcgacggtgaccctttacgaggacatccaggagttctggatcgccgaacgggacgacaacgccgaggtcgtcggctgcggcgcactgcatgtgatgtgggaagacctggcggaagtgcgcacgctcgcggtgaagccgggactcaagggtgccggtgtcggtcaccagctgctggagaagttgctgcagaccgcgcgctggctcggtgttcgccgtgttttctgtctgaccttcgaagtcgacttcttcgagaagcacggcttcgtggagatcggcgagacgcccgtcgacacggatgtctacgcggagctgatgcgttcctatgacgagggcgtagcggagttcctcggtctcgaacgggtgaaaccgaacaccttgggcaacagccggatgcttctgcatctgtgatcgacacggacacgcgaagaggcgtccggcggcgagccgcggaagccgcattccgtcggaccggtcatgcccgcgttccctatgtccgaaacgcgcatgtttccggtcggtgatgagggtccggtctctcccaggggtttgtgtttttcccgcaaaagcggtttgctttccgacgtactgcagtactgcatataacaggggacggcgaaacggcggatgcccgaccaggtccggccctgacgttatcgatgaaaggaaatccggtggcacagaaggttcaggtccttcttgtcgatgacctcgacggcggcgaggcggacgagaccgtgacgttcgcactggacggcaagacatacgagatcgatctcaccaccgccaatgcggacaagctccgcggccttctcgagccgtacgtcaagagcggccggcgtaccggcgggcgtgcttcgggcggccgtggaaaggcgcgtgcggcggcgtccggcggcagccaggacaccgcgcagatccgcgcctgggcgaaggagaacggctacgaggtcaacgaccgcggccgcgtccccgcgaccatccgcgaggcctacgagaaggccaacggctgacccgaggccggtgaaaggcttttcacggccgggggacccggaagggcgccggcggcctgccgcacgcgcgccgcagccgggcccggtggcactgcgtcgccgccgtgttcaccagccgtacgagatcgggggcacccccgccgccccccatggcggacatggccggcagcgaggcctcggtctcctgtccgggctcggggggccgcagccactcggcggccccctgcggaccaggacggccctgcgggcgcgtcccgggccgggtgccgggcggtggcggagcgtccatcacggaccccgcgccgagccccaccaggtccaggtccagcgcgtcccactccagccaccgcagcagccccggcagctcctgcgcgctgcccgcggccaccagcagccgcatccggtccgcctgcaccgccaccgggaacgccggtgccaccgggcccgaccccggatggcgcagcaccgcccggccggcctccagtggcacgtccaggacgtcgaagcggtcgcccacgacaagtcgtaccggtgctccgggcaccgtcgcccagcccagttcgttctcgtaccagtgccgcgcccggtccccggggtcgagcggccgacggggaagcgggaccgggagagggatcgtggaaaggctgccgaccatgacagtgcaaccgccggaaagcgccggaggttacgctgggtcgctctgcgcagacgcaccgtgccgaaatccggggcgcgcggaggcggtaaagggcgcaaggttgttcgcccatagcggagggaaccggtgcgcgccgcatggagtgtcagtccctgcgggtaagacattgcctagtgggagggggcgacacgcaggccgcacccgggcagaggagtctcacgttcgccatcggcgtactggcgagtggggtaactgcctggcctgcgggaacatcgtctcgcaccatcgggttggagcagatgtcggcgttcggggtcaggaggccatcgacggtgtcggcagttggaatgagcggtccccgcttgcgggactaagctgcggaaggacagggaggggaagttccccccactgcctgaccgctctgaggagcgattaacgatgttcgagaggttcaccgaccgcgcgcggcgggttgtcgtcctggctcaggaagaagcccggatgctcaaccacaactacatcggcaccgagcacatcctcctgggcctgatccacgagggtgagggtgtcgccgccaaggcccttgagagcctcgggatttcgctcgaggcggtccgccagcaggtggaggagatcatcggccagggccagcaggccccgtccggccacattcccttcaccccccgtgccaagaaggtcctggagctgtcgctccgcgaggcccttcagctgggccacaactacatcggcacggagcacatcctgctcggcctgatccgtgagggcgagggcgtcgccgcccaggtcctggtcaagctgggcgcagacctcaaccgggtgcggcagcaggtgatccagctgctctccggctaccagggcaaggagaccgccaccgccggcggccctgccgagggcaccccctcgacgtccctggtcctcgaccagttcggccggaacctcacccaggccgcccgcgagtccaagctcgacccggtcatcgggcgcgagaaggagatcgagcgggtcatgcaggtgctgtcccgccgtaccaagaacaacccggtgctgatcggtgagcccggcgtcggcaagaccgccgtcgtcgagggcctcgcccaggccatcgtcaagggcgaggtgcccgagaccctcaaggacaagcacctctacaccctcgacctcggcgccctggtcgccggctcccgctaccgcggtgacttcgaggagcgcctgaagaaggtgctcaaggagatccgcacccgcggcgacatcatcctgttcatcgacgagctgcacacgctggtcggtgcgggtgccgccgagggcgccatcgacgccgcttcgatcctgaagccgatgctggcccgcggtgagctgcagaccatcggtgccaccacgctggacgagtaccgcaagcacctggagaaggacgcggccctggagcgccgcttccagcccatccaggtcgccgagccgtccctgccgcacaccatcgagatcctcaagggcctgcgcgaccggtacgaggcgcaccaccgcgtctcgatcaccgacgaggcgctggtccaggccgccaccctggccgaccgctacatctcggaccgcttcctgccggacaaggcgatcgacctgatcgacgaggccggctcgcggatgcgcatccgccggatgaccgcgccgccggacctgcgcgagttcgacgagaagatcgccgccgtccgccgggacaaggagtccgcgatcgactcgcaggacttcgagaaggccgcctccctgcgcgacaaggagaagcagctcctgtccgccaaggccaagcgggagaaggagtggaaggccggcgacatggacgtcgtcgcggaggtcgacggcgagctgatcgccgaggtcctcgccacggcgaccggcatcccggtcttcaagctgaccgaggaggagtccagccgtctgctccgcatggaggacgagctgcacaagcgggtcatcggccaggtcgacgccgtcaaggcgctgtccaaggcgatccgccgtacgcgtgccggcctgaaggatcccaagcgtccgggtggctcgttcatcttcgccggcccgtccggcgtcggtaagacggagctgtccaaggcgctggcggagttcctcttcggtgacgaggacgcgctgatctccctcgacatgtcggagttcagcgagaagcacacggtctcgcgcctcttcggttcgccccccggctacgtgggctacgaggagggcggccagctgacggagaaggtccgccgcaagccgttctcggtcgtcctcttcgacgaggtcgagaaggcccacccggacatcttcaactcgctgctgcagatcctggaggacggtcgcctgaccgactcccagggccgggtcgtggacttcaagaacacggtcatcatcatgacgaccaacctcggcacccgggacatctccaagggcttcaacctgggcttcgccgcctccggcgacacgaagaccaactacgagcgcatgaagaacaaggtctcggacgagctgaagcagcacttccggcccgagttcctcaaccgtgtcgacgacgtggtcgtcttcccgcagctcacgcaggcggacatcctgcggatcgtcgacctgatgatcggcaaggtggacgagcgactcaaggaccgggacatgggcatcgagctgtcccagtccgccaaggagctgctgtccaagaagggctacgaccccgttctgggcgcccggccgctgcgccggacgattcagcgcgagatcgaggactcgctctcggagaagatcctcttcggcgagctgcgccccggtcacatcgtggtcgtggacaccgagggcgacggcgacgagcagaccttcaccttccggggtgaggagaagtcggcgctgcccgacgtcccgccgatcgagcaggcggccggcggtgccggtccgaacctgagcaaggacgcgtaacccctcgggggtacgacggacggacgtgaaggggctgccccgggaccgagaggtcccggggcagccccttctcccggtttcagcgcttgaccagcgtgacgtccgcgccggggaagaggcccgtgtaccgctcgatggggaaacgctcgccggggtaggtgtgcagggtcacccggcgcagcccgggcaggcgctcggccagcacggacaggtcctcgccgccgtccatccggtggaggaccagccgcgtgacccccggcagcacgggcatggcctcgatgcagccgggggaccgcgtcacgaggcccgcgttcaggtgcaggccgctcaacgcgggcagcccggccacacagtcccagtcctcctccgtcaggggcgttctcagggcccccaggctgaggtccgtgagcccggaccagtgccccagcccgcgcagacccgtgcggtccgtggtgttcatgcccagcaggaggaactccagcggagcatttgccggcaggacgtcggtgaggctttcgccgggcagctcctggtacagggagagccgccgcagagagcccagcgcccccagaccgctcagatcggcgatcggtccgcagacgagatcgacgagaggaagcggggagagccggcccaggccgtgggccgccgggcagcccctgacccacagggtgcgcagcgaggagaacggcagcagcgcgcccaggtcgccgaccagcgggttgtcgcacaggtcgagcaggggcagcgacccgtgctccggaacggccgccaccatctcctcggcacggtgcgcgccccggaaggtcaccccctgccagggccgcatccccgccagcgccgcccgctgctccgccgatccgcagctgaccagcaggtcggcgcggtccaggtggtccagcacctgagccgcgtactcctcggtggcgaagcggctccaggtgcccacgagctgccggcgcacgtggaggtccgggtgggaccggaaccggcgcagcacgcccagggcccctgccggctcctccgtgccgagcaccgaagccgtgatcaccacgcccagcgcctcggcgtcggtcagcccctcgggtccgggcagcagctccagcaccaggggacccgcctccgccagcgccctcgcgtccttcgaggtccgcggcgggatcagcgcggcggcccgcgcctccacctcggcccgcaccgccggttccagggccgccgtgtgctccaggcaggccagcgccagcagggtcagccgcggggtgtcccgcgcgagcagccgccgcagcaccgaggcgcgttcacgcgggcgggcgtgggcgacggccatgcggacgacgtcctcccactggctctcgtcggcatggcgggtgaggacgtcgaggtggccctcctccacggcgtagcgggcgcccaggtagtcctggaaggtgcggtgcacgaagtcgacggcgccctcggccggccggcgcagcagtccgctgcgcagcagcagggtgcgcagggccgccgccgcggtgccggggtcggcgggcaggccgatcgacgccagacagcgctccacgatgccctcggcggtctcggtgtccatctcc

SEQ ID NO: 744 - DNA, 2658 bp, Unknown
  Kingdom: Bacteria, Phylum: Actinobacteria, Class: Actinobacteria, Order: Streptomycetales, Family: Streptomycetaceae, Genus: Streptomyces
gggggtgcatcaggtcctcgtcaccccggacgcgatgcagggccgggccacgagcgtcttcggcctggtcggctccggcatgaactccctgggcgcgctcgcgggcggcttcctgctggcggccgcgggggcgtactggagcgtcctggccgccgccgcgggcatggccctgctggcgctggccgccctggcgaccccggcggtgcgccggatgggcgcggccggctgagggccggcgggaagccccgtccacctgcacggggaccggatatcgaggcggtatagaccgccccggaagactcaaggcaccggacgttccagaaggcgtccggtgcttcgtcgtgcgggcgttgcggacaacttcatatcgacctctgtcatgtgtaaggaactgttgacaggtgccgccgacacctgtcatggttttcttacacatgaaagaggtcgcgatggaaaccttcccgaccccgacaggcgatgaggtgttgcagatgctggcggcgctcggcaatccgcaccggatgcggatcatcgcggcgctgtcgcaggggcggaactacgtgagccggctcgcccgcgagatcggcatgagccgccccctgctccacatgcatctgcagcgcctagaggcggctgggctcgtgaccggagtactcgaactatcggaaggcggaaaggcgatgaagtacttcgaagtcacccccttcgtcctgcacctgaccccgcggaccgtggccgaggcggcccggagcctgaccgaccaggacgagtccaagagcaccaccaagggagcgaagtgaacgggcacgagacggtgacgctggccagtgacccatggagcggcgacgcgaccggactcgtcgcggcgggaggtgtcttcctgctgctcatcgtgatcgtctggcagatcgcggcgacctggcgggcccgcatgctggccgcccgcgaggacgagtaccgccgcctcgccgcgaagtacgcccagctcctggaggacaacgtggagctccaccggcgcacgtccgaggagctcacgcaggcgcggcgggccatcgcctcgatggagaagatgatgcgcgagatcgagtgaccccggtccactccccccgcgctgccaggggggccgcaccaccgagttggcgctcggcggcacggcccggcaggggaacacacgaagtcccgcacagccgatcgtgacgtcacggcaaggcctaggaaccgaaggccgtgacgtcgggcggcgtgcgtccgctaccgcaatgcactcccatgcataggagaccatctcatgccgagcacgacaccccccacgccgccgggggaggaccgccgaccgctgaccgtacgggtcgcaggctggtcggcccgcaacgccaagaagaccatcggggggtggctgctcctcgtcgtgctctcggtgctgatcggcggcgccgccggatcgggcgcccagacctctgacccgggggagtccgggcgggcccagaagatcgtccgcgagcaggacgtcgaggagccctaccaggagtcggtcctcatcgaggcgaaggagcgcggctccgtcaagttcgccgaggacgcggggctccggaaggccgcccaggacctggtcgccaacctgaaggccaccggcgccgccgtcaccgacatcgcggcccccctcggagcccggggcgccgagcagatcagccgggacgggcactccggcctcgtcgggttcaccgtcgccggcccggaggagcaggtcgacgcccacttcgagacggtcctgaaggccgtcgagaagaccaggtccgcccaccccgacgtgcgtatcgccgaggccggcgacctgtccctgcagacggccgtgaacgacgccgcagacaaggacctcgccaaggccgagatgacctcgctgccgctcaccctggtcatcctgctcgtggtgttcggcgcgctggtcgccgccggcatcccggtcctgctcgccatcacctcggtgctcgccgccctcggcctgctcggcgccgtcggcaccgtcatccccgccaacagcacggtctcctccgtcgtcctgctcatcggcatggccgtcggcgtcgactactcgctcttctacctgcgtcgcgagcgcgaggagcgggcggccgggaagtccgccgccgaggccctggaagccagcgcccgcacctccgggcacgccgtcgtggtctccggcatcaccgtgatgctctccgtcgccggactcttcatcaccggcatcgacgtcttcaacggcatggccgtcggcaccgtcctcgtggtcggcctcgccgtcctcggctcggtcaccgtcctgccggccctgctcgcactcctcggccgccgcgtcgactccctgcgcctgccgttcctgggccgccgccgcaccaccgccaccgagtcccgcacctggaccgccatcgcccgcagcgtcgtgcgcaagcccctgctcatgggcggcgccgccgtgatcgtgctgctcgccctggccgccccggcgctcggcatgaagctctccgacccggggcagacccgctcgctgccgcgctccatcgaggccgtcgacgccggcgtccgcatccaggaggccttccccggcggacccgccccggcctcggtcgtcgtctggggcgacggcgccaccaccggcaaggc

SEQ ID NO: 745 - DNA, 3213 bp, Unknown
  Kingdom: Bacteria, Phylum: Actinobacteria, Class: Actinobacteria, Order: Streptomycetales, Family: Streptomycetaceae, Genus: Streptomyces
gcggtcgccgtcgacgtccgcggctacggccgctcctcgaggccggccgcgacggacgcgtaccggatgctcgacctggtggaggacagcgtcgcggtggtgcgtgcgctcggcgaggagtcggcggtggtcgtcggccacgactggggcgccaccatcgccgcgcactgcgcgctcctgcggccggaggtcttccgcgcggtgggtctgctgagcgtcccctacaccccgcccggcggcccgcgccccagcgacgtcttcgccgggatggggggtgacgaggagttctacgtctcgtacttccaggagccgggccgcgcggaggccgagatcgaaccggacgtacgcggctggctcgcgggcttctacgccgccctgtccgccgggaccatgcccgcgcccggcgcccccgacccgcatttcgtcacccggggcggcacgctgcgcgaccggtttcccaccggcccgctgccgacgtggctcggcgagcgggacctcgacgtctacgccggcgagttcgagcggaccggcctgaccggtgcgctcaaccgctaccggaacatggaccgcgactgggaggacctcgccgccttccgcggcgctcccctcacccagccgtccctgttcgccggcggctccctggacgcgtccacgacctggctggccgaggcgatcgacgcgtacccggtcacgctgccgggcctcgtctcctcgcacctcctcgaaggctgcggccactggatccagcaggagcgtcccgccgaggtgaaccgcctcctgaccgactggctcgcggccctgcccgcctgaggccgggcgctcagctcggtgagcgtgttccctgtgcggccagcctgctcagggtccgggccgagggggtgccgaggtcggcggtgatcaggacgacctcctggtcgtcctcggggacgaggaggacgtcgcagttcaggcgcagccggcccgccaccggatggtcgagggtcttggtgcggtggccggggttgtgcaccggacgcgtctcccacaactgcccgaactcctcgctgccttcgcgtagttcggccagcagggcggcgagccgcggatcgtgcgggtaacggtcggcggcccggcgcaggcgggcgaccacgatgtgtccgaactcctccctgctggagctctcgcgctccgggcccccggcgaggaagcggcgacgggccaggttggccgtgcccgtggcgaggtcaccgccgaggagcgtctgggccagcgggttgcaggcgacgaccccgtaggtcgcgtcggtgacgatcgcggcggtgtccggcagccgctggagcatctgcgcgacgtgcgggcgcacacggcgtacggcgccggtggcgggcggcggcgcgctcgtgccggccaggcggaacaggtggctgcgttcggccggtgtgaggcggagggcctgggccagcgcgtccaggatgcgcggtgaggggcgcgggccgcgggcctgttcgaggcgcgtgtagtagtcgacggacatgtgcgccagctccgccacctcctcgcggcgcaggcccggggtgcggcgcggggcacctgcgggcaggcccagggcgtgcgggcgcagggccgcgcggcgctcccgcaggaaacgggccagttcctgccgcgccatggcctctccctccccgtcccgctgcctggtacaggttgtccctggcagggcgggcgccgccaggggaccgtggtggtcatgaacgatcgcacagcactggtcacgggtgccaacaagggcatcggcaagcagatcgcccgcctgctcgcggcggagggtttcacggtgtacgtcggctcccgtgacgccggacgcggacggcgggccgtcgacgagatcggcggcgccgcgcggctgctggtcctcgacgtcacggacccggacggcatcgcggcggctgcggggcaggtggaccgcctcgacgtactggtcaacaacgcgggcgtctcgccctcgctcgcgcccgcgaccgagacgggcctggaggaattccggcgtacgtacgaggcgaacgtgttcggggtcgtggcggtcacgaacgccttcctgcccgccctgcgccgctccccgcgcccccggatcgtcaacgtctccagcgggaccgcgtccctgacctggagcaccagccccaacccgcagttcaccccgggcagcggcggcgcggccgcctaccggtcgtcgaaggccgccctgaacgccctcaccctcctgttcgcccagaccctggccgaggacggcttcaaggtcaacgcgctcgcccccggcctgcgggccaccggcctcaacccggtggccgccgagtccggcggcgacccggcggaggccgcgcggggtgccgtacgcctggcactcctgccggacgacggaccgaccggcgcgttcttctcctgggacggaacgcccgtgccctggtgaccagtgaccggccggcacgtcacttccggcaggtcaccacggacaccgcgcttccggcagtcaccgcaggcaggtcacttcaggcagccgggagccgggaaggccgtggtggtggcggggtggccgccgccctccatgttggtgacgagcttgggcgaccggccgttcgcgtcgacgatgcgggcgacgaagccggcgctcgcgggcagcgcggcgtggccgcggtccacgacgccgccgaagcgggtgtggtcaccggcgtcctcgaagaaggcgcgcgggcccgtgggaccgttgctgagcacggccagggtgccggccccgatggacgcctcgttgacgatcgtgcagccgcgtgcgtcgggcgtgccggccttgggcagcgggaaggtcttggtgccgcccttgtcgctgtgcacctgcagcgccggggccacgccccccacgccggtcagcttcagcgacaggttcccctccttggcggtgaggtggccgctgtccagggcgtcgaggacacggaacatgtaggcgtcgccgggcttccagtccggcgagacggcgcggatccaggcctcggggccgcccgcggccggatcgttgcgcaggacggcgacgaggccccggccgatggagacgggcttgcccgcgtagcgggcggccgggctggtgaggacagcggagttggcggtccggccggcggccgaggcggagacggccgggagcacggcggtggcgccgagggcggtggcgagcgcggcggcggcgaggac

SEQ ID NO: 746 - DNA, 10311 bp, Unknown
  Kingdom: Bacteria, Phylum: Actinobacteria, Class: Actinobacteria, Order: Streptomycetales, Family: Streptomycetaceae, Genus: Streptomyces
accgacccggccatcagtcacaacaagcaccgttgcagtactagaccaaacgaggccgccgttgggcgcgggcggcaggagaggactcaccagttgtctgcgcagacgaagctacgacgcgcgttatcccatgtggccgtcggcacggcggtgttcgcggcggtgccgttcgctgtcccgagtggggccgctgcccaggaggccagcgctgccgcagctgaacgtttcgttcccaacccggatcccaacggtgcaccgtcgtcccggccggcggtcgcgagcgggtttccgtggcggcggcaagccgccccgtgtccggaaagaacccccaggccggcccgacgttcacacaggcgagtggagtgtggaacgtcaacacctccatggccgtgctgcgtaacaccgtcacggacgccgacggcgacaaggccaatctgccccttcgaggtctagacgaccgacgccagcggcaatccgaaaacacaggtcaaggtcacggacgacaatccgtacggggtcttggtgtcacccttcgtggcgactgggaagaccgccgaggtcaccgtgccccccgggaggctgaagccgggcaccacctacgccttccatacctccgcctatgacggcagcatgtacgagacgtcgtggtcgccctgggcgaaattccgtatccgcgatcgcgcggtggacatcaccctgccggcgccgaacaagagcgctgcggatcccgcgttcgacaacacgtggcagccggtcccgggtggggggcagtcaacaccaaacagttcgccgcgaccgtcgagcggcactgcactcctgcaaggaatggcgaccagctctgcatcacctcctcgccggccactgcagatgacatcgcgaaggccaagtaaagccgttcacgtctgaagggagttcgcgctgccgcgccgcccctgaacgacgcctgcgaggccggcgcgcagcgcagggcagctacctgtcgatcttcacgcgtgactcggcgtgcatgtacaacaagacgaccgtcgaggtgaccgacgaagagaagaagacgtccaaggggtatcagggcttcctgatgtcctaccacatgaagaccgacatggtcggtaccgaactgaagctgtgggctcgcgtcaccccccttcccaggcccgcaggggaggtcccctttccggcgcagcccggcgcgatcaagctgacgatcctcccggagtgcaaggcgggatgcgtcggcaagccctcctacgcgtgggacggcaacttgatgtggggtggctcgtacgacatcgatccgcacgaggagacgggcacggcgacggtgaagtggtccggaggtgtgccggacgagtcagcgaagaaggacatggacctctcgcaggacatggccttcacgccgtacgcgaccttctccacgagcgttccggaaaccttccccaccgacgagagccagggctatatcgggagtcccgtctacgcacgctgtgacatggtgtactccccggcgggctgcgtgatgcgtgactacatgcccggttacgtgttcaacaccgccaagacgccggcggcagccgcacacgcctggctgatccagagcaagatccgcaagggcgcgccgctgaactatctccccgaccgtaggggagacacgggggcgcatggcgagcgcaacacctacggccgtgatccggacgccaaccgcaaggtgatctgccctgacggctgggcggccgccaaggggcaccccgacacgacaccggtgaccgacatcagcgcgaccgacggggccagctgtgacgagttctccttcgccgctacctacaacagtggcggcatgcccaaggacatgctgggcaccaatcccgtctcttccggcgaccagtgtgtgcagacctacgcgaccaagctgacggacggcacctggaagctgtacgacgacgagcgcaaggcaggccccacgtggaaggaagtctgcggccgatcggccatgtccggctggatcaactccacttccatgagccgcttccccaacttcgccaagcagtaccggctgctcgaccaggacctgtacttcgtcaggacccctggcttcgagaagtgcgacgcgagcaaggcggtcgtgaagtgcgacatcaggtaaccctgtaaaaagacaagtcccgctacatgacaagcgggcgtctgcgggggcggcgctgcgcgccgcccccgcttccccgtaggagagacgagatgcacgacggaataacctggatcgcccacagcaacatttcctggctcggctactgcatcacactggcgcgcggcgtagaagccgaagaactcgtccgccgcctcgcaggagaaacagcccctgccccactgggccagctgacggccgcagagctcgagaggtacctcagccagcgggaccaagagccgggcagcggcggcgccatcgccgtgcggtacggcaccgccgccggcctggccttcgccatagcggacggccactggccaggagagatgggcctgggaattcccgacggcatgtcccacgaaggtgctcacgtcttcaggctgtactacgagaaggagaacccgaagctgcccccgcccacgttcagctacttccacgacggacgctatatatgcggattcgacatgtatatgcacacgtggtctacggagatcacgggatcaaaccccggcctggtaagggaggccgtattgagggcaggtctcccaggagaaacagagcgagacgtcgcgcacacaaaatccctgacgatcgtagaagaccagttccagctcacccttccacgggaacaagtgctgaaccaggcgctgcccgcggcgttgatcaggggccagaccgctgcatgatcctcgtcaggcctgtactacttccgaaactcagtcaccaggtctcacctggtggttcacggtgcggctttgtacccgttgatcggcccaccgtgaacgggtgtccggcgggtccgccccgctcggaccggaaataggatcacgctcgggtcgtcgtcgggggcgcgcaggctcagtccggcgccttgatggctgcacccgccgttgtagtaggcgagatagtggtcaaggaccatgcgcaggtggcgctcgccgccgatgagtatccggccggtgcactcggagcggacggtgcgcacgaaccgctcggcgatcgcgttcatccgcgcgcttcgggagccgtgagcagcacgccggtcccgctcgcggcgagtacggtgtcgaaggcctcggtgaacttggcgtcacggtcccggatccaacggcggaaccggtctgctcgggatcggcggtgaagtcccgggccggctgcgtggcccaggcgctggtcgggtaccgggtcgtgccctgcaggtggacccggcgggtgcggtgctcgatgacgaacgccccgtacagccgggtcagaaagagcgcgcagtccacgtggaagaagtccatcgccaggatcgactcggcatgggcctgaagaaaccttcgccacccatcgtcgcgtgcggtcggcggcgggatccggcggccgcgcaggattcttcggatcgggcccgctccgaggcgatgccccaggcggcgcagctcgccctggatccggaccacgccccaggtccggttctcggtggcgaggcggacgatcaactctgcgagttcgtcgtcgagcggtggacgtcccggtgaccgaggctgggtccacttcttgacgaccatgcggcggtgccaccgcagcagcgtgctcggattgacgattcggcgcagccgcaacgctttcggcagcatcctggacaacgccgcgaacacagcccggtcagtccattcgagccgcggctccaggtcggcacaccgccaagaccgcgacctcttggcgcagtaccagtatcccggcgttcttcgactccgccgatctggccagcagcaccagccaggacagcaccgtgacggcgaaccggtagatcagccgactcagcatggccccccatcaccgcagcccgggcccgtggccgagtttcgggagaactacaggggtcggcccgggttgcccctgacgcgggccggggtccgggcgcggttgtgagcccctcacgctcgcaggtacgccagcaccgcgagcacccgtcggtgcccctcggtgtccaccgggaggtccagcttgttgaagatgttgccgatgtgtttgttcacggccgcctcgctgatgaacaggtgcttggccaggttcgcgttggtgcggccctgcgcgatcagcgcgagcacctcgcgctcgcgggcgctgagccgctccagcgggtcctggcgcagctggaccagctgctggatgacctcggggtccaccacggtcccgccgacggcgacccgttcgatcgcggaggtgaagtctgccaccgcgctcacccgctccttgagcagatagccgacgccggcgccgccgcccgagtccaacaggcgcagggcgtacgagcgttccacgtactggctcagcacgagcacgggcagcccggggaactgcgcgcgcagttcgaccgacgcgcgcagcccgtcgtcgctgagcgacggcggcatccgtacgtccgtgacgatgaggtcgggccggtcggcgcggaccgcatcgaccagggcgtcggcgtcaccgacggccgccaccacgtcatggccgacccgttcgagcagcccgaccagcccttcgcgcaacaggacggcgtcctcggccacgatcaggcgaagcgacacggaacctccacgtgcatcagggtgggaccaccgtccggactcgacacccgcatccggccgtcgagagcgaagacccggtctgcgagaccggtcacgccgctgcccgcagggtcgaggccgccccggccgtcgtccttgatgtcgaggatgaacaggtcggaatggtagcgaccgtggacgtgcgcggtcgtggcaccgctgtgcttggcgatgttcgtcatggcctcgttgatcaagtaatacatcgtcgtttcgagcttcctgggcagccgctgtggcagcttcaggtccacggtcaccgggatggggaagcggcccgcgtagtcttcgatggccgcgatgagcccgtggtcggcgaggaccggcgggttcagcccgcggattagggcacgcaactcctggtgcacgctggagagttggttgtcggccttggtgagcagctcgtcctgcgcggacccctcctcgacgtccaggcgcatcatgcccagggtcatgccgagggacacgaggtgctgctgtgccccgtcgtgcaggtcacgctcgatgcgtacgcgctcggcgtcgaaggagtccaggaggcgcgactgcgaggcgcgcacctcgcgcagctcttcgcccagctcccggtcccgcggcgcgaggaacgtgcgggccatggccgcacgcgccccggcccacgaggtcaccgtgtagggcgaggagagcagcacgatcacgccgaacacggtccatggccaggtgtcgccggacgtcgcggcgatcaccgtggccggcaccccgaaggagaagccgagcacaaggaggtcgagccaccacagagccgcggccgacaccagcgtgaacgccagctcccgccaggtcgcctgctccttgagccgggtggtcacccagccgcgcaggcccggggagtccgggctgcggtgcgggtcggtcagccggtcgaggtccaccagatgcagccgccggcgctccaccgtggccaccaccgtggaggcgaggaccaggccgaccagtggggcgattccgatcagtacgacgagcagggcgagtcccgcggccaggccgagcgcgaagatgatgaccgccgcggcgccgaacaggatgccgccgctcagatacgccagcgaccgccagggccagctggaggtcagaaagctcaggggacgctgagccatggcctgccaggccgttgtgggttgcatgcgctcaacgtatcccggagacctcttcccgatctccggggcagcgtggccgccaggagccggagtgtggaagtagagctggctctacctcacgagtagagagcaggtcagtgtcccggccgcctcccgcacggtgaaatcgacgcatgacgacgagccacatcgcccccacacaggacgcggtcgaactccacggcctgcgcaaggtccacggcaccggcggacgccaggtcaccgccctggacggcgtctccctcagcttccgccgcggcaccttcacggcgatcatgggcccctccggtgccggcaagtcgaccctgctgcagtgcgcggccggtctggagcagccgaccgagggcaagatcatcctcgccggtgcggacatcgaccgtcagaacgagaagcaacgcaccgaactgcgccgcaagcacgtcggcttcgtgttccaggcgttcaacctggtcgagtccctgacggccgcgcagaacgtggagttgccgtcccggttcgccggccgcaaggtcagccgtgagcaggtcgggcaggcgctcgcctccgtcggcctcgccgagcgcgccggacaccggcccagtgagctctccggcggccagcagcagcgcgtcgccctcgcccgtgccctcgtcacccggcccgacgtcctcttcgcggacgagccgaccggcgccctggacaccgccacctcacgtgaggtgctgcggatgatgcggatgctggtcgaccaggagggccagaccaccttgatggtcacccacgacccggtggccgcggcccacgccgacgtcgtcgtcttcctcaaggacggccgcatcgccgaccgcatctcgctcgaccgccggaccggtgccgacaacgctgcggcgatcgccacccacatggcccggctggaggactgacagacatgctgatcctcgcgaacgtccgggaacgctggtccggtttcctcggcgccttcgtcgccgtcctggtcggcgttgccctgatcaccaccaccctggtcgtctacgactccgccaagcccagggtccagccgcgctacgaagccgccgccgccctcgccctgccgccgcgggccgtcgatgccgatggcagccccaaggaccggatgccctggagcacgtccgaggccgcgccgctgctccgcggcctggagaaggttccgggcatcgccgacgtggtgttggaccgctccttctacgcccaggcgatcacgaacggcaagccggtcaccgaccagggcgccctggagtccgggcacggtttcgccagcgcccacatggcgccgtacaagctggtctccggccggcccccggccgcggcggacgaggtcgtggtcgaccgcgccctcggcgcggccgtgggcagggagctgaccgtcaacatcaggcagggccgcaagccgttcaaggtcgtcggcaccgtggacggtcccggctactacttcagcgagcagttcgccacccagcagcagcccgggatctccaccatcgccctgatccccgacaagagcgccggcaccggtgcgatcgtcgccgcggcgaagaaggccgtcggcgcgcacggcagcgtcgtctccggtgacggacgggccgagctgcagcccgaatacatcgagcacaagcgcttcctcggcgtccaactgatcagcgccatggccatcctcggcctgttcaccacgatcttcgtcgtcgcctccatgctggtcctgtcgaccgggatgcgccgccgcgagatcggtctgctgcgcaccatcggcgcctcgcccaagcagatccgccgcatgatcctcggtgaggccgccgtcgtcggcctggccggctcgatcgtgggctgcggggccggtgtcgccgcgacgccactgctgctgtcgatcctcaagggcctggacgtcaccccgcccggcatgaagatcaccgtcgccgcctggccgctgctggtggcctccgtgatcggtatcggggtcagcgtgatcggcgcctggagcgcgggccgcaaggccgccaaggtcgccccgatcgaggcgctgctcgacagccgctcggccaacaagggcatggggcgcgggcgttggatcgccggactgtccgtgctcggcctgggcgccctgctcgccatcggcacggccacctccaccgccgacaaccgcatcaacatggcgatcttcgccaccatgacgctgatcgtcgcggcggccctgctggctcccgtgatcgtcgggcccgtcggccggatcctgaccgcccccttccagcgcggcggcaaggccacccccgtcctggtccgggccgaactggtcgccaacccccgccgcgccgcctccctggtggccccggtgatcgccgcagtcggcttcgcggtgctgctcagcggcatggtcgagacgatgcgggtcgcctacccggccggcgaggcactgaaggtcgcgggccagacgatcgtcacgccggacggcaccccgggcaacaccgacgaggtcgtcgccgccaacccggtcggcaaggccgccctgccgacccgcgcattcgtcgagaccaggaagacgcaggccggcgataaccccggtacggccaccgtcctggacgtcctgggcagccgggacccgaagtggaacaagcccgggcaggccgtcctcggcaagaagacggccggcgagctgggcctgaggcagggccaggaggtcccggtgcggttcgcggacggcgccaccgtcacgctcaccgtcgcccacgtgctgcccgacgaccccgcccgcggcgacttcgtggtcgcccgtgacctggtccgcgcccacgccccggccacgctcaccgacgacatcttcgtcccggccggcgccaaggcatcggccgcggtccccggggtggcgctgcacgacgccgccgcgtacgccctggccgactacaacaccgacgccaaactcaccgactccctcgccatgatgctgatcgtcatcgccgtcggctacagcgtgatcgccgtcgccaactcgatggccatggcggcccatggtcggcgccgcgacttcggggtgatgaagtcggccggcggcaccgcccgccagctcctgttcacctctgccggcgagaccaccctggtcgtcgtcatcggcgccgccctcggggttctggtcacactgcccccgctggccgggatggcggccggcctgtccgaggccacctcctcggacgtgagcctgcacctgaactacggcaccctcgtcatggccgtcatcggcaccctggcagcggcggtgctcgcggggatcgtggtcacctcgaagacgctcaagcggcagacagcatgagaaggcatccgcttaccgatcaacgggcttgtctggtcgaacaagggtattgatcggatgatcgcggtggggtcggcgcacgaaggggcgctcggattcgtcagtacgtgagcgtcctcagctacgcatggttgctgcagttgtacacagcggatttcttttctcggcagacctgcaccaggacggtcctcttgttatggaaggtgacctttataggtcgggcagtgccctcaccgcatacgcggggctgatagtagctgagaccgtcctcccagacgtacagggttgcacagtagccgtccgctttccggtcctccacgtagccggtcaccttgccgttgtacttgccgtggccatcaccggaccatgtgatctggacgctggcgaacgccccgtgatgggagtccttcgactgcactttcacgtttcgatacgactgggccgtgacgtcgcccgctgcagatgccgggccagcagcgacaaccgtgcctgccagcagggcggcagtcccacccagcccgagaagtgtgcgtgtattcatggattccccctgaagcctcttccaatggtcgtagcggccctagaggcgaggcggtcagagcgaatcaaccccagggttgaactccgagtaccgcacaggttgaccccggagcaatgtcctcggtgtcctgccgtcctgcccaccaccttcgccggctaccccgtcacacccggcaccaccgtcctggtctgcccctacaccgcccaccgcgacgcccttgagcaccctcggccccaggaattcaagcccgaacgctggctcgacgacaccggctccctggtggccaccggcgtcttcctgcccttcagcacaccggaccgcgcggctgtgagggaaccgccatggcactggccgaactcaccctcatcaccgcggaaacagcacgccgccaccacctgcacgaacccgatccaggaccagccaccagatcaccaccaacggagcactcacccccgccggactgcgcctgcgcaccaccccccgcacccaaagcgccgcac

SEQ ID NO: 747 - DNA, 4272 bp, Unknown
  Kingdom: Bacteria, Phylum: Actinobacteria, Class: Actinobacteria, Order: Streptomycetales, Family: Streptomycetaceae, Genus: Streptomyces
tgggcgccctgcagcagcgccttggtctcgatgaccgcgctgcggggcgcggcgaggaccgccgaggccaggtcaccggcggcggcgtccagctggtcgcggggcacggcgaggttggccagccccgaggcgaccgcctcctcggcggagacgaagcgtcccgtcacgcagatctccagcgcgcgggcgtagccgaccaggcccaccagcggatgtgtgccggtgaggtcgggcaccaggccgaggctggtctcgcgcatggcgaactgcacgtcgtccgcgaccacgcgcaggtcacaggcgagcgccagctggaagccggcgccgatggcgtggccctggaccacggccacggacacgacgtcgctgcgccgccaccaggtgaacgcctcctggtactcggcgatggccgcgtccagttcggcgtcgccgccgcgtgccaggtcgaggaaggacggctcgccgtcgaagccctcgggcgtgaacgcctgccggtcgagcccggcggagaaggacttcccctctgcgcgcagcagcacgacgcggacggagcccggcagcagccggccggcctcggcgagcgcgcgccacagggcggggctctgcgcgttgcgcttggccgggttggtcagcgtcaccgtggcgaccgcgtcgtccacggagagccgtacgccgtccttgtcgagaactgtgtcgagtactggtgtgtcgcgcactgacgtgtcgcgtaccggttcgaggtcgtgctctttgtcgggcgaagccatggggcgcctccggtgggtgcggtcagcatggacgccgtgctgtcgtactgccgtacgacggcgcacggaatccgtaagtgactgcacagtaaccacccggccggccggtcgaccgaccgggtggccaccgtcgaagccgatggaccgcccgcggtcggtcaggcggacgtggtcttcttgccccgcgtcgccccgccacgcccacggagcgtgacgcccgactcgctgagcatccggtgcacgaagccatacgagcggccggtttcctcggccaacgcccgaatgctcgcaccggcgtcgtacttcttcttcaggtctgccgcgagcttgtcgcgcgcggcgccggtcacccggctgcccttcttcagagtctcggccacccgtgcctcctcatgggaagtgcgctctggtcccctcatgatcacccctccggggcctcatggccacccattcggcaaggtccgtgagacaggcttgtgacgacaggagtgcgtccccacatgcggaatctcagattccgcgcaccaccgtccgtaccgccgaacgggttgttccgcgaagtggcaggtcagagacgcacgacggccgagcccttggcatataagggctcggccggaaaatccggggaggacacaccccgatacgaggagatctcacgcagatgacggatcgccgatgggccgaatgatccatacgccgttgatcagccgcccggccagggctcgaaccgtggcccgaaccgtggccggaagccaggcggcccgcggggtcaggcgagggcgacgaggtccgcgtagcccgcgccccacaggtcctcgacgccgtcgggcagcaggatgatgcgctccggctgcagcgcctcgaccgcgccctcgtcgtgggtgacgaggacgacggcgcccttgtaggtgcgcagcgcgccgaggatctcctcgcggctggccgggtcgaggttgttggtgggctcgtcgagcagcaggacgttggcggaggacacgaccagggtggccagtgccaggcgggtcttctcgccgccggagaggaccccggccggcttgtcgacgtcgtcgccggagaacaggaaggaaccgagcaccttgcggacctcgacgaggtccatgtcgggcgcggccgaacgcatgttctccaggacggtgcgctccgggtccagcgtctcgtgctcctgcgcgtagtagccgagcttgaggccgtgaccggggacgacctgaccggtgtcgggcttctcgaccccgccgagcaggcgcagcagggtggtcttgcccgcgccgttgaggccgaggatgacgacccgggagcccttgtcgatggccaggtcgacgtcggtgaagatctccagggagccgtacgacttcgacaggccctcggccatcagcggggtcttgccgcacggcgagggctcggggaagcgcagcttggcgaccttgtcggactggcggaccgcctccaggccggacagcagcttgtccgcgcggcgggccatgttctgcgcggcgacggtcttggtggccttggcgcgcatcttgtcggcctgcgagtgcagggcggcggccttcttctccgcgttggcacgctcgcgcttgcggcgcttctcgtcggcctcgcgctgctgctggtagagcttccagcccatgttgtagatgtcgatctgggagcggttggcgtccaggtagaacaccttgttgacgaccgtctcgaccaggtcgacgtcgtgggagatcacgatgaagccgccgcggtaggtcttcaggtagtcgcgcagccaggtgatcgagtccgcgtcgaggtggttggtcggctcgtcgaggagcagcgtgtccgcgtcggagaacaggatgcgggccagctcgatgcggcggcgctgaccgccggagagggtgtgcaggggctggccgagcacgcggtcgggcaggttgagcgcggcggcgatggtggcggcctcggcctcggcggcgtacccgcccttggtgaggaactccgtctcctggcgctcgtactgcttcatcgccttgtcgcgggtcgcgcccttgccgttggcgatgcgctgctcgttgtcgcgcatcttgcggatcagcacgtccaggccgcgggcggagaggatgcggtcgcgggcgagcacgtcgaggtcgccggtgcgggggtcctgcgggaggtagccgacctcaccggaacgggtgatggtgcccccggaggggatgccctcgcccgcgaggcacttggtgagggtggtcttgccggcgccgttgcggccgacgaggccgatgcggtcgcccttggcgacgcggaaggtggcgttctcgatgaggatgcgggcaccggcgcgcagctcgatgccggaggcggagatcacggtcagactccagggcaggtcggtggcaggttgggcggctgaggacgttcccgccgtctaatgcgcgaggagaatggccatgggggacagtctaacggggctgtgcaagcggttttcccaggtgtttgcgaggggggcgcgcggcggacgcgcggggcgttgtcagtggccggtgccagactggtcggcgcaccggatttcccgggcgcgcaccgagtcacgaggaagtgatcggcatggcggacacggcgggcggacgcccgagcatctacccgacgctgctgtacgcggacgcgaaggcggccatcgagcagctcaccgaggccttcggattcaccgagctgtcggtgtacgagggtgaggacggcctcgtacagcacgccgagctggtgcagggcaacggcgcggtgatgctcggctccaaagggcacggcggccggttcgacgaggcgatgcgcgacgccggcccggtcggggtctacgtcgtggtggacgacgtggacggccaccaccagcgggcggtggatcacggcgcggagatcctgatgcccccgacggaccaggactacggctcccgggactacatggcccgggatgccgagggcaacatctggagcttcggcacgtacgcgccgcgcacggagggctgaactctccgctgcgcgggcgccccctgtgccgccagccgctagctgccgcccgtgtgcacctggaaggcggctctgcggacggccttggccagggcggggtcggggtgtgcggcggcgagggcgaccagcacctgcaccgtgcgggggtgaccgacggcccgcacctcgtcgagcagggcggggacggtgggctgcagcgccgactccaggtgccgtacgagcatcggcgactcgccgtggtcggcgacggcggcggcggtgtccacccacagccacgtggcctcctcacgggtgaggacctcgtgggcgtcctcggggtcgacaccgtcgtgctcggccagccacagcagggcgtacgggcgcagcgcgggctcgtcgagcacagcccgcacctcgggttcggcgggggcgccgaccacgcgcagcgcctcgaaggcgaggccgcgcagcagggcgtcctcaccgcgggccgcgcccagcagctcgg

SEQ ID NO: 748 - DNA, 4604 bp, Unknown
  Kingdom: Bacteria, Phylum: Actinobacteria, Class: Actinobacteria, Order: Streptomycetales, Family: Streptomycetaceae, Genus: Streptomyces
gagcctgcgcgccttcgtcgtgccggcctcgagctacttcgacaagtggggcccgagcaacatcccggccgcgccgggcgccccgggcagcccgagcgcgtccaccaccggcaagccggggacgtcgaagtcgccgaaggcgccgaagacctcgcagagcccggaggctccgggcagcggtacggcgacgggttcggcctcgaccggcgagtcgggcaccggcgccggcgccggcgacgccgtgaaccggggaggctcggcttcgtaaccgctcgccggccgccgttaccgctacggcacggcacggcacacgacgaagggcggcacccccgtcgcagggggtgccgcccttcgtcgtagctccacggaccgcgacctacggaccgcgacctacggaccgcgacgtacggaccgcgacgtacggaccgcgacgtacggaccgcgacgtacggcctgcggccttcggcctacggctcgaacttgtagccgagcccgcggaccgtcacgagatagcgcggggcgcccgggtccggctcgatcttggcgcgcagccgcttgacgtgcacgtcgagcgtcttggtgtcgcccacgtagtcggcgccccagacccggtcgatgagctgcatccgggtcagcacccggccggcgttgcgcagcagcatctccagcaggtcgaactccttgagcggcaggtcgaccttggagccggacacggtgacgacgtgccggtccacgtccatgcggaccgggccggcctccagcgccgccggggtgacctcctccggctcgccgcgccggcgcagcaccgcgcggatccgggcgaccagctcgcgggaggagaagggcttggtgacgtagtcgtcggcccctatctccaggccgacgaccttgtcgatctcgctgtccttggcggtcaccatgatcaccgggacgttggagcggccccgcagctggcggcacacctccgtaccgggcagccccggcagcatcaggtcgaggaggacgaggtcggcgccgttgcgctcgaactcgtcgagtccgtcgggcccggtggccgcgatggcgacctcgaagccctccttgcggagcatgtacgacagggcgtcggagaaggactcctcgtcctcgacgacgagcactcgggtcacggaaggacctccggggcggtaaacggttcgtacggtgacgactgcgatgacgaatgcgatgacgactgcgatgtcggcgatgacatcggtgatgacggcgatgacgcggtgctgtgctgcccggccccggcctcctcgtcgagggcggggtgctccagggcgcggtcccggtcgcgggcctcgcgggcctcgcgggccgctgccgcctccggcagccgcagcgtgaaggtggagccctgtccctcggcgctccacaccgtgacctccccgccgtgcgaggcgaccacgtgcttcacgatcgcgagacccaggccggttccgccggtggcacgtgagcgggccgggtccacgcggtagaagcgctcgaagatgcgctccttgtccttgtcggagatgccgatgccctggtcggtgacggctatctcgatgaggtccccgcccggcacggtgatcctgcgggcggcgatgccgacgcgggtgcgggccggggagtagttgacggcgttctcgacgaggttgccgagggcggcggcgagctggccgcggttgccccagacccgcaggtcggcggctccgccggtggccatggtgatctgcttggtgcccgcctggtggcggcagcggtcgatggcctcggcgacgagttcgtcgacgcgcaccggctcggcgtcctccagcgggtcgtcgttctgcactcgggagaggtcgatcagctcctgcaccaggttggtcagccgggtcgcctcgatctgcatgcgtccggcgaagcgctgcacggcctccggatcgtccgaggcgtccatgacggcctcggagaggagggagagcgcgccgacgggcgtcttcagctcgtggctcacattggcgacgaagtcgcgtcgtacggcctcgatccggcgggcctcggtcaggtcctcgacgagcagcagcaccagacgcgatcccagcggcgccacgcgggcggagaccgcgagggcctcgccgcgcccggtgccgcgccgcggcaggtccagctcgacctgccgtatctccccgtcccgccgggtgtcgcgggccatctggagcatggcctccacggcgagcgtcccgccgcggaccagtccgagcgcgtacgcggcggagctggccttgacgacggcgtcggcctcgtcgaggacgacggcggaggagcgcagcacggacagcaccgtgtccacgccgggcggcagcaccgcgtcggtgtgcagcgaggtgcgcgtcggacgcttctgctcccgttcgctgaagcggaacgccagcatggcgatgacgccggtgagcactccggcgatcgctgccgctgcggcgaccgccgcgttcacgtccatgcgaccaggttaggcacggcgtacgacctgcccgcacccgtccgggtgcgacctcgaacactcgtcgcccagagttcaccttggagccagcgacggttcacttgaggtgacggaaacggacgcgtacgggccggaacgtgggagcgtggggatcgcaccccctgactggcaccctgcccggccccctggccggcacgaacgaagacgtacgagagggaaccgacgatgcgggacgcgtaccacgaggaactggactcgatcggcgacggactggtggagatggcccggctggtcgggtcggccatcggacgcgccacgaccgccatcctcgacgccgacctgaagctggccgagagcgtgatcgaggccgaccagaaggtcgacgaactccagcacgacctggaggcccgggccatagccctgctggcccggcagcagccggtggcgacggacctgcggatcgtcgtcacgtcgctgcggatgtccgcggacctggagcgctccggcgacctggcccagcacgtggccaagctggcccggctgcgcttcccggcgcgggcggtcccccaggacctgcacgccaccatcctggagatggggcagctcgcccagcgtctgatggcgaaggccgccgaggtgatcgtcaccaaggacgtcgacctggccctccagctggagcaggacgacgacgagatggacctgctgcaccgcaccctcttccagcacctgatcgacgaccgctggaagcacggcatcgagacggccgtggacgtcaccctgctcggccgctactacgagcgctacgccgaccacgcggtggcggtggccaagcgcgtcgtctacctggtcacgggcgagcacgccgacgagttgcagcaggacatccagtcggtgccgaaggtcgacggagcctgagcaaaggggcgtgcggcgggcgctggaaggtgagcgagccactgtgcgccgttgatgcgcccggcggaacgggcatggaatgggcgaaggcaccagcctcgaggagggacccatggccgaatcccccagcaccgcgcccgacccgacccagaaccgcgagaccgagcagcccgccgagccccgcagcctcccgctcctcgccgcctgcggctgcggctcgggctgcggctgcggctgccagtccggcggcccctgccagtgcggctgaccgagcggctgttacccacttcggagtgacggccggcacacgggccggaccttcctgctggcagaccgtcagaaggaggcccggcccacgtgtgtgcgcactacacccgagcgtcacggaaacatggccaatcggtaacacagtgcgtggagcacgcacatatccacacggaacggacaaagtgtgaggcgcgcggccaaccggccgccatcgcatgcgcgcatcgcgcaccgcaccagcagggagagcctgtgtccgtgcccgtttccgtctcctggaccgcccgccgtctcgctacggccgccgccgcggccggggcggagcgcgtgagtggctgagtgtggcgcatgggacagtcctccggcggcacggtcggcgggccaccccatgtgccgccggagatagggagtcgcccgtgctgcctcctcaggggcagccaacgccccccgggcgccggccgcacccgcggcgcgcccactcgggtgagcgtcgcggccgggcaggccgccggtggaggcagcccgtcgtcggcccgggccccggtgggaagggcgtgtcgccgttccgcgccccggccgccgcgacgacacgcccgggaacgcggtgaacgcggccgggagggggagcaggctcgggaacgcctcgcacgaggtccgcctccccgtcaactgcggcgcgcgaggcccgaacaccgcttcggtcgagacgcgcaccactgggccgtgtggacgtgagcccatcaaaagggccgagccgtgcgagccactgggccgggcggggcgagccgcacacgcggttgcgtatgctgaaccacatcccagccgaactccctggacccagcaggggagttcgcgccgtggcgcggaccgctgtcgtcgctgatcccgcgccggcgccggcggccggggcggccgaggccctccggcc

SEQ ID NO: 749 - DNA, 1178 bp, Unknown
  Kingdom: Bacteria, Phylum: Actinobacteria, Class: Actinobacteria, Order: Streptomycetales, Family: Streptomycetaceae, Genus: Streptomyces
gtccacctcgctggtcgagaccggcgtggtggacggcgaccgctacctcgcggccgtccgggcgctggccggggcgcacggcgccacccgctacttcgcgcaccgccgcgagagcacggagaaactgcaccggctggcggtggagaccggcctggaggtggtccgtcccgaactgcccctggagctgatagccaggcgcggccccatcggccgtacggtcctcagcttcccctccaccgtcgtgcacacgctgccgctcgccctggccggcacggacgtccgcgtcgccgtctgcgacatcgacccgagctggctgacggcgacggcctcgccgcgcgccgaggggttcctgtccggcgtgacgggcacggcccgcgacgtgcagcgggtcctgggggcggccctgcccgactgaccacgtccagcaggcgaacatttcgggcgggatccggacggtacgtggtatgtctggaggaaagaacaaaagacgtgcacccgaccggtcaagacgggcgagtgtacccatcccagtcgacacctatgcgccgacggccggtcattctttcccctgacgggctgaacttttgttgatcgaggggcagttgaccgtcccggcgtcatacccttcagagggtgaaccagctgatgtccccagaatccgaggccgaccatcccgcggagaccgcccttcccggcaccctgccggaggcactgttcgccgagctcgtcgccttccgccgcgacctgcacatgcacccggagctaggcaaccaggagttccgcaccaccgccgcgatcaaggcgcggctcgagaaggcgggcctgaggccccgcgtgctgccctccggcaccgggctcgtctgcgacatcggcagggagcccggcgacgacacgggcatcggtgaggacgccggggacggcgacggcgcccgcgacatgctcgcgctgcgcgccgacatcgacgcgctgccgatcccggacaccaagagcgagtcgccctaccgttcgacggtgcccgaccgcgcccacgcctgcggccacgacgtgcacaccacggtcgtgctcggtgccggtctcgtcctcgccgggctgcaccgcgaggggctgctgacccggcccgtgcggctggtcttccagcccgccgaggaggtgctgcccggcggcgccgccgaggcgat

SEQ ID NO: 750 - DNA, 4306 bp, Unknown
  Kingdom: Bacteria, Phylum: Actinobacteria, Class: Actinobacteria, Order: Streptomycetales, Family: Streptomycetaceae, Genus: Streptomyces
ccccgggtcgtctgacccaacgggtctacccccgctcgtccgcccagccgaggccggccccgggccgtccggcccggtcgggactgccccgggcggccccgcgtggccggcccgcgggcgggccggagcggtgccgccgggccgggccggcggcacgcccgtacccccgcgtggccggagggctggacgcgcccgatagccttcggccatgacctcgctgcaatccgctgtgcgacgccgccgcgccgtcgccgccgccggcgccgtttccgccggactgcttcttctgacggcctgcaacaagccgacgccgatggccaccgtcaccgtcggtgacaactcggtgcactcggaggccacctgctacaacgacggcaaggcgatcaagaccgccgacctgccgaagtgcctgaagtcggacaagacgatcaaggtcgaccccgacgagaccgtccggctcggcgtcgacccggacatcgcagacaagggctgggccatcctgatgaacggtcagccgctgaccgacaccagcaagaagacgtacaccaccatcccgggcagcgtgttcttcaacccccagtacggcgccagcgggaactccacctgggtcgccatcaaggagggcggcgacaaggacgtgaccggcgtgtggtccttcaagctgcagaaggactcctgacacgtcctccgtacgcgtactcgtcgccaccgcggtcccggccgaacgggacgcggtggcacgggcgttgacgcaaccggtgcgtgagctgccgctgcccggtgcgacggccgtgcaccgcttcggcgggtacgacctgatcgccgccggggtcggcccggccctcgccgccgcttccaccgcgaccgctctgacggccgccacgctcggcaacgccccctacgacctcgtcgtctccgcgggcatcgcgggcggcttcgcaccggccgcggacgccgtgcaccacccggagacacccaccggtgcgcccgtcggctcgctcgtcgtcgccgacgagatcaccgccgccgacctgggcgccgagaccggtgacgggttcctgccggtgaccgacctcggcttcggcaccgtcacccaccatcctcccgaatcactcgtacgggcagccgccgccgcgaccggcgcggccacgggcacggtgctgaccgtctcgacggtgaccggcaccaccgcccgcgccgacgccctgcgcacccgccacccccgcgctctcgccgaggccatggagggattcggcgtcgccgaggcggccggcgcgcacggagtccccgtactggagctgcgcgcggtctccaacccggtcgggccgcgcgaccgcgccgcctggcgcatcggcgacgcgctcgcggccctgaccgagggcttcgggaagctcgtccccgtactggagagttggaaggcacatgagcccgcagattcctgagcagttgcagatcgcctactcgccctgccccaacgacaccttcgtcttcgacgccctcgcccacggccgcgtcccggacgcgcccgccctcgacgtcaccttcgccgacatcgacgtcaccaacggcatggccgaacgcggcgagctggacgtgctgaaggtgtcgtacgcggtactgccgtacgtgctcggcgagtacgcgctgctgccgtgcggcggcgcgctgggccggggctgcgggccgctggtgctgaccagggagccggacgccgacctgaagggccgcacggtcgcggtgccgagcgagaagtcgacggcgtacctgctgttccggctgtgggcggcggacacggtgcccggcggggtcggcgagatcgtcgtgatgccgttccacgagatcatgccggccgtacgggacggcaaggtcgacgccggtctggtgatccacgaggcccgcttcacgtaccagaactacggtctgcacaagctcgccgacatgggcgcgcactgggaggacaccaccgggctgcccatcccgctcggcgcgatcatcgcgaagcggtcgctgggcgcggacacgctgaaccggctggccgagtcgatccgcgcctccgtgcgcgccgcctgggacgaccccgaggcgtcacggccgtacgtcatggagcacgcccaggagatggacccggccgtcgccgaccagcacatcgggctgtacgtcaacgagttcaccgccgacctgggcgaggacggctacgcggcgatccgcgggctgctcacccgtgcggcggccgagggactcgtaccgccgctcggcccggacgcgctggccttcccctgatccggcccagccgcgccggtctcgccctgatccagggcgacctgcgcctggaccagggcaccccgggccgccgcgcccgccgtggtcagacgtccagctgatcggcgaccgcgcgcagcagcccggcgaccttcttgccggaggccttctcgggatagcggccgcgctccagggtctggccgacgctctccaggagcgtcgtcagatcctggacgatcgagagcagctcgtccggcttcttgcgctgtgccgccgcgaccgagggcgccggttccagaagcgtcaccgtcagtgcctggtcgccgcgctgacccgcgacgacgccgaactccacgcgctgtcccggcttgagcgtgtcgactccggcgggaaggaccgaggaatggacgaagacgtcaccgccgtcgtcgcgggagaggaagccgaagcccttctcgctgttgaaccacttgaccttgccagtcggcaaagcacacactccctcgatcggtcccggacgccgtcggactgctggcgaaccaccttaccggggctctccccaacccatcacgcccttaaccacgccctgtaacgggacacggcgcccgcatgtcccgggtggcgcgaaagcggcgcacggcggcgacttccgcgctcacgggcgcggggaactaccctggcctggtgcgtgacaagacccaagcgaattccgccgccggtgaccggctgatccgtgccggtgccatcgtgttcttcatcggcgcgctggccaccatggtgacggtggcgcccctgttcttcggaacgaggccttttccgacctatatgttcggactgagcatgctcatggccgtcggcttcctgatcgccgccggcggagtgttccagtcgatcgcggcgggccgccgtcaggctcgcggcgacgcggggtaggcggggcggagggaaggggcggagccgccgggcgcgttctcggccgaaaaacgtgtgccgggcctctcgccgtgctctgaccgctccgggtacgtcgagtactccgtgagccagtgcgggaacgcggtcaggtcggtcaggaccacgtccgcgccggccgtccgcagttcctccgcgtcgcacggcccggtggccaccgccaccgacagggctccggccgcgcgggctccgcgcacgtcgcccacgtggtcgccgacgtacaccccggcgccgtactcgcacagcgcctgcgccttctgctccgcccacaggccgccgatcaccgcgtccggttcgatgcccaggtgctccaggtgcagcttggcgttcggctcgtgcttggcggtcacgacgatcgcccgtccgccggcccgccgtacggccgcgaccgcctcccgcgcgccgggcatcgcgagcgtgggcgtgatggccgtcgccgggtagatctcccggtacaggtccgccacggccgccacctgctcggccgggaaccagttggccagctcgtcctccagaggcggcccgagccgcgtgaccaccagaccggcgtcgacgggcgtcccggtccgctcggacagctccacgtagcaggcgtggatgccggggcgcgagtcgatgagggtcatgtcgagatcgaacccgacggtcagcgggcgcggggtggtgtgggccatgggggccattgtgcccaggcggccggacgggcggacgcccggaccccggaccccgacgagacgtcgagaccccggagccgcggggcggcggctaccggcggcgctgggagcgccagagcaggaacagggccgacaggacggccgccgctcggagcacccacggccaggtctgggcgaccgcgtcgttcatctggccctgggcgatgggagcgccccagcggccgtcctggcggccccacagccagagcagtcccgcggccagggccaccccgggcatacccatgacggcccacttggactccgccggggtcagccgccgggagccgtacgcgatgaaccagccgaacagcagcgcgaacaggttgccggtcaccgcgccgccgcgctgctggtgggcggcg

SEQ ID NO: 751 - DNA, 4711 bp, Unknown
  Kingdom: Bacteria, Phylum: Actinobacteria, Class: Actinobacteria, Order: Streptomycetales, Family: Streptomycetaceae, Genus: Streptomyces
cgcccgcctcgcggaccgacgtcccacccgcctcgcgggccatccgcaccgccgccaccagcgccttgaagacgttgacgctcgtcgagtcgcccaccacgacctgcccgggcgccgcgccgaccagcggcgcgatccggtcgccgatccgctcgggcgcggtccaccagccgctctcgtcccaggagcggatgcgcagctcaccccactggcggcgtacgacgtccgcgacccggtccggaacgtgcgccgggagcgcgcccagcgagttcccgtcgaggtagaccacctcgtccaggacgaaccggtcgcgcagcgcgcccagctcgtccgcggcgtccagcgcctctgccctgctcaggagttcagacatgcgaccgcgccgtccacagctcggggaacacgttcttctgcgcccgcttctccagccaggccacaccggcggagccgcccgtgccggacttggcgcccatcgcgcgccgggtggcgaccagatggtcgttgcgccatcgccacaccagttcggccacgtccgtcagtgcctcgccgagccgggcgagttcgtcctccgggtcgccctcgtagagcgccgtccagacggcctccacctcctgggagggctcgtggcgcagcgccacgtcgcgctgcaggacggcctccgggacggcgtgcccgcgccgggccaggagccgcagtacctcgtcgtagaggctcggctcgtgcagcgccttctccagttcggcgtggacgcggggcgcgccgcggtgcgggacgagcatcgacgcggacttctcgccgagcaggaactccatgcggcggtacatcgccgactggaaaccggagccctcgccgagggcgccccggtagctgttgaactgggcgggcgtgagctgcccgagcggcttccaggaggcgttcagcgcctccagttcccgtacggaccgcttgagcgcggcccgcgcggccgggacgtcgtccgcgcgcagcgcacgggccgcggtctcccactcgtggacgatgacggtgaaccacagctccatgacctgggtggtgaccaggaagaccatctctccgggatcgtcggagagggtgtgctggaggtgggtgagcacgtccgccttgacgtagtcctcgtacggcgtcgtgccttcgaagtcgagatgcggggtctcgggctcagctgcctcggcgggcctgggcgtctgttgagcctggtgggacatcgctgtctcctgcatgtactccgggtagcggtccgcccctgccgatgccggcacgggggccccggtccccaccggcatcctgcgcagcatcggcgcagatcgcaagggcggcccgggtgccggcccgccgccgggtggcagactgcttccatgaccacgcacaagaacctgctgggcggcccggagccgacctacctccccgagaacgaggaggcgtaccgcctgctgggcgaggagtcgcagtcgccggccgaggtcgccgcgaaggacccgacgttctcgctggcctgggcgatgctcgccgacgacgcgttcgaggaggggcgggtggtcgagtcgtacgcgtacgcgcgcaccggctaccaccgcggcctggaccagctccgccgggccggctggaagggccacggccccatcccctgggaccaccgggccaaccgcggtttcctgcgctgcctggccgccctcgcccgcgccgccgacgagatccaggagaaggacgaggcggcgcggtgctggcagttcctgcaggacagcagcgcggaggcgtacgccgagctgaagcgctgacgaacgccggcagactcagacacagacacacagcgagcccgtcgcccgaaggcgcgggctcgctggtgcgtcagcgtcgcggaacgcggtacgcgcagtacctggaacgcgggcgggttacttgatcttggtgcccgtcgagcgcaggttgccgcaggcctccaccacgcgcgtggccatgccggcctcggccagcttgccccaggtgcgcgggtcgtaggtcttcttggagccgacctcgccgtcgaccttgaggacgccgtcgtagttcttgaacatgtggtcggcgaccggacgcgtgaaggcgtactgcgtgtcggtgtcgatgttcatcttgaccacgccgttctccagggcggtgcggatctcctcctccgaggagccggagccgccgtggaagacgaagtcgaacggctggctgccggccgggcggccgtacttcgccgcgacgccttcgttgaggtccttcagcaggtcggggcggaggacgacgttgcccggcttgtacacgccgtgcacgttgccgaaggaggcggccagcaggtagcggcccttgtcgcccaggccgagggcctcggcggtgcggatcgcgtcctcgaccgtcgtgtacagcgagtcgttgatctcgtgggagacgccgtcctcctcgccgccggtcggggtgatctcgacctcgaggatgatcttggcggcgcgggcctgctccagcagctcctgcgcgatctggaggttgtcggcgagggtctccgcggagccgtcccacatgtgggactggaacagcgggttcaggccggcctcgacacgcttcttggagagcgcgagcagcggacgtacgtacccgtcgagcttgtccttcgggcagtggtcggtgtgcagcgcgatgttgaccgggtacttctcggcgatgatgtgcgcgtactcggccagggccacggcaccggtgaccatgtccttgctgtactggccgccgaggaactcggcaccacccgtggagatctggacgatgccgtcgctctccgcctcggcgaagccgcgcagcgccgcgttcagggtctgtgaggacgtcacgttgatggccgggtaggcgaacttgcctgccttcgcccggtcgagcatctcgttgtagacctcgggggttgcgatgggcatctgtccgctccttgtatgtgcggggtgcgttctgcgtacttacggccctgacctagggagtgacgtcatcgtcggccccatcttcgcagacggagccggatgcttcggtcaccctgtccagcctgtggataaccggattcgtccacctgtggacgaccgggcgcgtccccccgtgggcgtccggtccgcgcggcccgcaccccgcccgtggcgcggctgcggacgcggctcagtccaggccgaggtcgtccttcgagtacgcgaacacgtacggcacgcccgcccgctcggcgatggcctcggccgcgcccgtggcccggtcgacgatcgtggcgaccgcgacgacctccgcgccggcctcgcgcagcgcctccacggcggtcagcaccgagccgccggtggtggaggtgtcctcgacggcgagcacgcggcggcccgccacctcggtgccctcgatacggcgctgcagaccgtgcgccttgcccgccttgcgcacgacgaacgcgtcgagcgtcttcccgcgcgcggcggaggcgtgcagcatcgcggtggccaccgggtcggcgcccagggtgaggccgccgaccgcctcgtagtccagtccgtcggtcaggtcgagcatgacctggccgaccagcggggccgcctcgccgtcgagggtgatgcggcggaggtcgacgtagtagtcggcttccttacccgacgacagggtcaccttgccgtgcaccacggccttgtccttgatctgctgcagcagctcgccacgtacgtcgctcatggcagtcagcttaagcgcggcgccaggcccaggtggtggtggcctccagcggttccagcggggtgaccaggcgcgggtgcgtgttgagtccgtcgggcgggccggtctgcggttccacgcacaccgcggcctcctgctcgtcgtagacgacgacccacttctcggggctggtcaccttcagctccagctgtccgggccaggtgagggtgacgtcgacgccgtccggcatgccgaagcagtcgtcccaggggcccggccgcgggtcgatgcggcggccggtgggcaggtggtcgtcgccgcgctcctcctgccaggcgggctcgaacgcgagccgcacgtcctgcccgccgaggttgcggtggaaccaggggtgccagccgatctgcgccgggaaggaggagtcgtacgtctccacggacatcgacagcgtcagggcgtcctcggtcagtgcgaccacctgggtgacccggccggggtagggccaggggtcgacgaggtcgtacgtcagcaccgcctcgtccgccgaggtgcgggccgtgcgccaggcgccgtcgcgggcggtgccgtggatggcgtgcggcggggagttgagcggcatctggtggacggtggcgccgtcgtggaacctgccctcgcggatccggccgcaccagggaaccatcgggaaacagccgaaccggtcgccctggcggagcagttcgagtccgcccaccctgagtccgccgatgcggccgccgtggcccggccgtacggtcgcttccgcgtcgcccgcggtcagcgtgatgtcttcgtcgctcacggaacgaggctactgggccgatcaagggcgcgcgcggttcccgggccgtgctccaacccgggccgacctgctgtcgtggcggcgcgggccgggtcagcggcggcgtctgagagcccggccgacgacgatcgccgaggccacgaccagtgcggcggcggggaccgcccagcgcagggtggggcccgcggagac

SEQ ID NO: 752 - DNA, 2097 bp, Unknown
  Kingdom: Bacteria, Phylum: Actinobacteria, Class: Actinobacteria, Order: Streptomycetales, Family: Streptomycetaceae, Genus: Streptomyces
gccgggccggtgccttgccggtaccgacgccggtgccggtgccgcgctgaccggcgaccctcaggtcctcgatctgccgcagcgaggtgtagccgccgccgacctggacggtccggttggcgccgccctcgtcgaaggatccggccgggacggtggccccgccggcctgcagtgcctgggccaggtcggcggtggtgaggccggccttcgcgagcttcgcgtcgtcgggggtcacggtgacctggaggtcccgtacgccgtcgacggtgacctggctgacgccgtcgatgttcttcagcgtcggtacgaccgtcttgtcgagctggtcggcgagcgcctgctggtccttgccggaggtcacggcgaggaccacggtgggtatgtcgtcggtggaaccggcgacgacctgcgggtcgacgtcgttcgggagcagcgccttggcgcggttgacggcctgctggacgttggcgaccagctgctgcgtgtcgttgccgtactcgaaggacgccgtgatcacggcgctgccctcactcgcggtggcggtcacgccggtgatgccgtcgacggccttgaggttgttctccagcggttcgacgacctgcttctccaccacgtccggggaggcgccctggtagggcgcgagcacggacaccacgggaagctcgatgctgggcagcagctgctgtttgagctgggggatcgcgatggccccgaagacgagcgcgacgatcgagatcagtccgatcagggcccgttgcgcgaggctgaatctggacagccaggacatgggtcagggtctctcttccgtgagcgtctgtgacgtctgtgagcgccggagtggcaggccgaaagcggcaggggtagcagcagggaggtacgggaggacggcgggagaagcggcgcgggcgcgcagcggcgcccactccctacaccttcgggcacgggcgcccggtgatccgtaggcccctggtccatttccgtgcggcgcgtctactccggccgcagtacgcccgggtagagggcgctccacccctggatgtaccggggtgcggcgggctcagtccaccctggggcggaccagaccggactcgtaggcgatgacgacgagctgggcccggtcgcgggcgcggagcttggacatggcccggttgacgtgggtcttcacggtcagcgggctgacctggaggcgttcggcgatctcgtcgttggagtggccgccggcgacctggacgaggacctcgcgctcgcgtccggtcagcgcgtccaggcgggccgagcggaccgggtcgcggccgtcgtcggcgtcgtcgccctgcgcgaggaaacgggcgatgaggcccttggtggccgccggtgacagcagtgcctcgccgccggccgcgatgcggatggcgctcaggagttcctcgggttcgctgcccttgccgaggaagccggaggcgcccgcgcgcagcgactggacgacgtagtcgtcgacctcgaaggtggtcaggatgaccacgcggacctggtcgagagcggggtcggcgctgatcaggcgggtggcggcgaggccgtcggtgccgggcatgcggatgtccatgaggacgacgtcggcgcgctgctccttcgccaggcgtaccgcctccgctccttcggaggcctcgccgaccacctccatgtcgggctcggagtcgacgagcacgcggaaggcgctgcgcagcagtgcctggtcgtcggcgagcaggacacggatcgtcatacggcgtcccccggggcgcgggtgcacgtactcgtgcggcgggtgctggtggcggtgctggtggtggtgttgacgggaaggatcgcatggacgcggaatccgccgccgtagcgggggccggtggtgagggtgccgcgcagggcggtgacccgctcgcgcatgccgagcaggccgtggccaccgccggtggcgcgcggtgcgtcgtccgcgtccgcgccgtcgtccagcacggtgacctccaggttcggtccgacccgtacgacgctgacctcggccctggcccggctgcccgcgtgcttctgcacgttggtcagggcctcctggacgatccggaacgcggccaggtcgacggcggc

SEQ ID NO: 753 - DNA, 7447 bp, Unknown
  Kingdom: Bacteria, Phylum: Actinobacteria, Class: Actinobacteria, Order: Streptomycetales, Family: Streptomycetaceae, Genus: Streptomyces
gtggcggggaccaacttcgccctgtgggcgggcggcgccgaggcggtcgacgtctgcctgttcgacgaggctggccaggagacccgggcccgcctgaccgagctgacgcacgagatctggcacggcttcgtccccggtgtgctgcccggccgccgctacggcttccgggtgcacggccgctgggacccgtggaccggcgcccgctggaacccggcgaagctgctgctcgacccgtacgcgcgcgcggtggacggcgagttcgcgctgcccccggaggtctacgggcacgtacgggactggccggagcagcacgtcgccgacaccgtgcgcgacgaccgcgactcggcgccgttcgtccccaagggcgtggtcgtccaggacgacgacgactggtccgacgaccgccgccccaagacgccgtgggcggactcggtcatctacgagctgcacgtgcgcggcttcaccaagctgcacccgggcatccccgaggagctgcgcggcacgtacgccgggctcgcccacccggcggcgatcgagcacctggtgaagctgggcgtgacggcggtggagctgctgccggtgcaccagttcgcgcacgaggaccacctgctgcgccggggcctgcgcaaccactggggctacaactcgatcggctacttcgccccgcacgccgcctacgccgcctccggcaccacaggacagcaggtgggcgagttcaagcggatggtgcgcgcgctgcacgcggcaggcatcgaggtcgtcctcgacgtcgtctacaaccacaccgccgaggccggcgagtacggcccgacgctctccctgaagggcatcgacaaccggcgctactaccgcctcgcgcccgacgcccgccggtacgccgactacaccggctgcggcaacacgctcaacgtcgtccagccgcacgtgctgcgcctgatcaccgactcgctgcgctactgggtgaccgagatgggcgtggacggcttccgcttcgacctggccgccgccctggcccgctccctgcacgacgtggacatgctctcgccgttcctcgccgtgatcgctcaggacccggtgctgcgccgggtgaagctgatcgccgagccgtgggacatcggctcgggcggctaccaggtgggcgccttcccgccgctgtgggcggagtggaacgaccgctaccgcgacgccgtacgggacttctggcggcacgcgctgccggacgtgcgggagatgggctaccggctgtccggctccagcgacctgtacgcctggggcggccggcgcccgtacgcgtcggtcaacttcgtcaccgcgcacgacggtttcaccctgcgcgacctggtgagttacgaccgcaagcacaacgaggccaacggcgagggcaatcgggacggcacggacgacaaccgctcctggaactgcggcgtggagggcgagagcgacgacgagcggatcctggccctgcggcgcaggcagctgcgcaacctgctgaccacgctgctgctgtccacgggcgtgccgatgctggtcgcgggcgacgagctgggccgcacccagcgcggcaacaacaacgcctactgccaggacaacgagaccggctggctggactggagcctgctggaggagccgggatggaaggcgctgttcgagctgacctcccggctgatcgcactgcgccaccggcatcccgtgctgcgccgccgggcgttcttctccgggctcgcggcctcggcggacgggctgcgggacctggcgtggttcaccgcgcgcggcaccgagatgacggagggcgactggtacgcccccgccgccacgctgggcatgtacctgtccggcagggacatcccgggccgcgacgagcggggtgcgccggtcctcgacgacagcttcctggccgtgctgcacgccggtgagggcccggtgagcttcgtcctgccgggtccgccgtgggcggagcgctacgaggtggtggtggacaccggccgcgaggaccagggcgaggcgcccggcgagacgcaccgcgcgggggcggcgatcaccgtcccggcgcgcacggtgctgctgctgcgcgtcaccggctgaggcgcgccgaccgagggcccgggcgagcggagggtgaggcgtgcgattgacggtgaagagtgtgagtggttgactacacatatgaagacggaacggccccgccagttgtccaccgccgaggagcgccgcgagacggtcctgaacaccgccgtcggcgccttcgcggccaagggctacttcggcaccaccacgaacgaggtggccaaggcggccgggatctcgcaggcgtacgtctaccggctcttccccaccaaggaggccctgttcgccgcggtcgtcgagcgctgcttcgcgcgggtgcgggcggccctggaggagggtgccgcccaggcggcgggcagctcgccggacgcggtcctgtccgccatgggcgatgcctacgcccgactgatcagcgacaacgacgtactcctcgtccagctgcacgcccaggccgcggcggcctccgagccggccatccgggagaccgtgcgcgccggctacgcccgcacggtcgagtacgtccggggcgcctcgggcggcgacgaccggcaggtccaggagttcttcgccctcggcatgctctgccacctgctggtgtccatcgacgccgacgccgtcgacgcaccctggacgcgcaccctggcgacgggcatccgtcactactgacccccgcctcgcatcaccgggcggccgtcggctcaccatcgacccggcagccgccttctctcggagcctgacagtgagtggtcaaccactctcatcatcaccctcatacgttgctcgaacccgcgaaacggagtcgtcatgcgcgtcaccgagatcgtcctccccgccaccggagagcccgagaccctggagacccgggtgcgggacctgcctcggccgggtcccggccaggtcgtcgtccgcgtcgaggccagcggtgtgaccttcgccgaacagcagatgcggcgcggcaagtactacgacatgcccgccttccccttcgtccccggctacgacctcgtcggcgtcgtcgaggccgtcggggagcccgtaccgggacaggcgccctcaccggtggtgccggggcagcgggtcgccgcgctcaccaagacgggcggctgggccgaccacgcgctgctcgcggccgccgacctcgtcccggtgcccgacggcgtggacccggccgaggccgagacgctggtgaccaacggcgccaccgcctggcggatgctgcaccggaccgcgcgggtgcggccgggcgacaccgtcgtcgtgcacggcgccaacggcggtgtcggcaacgtcctggtacagctcgcccgcgcccacggcgtgcgggtcatcggcaccgcctccgcccgcaaccaggaagccgtccgcgccctgggcgccctccccgtcgactaccgctccgacgtcctcgcccaggtccgcgcgctcgcgccgcacggcgtggccgccgtcttcgaccacgtcggcggcccgggcatcaaggactcctggcggatgctggcccccggcggcgtcctcgtctcctacggcagcgccgccacccgcgacgagcccggcagcggcaggctcccggtcctcgcgctggtgggccggctgctctggtggaacgctttgccgggcggccgccgtgcccacttcttcaacctgtgggccggcaaggcacggcgtcccgagcgctaccgggccctgctgcgcgaggacctcgcccaggtcttcgacctgctccgctccggcgccctgacggccaggatcgaccgcgtctacccgctcacccaggccgccgaggccctgcggtacgccgagtccgggtccgtggtcggcaaggtcgtcatcgcgccgggcgcacccgccgtcggatgacaggcgggccgggaccggtcagccgaggatcccccggtcgtaggccaccgcgacggccgccgcccggtccttgacgcccagtttcgcgtagaggtgggtgagatgggtcttcaccgtggcctcgctgatgaacagttcgcgggcgatctcccggttggaggtgccccgggcgaccaggaccagcacctcgcgctcgcgggcggagagcggttcgttgcccgcggcgggggcgcggaccgcggagaccaggcgggaggcgacggccggggagagcaccgtgcggccctcggcggcggcccgcaccgcggtgaacagctcctcgcgcggggcgtccttgagcaggtagccggtcgcgccggcctcgatcgcgggcagcgtgtcggagtcggtgtcgtacgtcgtcaggacgagcaccttcgcgcgggcgccgcggcgggtcagttcccggatcgcgtccacaccggcgccgcccggcatgcgcaggtccatgaggatcacgtccgggtcgagcgccccggccttctgcaccgcctcgacaccgccggccgcctcgccgagcacggtgaacccgggcgcggcctcgaacatgccgcgcagaccgtcccgtacgacggggtggtcgtcgacgatcagcaaggagatgggcgtgtcatcggtcatggcccaccaacggtacgcgagccgagaccgccgtaccgtgcccgggctcggactcgaccgtcagggccccggcgatgcgttcggcgcgggcgcgcatgccgtccaggccgaacccgccggcgcgggtgcgggcgggcacggcgagcgggtcgaagccccggccgtcgtcccgtacgtccagggagacctcgtcgcccatgaaggagagggtgacgccgacccgggaggcgcgggcgtgccgggcggcgttggacagggcctcctggacgatgcgcagcagcgtcgccgacacctcgtcgtgcagcggctgggcgcagccggtcacggtgaagtcggcccggcagccggtgcgttcgccccactgggcgacggtgccctccagcgcctgaggcagtccggcgtcctccaggtccacgggggcgaggttgtgcaccgagcggcgggcctcgcccaggctgtgccgggccaggtccatggcgcggccgacgtgcacgcgggccgtcgcctcgtccggtgcggcggacaccacctggagctgggcgatgatgccggtcagtccctgggcgagggtgtcgtggatctcggcggccaggcgccggcgctcgtcggcgatcccggcctcccgtgcctggacgaggagttgggcgtgcagggcggcgttctcgtcgagggcctgctgcaacgcggtgttggtgcgctccagttcgtcgatggtggcggcctgggcgcgggcgcgggcctgctcctgttcggcgtagcgggtgaagaggaggaccaggccggcgttggcgccgaggacgacgacgaagccgagccagaggatgagtccgtgcggtggcatgccgccgatctcgctgccggccatcgtgacggcggtcatgcacaggccgggcagcaccagccggcggggcagttgccgggcggcggtgtagtagccggcgaccgcgtagaaggcgaagaacgggttgagccaggtcaggacgaagcccagggcccagcgcgcgaagtagaagcaggcgctcgccgcccccggcatctgccgttcgcgggcccatctgccccagctcatctggaggaccacggctacggcgaccaaggcgacggagacggcgatctcgccccggctcatgccgaccgcgacggccgagcccgccgccgtgagcacggccacgacgagcagggcgtagggcccccatgtgtcgaaggaggcccggggcggcttcaactcggcgctcgtcacggtcgcggtgtccggcatggccccagtgtccggcacgggcccggtcccggtcacacccctggcacccggcatgagcgaggtcactcccagcggaaccagcgggcggcaccggccgtgagcagcaccgtccacgcgacgagcacgcccaggtggctccagcccggccagtggcccgcggcggcctggttcagagcctgcgcggcggcgccgaagggcgtgtacccgacgatccgggcgagcaggtggggcatggactgcaccggcacccacaggcccgcgctgaacatcatcgggaagatgacggcgccgccgatggcaccggcgatcttcgtggtgcgcgagagggcggagacgagcgagcccagcgcgagggcggcgcacacggcgagcagcagcgcgagcgcgtagccgaagccctgctcgggcaggcgtacgccgaaggcgatccggccgacggccagggcgagcagggccgagaccagcgccgcgcccgcgaagagcaccatctgcgcgctgagcagggcggcgggccggaccggagtggcggacatccggcgcaggatgccgcgctcgcggtagccggtgaggacctgcggcatggcctgcagcccgccgaggatcatgccgagcagcaccgcgacgggcacgtagatgtcgacgagccgcagtccgccgagcccgttgtcgtgctccctgaaggacgggacggagccgaggatcgccagcaggacggccgggaacagcaggacccagaagatcgcgccgggctcgcggcggaacaggcggatctcggtgcgcagcacggccgggttcaccagggcgctgttcatacggcggcctccgtcaggtccaggaacgcgtcgtcgagcgtggcgtcgctgacgcggagttggtgggcggtgatgtggtggcgggcgagcagggtgatgacggcgttgacggtggtgtcggtgccggacagcgtgatccggccgtccttcgacgtcaccgacgccagctcgggcagggcgttcaggtcacgctcgtccagcggcgcggacggcgtgaagctgacgacggtggcgcccgccgaacgccggatcagtccctgcggggtgtccagggcgacgatccggccccggtcgatcacggcgatccggtcgcacagccgctgggcctcctccatgaagtgcgtcacgagcaggacggtgacaccgccggcccggacgtcctcgatgagctgccaggtgtcgcggcgggcgcgcgggtcgagcccggtggtcagctcgtccaggacgacgacgcgggggttgcccacgagggcgagcgcgatgaacaggcgctgcttctggccgccggacagcttggcgaagcgggtggtgagcttgtcggtgaggccgaggcgctcggcgagcgggcgccagtcggccggggccgggtagaaggaggcgtacatctccagtgcctcgcggacggtgagcttggcctgcagctcgcttagctggagctgggcgccgaggacgcgggcgaccttctcgtggtcggcgacggggtcgagcccggtgacccggatccggcccgcgtcgggcacgcgcagcccctcgacgcactccacggtggtggtcttgcccgcgccgttcgggccga

SEQ ID NO: 754 - DNA, 1727 bp, Unknown
  Kingdom: Bacteria, Phylum: Actinobacteria, Class: Actinobacteria, Order: Streptomycetales, Family: Streptomycetaceae, Genus: Streptomyces
gcacgaccacctcgacggcggcctgcgccccgccaccctcgtcgagctcgccgcggcggtcggccacaccctgcccaccaccgaccccggcgagctggccgcctggtacgtcgaggccgccggctccggcgacctggtccgttacataggcaccttcgagcacaccctcgccgtgatgcagacccgcgagggcctgctgcgcaccgccgaggagtacgtgctcgacctggccgccgacggcgtggtctacggcgaggtgcgctacgcgcccgagctgatggtgaacggcgggctgaccctgaccgaggtcgtcgaggcggtccaggagggactggcggccggcatggccaaggcggcggcggacggcaccccggtccgcgtcggcaccctgctgtgcggcatgcggatgttcgaccgcacccgggagatcgccgacctggcggtggccttccgggacgcgggcgtggtcggcttcgacatcgcgggcgccgaggacggcttcccgcccgccgaccacctcgccgccttcgaccatctgcgcggcgagagcgtcccgttcaccatccacgccggtgaggcgcacggcctgcccagcatccaccaggccctgcaggtgtgcggcgcccagcggatcgggcacggcgtgcgcatcaccgaggacatcgtggacggcaagctcggccgcctcgccggatgggtgcgcgaccgccgtgtcgccctggagatgtgcccgacgtccaacctccagaccggcgcggccacctcgatcgccgagcaccccgtcaccgccctgaaggacctcggcttccgggtcaccgtcaacaccgacaaccgtctggtgtcgggtacgacgatgacccgggagatgtcgctgctggtcgaggaggcgggctggagcgtggaggacctgcgcacggtcacggtgaacgccgtcaagagcgcgttcatcccgttcgacgagcgcagggccctcatcgaggacgtcgtcctgccgggctacgcgtccgcgctctgaagcagccccttgacgtaggcggcctgtccgacgtgctggaggtcgtcggacaggacgctcaccaggcgcacgcccagcgtgacgggcggatcccagcgctcgtccacgatgcgtccgaggtccgccgccgccaccttccgcagggcccgcacgctctgttcgtacacggcgtcgtggtaacccgtcagcaggtcaccggagtcgacgcgcaccttggccaccttcgccggagtgtgcccgtacccggtctcgcgcgcgtgcaggtccaggccgaagcgtttctcccagtcctgggcgagccacacctggtcgaggtcgaaggcgtccgcgagatggtcgtcctggacccgggtcagatgccagatcagccaggcgacggagttggcgtccgcggcgggccgggcgttgagctgctcggccgacaggccgtcgacgacggcgtggacttcttcctggatgcggccgtagccgtcgatgagaatgtccttcgcatgcatacgtccaccatcgcgcatccggcgcgctcacgcgtccggaacccagcttccgtggaagccgagcggcacccggccgggcaggtggacccgggccaccggctcgccggtgaagtcctgcgcggcgaggatcaccaggtcggcggcgccccggtccgggttgtggacgtaggcgagggtgtacccgtcgtcctccgcggcccggcggtcgccggcgt

SEQ ID NO: 755 - DNA, 2729 bp, Unknown
  Kingdom: Bacteria, Phylum: Actinobacteria, Class: Actinobacteria, Order: Streptomycetales, Family: Streptomycetaceae, Genus: Streptomyces
catcggcgccagcgccggctgcatcacgcgcgggccggccaccggcgccgcagccgagagcaggacggccgccgccccgcccgcgagccccaggctcagcgcccccagcgcggccgtcctgctctcggctgcggcgctgggggccgggcaggccgtgatgcagccggcgctggcgacgatgatcgtggactgctcggagacggagacgcggtcacgggccttcgccatgcagttcttcctgcagaacctcgggctcggtgtcggtggtctcataggcgggcacctcgtcgacacctcacgggtctcctccttcactctgctgttctcgatcgaggcggcggtgttcctgctgctcgtcgcgctgatggcgaccgtgcggatgccccgtgccccgcgtgtggagaaggctccggcggcagccggggcggctaccggacggagcggttggcggcagttgctcgggaaccgggccatggtgcagctgtgcgtcctgggcttcgtgctgttcttcgcctgctacgggcagttcgagtcggggctgagcgcgtacggcgtggaggccgccgggatctcgacgtcggcgctgggtacggcgctggccgcgaacacgctgatgatcgtggtggcgcagttcgccgtgctgaagttcgtcgagcggcggcggcgctcccgggtgatcgcggcggtcggtgtgatctgggcggtggcctgggccgcggcggcgtacgcgggtctcgggcacggcagccaggcgatggcgacggcggcgttcgtgtcgacgtacgcgctgttcgggctgggtgaggccatgctgtcgccgacgctcgcgccgctcgtggccgatctcgctccgcaggggatggcggggcagtacaactcggccttcgccctggtgaagcagctcgcgctggcggtcggtccggcggtgggcggtccgctggcggcgtcgctgccagggccgtacgtggtgaccttcctgctgttctcgctggggatcagcgtgctcgcggtgcgccttggacgggggctcaccaccgtgcaggaccatccgtggggtgcgcggagccgggtggtggcgcgcggcgtggccgccgcggagccggtgaccacgcaggcgtgagccgcccaggggtgagacctggcgggtgcggggcggccgtcgtcttcgggcgacggccgcttcggcgtacgggcggggccgtcccgtcgtagggctgcagggcgtagggctgcggggttagggccgtttggcgggcagggtgaactcgcaccagacggccttcccgccgtccggggtgcggcgggcgccccagtgggcggcgatggtggcgacgatggcgatgccccggcccgcttcgtcggcgggttcggcgcggcggcgtctggggaggtggtcgtcgccgtcggtgacctcgacgatgaggcggcggtccgtgcggcgcaggcgcaggcgcatgggcggtgtgccgtgctggagggagttggcgacgagttcgctggccgcgaggacgcccgtgtcgtgcagttcgggcgggaagcgccagctggtgaggacgccggaggcgaaggcacgcgcgcgcggggcggcttccacgccgccgaggagttccagggcggcgttgcggaagagttcgccgtcggggccggtgcgggcggggtgctggaggacgaggacggccacgtcgtcgtcgtggtcggcctggacgccggctgagcggaccaggcggtcgcagacgacctggggggtgccggtggcgccggccagggcgcgtgccagggcggtgatgccctcgtcgaggtcctggtcgcggcgttcgaccaggccgtcggtgtagaggacggcggtggagccgggggccagggggaccgagccggaggcgtgcatccagccgccggtgcccaggggcgggccggtgggttcgtcggcgcggacgacggtgcccctctcgtcgcggaccaggatcggcaggtgcccggcggaggagtacaccagccggccctcgttggggtcgtggacggcgtagacgcaggtggcgatctggttggggtcgatctcggcggcgaggccgtcgaggagctggaggatctcgtgcggcgggaggtccatgcgggcgtaggcgcgcacggcggtgcgcagctggcccatgacggcggcggcgcggaccccgcggcccatgacgtcgccgatgacggcgccgacccggccgccgggcagcgggatcaggtcgtaccagtcgccgccgatgtcccggcccagcgagccgcccgcgtagccggagcggtagcgcacggcgacgtcggcgccggggacgctggggatggtgcggggcagcatggcctgctggaggccctgggcgaggtccttctcctgttcgtagagcatggcgcgctgcaggctctgcgcgatgctgctgccgagggccacgaggaggttgcgttcctcctgggtgaagccgtgccggccgctgtagagcaggcccatgccgccgatgggccgtccctgggcgatcagcggcaggtaggcggccgaggcgatgcccagcccggtgatgtgcggccacaggatggggtagcgctcggcgaagtcctccggtgattcgatgaagcgcgggctgagggtgcgcaccgcctcgctcatcgggtagcgctcgtcgatccgggtgacgcgggtgcccgggacggagctgccctcgggtccctcggcgacgagccgtatgcggccggcctcg

SEQ ID NO: 756 - DNA, 5028 bp, Unknown
  Kingdom: Bacteria, Phylum: Actinobacteria, Class: Actinobacteria, Order: Streptomycetales, Family: Streptomycetaceae, Genus: Streptomyces
ggcccgccggccggcgggcccgcaccgacgacgtgtcagaagccgaggcgttcccggcgcaccgaatacaccacgaagcccgcgccggcggcgaggaagagcgagccgccgacgacgtagggagtggtgtcgacgcttccggtgtcggcgagttccgtaccgccggtggcggcggtgccgtcgccggcaacggcgtcctcggcacccgtgcgcgtgcccgtcgtcccgtccgccgtcgtactcgcggcgcgtccccgcaccgtggtgtgggccgtcggtaccgcgtcggccaccgctctcgtcggcgtgtccccggacgcgctcgcggagggcacgaaccacagggcgccaagaagggtgcccgcggcggtggcggtcaggagcgtacgacgagcggttgacacggaatatcgatccccttgtggcactggcgaattggccgtgtggggcgatgttagtgaaagcgacgggtcacgggaaagtcacgggaggtttgaagtgcggcctccgggagcgcggcgtccgatcggtggccctttgcgctgatacgcgcgcgccgggcgggcgtcgcgcgcccttgtggtggaagcactgacttggtgtcgagggggcgcacgctccggcgtgtacgggtcggcggggcgcccggcggccgtcggcgctcacgtccggtcccgcgctcccaccgggcgggaccccgccttcccgggacgcgggcccggcgaggatgatggcggacggtccacgcgaaccgtccgcacagtgcccgcacgcatgcgcccgcgcccccgccgacgtggcgaggcacacactcgggcggcctggggaacgggacgaaacggtcgtagcgttgatgattcgcgacgggggattcgaggggtcccggggggaatacggcaacgatggagaagcgtgtgatgacgaacagcaagcggcgtcaggccctgatggcctcgtccgctctgctcggcggtgttctggtgctcacggcctgctccggcagcagcgacgcggccggcgggaacggtgacgacagctcgcaggccacggcggacaaggccgcggcccagcagacgtcggaggcccagatcaagatcacaccggcggacggctccgacaacgcgtccatcaacaactccgccgccgtcaccgtgaccaagggcacgctgacggacgtcaccatgaccaccgtcgacggcaaggccgtcaagggccagatatcggcggacaagaccagctggaagccgagcggccagctgagccgctccacgacctacaaggtcgccgccaccgccaccgacgccaagggccgcgccgcccacgagaacgcctcgttcaccacggtcgccccggcgcacagcttcatcggcaccttcacgccggacagcggcaccaccgtcggcgtgggcatgcccgtctcgatcaacttcgacaaggcgatcaccaacaaggcggccgtccagaagggcatcaccgtctcctcctccagcggccaggaggtcgtcgggcactggttcggcgccaaccgcctcgacttccgccccgagcagtactggaaggagggctccaccgtcacgctgaagctcaacctcgacggcgtgcagggcgcccagggcgtctacggcgtccagcagaagacggtcaccttccacatcggccgcaaccaggtctcctatgtcgacgccaagaccaagcagatgaaggtcacgcaggacggcaagacgatcaagaccatcccgatctccgccggttcccccgagcacaccacctacgagggcgcgatggtgatctcggagaagttcacccagacccggatgaacggcgcgacggtcggcttcaaggactccgacggcaagggcgagtacgacatcaaggacgtgccgcacgccatgcgcctgaccaactccggcaccttcatccacggcaactactggggcgccccgtccgtcttcggcagcgccaacaccagccacggctgcgtcggtctgcaggacaagaagggtgcgaaggacccgagcacgccggccgcgtggttctacaaccactcgctgctcggtgacgtcgtcgtcgtccagcacaccggcgacaagaccgtctccccggacaacggcctcaacggctggaacatgagctggtcgcagtggaaggccggctccgccgcctgatccgcgcagcagccctgctaccgccgatgccgcccctgcccggggcggcatcggtcttctcgttttcggggcgggggtgtcacgccgacgacgccgggcttccgcttcccgagcgcgtcgcgtccgcaccccagctggccagcagccgcagcgactcggccgacggcgagtccggctcggcgtggtagacgaccagggactgctcggtaccgtcggcgatcctgaacgactcgtagcgcaacgccagttcgccgacgagcgggtggcgcaggagcttgacgccgtggctcttctccttgacgtcgtgcgtggcccacaggcggcggaagtcctcgctcttgacggacagttcaccgacgagcgccgacagccgcggatcgtccgggtagcagccggcctccatgtgcagggacaggacgacgtccatcgccttctgctcccagtcgacgtacagatcgcggtagtccgcattcaggaagaccatgcgcgcccagttccgctcggcggcgggcagcagggaccagtcaccgaagacggccgccgccatccggttccacgccagcagttccgagcgccgccccacgacgtacgccgggacgctgtccatcgtgtcgagcaactgccgcagcgcggtgcgcacctgctgcgtcggcgccgtctgcttcttcttgtgcttcggcttggccaggtgggtcaggtgggcgtgctcggcgtcggtcaggcgcagcgcgcgggcgatggagtccagcacctcggcggacacgttgcggccgttgccctgttccaggcgcgtgtagtacgccaccgagacgccggcgagctgcgccagctcctcgcggcgcagaccgggcacgcggcgttggcgtccgtagtgcggcaggcccacgtcctccggctggagccgggcccggcgagtgcgcaggaactcgctcagctcggcccgccgctccagcccggcaccggcctccgtgccgccctgggctccggccgccgtgccgtcccgggctccggtctccgcgccggctcccgccgtgtccgttccgggcttttcgtccatacgtccagtatccctgctcctacgcaccgcatcctgctcccgccagtagtaggcacagcagtcgtacgcagagccgtgacctgggcggacggcacgcgatgcggcacgctgggagacgtgcccggccggaaggcagccgggcacgacaaccgctaggagacccctcggcatgaccactgtcgccgcatacgccgcccccgcagcgaaggcgccgctggagcgcaccaccatcgaacgccgggcagtcggcgagttcgacgtgctgatcgacgtcaagttcgccggcatctgccactcggacatccaccaggcccgcgagggctggggcgaggccatcttcccgatggtccccggccacgagatcgcgggcatcgtctccgaggtcggccccggcgtcacccggtacgccgtcggcgaccgcgtgggcgtcggctgcatggtcgactcctgccgcgagtgcgagaactgcgcggcgggcctggagcagtactgcacgagccgcccgacctggacgtacaacgccgtcggcaaggacggcgagccgacctacggcggctactcccagaagatcgtggtcgacgagaactacgtcgtccgcatccccgacggcctggccctggacgtggccgcgccgctgctgtgcgccggcatcaccacgtactccccgctcaagcactggaacaccggccccggcaagaaggtcgccgtggtcggtttcggcggcctcggccacatgggcgtcaagatcgcccacgcgctcggcgcggaggtgaccgtgctgtcccagtccctgcgcaagcaggacgacggcctgcgcctcggcgccgaccactactacgccaccagcgacccggcgacgttcgagcagctcaagggcaccttcgacctgatcctcaacacggtctcggcgccgctcgacttcccggcgttcctctccctgctgcgcaccgacggcgccatggtgaacgtcggcctccccgaggagccggtcgagatcccgctcgccggcctcttcggcaaccggcgcaacctcaccagctccaacatcggcggcatcgccgagacccaggagatgctggacttctgcgccgcgcacggcctgggcgccgagatcgaactgatcgacgcggaacagatcaacgaggcgtacgagcgggtactggccagcgacgtgcggtaccgcttcgtcatcgacacggcgacgatctgacccggccgggcgcccgtccgcgctcctctggccctcgccccggccgctcgctgccgcttccccgaacggtgcgggcagccggggacggtcgtacccgcgggggcgcatggcgcaccgcctccggatcgtcggccgcacggtcaccgacaccggcggactgccccacctcgcgcggctgtgcaccaccctgcaccgggtcatgcacacccgctggcccggcctgcggcccctgccgtcccggcgtccgtgagcccgaggcccgaggagggcggcaccggtcagtgcggcagtgtcgccgggctgccgccgttggcctcgtagcctgccaccgccagggcgcggtagacggcgaattccgctgccgggtcctcggacagggtccaggggagggcgccgacgtggccgtcgacgtgtatgagctggtccatggcctccgcccagcgttcggagcggaccaggaagaagacgagcaggtggcggacgtgggctgtcatcgggtcgccgggacgggcggaatggatcgcgtgcagggcgccgtggaccgccttggtgacgacctcgctctggtagaagccgcggaccaggttcacctcggg

SEQ ID NO: 757 - DNA, 3741 bp, Unknown
  Kingdom: Bacteria, Phylum: Actinobacteria, Class: Actinobacteria, Order: Streptomycetales, Family: Streptomycetaceae, Genus: Streptomyces
ggacagcgtcagtcggtgtccggatgcgccgactacaccagggccgcggccctggtgtagtcggcgcatccggacaccgactgacgctgtcctccctagttcatgtctccttgaggagttcgcctcttcctgaggagttcgtgtctggctgaggagatcgtttcttcctgaggtcggcgccacctcgtaggagaccgcgaaagccgcaccggagcagtccggtgcggctcgcgggccgttcactgtggtgccgccgcggctactgcggggcgcggttacttcgggtcgcggttacttcgggtcgcggtcgaagagcgccttcgaccagcggtagccgagtgccgccagccccaggcaccaggccacggcgatccaccagttgttgccgatctcggtgccgagcagcagtccgcgcagcgtctcgatggcgggggtgaacggctggtactcggcgaacggccggaaccagcccggcatcgcgtcgagcggcacgaaggcgctggacagcagcggcaggatcatcagcggcatggcgttgttgctggccgcctcggcgttcgggctggacaggcccatgccgaccgcgatccaggtgagcgccagggagacgagggccagcaggccgaccgccaggacccattccaggacggtggcgttcgaggaccggaacccgatggccaccgcgacggcgccgacgaggaccacgctcatcacgcactgcagcacgctgccgacgacgtgcccgatgagcaccgacccgcggtggatcgccatcgtgcggaagcgggcgatgatgccttcgttcatgtccatggagacggagaccgcgctgccgatcgtggtaccgccgatggtcagcatcaggatgcccgggacgaggtaggcgaggtactcggagcggtccgcgtggccgcccccgatgccggcgctcatcacgtcaccgaagatgtagacgaagagcagcaggagcatgaccggcgtgaggagcaggttcagcgtcaaggacgggtagcgccggacgtgcagcaggttgcgccgcagcatcgtggacgagtcacgcagggcgagggagagggagctgctcatcggacgttctccttggactggtgcgactgctgccgctggtccgactggttcgactggttcgactggttcgactggttcggctggtcgggcttgctcgtctgctgcgactggctcggcttgtcggtgccgccggtcagggcgaagaagacgtcgtcgaggtcgggggtgtgcacggtcagttcgtccgcctcgatgccgacggcgtccagccggtccaggacggagcgcaggtcgcgctggctgccgtcgctggggatctgcagcgacagcgcttcgtcgtcgctggtgacctcacgcagcgccagtacggcgctccggtacgcggccgggtcggagaagcgcagccgcacatggccgccggggatgagccgcttcagttcctcggcggtgccctcggcggcgatcttcccgtcgtcgagcaccgcgatacggtcggcgagttcgtcggcctcctccaggtactgggtggtgaggaagacggtgacgccgtcggagacgagcgcgcggatgatctgccacatgttgtggcggctgcgcgggtcgaggccggtggtcggctcgtcgaggaagatgatccgcggatcgccgaccagggtcatcgcgatgtcgaggcggcgcttcatgccgccggagtaggtggaggcgggcttcttcgccgcctccacgaggtcgaaccgctccagcagttcggcggtgacgcgccgcccctcccgcttggacaggtggtgcaggtccgccatgagaagcatgttctcctcgccggtgatcagaccgtcgacggcggagaactgtcccgtgacgccgatcgcggcgcgcacttcgtgcggggccgtggcgatgtcgtggcccgcgacctgggcctggccgccgtcggcggtgaggagtgtggagaggatctgcacggtggtcgtcttgccggcaccgttcggaccgagcagcgcgaacacggacccggcggggatgcgcaggtcgatgccgtcgaggacggtcttgtcaccgtacgacttgcgcagacccacagtggagacggcgaccggtgacgggtggccgtcatcccgcctgggcatgggcatcggcatgggcatgacaggagaaggcatggagccctccgtttcgaaggctgaagtggcgggagaggcaggagagttggggttggtgcttgaggccggtgcctggggcggtgcctgagggcggcgcttgaggccggtgtctgagggcggtgcttgaggggtcgtcaggccttggcacggaggatgtcgatgttgccgtgccgggtgcgggcgtggatcttgacggtctcctcggtctccgccggggcgtcggacgaggtgagcctggtgcgcacctgtccggagtccgagtgggcgtcgagccaggcggccgtgccctcccggacgccgacctcgatggcgccgtaggaggtcttcaactgcacgctgccgcgcgccacttcgcccacgcgcagggcgccgttcgcggtggtggcggtgacggagtcctcggcgcgccggatgtcgatgtcaccgttggcgccgctgacgcgcagctcgccggtggcggcctcgacggtcgtggtgccgtgcgagttcttcaggacggcggggccgtcgaggagtccgacgcgcacgctgccggagctgctggtgatctcggccgtgccctcgacccggtccacggtgaccgagccgtgggaggaggtcagctggagcggaccggtcgcgtcgaggcggatgtcaccgaccgacgtcttcacccggacctggccgagccggccctcgccgagcacctggacccaggagccggtcacgtcgatgtccgagccctcgggcagctgcaccgtgacgccgacgatgccactgggtccgatgaaccggcgttccttagtcttcaccgtcaggacgccgttcacgtaggccacctccgtctgctcggcggcccgcacgtccttgtcccgcttcgggtcgccgggctggaccgagacgaccgtttcggtgcggtcgcccgcggtgaactggacggaaccggcgcccacgtgggcggtcaccgcgatcggtccgggagtgtcgaaagaaggcatggctgtaccgtcctcatgagtcctggaggcatccgcgctggtggagcgcggtgccgggtgaagtggtgcgcgtggagtcgtacgggtgaacagcggtggtgcaggtgaacaccagcggtgccggtgaacaccagtggtgcccgtgaagcggtgggggcggctagcgcacccagcccgagaagctctgcccggtggtttcgatggttccggtggtgcgggtcttctccgtcgtgcgcggccgggcgccgccgtcgaccgcggccgacacggcccggaccagccacgcgttgaccgacaggccctcgcggctcgcggcctcctcggcgcgcgccttgaggtgggccggcagccgcaggttgacgcgggcggtgccgccctcgtcgccctcggcgggcacgggggccgcgagcggctcgacgggcggagcgaccacctccgcggggccgccgccggtggacggcagcgtcaccacgaagtcggggtcaagaccgcgcagccgtacgtcgaccgagccgggggcgagttcacgggtgatctcgtccatcgcggcggagagcacgttgagcatggtcagccgg

SEQ ID NO: 758 - DNA, 6990 bp, Unknown
  Kingdom: Bacteria, Phylum: Actinobacteria, Class: Actinobacteria, Order: Streptomycetales, Family: Streptomycetaceae, Genus: Streptomyces
gacagggcggcggcgggagcgagggagggcgcggaacccggcgagagacaggacccggcgggcggcaggatccctggcgggaggcaggtccccggcgggtctcagcccttgagcgcggtgctgatcgcctcggccagcggggtggtcgggcggccggtcaggcgggacaggtcaccgctgtcgaccaccagttcgccctgctcgatggaggcgtcgacgccggcgaggatcgcggcgaacggctccggcagtcccgcgccggtcaggacgccctggtactccgccacggagaccggccggtacacgatctcctggccggtctgccggctcagctcggcggcgaactcggcgaagccccacgcctcgtcgccgcccagttcgtacgtcttgttctcgtggccctcgccggtgagcaccgtgacggcggcggcggcgtagtcggcgcgcgaggcggaggagagccggccggcgcccgccgcgtgcacgagggcgtggtgctccagcaccggggcgaggctttcggtgtagttctcgtggtaccagccgttgcgcagcaggacgtagggcagaccggaggccagcagtgcctcctcggtgccgcggtggtcgtcggcgagggcggccttcaggctgccgggcgcgctggtgtaggcgagcagggcgacgcccgcggccttggccgcgtcgatgacgacccggtgctgctggacgcggcccttgtcgaactcgttgccggagacgagcaggaccttgtcgcccgccgcgaacaggccgtcgaaggtctcgggcgcgttgtagtccgcgaccgcgatccgtacgccgcgcccggcgaggtcggcggccttctccggggtgcggacgaccgcggtgatccggtcggcggggaccttgtccagcagttgttccacgacgaggcggccgaggtgtccggtggctccggtgacgacgatgctcatgaggggatctccttgtggggtgtgtctggcactaaccctaggagcggcgctaactcttggaaagtacccactttgaagtaaggtacccacatgaccgtaagtgggagtgggcatgtgggccgggcggcgggcaccgcaggggcgcgggcggcccaggacgcggcgctgtgcccgtaccggctggtcctggagcacgtcaccagccgctggggcgtgctggtcctgatcgaactgctggaacggccttaccggttcagcgagttgcggcgagccgtcggccgggtgagcgagaagggggtcagcgagaagatgctgacccagacgctccagaccctggagcgcgacgggctggtccaccgcgacgccaagcccgtcatcccgccgcgcgtcgactactcgctcaccggcctcggccgcgaggccgccgagcaggtacgcacgctcgccgagtggaccaaggagcgcatggcggacgtggaagcgtcccgggaggcgtacgacgaggcccgggcgccgggcgcccgggcctcgtgagcggcgaccgacggactcagccgacgacggtccaggtgtcgcggccggcgaggagcgcggcgaggtcgcccttgccgtgctgttcgacggcggtgtcgagctggtcggccatgagggtgtcgtagacggggcgttcgatgtcgcggaagacaccgatcggggtgtggtggagggtgtcggggtcggcgaggcgggacagggcgaacgcggtggtcggcgaggcggcgtgcgcgtcgtggaccaggaggtcggcctcgttctccgccgtcaccgtgaccaccttcagatcacccgtgacacggtcccgcaccacgccctgcgagccgtccgcgccgaagcggaccggcgctccgtgctccagccggatcagggcctcggccgcctgctgcttgtccttgagggcgtcgaaggcgccgtcgttgaagatgttgcagttctggtagatctcgatgagcgcggtgccggggtgggcggcggcctgccgcaggacctcggtgaggtgtttgcggtcggagtcgatggtgcgggcgacgaacgaggcctccgcgccgagggcgagggagaccgggttgaagggggcgtccagggagcccatgggcgtcgacttggtgatcttgccgcgttcggaggtgggggagtactggcccttggtcaggccgtagatgcggttgttgaacagcaggatcttgaggttgacgttgcggcgcagggcgtggatgaggtggttgccgccgatggacagcgcgtcgccgtcgccggtgacgacccacaccgacaggtcgcggcggctggtggccaggccggtggcgatggcgggggcgcggccgtggatggagtgcatcccgtaggtgttcatgtagtacgggaagcgggaggaacagccgatgccggagacgaagacgatgttctccctggccaggcccagctcgggcatgaagccctggacggccgccaggatcgcgtagtcaccgcagcccgggcaccagcggacctcctggtcggacttgaagtccttcatcgactgcacggcctcggccttgggcaccagggagagcgtctgcgcggtgcccgggccggtggtggacgtctcaggcatcgatggcctccttgagcgcggtggcgagctgctccgccttgaacggcatgccgttgacctggttgtaggagtgggcgtccaccaggtacttcgcgcggaccagggtggcgagctggccgaggttcatctccgggacgacgaccttgtcgtaggccttcaggacggtggccaggttggcggggaaggggttgaggtggcgcaggtgggcctgcgcgatcgcgaccccctcccgccgcagtcggcgcaccgccgcggtgatcggcccgtacgtcgatccccagcccagcaccagcgtcctcgccccgtccgggtcgtcgacctcgacgtcggggacgtcgatgccgtcgatcttggcctggcgggtgcggaccatgaagtcgtggttggccgggtcgtaggagatgttcccggtgccgtcctgcttctcgatgccgccgatgcggtgctccaggcccggcgtgccgggcaccgcccaggggcgggccagcgtgcgcgggtcgcgtttgtagggccagaacacctcggtgccgtcggccagggtgtggttggggccctcggcgaaggccaccttcaggtccggcagctccgtgatctcggggatgcgccacggctcggagccgttggccaggtagccgtcggagagcaagaagaccggggtgcggtaggtgagcgcgatccgcgccgcctccagcgccgcgtcgaagcagtccgccgccgtgcgcggagccaccaccggcaccggcgcctcaccgttgcggccgtacatcgcctggagcaggtcggcctgctcggtcttggtcggcagtcccgtggacggaccgccgcgctggatgtccaccacgaccagcggcagctccagcgagaccgcgagcccgatcgtctcgctcttgagcgccaccccgggacccgacgtcgtggtcaccgcgagcgcgccgccgaacgccgcgcccagggccgcgccgatcccggcgatctcgtcctccgcctggaaggtgcgcaccccgaagttcttgtgtctgctcagctcgtgcaggatgtcggaggccggcgtgatcgggtacgagcccaggaacagcggcaggtcagcctgccgggacgcggcgatcagcccgtaggccagcgccaggttccccgagatgttgcggtagagccccggcgcgaacgccgacgcggccggcgccacctcgtaggagaccgcgaagtcctcggtcgtctcgccgaagttccagcccgcccggaacgccgccacgttcgccgccgcgatctgcgggctccgcgcgaacttcgtctgcaggaacttctccgtcgcctccgtcggccggtggtacatccacgacagcaggcccagcgcgaacatgttcttgctccgctcggcctccttgcgcgacagcccgaacccggccagtgcctgcaccgtcagcgtcgtcagcggcaccgggtgcacgctgtaaccgtccagcgaaccgtcctgaagcggcgagtccgcgtacccgaccttctgcagcgcccgcttcgtgaactcgtccgtgttcacgatgatctccgcgccgcgcggaaggtcgccgatgttcgccttcagggcggccgggttcatcgccaccagcacgtccggagcgtcgcccggcgtgaggatgtcgtggtcggcgaagtgcagctggaacgacgacacgcccggcagtgtccctgcgggcgcgcggatctcggcggggaagttcggcagcgtcgacagatcgttcccgaaggacgccgtctccgaggtgaaccggtcgccggtgagctgcataccgtcacccgagtcccccgcgaaacggatgatcacccggtccagacggcggacgtccttcgctccggccgccttgcgctgctctcctacgacggctccgtcggcctgttccgctggactgctgacctggctggtcactgaactggacctccttcgaggcggctgtttgggaccggccttcccgaagaccctgcgaagaccttcccggttttcaaccctacgaccgtcagggatgccctcccggtgccgatcgcatgctggacgcacccgtgagacggtccgatgccctgctctttcacgccgttccggcccttcgggcctcctttcggacctcctcggcgaaggtgcgtcgcagtcgcccgtccggcgtactcgcgaccggatcggggcccgtaccgccccagtgtcggtcggtcaggagttcagataggtgaggacggcgagaacacgccggtgatccccgtcactctgcgacagcccgagtttcaggaagatgttgctgacgtgcttctccaccgcgccgtcgctcaccaccagctgccgcgcgatcgccgagttggtgcgcccctcggccatcaggcccaggacctcgcgctcccgcggggtcagccccgccagcacgtcctgcttgcggctgcgcccgagcagctgggcgacgacctccgggtccagggccgtaccgccctgggccacccggaccaccgcgtccacgaactcccgcacctcggccacccggtccttcagcaggtagccgaccccgcggctggaggccgccagcagttcggtggcgtaccgctcctcgacgtactgcgacagcacgagcacaccgagccccggatgcgccttgcgcagccgcaccgcggcccgcaccccctcgtcggtgtgggtcggcggcatccgcacgtcggccacgacgacgtcgggcagctctccctggtcgtgcaactccgtgatggtcttgaccagcgcctcggcgtccccgacgccggccacgacctcgtgcccgcggtcggtcagcaaccgggtcaggccctccctgagcagcactgaatcctcggcgatgaccacccgcaccctgtcctccacgatcctcggccccccacagccttctgcctgcttcccggcagcccgcacggccgcacggtccgtccggcgcgtacggactcgtacgacatggtccagcattccagcatccggaccccgccgcggcagcgcgcggcggaaagaaggaggaaggggtatgtgttccgtctgcgttctggccggttccggtcggtgtccggccgggcggcaggccgccgtcgtgcgtctccgtgtgtctccgtgcgtttccccgtgtgtctccctggctctccgcgcgcgctcagcgccgccagggcagttccgccgtcacccgggtggggccaccggccggcgagtcgacgacgaggatcccgtccaccgcgtccagccgttcggccagccccgcgagacccgaccccgaggacacgtcggcgccgcccactccgtcgtccatgacctgcagcagcagccggtcctccacccgccacacgtccaccgccgcggacttcgccccgctgtgcttgctgatgttctgcagcagctcggacaccgtgaagtaggcgatgccctcgatcgccgccgccgggcgctccgccaggtccacctccacccgtaccggcaccgtgcaccgcgaggccaccgaggacagggccgcgtccaggccccggtcggtcaggacggcggggtggatgccgcgggccaggtcgcgcagctcctgcagcgcggtcttcacctcgccgtgcgcctcgtccaccatccgcgccgccgcgtccgggtcctccgtcagcttctccttcgccaggcccagatccatcgcgagggccaccagccgggcctgcgccccgtcgtgcaggtcccgttcgatgcgccgcaggtcggcggcggccgtgtcgaccacgacaccgcggtcggactccagttccaccacgcgcgccgacagccgcgacgggccgagcagcccgtgcaccagcacccggtccaccgtggtcagcgcccggatgatccatggggtggccagcgtgatcagcaggcccaccagagcggtcacggtgatctcgaacgggttgtcgaggtagatctggtggtgcccgtcgccgtacaactggatgccgccctgacctgcccacatcgggaagacccagaaccacagggggtacgtcagcagcatccagccgttcgtccacagcaccaccgcgaccacgaacgagaacaccgcccaggggaactgcagcacggcgtagagcagggcccgccacgagccgccgctcttcagcacggccccggtccaggccagcgggccctggcccttcacgggcagcggttccggttcggccacgtcgaggccgagcagcccgcgcgcccgcacgcgctccagcgcgccgaagccgcggcagcccgccagcgcccccgccagcaccgggatgccgaggaacgtcaccagcaggccggcgcccagcgacaccatcgtgacggcgtacgtgaagagcaggatgccgatcggcaggcccagcagcacgtacgccagctcgcgccagctgcgcgcctcgacgggggcccgc

SEQ ID NO: 759 - DNA, 2864 bp, Unknown
  Kingdom: Bacteria, Phylum: Actinobacteria, Class: Actinobacteria, Order: Streptomycetales, Family: Streptomycetaceae, Genus: Streptomyces
gtcggtgccgaaccgctccgcatggcgccggacgccggcggcgagctgcgccgcgcgctcgggttcctcggtggcgagggcgcgggccaggtcggcggcccagggcaccatgaccgggttgtggtggccgcggacggccgccgccttctcggcggcctccagttcggcgacgccctccttggtgcggcctgcggcgagcagcagcctgccgcggacgctgcgcgggtcggggatcacgatggtggccgggtacggcggggcgaagccgtaccggtcggcgatctcccaggcctcctcgacgtggccgcgggcgagcagggtgtccacgaggttgcaggtggcggtccagtacaggggcagtccgcggccgacccgttcggcgatgcgcagcgactcgcgcagggccgcctccgcctcgcgcagccggccgcgcctgcggtggccgaggccgacgtaggcgtgcgcgagggcgaggtggccgccgttccagtgggcgttctcgtaggcgcgcagtgcttcgttgtagagggtctcggcgcggtccaggcggtcgctgtaggcgtaggcgctggccagcatcagcagcagttcgatgccccactcggtgtcggtccagccgaggccgggggcgagacggccgttgacgagggcgcggtcgcacagttcggcgacctcctcggcgttctcgccgcgggccatggcgtcgaagccgcgcaggatcagcagcgcccgctcggagttgtcgcgtccggtgcatcctgcggcgagttcggcgagccgctcggagcggtccggggtgatggtctcgccggtgtgcaggccttcccacatgtactgcacggcgtgcagccgcagccggacggggcccggtgggtgccgggcggcctcggcctcgatggtgcggacggcgtcctccagctggttgttgtgcagcagtgcctgggagagccgccagacggcgtccacgcggacgccgccgtccaggccgggcatgctgagcgccagctggaggtggtcgatggtggtggccggggaggtgagcagggtggcgcagcccagttcgtagaggacgcgtgcgtgcacgtcgggcgtgggcggctccagcagggcgcgctccaggcagcggcgggccgcttcgggggcgccgacggcgaggtgttcgcgggcggcctgccgcagctgctcgacgagttcctcgtcgtcgtccgggtggacttcgagcagatgccgggaggcggcggccgcgccgagcccggagtcggcgacgacctgggcggcgatgccgtgcatggcggtgcgcagcgcgtccgggatggagtggtagacggcggtggcgatcagcgggtgcacgaactccaggtcgctgtcgccgccccgtgcgctcgccgggtcgggttcggtgaggatgcgggcgcctcgcagcaggtcggcgcagcgcaccgcgtcctcgcggtccatggtggcgagccgggcgacgaggtcgacggagatgccggtgcccaggatggcggcggcccaggcgaaccgggtggcgtcgatgccgagttcttcgaggcgggcgacgagtccgccgccgcgcgcggtgcggttcagctcgcgcagttcgcccgcgtgcgcctcgacgggttcgagttcgctgtcgcgcaccttggcgaggagttcgacggtgtcgtaggggttgccgccggtgaccgcccacacctcgcggcagaacggggcgtcggcgtgcgggccgagggtggtgcgggtgaggtgcgcggtggcgtccggggacagggagctgagggtgtggacgcccgcggcggcggcgacggtctccagcaggcgggcgccgtccccgctcacctctccgggccggcgggtcaccacgaggaggacggacagctcgtcgaggcgttcggcgaaggcggcgagccagcgcaggctctcctcgtcggcccagtgggcgtcgtcgaccatgagcacgagcggccagtcgcgtgcggccagccggctcacggcgtcgacgaggccctcgcagacgctgcgcgggtcggcctgtccctcgccgggttccgctatgccgagggccggtccggcgatgccgtaccactcgccgaggtactcgcgggcctcctcgggcatcagcgacagcagtgcgggctgcagcagttggcgtaccacgttgaacgggacggagcgcaggatctcgccgccgcgcgccgaccacaccgtgcagccgttctcctcggcgatgcggcgggtctcggccagcagagcggtcttgccgagtccggcctcgccctgcaggaccagcagtccgccgcaggacgtgcggtcggcgcacaggtcctccaccgcgcgcaggatggtggtgacttcctcgtcgcgctcccgcagggaggccgaggcgaccgctcccggccgtacctccgtcatcccgctacctccccaagtcgcccgaacgacgtacgggtgccgagcctagccgccgggccgcccgaacggaggccggaccgggcagctgttcccgtcacgggtgacgtgcggtgcgggcgggcgacgcgccgctcccacgacctgcgaaggaaagcatgacatgtcaacaaacgtgtggcggcagcgttgtggtggtccggcggagccctgtcgtggcggtgaaacagagccctctcataccgctttcacggacgcctcatacggtgggggcatgacgcaggtgactcctcccgggtggtaccccgaccccgggcagacaagtgacggtcccgccaccgagcgctggtgggacggcagggcgtggacggaccggacccgccccgccggttcggccgccgtatggggtccgccggcgcagccccccgcccagccggcgcccccggcac

SEQ ID NO: 760 - DNA, 2795 bp, Unknown
  Kingdom: Bacteria, Phylum: Actinobacteria, Class: Actinobacteria, Order: Streptomycetales, Family: Streptomycetaceae, Genus: Streptomyces
tcccgctggacaccgtcgacgacgtccggggagcgttccaggagcatcgcgacgggggtctccgtgccgacgccgagggcggtgaggtgccgggcgagggcgttcgcgcgggcgttgagttcccggtagctgagcgtggtgtcccccgaagcgaccgcgaccgcgtcgggggtggcggcggcctgccgctcgaagagggcggcgaggccgccgtccgggagcgggcgggccgcgtcggcgtcggcgtcggtgtcggccagttcggcgagccggtcggcgggcagcaggtcgagcgtggcgaacgggcggccggtgtcctcggtgacctcctggaggaagtgcaggaaccattcctggcaggcggcgacgtcggcctcggtgtagcgctcggggttgccgtcgaagtcgatctggagaccggtgccgtcgccgcggtcgtacagggcgacggacaggtcctcgacggggccgagtccgaggttggtgaaccggaccggggcgcccgcgaacgtcagctcgtagtcgaacgccatgatgttgacgaccgggcccatcagcgcgccttcgccgccggtgaggccgaggtcgcggcgcaggtcctcgtagcggacgcgctggtgcttgagggcggcgcgcgcctcgcgggtgacgcggggcatcagttcgcgcaggcagtcgccgggcgcgacctcgatgcgcagcggcaccacgttggaggcgaggaccggggtacggcggatcgcgggggtgacgcggccggtgacgggcagcccgacgacgacctcgcgctgcccggtggcgcggtgcaggaacgcggcggtgacggcgaccgcgaacagcggcagacgggtgcggcaggagcgggcggcggcggtgagccggccggcgtactcctgcggcagcctgctggtgcggcggatccgcacggcgtgcggcgcttcaccggtgccggggccgccggacaaccggtcgctgagcagcgcgggggccggcatcccggcgagccgtccgagccaggcctcccgttcccgtacggcgggttcgccggcgcggtaggcggcgtcctcggcgagggtctcggtgagcggcgcgaacggttccagggcgtcggccaccggggcgccggtgaccagttcggtgtaggtgccggcgagccggcgggagatcagcgcaccgccgaagccgtcgatgaggatgtggtggacccgctggtagtacacgtagcgtgcggtgccgacgcggaacagcgcgaaggtggagaggtggcccgcggacaggtcgacgggccgctccatgtcgtcgtgcatccacgcgcgggcggcgccgagcgggtcgtgctcgccccgcaggtcgaagtagggcagggtgggcggcggaccgtcgtcgacgagttgccacaggctgccgtcggggtcctgcacgatgcggcggaccctgagcgtctccgcctccccgagcagcgcgtgccaggcggtctggaggagttccggggcgatctcgccgtcgatgtcgaagtactcggcgatgttgtaggcgcagccggtgcggtcgaggccgtgcgcgaaccagaccccggtctgcggtgccgagagcggcagccgccgcagggccggtccggaagggtcggacgggtgccggttcacgggcgtatccccctgtcggcgagcgtggtgacccgctgcggagcggggctggggacgagggcgggcgacgggtgcagcgccgcggtgagcagggtcatcagctgccgtcctgccgtctccaggtagaagtggccgccgggcagggtgtgcaccgcgtgggcggcgaccgtgtggcgggcccactgggcggcgtcgtcggggccgcaggagcggtcggtgtcgccggtcacgacggtcacggggcaggtgagcggggcgccgggcacgaagcggtacgtctcgatcagccggaagtcgccgcgcaggacgggcagcgtcagctcgcgcacctcggggtcctccaggagggctgccccggtgccgccgagggccctcacgtacgccatggcgtccgcgtcgtcgcggaaggagagggcgcggcgggtgtcgacgtgcggggccttgcgggcggagacgaacaggtggacgagggcgttcgggtgggtcgcgcgcagtcgccgggccgtctcgaaggcgacggtggcgcccatgctgtggccgaggaaggcggccggtctgtcgaggcgcggcggcagggccgcggtgacgccgcggacgagttcgtcgagggtcccggcgagcggctcgccgaagcggtcctgacggccggggtactgcacggccaccaactcgatgtccggcggggcgagccgggccagctcacggaaggtgctggccgcgccgcccgcgtgcgggaagcagaacagccgcagccgggcggacgggcggggcacgaacacccggaaccagtcggcgccggtggcggcctgggcaacagtcatgagcgcggcaactccctgcgggtaagcggcggttcgggaaacggtgaagccccggacgggaatccgtccggggcttcactctgccgggagtgcctatatttttccgttacgcggtctttgcgggggatcaaggacctcgtacggaacgagccctcccggggtcatggtgaccgctcgtccatcaggccggcttgacggtgacgtcaccgcccgagctgtgtgccctgaccttgcgggaggagccgtcgtcgaccgggacggtgaccttgcggctgccgccatcggtgccggcgtcgacggcgtaggagcccttgggcagcgtgaccgtgac

SEQ ID NO: 761 - DNA, 10855 bp, Unknown
  Kingdom: Bacteria, Phylum: Actinobacteria, Class: Actinobacteria, Order: Streptomycetales, Family: Streptomycetaceae, Genus: Streptomyces
tcgaccagtgcgtggcgttcttcggcgtcgactccagcgtccgcttcaccaccgcggcgacctgatcgtcggtgaccgtccgcggcccgccaggccgtggcatgtctccgaggccggcgatccggtgctcgacgaaccgcttgcgccagcggcccaccgcatgcggagtggagttcacctgcgcggccacgtccttgttcgacgcgccggtcgcgcaggccaggatgatccggcaccgcaaagcccacgcctgcggcgtggaacggcgccgcacccatccctccagcgcagaccgttcctcatccgacaggatcaactcagccttcggccgcccagtacgtgccaccaggcaaccctacacatctgaatggaattcccgactcagatgactagaacatcccgccgtccagtcgcagggtgcggccggtcatataggccgcgtcctgcgagcagaggaaggcgtatccggcggcgatctccgggggctcggcgagccgccgcagggcgatcgcggtgtcgagccacgtggacagctgctgtttgccggccagttcggggtgcggatagttgaccgcgttctcggctgccatgtccgtggcggtgccgcccggggcgatggcattgatcgtgatgcccttccggcccagctccgcggacaggttcagcaccatcgactccacggccgccttgctcgccgcgtacagggtgtgacggaagacggccttgcgcgcgctcaccgaggaggtcagcacgatccggccgcccgctcgcatgtgtgacacggcatgctgtacggcgaacagctggccacgcgtgttcacggcgaagacgcggtcgaagtcggccggcgtgatctcctccagggcgtcgaaatgttcgatgccggcacaggaggcgagcacgtcgagccggccgaactccgccaccgtccggtccatcagtgacctgctctgttccggatcggcggcgtccgcccgcacggcgatcgcccggcctccgcccgcgaccagctcggccaccacggcgtccgcggcctccttgttctcccggtagctgatcgcgaccgccgatccctcctcggccagccgcttcgccacggccgcaccgatcccgcggctgccgcccgtcacgaccgccaccttgccttcgaaacgtgcccgctgcagggatgacaccgcttatctcccctctgatgtgtgccgagtctccggtctgtgccgagctgatgcgtgcggaacgcgagtctcgtccatgagcgacgtggccggtatgcaggaatccggccaaccgggtcgtcagctcttgcggcactgcacgttcgacctctccgactgttgaaaccgcacaatcccttgctctcgaatcggtcgcctcctgccctgacttccccttcgcacgctggcatgatcaccgtaagggcaagtcaggcgttctgtagcatccacacaattctaggaggctcgtgtgacccgtaacggtcgtgtgctggtgaccggcgccggggcgatgaccccgctgggggccgatgcgccgtcgtcgtgggcgggactgctggacggcaggtcgggggtgcgtctcctggaggaggagtgggccgcggacctgcccgtgcacgttgcggccgggctgaccgtcgaccctgcctccctgcttccgcggaccgaggccaggaagctggaccgcggtgagcagatcgccgtcctcagtgcgcgggaagcctggcgggacgccggtgctccgcaggtcgagccggagcggctcgccgtcgtcatcggtaccgggaccggcggtgtcctcaccacgctgggacaggacgacgtcttcgaacgcgccggtgttcgccggctgtcaccgttcgcggtcccgatgctgatgcccaacgggccggctgcctgggtgagcatggacctgggcgcgaagggcggcgcgaggactccggtgagtgcctgtgcgtccggggcggaggcactcgccctggggcaggatctgatccgcggcgggcgggcggacgtggtcgtcgcaggtggcgtcgaggcgtgcctgcaccccttcaccatcgcggcgttcgcccagatgaaggccctgtcgacgcagtccgtggacccggagaccgtgtcccgcccgttcgacgtcaagcggtccgggttcgtcatgggcgagggcgccgggatgatggtgctcgaacgcgacgagttcgcccgggcccgcggagcacgcgtctacgggacgctggccggcagtgccgtgagttcgagcgcgcaccacatcacggcctccgacgcggagggccaggccttcgccatggaactggcgctgcgcgacgcgggattgaccccggaggacatcggggtcgtgcacgcccacgccacctcgacggagtccggcgacctggcggaggccgcggcgatcggccgggtgctcggcagtcgtgccgcggtgacggcgacgaagtcgatgacaggacacatggtgggtgcgtcgggaacggtcggcgccatggccgctctgttcgcgctcagggacggcacgctgccggccacgcgcaacctcgacgaactcgacccgcgcgtggaactggacgtggtgcgcggtgagccgcgcaccggtgagtggaccgccgcgctggccaactcgttcgggttcggcggacacaacgtcagtctcgtcttcaccgcttcacgggccgccgatgcccgtgccgagcagacccagcgctgagcacagggaagcggagagcgtcatccacgcgatgaacgccccgccgccgcagagcaccgcacggggcacgcttccgtccgatgcccatgacagcacgcctgcgacgaccgcgaccagcagggacagggcgcttgccagggcgacgagcaggatccgcgccgagagtccggaacgcggacgcccacatccgcagcccgtaccggccggcctccggccggctcccgccgggcgtcccccgccgccgcatgctgtgcgatggatcctcgtgtgcgccgcgctgacccgggcggcaccgacggccgacacgtgtgccgtcggtgccggccacacgtagatgatcagcccacccggagacctccccggtcgtgcgaagccgtccgacgcctgtccgatgcctgtacgccgtccggggcccgtccggggccctccgctcaggcgtcctgcatgcggcgggccgatgcgcggtggcggcgcagggtgtcgtccaggccggggacgcggggttcgccgttctcgacgaggaagcgtccggcggtgatggtgtgccaggcccaggcggggccgcagttgaggagcgcggtgacggggtcgccgagggcaccggcgtagggcagggtgtccagccgccagaccgcgaggtcgccgcacgcgccggggcgcaggacgccgatctcgccgtcccggccgatggcgcgggctccccctcgtgtggccatccacagggcctcgcgtgcgggcatggcgtcggcggtctggccgcggagccgggccagcagcatggcggtcttggtctccatccacaaggactggtggtcggcggccgtggctccgtcgcagccgatgccgacgtcgatgccggcgtccagcatctcgcggacgggggtggggccgccgggcagaccgccgccgatcacggtggagctggggcagtgggcgacgccgacgccgcgacgcgcgagcagcgccatctcggcggcggaggggtagacgacgtgggcgcaccaggtgcggtcggtgagccagccgagttcgtcgaggacctccagcggtctgcggccgtagcgggcggcgacgaactgctcctcggccgggtcgtcggcgacgtgggtgtgcagccggacgtcgaggcggtcggccagctcggccgtgcgggtcatggtggagcgggtgcagctgagcaggttggtggggccgagggcgacgcggaccatggacgccggacgggggtcgtggtgggcttcgaccagccgttcgcagtcggccaggaaggtgtcctcgtcctcggccaggtggtcggggcagatgccgccgtggcgtgcgcccatggtcatcgcgccgcggacggcggtgaaccgcatccccagttgggcggcggtctcgatctgcgcgtcgagcaggcggggccgcggatggaggtagaggtggtcgaccgtggtggtgcagccggaccaggcgagttcggccatgccgacggtggtggacagccgtacggcttcctcgtcgagccgggaccacagggagaagtagtgccagaaccattcctccaggctgccgtcggcttccggccggccgccggatctggtgaggttctggtagaggtgctggtgggcgttgaccagtcccggggtcaccaggcagccttgcgcgtcggtcaccttcctggcgtcgggcggtgtgtcggcgggtccaccgagggcggtgacgatcccgtcggtgaccgcgacccagccgccgggcaggtcctcgtgcgtctcgtccatggtgacgaccaggtcggcatgccggatcagcaggtcggcggtcattcgtcgtcgccctcgccctcgtcgttgtcgtagtcgtagtcgtagtcgttcaggatggccagcgcggcggtggtcgcggcgaccgggtcgccgtcgcgtacggcctcgaacagcgcggtgtggaacgggtcgtcaccggcgtcgtccatgcactggttggccttgacggtctcgcgcagggcgtcgctcaggctgcggtagaggttgccgagcagcgggttgtgcgaggcctcggcgatgcgcaggtggaagtcgacgtcggcgtcggtgaacgcgtcgaggtcggcggcgcggcccgcggcggtgcggcgttccatggcctcctggagcgaggcgaggtcttcctgggtgcgggtggcggcggccagccgggccgcgacgatgtcgagtccgcggcgcacgtccagcatgtcgtcggtcttggagcgggtgaggtggcggcgcagggcgacctgtccctcgtcggtggcggtcacgaaggtgccgttgccctgacgggtggtcagcaggccggcgtgcaccagtacgcggacggcttcgcggaccgagaggcggctcacctggagcgtctcggcgagccggctctcgctggggatccggtcgccgacctgccaggtaccccgcgcgatctcgtcgcgcagttggttgatcacggtgtcgacgagcgacacccggctgacggattccatccgaccccttccttagtcatctgatgacctgataaccatatggatcactccggaccaaggtccagccttctctccgaattcagcctgctctgccacgcatccagcctgctctgccccgcattcagccttctctcccttgttcactctgttcaagggagctttctcgagggagctttctcatggcccctgtcctgttcacccgggtccgcccgcacggcggcaccctctgcgacctgctggtcaccgacggccgcatcacggcggtagatcccggaaccccgccgacgggctgtcatgtcgtcgacggcggcggcgcgctcgccctgccctcacccgtcgacgcgcacatccaccccgacaagaccacctggggccggccctggctgccgcgcgagccggcccggagcctgcgcgagctgatcgactacgacgtcgccgcccgggcgcggatgaccaccccggtcgaggaacgcgccggcgccctcctcgcccatgccgtcggccgcggcacccgggccatgcgcgcgcactgcgacgtcgcccccgtctacggcctgtccaacgtgcacggcgtacgggccgccgccaccgccttcgcaggcgccctggacctgcaggtggtggccttcccgcagctcggcctgctcaccgagcccggcaccgccgacctgctcgaacagtcgctgaaggaaggcgccgacgtcatcggcggcctggacccggccggcgtcgacggcgacctggacggccacctggacaccctgttcgccatcgccgggcgcaccggcgcacccctcgacatccacctccacgaccgcggaaggaccggcctcgaccaggtcaccgagatcgcgcgccgcacgacggcggccggcatgcacggcaaggtcaccatcagccacgccttctgcctggccgactgcggggccgccgagctggagcggaccggcgagctgctcgcggaagccggggtggcgctgaccacctgtgcgctcggcagcgaacccgtcgtacctttcccgccgttgcgcgaccagggcgtgctggtggccgccggttccgacggcgtacgggacgcgtggtcgccgttcggcgacggggacatgatcacgcgggcgcatctgctcgcctaccgcacggacgcgcgcaccgacgaggaactggcggcgtgctacgccgtcgtggcgcacggcggtgcggacctgctcgggctggaacgagccgacctgcgcgtcggtgacccggccgacttcgtcctgctcaccggtgagtcccccgcgcaggtcgtcgtcgaccggccggtgcccgacctggtcgtacgggccggcgaggtcgtggcccgccgcggtcacgtggaggggggcggccgatgaagcgccgaaccgcgcccctgctcgccggttgcctcgcactcggcctgaccgcctgcgccggagccggcgtgggcgcagggcagccggccccgggaccgctcgatctgaagaccacgactgcgcgggccaccgaaggcctggacaagatcacctggaacctggcgtacgagccgcagaccctcgaccccatccgctccttcaactactccgagaacaccgcgctcgccaacatgtgcgagagcctgctgcggctcacgcccgacctgaagatcgagccggggctggccgagaaggccgcgaacccgaccccgaccacctgggtctacacgctgcgcaaggacgtgacgttctgggacggtcaccggctgaccgccgacgatgtggcggccagtctcaaccgccacctcgaccccgcgctgggcacctggtggagcgactacttcgagaccgtcaagtcgatcagggcgaccggtccacggcaggtcaccgtggtcctcaagcagccggacgtgctgttcaaccaggccatggccaccgccgccggggcgatcgtggagaagtccttcctcgcccgggccggcaaggacctgggctcgcccgggaccggggtcatgtgcaccgggccgttcaggttcgcgggctggaagtccggcgactcgctgacgctgacccgcaacgacacctactggaaccccgcgctcagggcgacctcgaagtcgctggtgttccgcttcatcgccgacgagacgacggccgtgaacgcgctgcgctccggccagatcgacggccagtacttctacctgccgcccgccggactcagccggctccgcacctcgcccaccggatcggtcaccctgggccgttcgctcaccttctgggccctgctcggctccgccaggacgggtccgtacgccgacccgcgcgtcagggccgccctgtctgccgcactggaccgggccggcatgagcaaggtgatcttccagggcgccgccgaacccgaacgcgccctggccaaccccgactactggggttacgccacccacaccttccgcacctcctacgacgccctgccgatcggtgccgacgccgacctggccagggccaggaagctgctcaaggaagccgggacgcccactgagcccatcaccatcggcatccagggcagttcggcggtgcacgagcagaccgccgacatcctcaaggccaccggcgaagcactcggcctcaccatcgacatcaaggtcatcccggtcgagcagtacggcaacctctacagcgaccccaagtcccgggacggcatcgacgcctttctcagcacctggtacggcaacatccccgaccccctggacgtctaccgggtcttcaccaagggcggccggtccaacttcgacgactacccgtcggtcgacgccgacatcaagaaggcccaggccacctacgacccggccgagcgtgccgcgctcgtcaccggcatccaggccaaggtgacccgggacgtgccctggacgccgctcaacgacctgcccgtcatcctctacatgaacaaacgggtcaccggcgccgtcgcctccttcccgtacctgtactacccctgggcagccgggctcggtgcgcgatgacctggaccctcttcctggcacggcggctggccgcgctcgtggccgtgctcctcatcgcctccttcctggtgtacgggctgctctacctggtccccggcggtccgatggccttcctgctgggcaaccgcagcggcagtcccgaacagatcgcggcgatccggcacgagtaccggctggacgacccgttcctggtgcgctacctcggctggctgggcgacgcgctgcacggcgacttcggccagtccctggtctaccggcagggcgtcgacgagctgatgtccgcgcgactggccaccaccgcgctcctcgtcctctactccaccgtgatcatcgtggtggcgggcgtcgccctcggcgtcctcggcgcactgcgacgcggcgcggtcgacacggtgatctccgtcgtgaacagcgtcttcctggccacccccaccttcgtcgtcggagtcctgctggccatcgtcttcgccctggacctcggctggttcccggtgttcggggcgggcagcggcctgctcgaccgcctctaccacctgacgctcccggcgatcgccctcagcctgggcagcgccgccttcctcgcgcggatcacccgggcctcggtgggcgaggaactgcgccgcgaacacgtggagaccgcacgcagccgcggcttctccgagcggcacatcgtgcgccggcacgtcctgcgcaacgcgtccgtccccgtcgtcaccgtcaccggactcaccgtggccggtctgatcgccggctcggtcgtggtggagaacatcttcgccctggacggcctcggctccctgctcgtacgggccatcctccagcgggacttcgcagtggtccagggcgtggtcctggtcctggtcaccgcgttcgtcgtgatcaacctgctggtcgacatctgctactccctcatcgacccgcgcctgtctcccggggaggcgacatgaaggcacgcctggggcccctgggcctgaccgccgcggtgctgctcggcctgatcgtgctcgtcaccgtgtgcgcgccgctgctcgcaccgcacgatccggaccagccggacctcgtcaacgcgctggccggcaccagcgcggcccacccgctcggcggcgacgcgctcggccgggacatcctgtcccgcctgatgtacggcgcccggaccaccctgctgggcccgctcgtcgtcatcgcgctgtccacggcggcgggcaccgtcctcgcgatcacggccgcatggaccggcggccgcgtcgacgcggtcatctcgcgcctgctggacgtgctgttcgcggtaccgggcatcgtgttcgcgctcgtgaccgtggccgtcctcggtccgggcatgaccggggtggtcgccggtctggccgtcgcctacaccccctacgtcgcccgggtcgtccgcgccgcggcactgcgggagcggcggctgccctacgtggccgccgcctgggtccagggcagaccggcgctggccatctgcggccggcacctgctgcccaacctccggccgatcatcgtggcccagtccgtgtccgcgctcggcttcgccgtcatcgacctggcctccatctccttcctcggcctcggcgtacagccgccggacgccgactgggggctgatggtgaagagcggactggacagcgcggtacgcggccagccgaccgaagcggtcagcgcgggcctgctgatcgcactcgtggtggtggcggtgaacgtgctcggcgaccggctcggcagacaggaaggtgatcaccggtgagcaaggacctgctcctcctggaccggctacggctcgaagtcccctccggccgtgactggcggacactcgtcgaggacgtcagcctgaccatcgcccccggcgaggccgtcggcctggtcggcgagtcgggatccggcaagtcgatgacggcccgctccgtcctcaggctgcttccgccgggtgcccggctcggcggccggatcgagttcgacggcacctccctacgggagttgaccccccgggagctgcgcgccctgcgcacgcgccgcatcgcgatggtcttccaggacccgcgggcacacatcaacccggtccgctccatcggcgacttcctcaccgaagccatggtgaccaacctggcggtgcccccacggcaggcgcacgccaaggccgtacggctcctcgccgacgtcgggatcaccgacggcgagcggcgcatgcggcagcatccgcacgaactgtccggcggactgctgcagcgcgtcatgatcgcctcggtgctggccgtggaacccgacctggtgctggccgacgagcccaccaccgcgctggacgtgaccacccagtccgaggtcatggccatcctggacgagctgcgcacggaacgcggcatggccctgctgctgatcacccacgatctcgaactcgcggcggccacctgcgaccggctcgccgtcatgtacgcggggcgcatcgtcgaggtccagtccgcccagagcctcgtccggtccccccgccacccctacaccagcggactcatgacctcgcggccccgcatcgatcacgtcgcaccacggctgcccgtcatcccgggccggcccgtcgccgccttcgaggccggcgagggctgcgccttccagccgcgctgcgcccactccgaggcgcggtgcctgac

SEQ ID NO: 762 - DNA, 3889 bp, Unknown
  Kingdom: Bacteria, Phylum: Actinobacteria, Class: Actinobacteria, Order: Streptomycetales, Family: Streptomycetaceae, Genus: Streptomyces
cggccggcctcgacgaggccgaggaccaggctggtggcgccgagcagcgggaggccgtggctgtccttgacgacgtcgatgacgtcctggacggagtgggcgtgggcgagggcggcggtggtggtctgcacgatgttggtctgctcgcggcgggcggcggcccgggcggcccgctcctgccggcccgcgatgtcgtcgagttcctcggtggcgtcccggatgatcccgatgatccggtgcgggcggccggcgtcgtcccggcggatgtagccctgggtgtggatccagcgcagggtgccgtcgcggcggcgcaggcgcatgtaggtgccgtagttctccctgccctccttcagggcacgggccaccatggcgtccaggcggcggccctcgccgccgggaacccgctgggccagggtctcggggcggccgtcgaactcctcgggggtgaggtcgaagatcttgtgggtctgcgcgtccatgctgagcagaccggtgtccaggtcccagtcgaagctgcccatgcggttgagtgccaggatcgggtccgggtgcgcgggccagtcgtccgggagtgacagggcgtgcgctccccgttcagccatgggcccaccttgccagggtttgcctgattcttcgagtggggagcgggggaacccttggaggaccgggggaaccggcgacaagaggagcgtgcacggccgtgggatggttcaccgcacccgactactggctgacgcggttggtgttccagcgggcgctggccgcggtgtacctcgtgtcgttcctgacggcggccctgcagttccgggcgctgctgggcgagcggggcatgctgccgatctcccggttcgtggcacgggtgccgttcaggagggcgccgagcctgttccacctgcgctgttcggacgggttcttcgcaggggtggcctggggcgggtgcgcggtgtcggcggtgctgctggcggggctggacgggtggctgccgctgtggggctgcatgctgctgtggctggtgccgtgggcgctgtacctgtcgatcgtgaacgtcgggcagacctggtacggcttcggctgggagtcgctgctgctggagaccgggttcctggcggtgttcctgggcaacgacgaggtggcgccgccggtcgtggtgctgttcctgctgcgctggatcctcttccgggtggagttcggcgcggggctgatcaagttgcgcggcgacgcgtgctggcgaaacctgacctgcctgtactaccaccacgagacccagccgatgccgggcccgctgagctggttcttccaccatctgcccgcgccgctgcacaaggtggagacggccgcgaaccacgtcacgcaactgatcgtgccgttcctgctgttcacgccgcagccggtcgccacggccgccgcctcgctgatgatcctgacccagctgtggctggtgctgtcgggcaacttcgcctggctgaactggatcaccatcgtgctggccctctccgccgtccgctggccgggcggcccgccgtccccggtgcccgcgacaccgctgtggtacgaggtggtggtcctggccgtcgccgcgctgctggtgggtctcagctaccacccggtgctgaacatgatctcccggcgccaggtcatgaaccgctccttcgacccgctgcacctggtcaacacctacggggccttcggcagcgtcagccgggtccgctacgaggtggtcgtcgagggcacgctggacgaggtgccgcgtgaggactccgactggcgggagtacgagttcaagggcaagcccggggacgtacggcactggccgcgccagttcgcgccgtaccatctgcgcctggactggctgatgtggttcgccgcgctctcccccgcctacgccggtccgtggttcggcgcgctggtggagcggctcctggagaacgaccgcgacacgctgcggctgctgcgccgctcgcccttcccgcccggcctgccgccccgctacgtccgcgcccgtctgttccgctaccggtacacgacctggcaggagctgcgcgccaccggagcctgctgggaccgtacgtatgtgcgggagttcctggcgccgacgcggctggcggggacggcggggcggggctgacggggacccgtcgccaggccttggcgctcctgacgggagcccttgtcagaccctggcgctcctgtcgggagcccgttgtcagaccctggcgctacggtctgtggcatgagagctacgggcactttcaccgtgcggtccttcacgccggccgacgtgaagccggacaccgacgtgaccaccggcctgccggtgggcgtcgccaccatggagaagcggttcgagggcgagatcgacggtcgctcggcgaccctgttcaccgccgcgtacgaccaggcgacgggcgtgggcacgtatgtcgccatggagtccttcgagggcagcctgcacggccggccgggcgccttcaacttcgtccactcggccacgacgacgggcagcgaccgcagcgcggagttcttcaccgtcgtcccggcgagcggcacgcgggagcttgccgggatacgcggcagcggcgggctgaccgtggacgcggacggcacgcaccggatctggttcgactacgagctggactgagccagtccgtagacgcgggtggccgttccgtcgaagaccgccgcgcgctcatgctcgtcaagcgcggcggtcagcccgcgggcggtgtccatgacgcgcccgtacggcgccgccagggtgcacaccggccagtccgagccgaacatcaggcggtccgggccgaaggcgtccagcaccgtgtccgcgtaggggcgcaggtccgcggtggtccagcgggccgggtccgcctccgtgaccaggcccgacagcttgcagacggtgttgggcagcgcggccagcgcgcggacggcacctgcccagggttccagggcgccggaggcgatgggcggcttgcccaggtggtcgaggacgaaggtcagctcggggtggcgggccgccgcctcggcgcaggcgggcagctgctgcgggacgacgaccaggtcgtacacgaggcccgccgcggccactgcggccagtgcgcggccgacgtccgggcgcagcagccagcgggggtcgggttcggactggacctggtggcgtacgcccttgaggtaactgccgccgggcagggagcgcaggcgggccagttcgtcggcgatgtccgggcgggtgaggtccgtccagccgaccacgcccgcgatcagcgcgtgggcctcggccagggccaggaactcgggggtctcctcgggcacggtgaccgtctggacgaggaccgtgcggtcgatcccggccgcgcgggcctgcggttccaggtcggggagcgtgaagtcgcgtcgcagtggccgcagctcggggccggtgatccagtcctggtcgcgtaccgacaggtcccacacgtggtggtgggcgtcgacggtcacggcagttcccagacgacgggcaggcccgcgtcggcgccgtcacgggagtagtcgtgcacgacgtcgagcagttcggccatcctggtctgccaggccacgttgacgggcagcttctccagctcggcgaggagacgggcgtagtcctcgcactccaggaggtggaagaggtcgcatccgctgcgccagatggtccaggaggtggcgccggcggcgcggatggcggtggtgagttcgggcgggacctcgcgatgggcggcctcgtaggcggcgacgcggtcggcgcggaccttggtgtgcagggcgactctcatgacggctcctcggggggcagcaggcccgcatcgcgcagctcccgccagagggcggcggggacgggggcggcgaactgctcggcgcagtcgcgtacttcggc

SEQ ID NO: 763 - DNA, 6228 bp, Unknown
  Kingdom: Bacteria, Phylum: Actinobacteria, Class: Actinobacteria, Order: Streptomycetales, Family: Streptomycetaceae, Genus: Streptomyces
ggcggcggggcgcagacgccgcccaggtccttcgcgcggaccgccttggtgatccaggtgcggtccaggacgcggcgctcgtcggcctcggcgaccaggtcctcggactggttgtagtcgccgtcggcggcctgtacggcccacaggtggacggcgacgccgtgctccttggcggccatcatgccgggcagcagatcaccgtcgccggtgacgaggacgacgtccgagcaggcgcggttgcgggccagttcggtcagctcggcgtgcatggcggcgtccacgcccttctgcgcccagcgcccgtcgctgcgggtgagcgcgccgagccggacggtgacccggggcatcacgcgcagcctgcggtgctcgggctggggtacgcggtcgggggcgccgtcgaaccagtagatgcgcagcagcggccgctccgtctccgactcggcctgttcgcgcagcccctggatgagcgcggtgtggtcgacggtgatccgggaccgcgacggctcaccggcgaggaggctcgcggcggcccccagcaggtacccggcgtccaccaggacgatgcagcggtccacgcgatccaccctctttccggggaggttgctcagggaggtgcttcgggcttctttcgagtctgcccgacggtgccggggttaacggcccgaactcgatcttcggcgtggcgtttcgggggtccgcggcccgatgagccttgttacatacggtaattatccgacatgcgttcattgtcggcatatgtgaatctggtcgcggccctggccccgagatcccccacaggaggttgatcaccatggccaagaaccgcaagcaggaccgcagccggcagaaggcgaccgtggccgcgaacggcccgcgcgagacggagcactccgtgacggaaccacagcccgaacaccacgctccgcagctcagtccgacggacgtggcccgcaagggccggcagaagcgcttcggccacaactgagaccggcgcgagggccgttgagcgggccctggcacccacgaggggcgtacccgatgcgcacgggaacgcccctcccctcttcttctgggctcggttcgcctccgggacgcctgagccggcgccgggaccacggccgtgctcagcccttcgggcctccacgcgctcgtggtgccggcgccgggaccacggccgtgctcagcccttcgggcctccacgcgctcgtggtctcaacaccggcgcgccccttcggctcactcgccgcagccggtcagcccgccaggtcagcccgccaggcaggaggggcccagcagcaccttgaggtcgccgaagagcgcggggtcgggcttgacccggtgccggtccaggcgcagcaccgtcgtcttcgacgggccctggagcttgatgcggacctcgctgtcgcccttgtggtgggtgaggatctcgccgaggcggctgaccatgggcggggtgacgcgggtggccgggatggtgaggaccacgggcgcgttggtgcccgcgtgggacaggtccgggacctggagttccatggcgaccaggcggggcacgtcctcgcgcttgtcgaggcggcccttgacgaacaccacggcgtcctcgacgagttgggtggacaccagctggtaggtcgccgggaagaacatgcactcgatggagccggccaggtcctcgacggtggcgatcgcccaggcgttgccctgcttggtcatcttgcgctgcaggcccgagatgatgccgccgatggtgacgaccgcgccgtcggcgtgctcgccgccggtgagctgggcgatgcccgcgtcggccttgtcggagagcacgtgctccaggccgaagagcgggtggtcggagacgtagagaccgagcatctcgcgctcctgcgcgagcaggtaggtcttgtcccactcctcggtggtgaactccacgtcgagtccgaagccgggctcgctgctggtctcctcgcccatcccgccgaagaggtcgaactggccctcggcctccttgcgcttgaccgcgaccacgttgtcgatcatcggctcgtactgcgcggtgaggcccttgcgggtgtgccccatggtgtcgaaggcgccggccttgatcagcgactcggtggtgcgcttgttgcagaccaccgcctcgaccttgtcgaggtagtcggggaacgaggagtacttccccttcgccttgcggctcttgatgatcgactcgacgacgttggtgccgacgttgcggacggcggagaggccgaagaggatcacgtcgtcgccctgggcggcgaagttggactccgactcgttgacgttgggcggcagcaccttgatgcccatgcggcggcactcgttgaggtagaccgccgacttgtccttgtcgtccttgacggaggtcagcagggccgccatgtactcggcggggtggttggccttcaggtaggcggtccagtacgacaccaggccgtacgcggccgagtgcgccttgttgaaggcgtagccggcgaacgggaccaggacgtcccacagggcctggatggcctcgtcgctgtagccgttcttcttggcgccggcctggaagatggtgaagttcttcgccagttcgtcgggcttcttcttgcccatcacgcggcgcaggatgtcggcctcgccgagcgagtagccggcgatgatctgcgcggccttctgcacctgctcctggtagacgatcaggccgtaggtgacggccaggacctcttcgaggggctcttccagctccttgtggatcggggtgatctcctggaggccgttcttgcgcagcgcgtagttggtgtgcgagtccatgcccatggggcccgggcggtacagcgcggagacggcggagatgtcctcgaagttgtcgggcttcatcaggcgcagcagcgagcgcatggggccgccgtcgaactggaagacgccgagggtgtcgccgcgctggagcaggtcgaaggtggtcgggtcgtccagcggcaggctcaggagatcgatgtcgatccccttgttggacttcaccatcttgacggcgtcgtccatgatcgtcaggttgcgcaggcccaggaagtccatcttcagcaggccgagcgactcgcagctcgggtagtcccactgggtgatggtcacgccgtcggtgtgccggacccacacagggacgtgctcggtgatggtctcgctggacatgatgacgccggcggcgtgcacgcccatctgccgcaccaggccctcgacgcccttggcggtgtcgatgaccttcttcacgtccggctcgttctcgtacatcccgcggatctcgccggcctcgctgtagcgcgggtgcgaggggtcggtgatgccgttcaggtcgatgcccttgccgaggacgtcggcgggcatggccttcgtgaggcggtcgcccatggcgtacgggtagcccagcacgcgcgcggagtccttgatcgcgttcttcgccttgatcttgccgtaggtgccgatcatggcgaccttgtcggcgccgtacttctccgtgacgtaccggatcacctcgacgcgcctgcgctcgtcgaagtcgatgtcgacgtcgggcatggagacgcgctcggggttgaggaaccgctcgaagatcaggccgtgcgggatcgggtcgaggtcggtgatgcccatggcgtaggcgacgatcgaaccggccgcggagcctcggccggggccgaccgcgatgccgttgttcttggcccacatgatgaagtcggcgacgacgaggaagtagcccgggaaccccatctggatgatgacgtccatctcgtactcgacctgcttctggcggtcctcggggatgccgccggggaagcggcgctccatgccgcgccggacctcctccttgaaccaggtgacctcggtgtagccctcggggatgtcgaacttgggcatgaggtcgcgcttctcgaacatgcccgtggtgtcgaccatctcggcgaccaggagcgtgttggcgcagccctgctgccaggcgtccgaggagtcgatggcgtacatctcgtccgtggacttcaggtagtagccggtgccgtcgaacttgaagcggtcggggtcggagaggttcttgccggtctggatgcacagcagggcgtcgtgggcactggcctcgtgcgcgtacgtgtagtgcgagtcgttggtgaccagcggcgggatgccgagcttcttgccgatctccaggagaccctcgcggacccggtgctcgatgtcgatgccgtggtccatcagctccaggaagtagcggtccttgccgaagatgtcctggtagtcggcggcggccttcagggcctcctcgtcctggcccaggcgcagccgggtctgcacctcgcccgaggggcagccggtggaggcgacgatgcccttggaccactgggcgatggtctccttgtccatgcggggccacttctgcagccagccctcggcataggcgtcggaggagagccggaagaggttgtgcaggccctccctgtcgaccgcccacatcgtcttgtgggtgtaaccaccggaaccggagacgtcgtcccgcttctggtgcggctggccccagcggaccttgcgcttgttgcgccgggactcgggggcgacataggcctcgatgccgatgatcggggtgaccccggccttcttcgcggagtggaagaagtcgtacgccccgtgcaggttgccgtggtcggacatggcgatgtgcgtcatgcccatctcgttgcacgcgtcgaacatgtccttcagccgcgcggcaccgtccagcatcgagtactgggtgtggacgtgcaggtgcgtgaacggcggcttcgacacggtgcggcctcctgggatacggatcggcgacgggctgcggacggtctgggggtcagcgtcgaagtctatgccccggcactgacacccggcggcccgccgggcgtgccgtgggccggaggctcgccgggagaaccgggcgctcccccgcgacaccgaggacgacgacgagcgtgaccccggacgtgacctcgaacaccagaaccgggcactccttcgtgacgtcggacgttggtggtggaggagatccgcccgtcatgtcacgcaccacccgcaccaggaggcaccccgcgatgtcggtcacccagctcagcgacgagcagcgcggcgaggagatcctctccgtcttcgacaccgccttcggcgagctgctggccgccgacccggccgcgttccgcgtgaagttccggaagatggcctcctccgccttcgcgttctaccggggcacggcgtgcctcttctaccacgacctggcggccgggaacgccgggccggacggcgcgcgcacggccggcggcccctacctggacgagcgcacctcgcgcgtgtggatccacggcgacctgcacgcggagaacttcggcacgtacatggattcgaacggccgtctggtcttcaacgtcaacgatttcgacgaggcctacgtcggtcccttcacctgggacgtcaagcgcttcgccgcctccatcgccctcgtggggtacgccaaggcactcagtgaccggcagatcacggagctggtgacggtctacgcgagcgcctaccgcgagcggatccacgccctggccaccggcgccaagagcgacgaggtgccgccgttcaccctggacaccgccgagggcccgctcctggacgcgctgcgcgacgcccgctcgctgacccggttctcgctgctggagtcgatgaccgagatccgcgacttcgagcgccgcttcgcgcccggcggcggctccatcgagctggacgcggccacccgctacaaggtgctcgccgccttcgacggctacctggagaccctgccggagtcgtcgctggcccgcccggactcctaccgcgtgaaggacgtcgtgggccgccggggcatcgggatcggctcggccgggctgccgtcgtacaacatcctgctggagggcaacagcgacgccctggagaacgacgtcgtgatctacatcaagcaggcccagaccccggccgtctcccggcacgtcacggaccgggcgatccgcgactacttccagcacgagggccaccgcacggtgatctcccagcgcgccctgcaggcgcacgccgacccgtggctgggctggaccgagctggacggcgccgggcagctggtggcggaggtctcgccgtacgccgtcgacctggactgggaggacatcgacgacccggaggagatcgcgcaggtcgtcgccgacctcggcc

SEQ ID NO: 764 - DNA, 3000 bp, Unknown
  Kingdom: Bacteria, Phylum: Actinobacteria, Class: Actinobacteria, Order: Streptomycetales, Family: Streptomycetaceae, Genus: Streptomyces
cgacaagaccgccaccccggccgccccggacaaggcccgcgtcaccgccgccgcgggcggcgacctccgcctggcctggcaccaccgggcgccgggcacggtccgccactacaccgtgcaccgcgtcctgcccgacggcagccgccgcttcctcggcgccaccggccagcgggcctacttcgccgccggcctcactcccgtcccgggtgagcgagccgtacggttcgcggtacgggcggtgggggagctgtacacctcctcggccgccgccaccgtcacccacccctggtaaccaccagccgatcccccgctgaagcacgacctacggagcattccgcatgcatgacgaccgcagcctggtcgaagcccgcctcaagcgcgtcctcgacgagcgcatccgccccgccgtgtaccccgagtccgtccctctggacgtcgcggtgtggcacgcgcccggcgagcccgtgccggtggccgagggtctggccgccgcgcccgagccgatcgaggccggcgcccgctggggtgctccgtggggcaccagctggttccgggtgaccggtaccgtgcccgaggagtgggccgggaagaccgtcgaggccctgctcgacctcggcttcgacgagaacatgcccggcttccagtgcgagggcctggtctaccggcccgacggcacccccgtgaagggcctcaacccgcgcaaccagtgggtcaggatcggcgcccccgtcgcgggcggcgaggaggtgcgcctgcacatcgaggccgcctccaaccccgtcatcctcgactaccaccccttcctgcccacccagctcggcgacaaggagaccgcgggcagcgacccgcagtacacgctgacccgcatggacctcgccgtgttcgacgagaccgtgtggcagctcgtcatcgacctggaggtgctcggcgagctgatggccgagctgccggccgactcccagcgccgctacgagatcctgcgcgccgtggaccgggccctcgacctggtcgacctccaggacgtcaacggcaccgccgaacgcgcccgcgcccagctcgccggcgtcctctcagcgcccgccgtgccctccgcgcaccgcatcagcgcggtcggccacgcgcacatcgactcggcgtggctgtggccgctgcgcgagaccgtgcgcaaggtggcccgtacgacgtccaacatgaccgcactcctggaggacgagcccgacttcgtcttcgccatgtcccaggcgcagcagtgggcgtggatcaaggagcaccggcccgaggtgtggacgcgggtcaagaaggcggtcgcggacgggcggttcgtgccgacggggggcatgtgggtggagtccgacaccaacatgcccggctcggaggccatggcccgccagttcgtgcacggcaagcggttcttcctcgacgagttcggcgtcgagaacgacgaggcgtggctgcccgacaccttcggcttcgcggcgggtctgccgcagatcatcaaggcggccggttccaagcggctgctgacgcagaagatctcctggtcgcagacgaacaagttcccgcaccacaccttccagtgggagggcatcgacggcacccgcatcttcacccacttcccgcccgtcgacacctacaactgctccatgaagggcagcgagatcgcgcacgcggcccgcaacttcaaggacaagggcgtcgcccggcactccctcgcccccaccggctggggcgacggcggcggcggcaccacgcgcgagatggtggccaaggccgcccggctgggcgacctggaaggctccgcgcaggtggtgtgggagacccccgaggccttcttcgacaaggccgaggccgagtaccccgaaccgcccgtctgggtcggcgaactgtacctggagctgcaccgcgccaccctcaccagccaggccaagaccaagcagggcaaccggcgcagcgaacacctgctgcgcgaggcggagttgtgggcggcgacggcggccgtgcgcgccgggttcccctacccctacgaggacctggaccgcatctggaagacggtcctgctgcaccagttccacgacatcctgcccggttcgtccatcgcctgggtgcaccgcgaggcacgcgccacctacgagcgggtcgccgccgagctgaacgcgatcatcgacggcgcccagcgcgccctggccggcgagggcaccgcgccgctcgtcttcaacgcggccccgcacacccgcgccggagtcccggcgggcggtgcctgcgcacccgccgtcgagggcgagacccggctcaccgctcgggcggacggcgggcacgtcctggacaacggcctgctgcgcgtcgagatcgacggacagggcctggtcgtctcggcgtacgacatcgaggccgaccgcgagaccgtcgcccccggccgggccgcgaacctcctgcaactgcaccccgacttccccaacatgtgggacgcctgggacgtggacgagttctaccgcaacaccgtcaccgacctgacggacgcggactcggtcaccgcgggccaggacggcacctcggtgcggatcgtgcgctccttcggctcctcccgcgtcacccaggtcctgtcgctcgcggcgggggagcggcggctcgtgctggacacggaggtcgactggcacgagacggagaagttcctcaagctggcgttcccgctggacgtgcacgccgaacggtacgcctccgagacccagttcgggcacttccaccggcccacgcacaccaacacctcgtgggaggcggccaagttcgaggcgtgcaaccaccggttcgtgcacatcgaggagcccgggtggggcgtcgcactggtcaacgactcgacgtacggccacgacgtggcccgcgccgtccgcaccgacggtgacctgggtacgaccaccacggtccgggtgtcgctgctgcgcgcgccgcgcttccccgacccggagaccgaccagggtgtccaccgcttccggcacgcgctggtgc

SEQ ID NO: 765 - DNA, 9071 bp, Unknown
  Kingdom: Bacteria, Phylum: Actinobacteria, Class: Actinobacteria, Order: Streptomycetales, Family: Streptomycetaceae, Genus: Streptomyces
cccgtgagggttcaccgcgtggcgtgagcgaggaacgcgctccaggcggcgggggagagggcgagcgcggcccgggggcggtctttggtgtcgcggacgtggacgaccgccggtgtgagagcgacctcgatgcagttgtcgccggatccgctgctgtagctggacttgtgccaggagagggcgatttccaggcagtcgccgtctccaccgctgctgtaagtcgacttgaaccatgcttgttcggaggtgctcataggtctccttgcatccgttgcagcaggcccacggagtcctgcatggtaagagcctgtgaacgcatcctggcatacctgccttggagcacgctgatcaccttcaggtcggagatgaactgcccgctctcctgaccttcgctgtatccgaaccacttgtgttttgggtcttcgagcagggcgatgggaccgtgcagcccggcatgtgacctctgtaccagcggcatgatctggatctcgacgttccggagttcggccgtctccaggaggtgattgactgcccccttggtgacttcgggcccaccggtccggcggaggaagacgtgctcttcgatgatgaagttgaaggcggtgttcggctgctcccgcagcaaccgctgccgttcggcgcgtgcagcccagttgtcctcgacctgctggtctgtgagcggtggcagctggtcggcgaacaactgccgtgcatacggctctgtctgcaggagacctgggatcatccggcactcatagttgaacaggctgacagcagtcctctccaggccggcccactgcctgaaccacgaggcgagccccggctgccgtgccaggcaaccggctgccttccgtaaggcccctgtgttacccagcaccctctccgccgcctcgatgaagtcggcgtcgggcatacgtcggcccaactcgacggacgccaccgtgtgtttggagtagccgatgagccggccgaactcctcgcggctcagtcccgcgtgttcccgcagggcctggaccactgctccgaaggtacggaggctgtcggaagactccggttcaccgcacctgcccgtcacaccatcgaccacgtcggtcacctcccgccccatggtcacgaacggtagccggtactgtccacacggtcaccgcgtacgctcacgcagcgtacgcggtcctgacctggcggagcggcctgtcgttccgtcagattggcgccatgaccgcaccatccactccccaacgtcccgccgtcgccagcgcgttcgcgcagcggctgagcgccaccccgcgcggagcgcgcctggcccgtcacctcgcgctgaaccagctggacgcctggggcatcccgtacggttcggcgccggcggaggcggtggcagcgatcgtggcggagctggccgcgaacgcggtgacgcatggccgtgtcccgggccgtgacttcgagctgcggctgtcgctggtcacgggcagtgtccgggtggaggtgagcgatacccgggtcggcccgccactgccgccggccccgggacacgtaccgccaccggagcacctcgcggagagcgggcgcggactggtgctggtggaggcgtacgccgaccggtgggaggtcctggaccgggtaccgcccccggggaagacgatccgagcagaggtagacctaccaccgacccgccgccgcgcccgacccgccgtcgactgaggagccccatgctggtctggccgtgatcgcgtggctgggggacggcctacggatgcgtccgcaaggtcgcggtgtcgggcggactgctcaccgtgtcactggatccagcctcgctggaggacctgggcctggacgatgcggagatcgaggcagagcttgaggctccggcggaagacatcgagcggatgcgggaggtgctgggacaggtgctggcgttcggccgtgaagatgcccgccctgaatacgtggacctgtagaccgcccgcggcctggtccccaccgacgccaccgaggaactggagggctcctcgtctcggtggctgtccacccacggccggttcgaagaacagggaagaccgcctcgacggacgccgtggtggggagcgcggcgctgccggtcccggtcctggctcgacctggcgaatcgagtgcatgaaggtcgccgtactgcggcgagcgaggaccgggcagagttgagtccttccctcaaggggaagtgtgctgccgtcaggccgccaggcgggtgccgcggcgccagatggcgcgggtgttgagggtgtcgctgatgttgctggtcgggtcgccgtcgaccaggaggaggtcggcgcggagaccctcggcgatgcggccccggtcgctgaggcggaagcggcgggctgtggtcgctgtggccgcgcgcagggcccgttcgggggtgaggccggctgccacgaggtactgcagttcgtggtgcaggctcgctccgtgtgccaggcccccgaagaacgtctcgggcatggagacgtcggtgcccgccagcacgtccacgccggctgcgtccagtgcgcgcacggtgtcgtacacgtcgtcgagcttgccctgcgggtagcggttgtagctggagcgcagggtctggtcccacgcgctgtcgaggcgcgcggcgacgcgggggtcgtcggcgagttcgctgccggtgttccccatcatcgaggcattgagggtgatgcagggaatgacgaacatgcccgcgtccttgacgatgctgatgatctcggcggtgtgcggctggtccatgaacacgtgggtgacgccgtcgactccggcttcggcggccatcctggtggcctccagggtcagcgcgtgggccacggtgagggcgccgtacttcttggcctcggcgacaccggcgttcacggtggcctggtcgagcgagggcagcccggggtgtccctccacgctgccgtcgtcgatcatgaacttgatgaagtcggacccccgcgcgaggagttggggcacgtaggcggccgcttcctcgggagtggcggagaacggcatcaggggcatcaccggggggagatcccacttcggccggaagccttcgggcatcagctcgctggggtgcccgccgggcggtgtgatggcgaagccggaagagcgcacgtcggccagggtgtcgtcgtcggtgatggccccccggttctcccgggtgttcatcccctgcatctccagttccgtcgtcaccccgaaccgcagggcgagcgccagggagcccggggcggagtggacatgggcgtcgatgagtcccggcagcagggtggcgccgctgccgtcgacgatctcgctgtcctgaggagcgtcgccgccgatgcgggcgatcctcccgccgtcgatgaccacggtctgcacgcctgcggtcttctctccgtcgaagacctgcgcgttggtgatcgcggtgagcgtcatagcagtccgcctcgtttcgtcgcccatccaggatttacataccggatgctatgcacttgcccagcggtatgcaaatgtgcggtccgggcctagactcggtcacatgagcagtgcgtccttctccgagcagccctccgacgacgcggcgctggaccagatcggcccggcactgtcccgtctgcggcgacgcgccccggcatcgagcaaggacctctcccgcaacctcgtcctcaatgtgatcgtcgacgcgccgggcgagatgaccgtaggtggcctcgctgccgagatgggcgtcgcccagccggtggccagtcggaccgtcgctgcctgtatcgaggaagggctgctgcgccgggcggcgtcccagtccgacggacgccgcaccgtgctcgaactcaccgaccacggcgaggccgaacgcaaccgcttcgccgcgcagcagcgcgaagcgttccaggagatcaccgccgcctggtcgccgcaggagcgcatccagttcgcacgcctcttggcccggtacggagcggacgccaccgcatggtccaggagacaggccgcgagcggcgactgaacgagcggagccccgacaccggagcagggccaggagcccagacaccgatcgcgccgacggacgatctgccgatccggaactcgccccgtgaacgggacgaccgggcatcctgcgggcgtccggcgcgctgtcgccctcctacggccggaagccggtcggccccgccggagtggagtccgacggggcccggctgggtcaggaaccggacttgcgtttgttccacacgtcgaagccgaccgcggccagcagggcgaggcccttgatgacctgctgccagtcggtgccgacgctgaggaggttcatgccgttgttcagcacgccgaggacgagaccaccgatgatcgcgccgagcacggtgccgacgccgccgctcatggacgcgccgccgatgaatgacgaggcgatggcctccagttcgaagttcaggcccgccttcggggacgccgcgttcagccgggccgcgaccaccagaccggccagggccgcgagcacgcccatgttcaggaagacgtagaaggtgaccttcttgtccttcacgccggacagcttcgccgccggcaggttgccgccgatcgcgtagatgtggcggccgaagaccgcgttgcgcatcacgtagccgtagccgaccaccagcacaccgaggaccagcagcacgatcggcgcgcccttgtagctggccagcagcatcgtgacgacgaggatcgcggcgaccatggcgacgagcttgagcaggaagagccggaaaggcggcacgtcgagggagaactcctgctggcgccggcggtcacggacctcctgcccgaccgtgaagacgatcaggacgagacccagcagcagggtgatgttgtggtagttggtgttcgggccgacctcgggcaggaacccgttgcccatcttctgcaggccgttggggaaggggccgagggtctgcccggcgaggaggatctccgtcagacctcggaagatcagcatcccggcgagcgtcacgatgaacgacggtatgccgaagtaggcgatcaggaacccctgtacggcacccgcgaccgcgcccaccaccaggcacagcaccagcgcggcgggccaggccacgtggtgctccacggtcagcacggccgcgaaagcgccgacgaacgccgtcagtgagccgaccgacaggtcgatgtggcccgcgatgatcaccagcatcatgccgatcgcgaggatcaggatgtagctgttctgcaggaccaggttggagacgttgcgcggcagcagcaggtcgccgccggtccatgccgcgaagaggatgacgatcagaccgagcgcgatcagcatgccgtactggcgcatgttgcggcgcagtccgttcagcatcatctggagcaggccgccgccggccgctccgctgccgcccggcggcgccggggccgggctcttggcggtcacatccgtgctcatcgggttacctctttgtcctgggtgtccttcgtcatccgacgcatcagcacttcctgggtggcctcggcccgcggcacctcgccggtcagccggccggcggacatggtgtagatgcggtcgcacatcccgagcagctccggcagctcggaggagatgaagacgaccgccttgccctgggcggccagttggtcgatgaccgtgtagatctcgtacttggcgcccacgtcgatgccccgcgtcggctcgtccaggatcagcacgtcgggacccgagaagatccacttgctgaggacgaccttctgctggttgccaccggacagcttgcccaccggctcgaacacggtcggcgccttgatgttcatggacgtgcggaagccctcggagacctggcgttcctcgtgctcgtccaccacaccccgcttggcgaccttgcggagggcggtcagcgagatgttgcggttgatggtgtcgatgaggttcaggccgtagtgcttgcggtcctcggtgacatacgcgatgccgtgcccgaccgcctccgccacggtcttcgtgcggatctcggcgccgtccttgaggaccgtgccgcccgcgtagcgtccgtaggagcggccgaagacgttcatggccagttcggtgcggcccgcgcccatcaggcccgcgatgccgacgatctccccgcgccgcacctggatcgacacgtcgtcgacgaccttgcgttgctggtcgatcgggtggaacacggtccagttgcggatctccagcgcgggcgccgccccctcctcgggccggtgcggggtgcgctcggggaagcggttgtcgaggtcgcggccgaccatgccggcgatgatccgctcctcggtggtcgcggccgccttcacgtcgagggtctcgatggtgcggccgtcccgcaggatcgtcaccgagtcggcgaccttgcggatctcgttgagcttgtgggagatgatgatcgaggtgatgccctggttcttcaactccagtatgagatcgaggagtttgtcgctgtcctcgtcgttgagcgcggccgtcggctcgtccaggatgagcagcttcacggacttcgacagcgccttggcgatctccaccagctgctgcttgcccacgccgatgtcggagacccgggtctccggatgctcggccaggccgacccggcgcagcagttcggtggcgtgccgcagcgtgccgttccagtcgatgaacccgcgcttggcgtgctcgttgccgaggaagatgttctccgcgatggacaggtacggcaccagcgccagctcctggtggatgatgacgatgccgtgctgctcgctggcccggatgtcccggaaccggcagacctccccctcgaagaggacctcgccctcgtaactgccgtgcggatggacgccggagagcaccttcatcagggtggacttgccggcgccgttctccccgcagatggcgtggacctcgccctgacggacggtcagggtgacgtccgacagcgctttgacaccgggaaaggtcttgacgatcgagcgcatttccaggacgggtcccgccatggtcgtgccttccagtcggtcggttcggtgggtgcggcgggttacttgcccagctgggcgtcggtgtagtagccgcccttgaccaggacgtcctcgtagttgctcttgtcgacgctgaccggctggagcaggtaggagggcacgaccttggtcccgttgtcgtacgacttggtgtcgttgacctgcggcttcttgcccttgatgacgtcgtcgaccatggtcgaggcgacgtcggcgagcttgcggaggtccttgtagacggtctgggtctgctggccggcgatgatcgacttcacggaggccagctcggcgtcctgcccggtgatgacgggcagcggcttgctgccggacccgtagccgtccgacttcagcgcggacagcacaccgatggagatgccgtcgtacggcgagaggatggcgtcgaccttctcgctcttgtacgaggacgtcaggatgtcgtccatccgccgctgggcggtggcgccgtcccagcgcagggtggtcaccttgttgagctgcgtctggccggacctgaccaccagctgcttcttgtccatgtacggcttgagcacgctcatcgcgccgttgaagaagtagcgggtgttgttgtcgtcgttggagccggcgaacagctcgatgttgaaggggcccgtcttgccgctgtccaggccgagccggtgcacgatgtacgtgccctggagccggccgaccttctcgttgtcgaaggaggcgtagtagtcgacgttcttggtgccgaggatcagccggtcgtaggagatcaccgggatcttggcgtcggcggcctgctggagcacgttgttcagggacttgttgtcgatggccgcgacgatcaggcccttgacgccctgggtgatcaggttctcgatctgcgagacctgggtgtccgggtcgtcctcgccgtagaccagcttggtcttgtagcccttggcctccaggtccttgacgacgttcttgccgtcggagatccaccgctcggaggacttggtcggcatcgcgatgccgatcgtgccgcccttgctgctgctcttgtcctccttgctgccgccctcgctgttctgtccgcaggcggacagggccagggcgagggaggcggcggtggccatcgcggcgagtgcggctctgcggttgcgcatggtcatcatccttgatgtgtgtgcggggtcggtccggcggcgcgcgttgtgcggtgcgtgccttgtgcggtgcgtgcgtgcgttgcggtgcaggcggtgcggtgcaggcggtgcggcggcgctggggccgcgctgtgcggcggcgctgagggtggtgccggtggtgccgtgcttccggaggaagtggtgccgggggccgggtcggtcgtgccgggcagtggtgcggcgaacggtgcgctgagggaccgaaaacaggtgtgttggattgtgcgcggctgtgtcggcttctgtgaagctcagtttccggaacgttatgctggtgtgtcgaagcggctgagcgcccccggcagccgggagcccagcggtgccatgtcaccgcccgccccgtgccgctccagcaggtccagcgccagccggccgcgccgcacccgctcccgcgcgctcgccagcgtcacttcgcgcaactggtgcccgtaggggtagatgcccggcgccttcgagagcccgaacttcaggtacagcggcgccccgcgccggatcagctccgcgacctcgtacatccgcacatagccgccgaggtcgtccggcgcctcgatgtacatgtccatcggcgcggccgacacccgccgtatctccgtgaggtgagcgagcgtcagatcgctgggcacgttgacggagtcggcacccaggcgctcgtagacggcgtacgaggccgggttgaccggaccgatcagcgcggacaccttcagggtggtgtcggccgggacgatgccggccagccgcgcccggtgcagcgtccacagcacgccctcgtcggccacgagcaggcacttgacgcccagttccgtcgcccgtaccgcgtcctcgacgcacccggcgaccgcgtcgtgaccgcgggcgcgcagcccggcgccgcgcgagtcggaacgcacc

SEQ ID NO: 766 - DNA, 3831 bp, Unknown
  Kingdom: Bacteria, Phylum: Actinobacteria, Class: Actinobacteria, Order: Streptomycetales, Family: Streptomycetaceae, Genus: Streptomyces
tccgaggcgagttcggcggcggtcagggcgcgggcgtagacatgtgcgcggcggatggtgccgctgaactcccgggtcgggttgtccacgtcgccgccgagcgccagtggcgccgtgttgctgctgggccgcaccgtcgtggtccgggtggcccggaccgcgccgtcgacgtggagcgtgaggctgccggcccgggcgtcgaagacaccggcgacgtggtgctcggaaccggtccagtcgtcgggcaggttccagtcggcggtcacccactgcccggaggcgtggatgaagaactccaggcgggagtcggtctgtttcagggcgtactgggtgtcgcccttggccacgatgggctggtggtagccggtcacgcgcggggtgatccaggcttccagggtgagcgaaccggtcaggtccagagtgtcgtcgcgggcgaagacggtggtgccggagacgccttcgccgcgcgcgaagccggcgttggggtcgatcacttcgccggtgagcgagcgcggtccggtctcggtgagcgaagtgcgggcgggcgtgggccagttcagtgcctggtcgacgaagtcccagatccagccgccctgcagcacgtcgtggcggcggacgaggtcccagtacgtcttgaagttgccgttcgagttccccatcgcgtggcagtactcgatcatgacgtacggccgggtgtcgctcgtgtccttcgcgcgggcctcgacgcgggtggggctctcgtacatcgcggagcggatgtcgctgatcccggggcggtcgtcgccctcgtactggatgacccgggtggtgtcgtaggagcggatccagtcgtgcatggcgacgaaggtgctgccgccgccggcctcgttgccgagcgaccagatgacgacgctcgcgtggttcttgtcgcggtggaccatgttctgggcgcgtgccacgcaggcccgggtccagtcggcgtggtcgcccgggtactggtttctgatgccgtgcgtctccaggttggtctcgccgaccaggtacaggccgtactcgtcggccagttccagccactgcgggttgttggggtagtgcgaggtgcggacgctgttcatgttcatccgcttgatgatcctgatgtcctcgatcatgtccgcgcgggtgagcgccgtaccgcgggcggggtgcatctcgtgccggttggtgccgcggaaggagacggacttgccgttgatccgcatcagtccgtccttgagggcgaactcacgcagtcccacccggtgcgagagggtctcgatcaccttcccggcagggtcgcgcaggcgcagtacggcggtgtagaggtcggggtgttcggccgaccagagccgggggccggggacggctctggcggcccgtaccgtcacgtcctggcccgcggggacggagccgaggtccgcgctctgttccagggggcgcggccagacggcgtgtccgcgccggtcgtagagctgcgtctcgacggtgtaccggccgtcaccgccttcgccgtaggcgcgcacactggcggtgaccgacaggtcggccgccgtgtagttgtcgcgcagcggcgtctccagtttgaagtcgcgcaggtggacgtcgggggtggagtagaggtagaccgagcggaagatcccgctcagccggatcatgtcctggtcctccatccagtcaccgtcggagtagcggtacacctccacggcgatctggttggtgccgggtttcagatgcggggtgatgtcgtactcggcgggggtgtacgagtcctcgtggtagcccgcgagtttcccgttgatccacacgtagtgggcggacttgacgccttcgaagtgcaggaacgtccgtcgtcccgtccagttgcgcggcacggtgaaggtacgccggtactggcccacggggttgtagcgggtcggggcggcgggcggctgcggctcctcgcccaggccgttggcgccccagtacgggtacgtgatgttgacgtagacggggaagtcgtggccgtgcatctgccacacggacggcacggggatggtgtcccaggaggagtcgtccaggtcggtgcggtagaaggtgtcgtcgcgcgcgtcgggacggtcggaccaggagaaccgccaggtgccgtcgaggctcagccggtacggggagcgggtgcggtcggccgcgagcgcctgcgcggtgtcggcgtacggcatgagcgtggtgtgcggcggctcggtccccagttggaagacgtcgatgtgcccgttccactcggtgcccgtggccgtggtgtcgtcggcgccggccgcgtacgcctgcatcgcggcgggcacggaggacacggcgagcgccccgagagcggccgctcctccttcgatgagtcgacgacggctgaagaccgcccggacggggcggtcggtggacggcacgtgcgggtgctgcatgaccatggccttcctcgagacggacagggcgccaccacggaaggcggggcaccgcgagctgtccgatgctgttggtaaaccgaacacgagctttcgctggtcgccgcggcgacggcaggcacaacgtcggtatgtcgaagggaagttactgccggaacagatcactgctgctggtgacagaggtggctgtggaaccaggcacaccctaggacccgcacgcaaccgaggcaacgatcctgtcggacggtgttcgttcttgatggacgggcggcgcgtccccggcccggacccgcacgccgtcaacatcacgcaatggcaattcactcgcggcggtgagggctgcgggaaagcccggcgggacttccggcctgttccgggcccgcaccccggccgcggcacagccacccccgtcgcgggcgtctcccgaacgacaccggtccccgtcatgggcggcggccgggcccggcgcgaggggcggttccctcacgcgcaccggtgaaaccggcggcgccacattgaccgagacgcatatgccgccgctgttcagccccggggcgtcgagggtttccttccggtggcccgcctttccccgcgatcccctttccccgcgattccccggaatgtcccgcccgcgcgacgaaccacccaaggacagggaaccaccaccatgcgcatccgcaagaacctggccctcatggccggcccggcgatgctgggcagcagcctgctcctcctcaccacggcgggcagtgccgccgcctcacctcaggcagccggcgcacccgagaccgcggcgaccaccgccctcgcaccggccgggcacacctcggcgcggcccgcggccggactggagtgcggccggaactggccgcaccaccagtaccgcaggggcggcgtgaccggcgcgtacaccgccttccacctgtgctgggacaaccggtacaacgcccggatcgactactcctcctcctacgtcaaggacacccgcaccgaccgccacaaggcctacgtctacgtgcacttccagaagatcatcgaccaccacaagtactggaggtggtcggggcccgaggccggcgcgggcccccaccgcaacagggtgaagcacttccagtggggcaactcctccgtgaccaacgtggcggtggccgtctgcgcgggcaccagggcgccctggcagtccggcagccactgcaagcgggtctgaaccgagcggccgccgagccgtgaggtggtgcggggtggtacggaggcgctccgtaccaccccgcactgacgtgcggtactgcccggatggcgagacggctttgccgcatggcgatacatggtatttacatgcatcttatgcgcagctcagaaaccccgaccgccgccaccggcacctccgcgagcgcggccgggcccggcc

SEQ ID NO: 767 - DNA, 3172 bp, Unknown
  Kingdom: Bacteria, Phylum: Actinobacteria, Class: Actinobacteria, Order: Streptomycetales, Family: Streptomycetaceae, Genus: Streptomyces
agacgtaccgctcctagacgtaccgctcctagacgtaccgttccaggatcgaggactccgccagccgtgacaggccctcgcggacgctgcgggcgcgggcctcgcccacgccgtccaccgtctggaggtcgtcgacactggccgcgagcagcttctgcaggccgccgaagtgctcgaccaggcggtcgatgatggcgccgggcagccgcggcaccttggccagcaggcggaagccgcgcggggagaccgcggagtcgagggtctcgggcgagccggtgtagccgagggcgcgggcgaccgtggacatctcgagcagctccgcgtgggagagcttgtcgagttcgacgagggcctcctcgaccgtgcgggaccgcttggccgtgggctcagggacgtagtcccgcacgaccagctcgcgctcgggctccacgcccgcgatcaactcgtccagctggagtgccaggagccggccgtcggtgcccagctccaccacgtactcggcgatctcggtggcgatacggcggaccatctccaggcgctgcgacaccgccgagacgtcccggaccgtcaccaggtcctcgatctccagcgcggagagcgtgcccgcgacctcgtccaggcggagcttgtagcgctccagcgtcgccagggcctggttggcgcgggagaggatcgccgcggagtcctccaggacacggcgctgaccgtcgacgtacagggcgatcaggcgcatcgactgggagacggagaccaccgggaagccgacctgcttgctgacccggtccgccgtgcggtgccgggtgccggtctcctccgtcgggatcgtcgggtccgggaccagctgcacgcccgcccgcaggatcttcgacaggtcggaggagagcacgatgccgccgtccagcttgcacagctcacgcagccgcgtcgccgtgaactcgacgtccaggacgaagccgcccgtgcacatcgtctccacggtcttgtcggagcccagcacgatcaggccgccggtgttgccgcggagcacccgctccagtccgtcccgcagggccgtgccgggcgccacggcgctcagggaggcgcgcatcaggccatcggcgccggagctcccaccggactttccgggagctgctgcccggtcgttggctgccactgcactcctccggtcgcaggtttgcggcgctcccgtttcgcatactcggttcgtacggacgggcgggaccagcgcaaagtctaccggcggtcctcctgctcccgtggggcctcccggcgacgcgagcgcggcaggacccgcagcgcgtcccccatgtcggccacttccaggaccttcatcccgggcggcaccttgcccgggtcgcccggcacgagcgcgtgcgtgaagcccaggcggtgcgcctccgaaagccggcgctgcacgcccgtgacccgtctcacctcgccagccagtcccacctcgccgatcgcgaccaggttcttcggcaacggggtgtcgctcgccgccgaggccagcgcgagcgcgatcgcgaggtcggcggcgggctcggacagcttcaccccgccgaccgtcgccgagtagatgtcccgcttgcccagcgcgctgatccggccgcgctgctccagcacggccagcatcatcgacacccgggaggtctccaggcccgacgtcgtacgccgcggggaggggatctgcgagtccacggtgagcgcctggacctcggcgaccagcgggcggcggccctccagggtcacggtcagacaggtgccgggcaccggctcggcgcggcgggtcaggaacaggccgctggggtcggccagacccgtgatgccctcgtcgtgcagctcgaagcagccgacctcgtcggtggcgccgtagcggttcttgacgccgcggaccaggcgcaggcgcgcgtgccggtcgccctcgaagtgcagcaccacgtccaccaggtgctccagcaggcgcgggcccgcgatcgcgccgtccttggtgacgtggcccaccagcagggtggacatgccgcgctccttggaggcgcggatcagcgccccggcgacctcccggacctgcgccatgccgccgggcgcaccgtcgatctcgggggaggccaccgtctgcaccgagtcgaggaccagcagggagggcttcaccgcgtccaagtggccgagcacggcggccagatcggtctcggcggcgagatagaggtggtcgtcgagggcgttgatgcggtcggcgcgcagccggacctggctcgctgactcctcacccgtcacatacagcgtgcggtgctcgtcgctcgcggccttcgccgccacgtccagcagcagcgtggacttgccgacgccgggctcaccggcgagcaggacgacggcaccggggaccagcccgccgcccagcacccggtccagctcgggcacgccggtggagcgggcggcggcctggcgtccgtcgacctggccgatgggcagggcggaggtggtgacgcggcccggtgtcgtcgtacggacggcgggcgtgccgtactcctcgaccgtgccccaggcctggcactcggggcagcggccgagccacttcgccgtctgccagccgcattcggtgcagcggtaggacggacggtccttggtggtcttcgtacgggcagccatgcacgaaaccgtaaccgccaccactgacaacgccggccgtcccctcgcgccggccgggcccgtgacagcgcccgcgccacggccccggccgtcccgagggggcgccggaccgagcgccgcccgccggtcgaacggggtcgaacgcgcccgcacgaaggagggaacggcccgctcccgtccccgtatgagggatcgtttcacccgtacggattaaaagtgcgcaacagggaagaacggacgaacctccgccgcctacggtcgcacaggtgatgagccccagtccgcagacctcgacccgtacgaaccgtacgacgcgtacgaccggtgagcaccgggcgcaccccgaggcgcgcgaccgcgctgccgcgcgcaccctggcgcagcatccgcccgccgcctacgagccctacctcgacggcctgttcacctactgcctgtccgtgctgtgcgaccacgacgcggcgaccgccgtcctcggtgacgcgctggcgttcgccgagcggcgcgcgccgctcggcgaacgccagcg

SEQ ID NO: 768 - DNA, 8697 bp, Unknown
  Kingdom: Bacteria, Phylum: Actinobacteria, Class: Actinobacteria, Order: Streptomycetales, Family: Streptomycetaceae, Genus: Streptomyces
ggcgccgagcacgcgcgcgtgccggaagagcctctgaccgccaagggccttcccaagcgcacccccagaatcaccacgcccgcccaagccccgcgccagcggaccggctcggtggatgccgaggccctccgccgccgcctcggcggcttccgcagcggagcccaggccggctaccgcgacgtggaggcggagatcgcggaccagaccgtccagaaccgccggccgacgccggccacccgcacgcaagccgagcaatccacggggggcacagtcgaggaggcaagcagttgacagcgcccaccaccttcggactgagcagtgaggcccgcaacctgcactggctgctgaccaatctggtcgaggaggtgcccggcatcgaatcggtcgccgtggtctcctccgacggcctcctgctcctctcctccgaccccggccgcaacagcgaggcccgcaggccacgctcggcggtacccgcggggccgcgcggctccgccgccgacctcgccaccatcgtctccggcatcggcagcctcaccatcggggcggccaggctgatggactccggcgcggtcaagcacacgatggtcgcgatggacgagggcagcctgttcgtgatgtcgatcagcgacggctcgctgctcggcgtgcacggttccgcggagtgcgacatgagcgtggtggcgtaccacatggcgctcttcgtgggccgcgccggacacgtcctgacacccgaactccgcagcgagctgcgcaagtcactggagtccgagtcggccgggagtgtgcgatgagcggtgtaccccgacagcagctcccggtccgcggcggggaccgaaaacccgcccgggtccgtccctactcgctcaccggcggacgcacccggttcgggcacgtgctgctcgtggagacgttcgtcgcgagcaccgccgcgctcgaacccgccgagcagcgcagggaactgacaagcgatccgctcgcaccccgggtcatgccggagatgcgggccatcgtcgaactgtgccgccggatgcgtacggtggccgagatcgccgcgctgctgaagatgccgctcggtgtggtccgcgtgctcctgagcgacctcgcggaccagggaaagatccgtgtgtacggaaccggaaccggtcacggcaccggccgtccggaccgcgctctgctggaaagggtgctgagtggactccgccgtctctgactccgccgtcgccgccaccgccggctcctccttcgccggctcctccttcgcgaccggcgccgtcccgctcgacgagccggacgaggcgctgctgccctggcagacggaccgcacccgggccccgatcgccacgaagatcgtggtggccggcggcttcggcgtgggcaagaccacgctggtcaccgccgtctcggagatcacgccgctgcagaccgaggcgctgatgaccgaggcgagcgccgagaccgacgacctcaccgccaccccgggcaaggtgagtacgaccgtcgccatggacttcggccggatcacgctcgacgacgacctggtgctgtacctgttcggcacgccgggccagcagcggttctggttcatgtgggacgacctggtgcgcggcgcgatcggcgccgtcgtactggccgacacccgccgcctgaaggactgcttcccggccctggactacttcgagagctgcgggctgccgtacgtcgtggcggtcaaccacttcgacggcagtgagctgttcgcaccggaggacgtccgggaggcgctcacgatccccgcgcacatacctgtcatgatcatggacgcgcggcgccggatctcggccgtcgagaccctgctgtccctcgtggcccacgcgctcgacgaaacccccgagtagcccgccgagcagccccgtgcagtccgagcagtccctttaggagcattccccgcatgcgcaagatactcgtcgtgggggccggccagtccggtctccagctcgccctcggcctccagtcgcacgggtacgaggtcaccctgatgtccaaccggaccgcggacgagatccgctccggccgggtcatgtcgacgcagtgcatgttccacaccgcgctccagcacgagcgcgacctgcagctgaacttctgggagacgcaggccccgcggatcgagggcctcggcgtctcggtcgccgcccccggctcccacgacccgggccccaccgtgcgcgcgatcgactgggtgggccgcctcgacgggtacgcgcagtcggtggaccagcgggtgaagatggccggctggatggagaccttcgcgcagcgcggcggccagctcgtcatccacggcgcggccgtcggcgacctcgactacttctcccgcgcctacgacctcgtcctcgtctcggcgggcaagggcgagctggtgtcgatgttcgagcgggacgccgagcggtccccgtacagcgcgccgcagcgcgcgctggcggtggcgtacgtgcacggcctgggcccgcgcccggagcacccggagttcgacgcggtccgctgcaacgtggtccccggggtcggcgagctgttcatcatgccgacgtacaccctctccggccgcgccgacatcctgttctgggagggcatacccggcggcccgctggacgccttccagggcatcaaggacccggcgcagcacctggccctgacgctggacctcatgcgcaggttcacaccctgggagcacgcgcgggccacgcacgtcgaactcaccgacgccggcgggaccctcgccggccgctacccgcccaccgtgcgcaagccggtcggccggctgcccggcggcggcctggtgctgggcgtcgcagacgtcgtcgtcgccaacgacccggtcaccggccagggttccaactcggcgtccaagtgcgccgccgcctacctcgcctcgatcctcgaacacggcgacaagccgttcgacgaggagtggatgcagcagacgttcgaccgctactggaacaccgcccagcacgtcaccaagtggacgaacgccatgctggccccgccgccggagcacgtcctgaacctgctcggcgccggcagccagctccagccggtcgccgaccgcttcgccaacgccttcaacgacccggccgacttcgagaacttcttctacgagccggagaagacggaggcctacctggcccaggtcacgggcgcgggcgcggggccggcggcctagtcccgcaggctccggacctgcggggtcccaaggcgcaggccccggactcgcaggccccggactcgtaggacccagactcataggccccggactcgtgagacccgtcctggaggcagccctacaggaccgtgggcttggagggggccgggagggccgggagcctcggcggcgtgtagcgcggcaggggctttccggcagggtcgggccgcaccgcccccagtaccgggttggcggccagcggcgacaccttcacctccgcgcccggccgcggcgcctgcaccaccatgccgccgccgaggtagagggcgacgtgcgtggccttggggaagtacaccaccaggtcgccgggccgcaggtccttcagcggtacgcgctggagttcggcccactgctcctggctggtgcgcgggatcggcgtaccggcctggccccaggcccgcgaggtcagccccgagcagtcgtacgccgccgggccggtcgcgccccactggtacggcttgccgagctggtccatcgcatagcgcacggcggcctcgccctcgcgggtcggcgccttgtcgtcgccgagcgcgccggaggccacgagcctgttctgcgcccgggcgatgccgtcctcctcgaacgcggcgagcgccgtcagccgcgccgggctgagcgaggcgagcagcttctcgatggcgcgcagcttgccctggacgtcgtcgcggtcgcgctgctgccgccgggcgagggcgagccgggcgtcgagcgcggagcgggcggcgcgtgccaggtcctccgccttcttctcggccgccgtcagccgggccaccgtctgggcccgctcccgcgccagctggccgatgacgtggccctcctccagcgcgtgctgcgggtcgcgggccagcatcagccgcaggtacggggagaagtcgctggtgccctggtactcctgccgggccagccggcccgccgccgcccggccgtcgtgcagcgcggcctgggcccggtcgagggcggcggtcagccggtcggtctcggcgcgctgccgctccagtcgctccgccgtggcgtcgtaggtttcggtggcctgttcggcctgccggtacagcgcctggaggttcgtcagcaactcggcgacggagggctgcccggccggccggcccgcctgacccgacggctggccctcctgagccgagagctgacccgacggcagatctgacgcccgcccgggcggcgggctcaacaactgtccggctgccggaccgggcggtgggctcaacggttgtccggctgcctgcccggctgccggtccggacgcctgcccggggccggccggccgtggctcggcggtggcggtcaccggcacgagagcggcctgggccgccatcgccgccgtacacaccagtcgcagcgccctttttgacacgacatcacctccggcgcggggcggtctctccgctccacaccgtgaggattcgacgtatgagccgatttgtgtgcccgcccagcgccgatcggcgcaacatggtcacccgccggtgtcacccggcttgccctccgggccgttgcggggctccggacgggaccacggccacttcagccggccgccccccttgccctccggatcgaactcgtacttccacccctgcggcagtccgagcctccggctctgcccgcgcggcacccgccggtagacgagcacggtgggcgggccgccggccgtgtccgagaccgggatgcggtacgtcttgggcgggtggccggtggggcccaccagtacgggcagcacccggccgtccatggggccgccctcgaacggcgtcggttcgctcttcacagcaccagtgtcagtcatccgccgaggtaaggccctggaccagggcggcggtccgctcgtcacgggcggcggtcaccgtcagcacggccacgaactgctcgaccagccagtcccgcagctccccgagcggtggctgcttgtcctcgtcgagccagatcagcgacgcggcctccacggccgtgatccacatccgtacggtcatccgcagccgcggcccggggtcggtcacctggaggtggctgaggatgtgctccgcggcggcccggcgcaccccgtccactatggcggtcgtccgggacgtctccaccacgctgccgccctggagcagcgcgctgaacccggcgtcgtgctggtcgacgaaggccaggtagcggtccagggcgcgggcgaggcggggcagcagggccagcgagatgttctccctgacggacaggttgggcaggatgccttcggtcttccggtcctcggcgagcatcaccacaccggccttgatggcggcggcggggctgcgccgggtcagggccgtgccggacacctcgacggtgccgccgtcggtgggcagggcgccgatgatcgccttggcggtctcgctgcgtccggcgccgagcagtccgccgagcccgacgacttcgccgcggtggatgtccaggccgacctcgtgcacccggtgacggaccgtcagatcggtggcgcgcagcgcgggcgggccctcgtggcggtcgtggtgctcggcgccgaaggccgtggctcccttggcgcggacggtggacatctcacggccgagcatcagcgagatgagcttcagccgttccaggccggccatgtcaccggtgtgcacgatcgcgccgtcgcgcatcaccgtgacccggtcgcagatcgcgtacagctcgtcgaggcggtggctgacgtagacgacggcgatgccctggctcctgaggtcgcggatcaccgagaacagcgtctcgacctcgcgcggttccagcgacgaggtcggctcgtccatcacgacgacgcgcgcgtcgacctggacggcccgggccagggccaccatctgctgcgcgccgaggccgagggtgcccagggggcgggtgacgtccacgtcgacgccgtagcgcttgagggtgtcggcggccgtgcggttcatggcccgtacgtcgacgaggccgaaacggcggggttcgcggcccaggcagaggttgcgggccaccgacatcagcgggacgaggttgacctcctggtagatggtggagatgcccgcggcctgcgcgtccagcgggttgcggaaggcgcggtcctctcccgcgaggcggaccgtgccggcgtcgggccggtacacgcccgtcatcaccttgatcagcgtcgacttgccggcgccgttctccccgatgagggcgtgcacctcaccggggcgcagccggaagtccaccgagcgcagcgcgcgcacgcccgcgaagctcttgtcgaccccggcgacttccacgatccagtcgctgccgggttcggggtcctgctggaccaacgtctctcctcctcccgcgggctgccgggggcagcagccttcctgccgggtcgcgggccctgcgtccacgaccccggtacgtgcgccgccggtctcagtacacgaggccctggtcgagggcctgctgggcgttgcccgaggtgaagtggccgtccttgatgatcaccttggcctggacgccggtggtgccgtagaagtcctgcagcgcctggaaggccagcgggccgaagcgcgggttggtctcgatgtcggacaccatctggccggcggcgacgttcttcacggcctgctggatgccgtcgatggagacgaccttgatgtccttgccgggtgtcttgcccgcggacctgacggcctggatcgcgccgagtgccatctcgtcgttctccgcgtagacggcgttgatgtcggagtgggactgcagcagctgctccatgaccttctggccgtcggtctgggcgaagttgccggtctgcgaggcgacgatcttcatcttggggtacttggccttgacctggtcctcgaagcccttggtccggtcggtggtgacgttgttgccgggggtgccggtcaggatggcgacgtgggcctcgctgttcgtggcgccggcgaggtcgtcggcggcgatctgcgcctggtggtagaagtcggagccgatgaaggccatgaagtcggtgcaggcggtgccgccgaccgtgcggtcgatggtgagcacggggatcttcgcggacttggccttggcgagggccgggccgaggccgtcggagttctccggagcgacgatcagcaccttggcgccctgcgcgatcatgtcctcgatctgcgagttctgggcgttgacgtccgcgttggcgttgcgctcgatgagcttgacgcccagcttcttcgcctgctgctcgatgctcttggtctcggtggcgcggaaggggttgctggtcgactccgactgggagaacccgacgacggtcttgccgtcggtgatgtccagcttgggtacgccgccggcgtagttcttgtacgtgcagcccgggcctgtagccgagggcgaggcgacctgctgggaggcgcccgcgttgtcgttcgcggcggaggaggacttggaactgccggagtcggaggaggagtccgacttggtgcagccggtggcggccaggcacaggccgacggtcagcacagcggcagtgagggtctttgcccgggacgagatgttcacgcgccgatcacatcctcaaacggtgtaggcgaaggcggaacgagaagagggagccgtccggtgacgcgctcgcggagaccgcccggacggactggcttttcaacgttgtagacattgagggaacgtcaaacgggatgtcaacccaccgttcacaacttgcttgcgattgatgcggggtccctcaacaggccgtcggcgactggcttgttgaggctctgccgtcgggtttcgcgccgctcaggccgcccaggccgtggagctgcggtgctgtcgggccggcggccctccggtgctctcgcgcgggccgggaaaaggtcgtgccgcgggggtggacacctttgtcggggctgtgctgtcatttggctgccttcttttccaacgttgtcaatgcgccgccgccgggagccgccgtacgggccggactcctcgaccacccgccgcccgcgccgcggcgcgccacctcgctccgccgcaggcaccgctcccccacgacaggacgatctcccctcatgggcaccgcacggcggcgggaggcgtccgctttctcgcatccaccgctcgccgccgcctgtgcggcggtcaccaggaggacttgatgggacatcacaacggcccggccgacgaaatgggcgacgaggcgcgtacgtcgcgggctccggtcagccggcgccgtctcatcggctgggcgggtacggccggactcggcggggcggcggcgaccctgctgccggccacgaccgccgaggccagcgcgatccggtgacgccgtcctccccgggttcgacccggtacgtccaccggccgtgccgctcgcggtccggtcgccgtatctgaacgcctggatgccggccgacaacctggcgggcacctggcccacgttctggaccggccgcaccaccgcgatgtccggcatcgcgcagatcgacggcgtccccttcctcttcctc

SEQ ID NO: 769 - DNA, 5420 bp, Unknown
  Kingdom: Bacteria, Phylum: Actinobacteria, Class: Actinobacteria, Order: Streptomycetales, Family: Streptomycetaceae, Genus: Streptomyces
gcccgccgcagcacccggcgccacaggcaccggcgcccgccacgcccctgacaccggcgcccccggcgagcccgccaccgcacccggtgaccccgtcgccgatgtcggggcgctgccccgccgtgtccggcaggcgagcctcgcccctcagctcaagcagactcccgaacggcgtgccgaaacccgggcggaccccggggaacgggacgccgacgaggtacgcagccggatggcctcgctccagcgcggctggcggcgcggacgcgaggagaacaccgtgggcgacgacgccgacggcagcacagcacaaggaacgaacaagggggacggtcgatgaccgcaccgaaggcgaccggccacaccgccaccggcaagaaggagctgaactggctcctcgacgacctcgtggaccgggtcgcgagcatccgcaaggccgtcgtgctctccggggacggcctggcgaccggggtgtccaaggacctgacccgggaggacagcgaacacctggccgccgtggcctccggcttccacagcctcgccaagggcgtgggccggcacttcgaggccggcagcgtccggcagacggtcgtcgaactggacgaggccttcctgttcgtgaccgccgccggtgacggcagctgtctcgccgtcctcgccgacgccgactccgacatcgggcaggtcgcctacgagatgacgctcctggtgaagcgggtcggagtgcatctgggcgccgcaccccgcaccgacctgcccgccggcgggtagtgggatgacatgaacggagacggtcaggcaggaagccactggttcgacgacgaggccggaccggtggtccgtccgtacgccatgacgcgcggccgcaccagccacgcggcccagcaccgcctcgatctgatcgcggtcgtcgtcaccgaaccgcacgtggacgacccggaggcggaccactcgctctccccggagcacgtggacatcgtcgaactgtgccgtgacaccccgcagtcggtcgccgaactggccgcggaactcgacctgcccatcggagtggtgcgcgtcctcatcggggacctcgtggacgaggagtacgtccacgtgagccgcccggtgccgccggccgagctgccggacgagagcgtgctgcgcgacgtgatcagcgggctgcgcgccctgtgagcgcaccccaccagaagcaggagaaaagaaagatgatcttcgggcgctccgagcgcggcaagcccccggtcgagcccctcacgctcaagatcctggtggccggcggcttcggcgtgggcaagacgacgctcgtcggcgcggtcagcgagatcaggccgctgcgcaccgaggaactgctcaccgaggccggtcgcccggtcgacgacgtgagcggcgtggagggcaagcacaccacgaccgtcgccatggacttcggccgcatcacgctgcgcgaggacctggtgctgtacctgttcgggacacctggtcaggagcggttctggttcatgtgggacgaactgtccgagggcgcgctcggcgcggtcgtcctggccgacacgcgccgtctggaggactgcttcgccgccgtcgactacttcgaacggcgttcgatccccttcctgatcggcgtcaactgcttcgagggggccgcacgttatcccgcggagaccgtccgtcaggccctggacctcgacgaggacgtgcccgtactgctgtgcgatgcccgcgaccgcgagtcggtcaaggagaccctcatcggcgtcgtccagcacgcgatggcgtacacagcggcccgccgccggaccgtcgccacctgagccggcccgtcggacttccgctcattcctcgccgtcctccagccagccgaagctcttctccacggccttgcgccagttgtggtactcgcggtcacggaccgagtcctccatggcgggcgtccattcggcgtccttctgccagtgcgacttgagctcgtccaggtcgttccacacacccgtggccagcccggccgcgtaggcggcgcccaggcaggtcgtctcggagaccttgggccggatcaccggcacgccgagcacgtccgcctggtgctgcatcaggaggttgttcttcgtcatcccgccgtcgaccttgaggctggtgagccgcaccccggagtcctggtacatcgcgtccacgacctcgcgcgtctgccaactggtcgcctccaggacggcgcgtgccaggtgggccttcgtgacgtacctggtcagtccggtgaccacaccgcgcgcgtccgaacgccagtacggagcgaacaggccggagaacgccggcacgatgtacgcgccgccgttgtcctcgacactggcggccagcggctcgatctcgtccgccgtacggatgatgcccagctggtcgcggaaccactgcaccagggcgccggtgatcgcgatggcgccctccaggcagtagaccggtgcctcgtcgccgatcttgtagcccatggtggtcagcaggccgctcttggacggtacgggccggttgcccgtgttgagcagcaggaagctgccggtgccgtacgtgttcttggcgtcgcccacgtcgtagcacgcctgtccgaacacggccgcctgctggtcgcccagggccgaggcgaccggcactcccgccagctggcccacggcggtgccgtacacctcggaggaggaccggatctccggcaggatgccctcggggacgttcatggccgccaggatggacgggtcccactggagggtctccaggttcatcagcatcgtccggcccgcgttggtgacgtccgtgacgtgccggccgccgtccgtgccgccggtgaggttccagatgagccaggagtcgatggtgccgaaggcgatctccccgcgctcggcgcggtcgcgcagaccaggcacgttgtccagcagccaggcggccttcggaccggagaagtagctggcgagcggcagaccggtctgctcgcggaaccggtcctgcccctccgtgccgcccagctcgttgcagagcgcggcggtccgggtgtcctgccacacgatcgcgttgtgcacgggcttgccggtcgcgcggtcccacaggacggtcgtctcgcgctggttggtgatgccgagcgcgctgagctgcccggcacgcagcccggccttggccagcgcgcccgcgaccaccgcctgcaccttcgaccagatctcggtggcgtcgtgttccacccagcccggcttggggaagatctggcggtgctcgcgctgatcggcggcgacgatcgcgccgtcgcggtcgaagacgatgcagcggctcgaggtggtgccctggtcgattgcggccacgtacttctcggcgttgtccgtcatggctaccccttggtggcgagggtggtcggacggccccgtcgtgtccggtgcccgcgcaggtccccggctcggcggaacggtgcgcgggcccgctccgcgggtccggtggatcgcgtagccggatctccggggcggagaagcggccgagaacgggactgcgggcgcccctgtgttctcactggtatcagtttgtcccagatggtggggaaactgctcggcatggtcgccccggccacctggcaccgggcatcgggcgccaggcatcaggggcggggtgcggggtgcacgcggcggtcccgcggcgcgggcttcccccggcgggtccggtccaggtaaatgtaggagacatgacacgactgccccgggtcctccgcggtgtgatcaccgccgtcgccgccctgctcgccgtgaccgccgcctccgcgacagcccgcgcggttcccgaacccagggccccgaaggacttcgtggccctcagtgcggtggacccgacgatcatccaggagatccgctacttcaccccgcacgacttcgtcggcgcgcgcgtcgacggctaccggcagccgatgtgcatcctcacccgctccgcggcccaggcactgcaccgcgcccagaaagaactcctgcgcaagggctacaccctcaaggtgtacgactgctaccggccgcagcgcgccgtcgaccacttcgtccgctgggcccgcgacctcgacgaccagaccatgaaggcggagttctacccgcgcgtcgacaagacccggctgttcgacgacggctacatcgcggcgaagtccggccacagccgcggctcgaccatggacctcaccctcgtcaggctcccggtccgcccgacgcacccgtacgtccccggtcagcccctggtgccctgctacgcgccgcagcgcgagcgcttcccggacaactccgtcgacatgggaaccggcttcgactgcttcgacacgctcgcccatacgctcgaccccaggatccaggggcgccagcgggccaaccggctgctgctcaagagcaccctcgagaacctcgggttcgtgaacctcgccgaggaatggtggcacttcacctaccagcccgagccctacccggacacctacttcgacttccccgtctcacggacctcgctcacaggcaggccctgagccggatggacccgacgcaagacgaccacccgtcgacgtaagacgaccacccgctgatcggatacagtccgcgcgtgtccgaaaatcaacatccgatcgccaactccgcgccccactcgcactgttcgggctgcggagcaccctacggagagggcatctccggctggccccgcacctgcgcggcctgcgggacggcggcctaccgcaacccgctgccggtcgcggtggccctccagcccgtctacgacccgaagggcaccgccctggtcgtgatccaccgcaccatcgctcccgcgcgcgggggtacggccctgccgggcggctacatcgacgaccgggaggactggcgccaggccgtcgtgcgcgaactcagggaggagacgggcatcgaggccgccgcccgcgacgtgcggctcatcgacgccatgagcgcgcccgacggccatctgctgctcttcggactgctcccggaacgccccgccgaagggctgccgcggtccgtccccaccgacgagacggacggctggcacctgctgcgcaggcccgaggaacttgccttcccgctgcacacgctggccgcacgggcctggttcgaaggccgctacatctgagctgtccgagccttccgccccccgagcggtcggaggcccctccgagcggtcgggagccgtccggccggtccgccgtccgctcagccgagcccacgcacgcgcaccggccgcgacggcgcccccgtaccgtcctcccgctcgtgttccacgaccacatccaggccctgccgccggacggcgtaccgctccatgccggcctcctcccacccgtcgcccgcatccggcaccaccagcccgccaccggtacgcccgggggcgggcgcccacacctccagctccagcccgcccccgggcgtacc

SEQ ID NO: 770 - DNA, 2675 bp, Unknown
  Kingdom: Bacteria, Phylum: Actinobacteria, Class: Actinobacteria, Order: Streptomycetales, Family: Streptomycetaceae, Genus: Streptomyces
gcggccggccggaaccaccgggggccaccgtccggccggtggcgcatacgacggcggcccgcctgcgtggtcgcagacgggccgccgttccgggtgggcgatactgggttcgaaccagtgacctcttcggtgtgaacgaagcgctctcccactgagctaatcgcccgggcgcaggaagaacattaccgcatgtcagggtgtgcccggcaccacgggcgcggcaggggcacgggccggggcccgtgagccggcggcgcggctcggccggccggtccgcgccaggccggtccggcgatcaagcgcccggccggtccgctcactggttcctgatgctccacggcatgacgaggccgaacttccacaggtacacgccgaccagcacggcgatgatcacgagcccggtcaccgtcaggatgatgttgcggcggcgcaccttggggtcgagggcccgctgggccgcctcggtgaccttgcgcttggtccagcggagcacgagctgggcccagacgaactcggtcgcccagatcgccatgccgccgaagatcaccacccagcccggtccgggcagcgggagcaggatgacgccggtcacgacgaccgccaggccgacgacgaagacaccgacctgccagctcacgtggagcacgcggcgtgaccggatgaattccggcgcccgggagccgaggccacgccggtcccgcccctcgtccggccccgcctccatcttcgctccgtccgacgccgcggcaaccccagccgactcgtcactccccgtattcatatggctgaaccctaccggagagaaacctgtcaccggaatggccgtaccgcccgaacgggttctcggccggaagagttacgtaaagccaggcaaaacactcagaggggtttacaacggcaccgtaggtggcatgtcgatttcgccgacgtgcgaatccccgagcgcacactgagcgaaaggccctggcgcttatgaacaccacggtcagctgcgagctgcacctgcgcctcgttgtgtcgagcgagtcctccctgcctgtccccgcaggcctgcggtacgacacggccgacccctacgccgtgcacgccaccttccacaccggagccgaggagaccgtcgagtgggtgttcgcccgcgacctcctcgccgaagggcttcaccgcccgacgggaaccggcgacgtccgagtctggccgtcgcgcagtcatggtcagggcgtcgtgtgcatcgccctgagctctccggagggcgaggccctgctcgaggcccctgcgcgggccctggagtccttcctgaagcggacggacgctgccgtgccccccggcacggaacaccggcacttcgatctggatcaggagctgtcccacatcctcgcggagagttagcggtaggccgtcgaggcccttcgagctgcccgttgccgtccactcggggagacggctcgggccaggacaaccgcacacagaacgcgccggtgccggcctcctcaccgggggagccgacaccggtgcgttcccgtgcgcccgcgcctggcgcgacggcacagccactaccatcggcctgcatcggcgggcgtgtgcccgatccccaggccagggagcgaaacgtgctgatcacccacgacacccggtgcgcgctcgacaccgtggtggatctggtgaacaccgcgccggaggacgacgcggcgccggacgcgctggcggacgtcatggcgctcgcggatttcgtacgaacacacaagatgagcgatgtcggtgtcctctcggagttcgacctctccgcggtgcgccggatccgcggccggttcgccggcatcttcgcggccccggacgcccgtacggccgccgcgatgatcaacgagctggtggccgcggcgggcaccacgccccggctcacggaccacgacggttacgactggcacgtgcactacttcgcgccgggtgcctcggtcgccgaccatctcgcggcggactgcggcatggcgctcgcgttcttcgtggtggccggggaacaggaacggctcaggcgctgcgaggcgccggactgccgacgggccttcgtcgacctctcccgcaaccgctcgcggcggtactgcgacagccggacctgcggcaaccggctgcacgtggccgcgtaccgggcgcggcgcaaggaagcggcgggctgacctgcgacggtgctctccgcggtgtcgtggtccccggcgggtgacgccgaggagccacgcgtacggctcacagcagcagcaggtcgtgcaacgcagccatgagcagcagactcccgatcaccgcaaggaagatcatcagcggtggctgggaaagggcgaagaggcacccgcgcggcttgtccttctgcggcgcggcctcgctctgggtcgtgtccaccatctcgcggtgatgatgacgcaggcggcacgggcggcgcgatcaacacgcgcggaatgtccgggacgtcgccggattccatgatcttccgtccggatcgggctcgggcctgatcgtttccgggatcacttggggacgcccgtcacacggcgggtctcatatgccgtgtttcttcaggatcgcctcgatgtcgctgaagtccccctcggagcggggtgcggacgccggacggccggcggcgggcggggtggccgcgccgagggagggtgccgatgccgccggagcgaccg

SEQ ID NO: 771 - DNA, 12375 bp, Unknown
  Kingdom: Bacteria, Phylum: Actinobacteria, Class: Actinobacteria, Order: Streptomycetales, Family: Streptomycetaceae, Genus: Streptomyces
ggcggtgtccacgaccacctgccactggcgcccgtgatcgagggggacgacgaagtccagggacttcggcgcggcgttgaacagcagcaggaaggagtcgtcgctgatccgctcaccgcgctggccgggctcggagatcgcgttgccgttgaggaacacggtcagcgcggaggcgcgcgccgagtcccagtcctgctgggtcatctccttgccctccggagtgaaccaggcgatgtcggacagctcgtcgtgggtgccctccaccgggcggccgtggaagaagcggcgccgtcggaagaccgggtgctccttgcgcagccgggccatcgcccgcacgaactccagcagctcgctgccctgctcgccgggctgcggccagcgcacccaggccagctcgtcgtcctggcagtaggcgttgttgttgccctgctgggtgcgggcgaactcgtcgccgtggctgatcatcggcacgccctgggacagcatcagcgtggagaggaagttgcgcatctgccgcgcccgcagctccagcacgtccggatcgtccgtggcgccctccgcgccgcagttccaggagcggttgtggctctcgccgtcccggttgtcctcgccgttggcctcgttgtgcttgtcgttgtaggacaccaggtcgtgcagcgtgaagccgtcgtggcaggtcacgaagttgatcgaggccagcgggcggcggccgtcgtcctggtagaggtcggaggagccggtcagccgggaggcgaactccgcgagcgcccgcggttcaccccgccacaggtcccgtacggtgtcgcggtacttgccgttccactccgtccacagcggcgggaagttccccacctggtagccgccctccccgacgtcccacggttcggcgatcagcttcacctgggagacgaccgggtcctgctgcaccaggtcgaagaacgacgacagccggtccacctcgtggaactgccgcgccagcgtcgccgccaggtcgaagcggaagccgtccacgtgcatctcggtgacccagtagcgcagcgagtccatgatcagctggagcacgtgcggggagcgcatcagcagggagttgccggtgcccgtggtgtccatgtagtagcgcgggtcgtccgtgagccggtagtactgggggttgtcgaggcccttgaaggagagcgtcgggcccaggtggttgccctcggcggtgtggttgtacaccacgtcgaggatgacctcgatcccggcctcgtgcagcgccctgaccgccgacttgaactccaggacctgctggccgcggtcgccccacgaggtgtacgcgttgtgcggggcgaagaaaccgatcgtgttgtagccccagtagttgttcaggcccatgtcgaccagacggtggtcgttcacgaactggtgtacgggcatcagttccagcgccgtgacgcccagttcggtcaggtgctcgatgaccgccgggtgggccagcgccgcgtaggtgccgcgcagctcctccggcagtcccgggtggcgcatggtgaggcccttgacgtgcgcctcgtagatcaccgtctcgtggtagccgcgccgcggcggccggtcgtcgccccagtcgaagtacgggttcaccaccaccgaggtcatggtgtgcggcgcggagtccaggtcgttgcgccggccggggtcgtcgaagtggtagccgtagacctcctcgccccaccggacggagccactgatcgcacgcgcgtacggatcgaggagcagcttcgcggaattgcagcgcagcccgcgctccggggcgtacggtccgtgcacacggaacccgtaccgctgccccggcatgacgcccggcaggtacgcgtgccgcacgaacgcgtcgctctcccgcagttccaccgccgtctccgagccgtcgtcgtgcagcagacacagctctactcggtccgcggcctccgtgaagaccgcgaagttggtgccggcgccgtcgtacgtggcaccgaggggatacgcctctccaggccagacctgcatggacacgactctctcagctgtgcggcgccgcgggtggcgccgctggtcacgagtgtccccgaaagtggggccgccacctatgacttcgcgacgggtgcgtcggcccggcggacctgtccgaagctgttcgaattccccggagtgcccggcgccacggcgtcaacagcatgatttcgctcactgtgccgacgggtcacgacggaacacgtaagcgacgggcggaagttgggaaaggagctgtccatccggctgcaccgcgcaccactcccggagtacccttccttgatcgttgggacggggatgctcgggggagcggaaggcggtgcacgggtgggctcgggaggcctggagcttccccctggtgacgagggtcacgaggggaactccgcagacgtcccgcccggcgcggtgtccctggcccggccgatggacgcgggtgccatcggcccggagctggactgggacgccgacgcctggcgcgaggtgcgcacccgcgcccagcgggccggccgggcctacatctggctgaacctcgtcgaacagcggctgcgcgccgtcgtctccgccgtgctgcgccccgtctacgaacccgtccacggcgacgactgggtggtcgccgcggcagggcccgccggacaggagtgggtgcagcgcgccgtcgccgtccgcgaggtcagccgccgcaagggctacctgctcgacccggccgacgacaacgtcatcagcttcctgaccctgccccagctgcgcgaactgatggtgcagcactggccctgcttcgagccgtacctcgacgagcgccgcgacgtcgaactcgccctggacgagctggaggtgacccgcaatgtcgtctcgcgcaaccgggccctgtcggaggccgtgctgaaccaggccgagcgcgcctccgcgcgcctcctggagatcctcggtaccggaggcgacgtgccctccgcccgccgcctccccgtcgacgcggtcgaggacctggtcggcgaccggtacgcggacgtcgtcgccgtgcactccgaccgggtgcggctgctgcgccagttcccggccgaggacatcttcggcggcgcccgccgcctggacgccatcggcatcggcctgaacctgctggtgcagaacttctccggccgccgcctggtgcgcctggccgagtccggctgccgggtacggctgctgttcctgaaccccgcctccagtgcggtgaagcggcgcgagcgggaactggggctcaagcgcggcgagctgagccgggcggtggagatgagcatcctgcacatgcgccgggtccgctcccggctgcgcgacccggacgccttcgagatccaggtctacgacgagacgccccgcctgacggcctacctggtggacggcgacggctccgacggcatcgcggtcgtccagtcccacctgcggcgcagccgcggcatggaggcaccggtgttcgtcctgcgcaacgggaacaaggtggtcaagtcggacgaggtggacgaaggcgggctcttctccgcctatcgcgaggagttcgagctgatgtgggctgattcgcgcccggtgtcctgaaacgcccttgcccgcgtcctggaagacccttgtccgggcgggctccggccgaggggggagccggaagcggaacgcggccctcggattgtcagtggcgcatgcgaaggtgggaaccactgggggaagcaccaccgagaaggggggccgccatgggctggcaccgggagctgctgatcggattcgacctggagacgaccgggacggatccgcacgaggcgcgcatcgtcacgggcgccgtgatcgaggtcagggcgggagagccgctgggccaccgggagtggctggccgatcccggcgtcccgatccccgaggacgcggtcgccgtgcacgggatcagcaacgagcgggccgccgccgagggccaccccgccgaccgggtggcggacgccatcgccggcgtactgaccggctactggaagacaggtgtaccggtcgtcgcctacaacgcggccttcgacctcaccctgctcgccgccgaactgcggcggtacgggctgccgtcgctgagcgagcgcctcggcggcgcccaaccggccccggtcatcgacccgtacaccatcgaccgcgcggtcgagcgctaccggcgcggcaagcgcaccctccaggcggtctgcacggagtacggcatagtcctcgactccgcccacgacgcggcggccgacgcgctcgcggcggcccggctggccggcgcgatagccgaccgccaccccaaggtcgcggccctcggcccggcggagctgcaccgccgccagatcgagtggtacgcggcctgggcggcggacttccagagcttcctgcgccgcaaggccgatgcggccgccgtggtcgacgggacctggcccctgcggcagccggcggacgagacggtctgacgacctcccgccccctacctcccgtcaccgcccgaagcggagagggggaggcgggccggtcagaaggggtaccagcgcaccgtctcgtcaccgtcccgcagggaggccacccggcgttcgaactcggccagcgccttggggttgctcggggcgtgctgggcgacccaggcgcagctggccgtctcccgggccccgcgcagcaccgagcagccctcccactcccgtacgtcccagccgtagaccgacgtgaaggcgtcgtaggcctcggcgggcaggccgtagcggtcccgggacagggccatcaccaccaggtcgtgctcgcgcaggtcggcggagaaggtctccaggtcgaccagaaccggaccctgcgggccgacgtgcacattgcggggcagcgcgtcaccgtggatcgggcccggcggcaggtgcggggtgagggcggcggcggccgtcgcgaaaccgtcgcggcgctcgcgcaggtacgccgcgtcggccgggtcgatcgcgccaccggccagccgcagccagcgttccacaccgccgagcagttcgcggggcggcagcgggaaggaaggggagggcagcgcatggacgacacggagcagttccgcgaggtcgcgcggctccgcagggcgcaccggttcggggagccggtgccacacggtgaccgggtggccctcgacgagcagcgcctcgggcccggccgcccggaccgccggcacaccggcgtccgccagccacgcggcgatgtcgagttcgcggcgcgcccggtcgaggagttcggcgtcgcggcccaccttgaccaccaggtccccggcggcgaacacggcgttctcgcccagcgccagcagccgcgcctttgccgccggccccggcaccacctgcgccgccgccagcacctcgcgcgcccgtgcctcgtccatcgtccgcctccctgtccgccgatttcccgctgtgcgtcggccagtctcgcatcagcacaggtgggagcgtgtgcgcggcctcttgacggggcacggcgccttcacgaccatggccgggcccgtccgagccgcacagagggttggtccacgtgacatcgctgaccgaggtgaggaggcggccgacgcggcgcgcggccggtccgggcctgccccggcgcggccacgaccccggcgcctggttcctggtgctgcccgcgctcgtcccgatcctggtcctcagcgtcggcccgctgctctacggcgtcctgctcgcgttcaccgacgcccagtccgggcgcacggaccccacgcggtggaccggcgtcctcaacctccgcgacctcgcgcacgacacgctgttctgggagtcgttccggatcggccttgtgtgggccgtcggggtcacggtgccgcagttcctgctcgcgctcggcctcgccctgctgctcgcccagaacctgcggctgcgctggctggcccgggcgctcgccatcgtcccctgggcgatgcccgaggtcgtcgtcggcatcatgtggcggctcgtctaccacccggacgcgggcatcctcaacgagaccctgcgcgacctcggcctcggcgacggccgcgactggctcagctcactggccaccgccctgcccgccgtcatcgtcgtcggcgtgtgggcggggatgccgcagaccacggtcgctctgctcgccgggctgcagaacaccccgcgcgagctgcacgaggccgccgcggtggacggcgccggagcctggcgccgcttccgcacggtcacctggcccgccctcaggccggtcgccctcgccatcacggcgctcaacctgatctggaacttcaactccttcgccctcgtctacgtgctgacgggcggcggacccggcggccggacccggctgcccatgctcttcgcctacgaggaggccttccgctacgggcagttcgggtacgcggcggcgatgggctgcgtcatggtcgccgtcgtctcggtcctgctcgccgtcttcctcgtcggccggctccgaggaggtgccgagaggtgaggacctcgacccgcgcccgcgtgggccagtacgccgcgctgctcgcctacctcgtcttcctggcctttcccttgctctggctcctgtccacggcgttcaagccgccgcgcgaactggcggacctgcaccccacctggatccccgagcaccccaccctcggcaacttccggcaggccttcgacgaacagccgctgctgcacgccgccctcaattccctgctggccgcgctcggcgccgcgctgatcgccgtgctgatcggcacgccgatggcgttcgtcctggcccggcgccgctcctggctcacccgggcggccaccggatgggtcgtggtcagccaggccttccccttcgtgctgctgatcatcccgctcttcctggtgctgaagaacctgaggctgatcgactccctcgccgggctggtcctggtctacgtcgtgtggtcgctgccgttcgcgctgtggatgctcaccgggtacgtccgcgccgtgccggccgaactggaggaggcggcggccgtcgatggcgccgggcggctgcggacgctggtctcggtgacggcgccgctgctcgcaccggggatcgtggcgacggccctgttcgcgttcatcaccgcgtggaacgagttcttcttcgcgctggtgctgctcaagacaccggagaagcagaccctgccggtcgtcctgacgcacttcatcggtgccgagggcgtcgccgacctcggtccgctcgcggcagccgccttcctggccacgctgccctcgctgctggtcttcgccctcatccagcggcggatcacgggcggcatgctcgccggggcggtgaagagctgatgcgcgtccgagccgtgcgcgtccgggccgcgcgcgtccgaaccatgcgcgtccgggccgtgcgcggccggtcctgctggatcctcgccctggtcctcaccgtcctgctcgccggctgctcgggcggcggcggggacggtgggggcggtcaccccggccgggtcaccctgcgcttccagtccctggcctggcagcaggagtccgtggcggccaccgaggaactggtgcgggagtggaacgccgcccacccggaagtccgggtcgagtacgtccagggcagctgggacagtgttcacgaccagctgctgacctccttcgagggcggtgaggcgccggacgtcatccacgacgcctccgacgacctcgccgatttcgcctacggcggctacctcgccgatctgacccctctgctgtccgggctgctgaagtccgagataccgcgacagagttgggagacgaccaccttcgggcacggcgtgtacggcgtgccgttcctccaggaaccccgggtgctgatcgccaacagccggctgctgaaggagtcgggtgtgcggatcccgacgccggaccggccctggagctgggacgagttccgccaggtgagcaagcggctgagcggccccgggaggtacggggtggcctggccgctgaaggaacccgtctccgcgacgctcaacctgtccctgtccaccggcggacgcctgttccaccgcgactccgacggccgggtcaccgtccggttcgaggccgccgaccaggtggtgccgcgcaccctgcgcgagcagatcggcaccgaccgcagcgcatccccgaccaccctgggcagcggcggctccgacacactgcccgggttcttcgcgggcaagtacgcgatggtgccgctcgggttctcctaccggcagcagatccagcagcaggcgccgaagggcttccagtggcaggtgctgcccgccccggccggagccgccggactcacccagggagtcagcccgcagacgctgtcgatcgccgaggacagcccgcacaagaaggaggccgccgcgttcctcgacttcctcctccagccggagaacatggcgcgcctggccctcggcgactggatgctgcccaccggcaccagcgcgctgaaggaccccgccctgcacagaacggagtacggctgggccaccggcacggcgctcgccgaccggctgcgctccgctcccgcgcagtccgtgcggggctaccccgagtggaaggacaaggtggcgacaccggcgctccaggagtactacagcggcgcgatcggcctggacgacctgcgggaacggctggagaaggacggcaacctggttctggccagataccagcgctgaaaatgatttgtacgagacgtctcgtctcgcctagggtcgggtgcatgaccgctcccgctcacatcgccatgttctccgccgccttgcacggccacgtcaaccccagcctggaggtgatccgcgaactcgtcgcccgagggcaccgggtgacgtacgcgatcccgccgctgttcgccgagaaggtcgccgagaccggtgccgaacccaagctgtggaacagcaccctgcccgggcccgacgccgatccggaggtctgggggacgacgctgctggacaacgtcgagccgttcctcgccgatgccatgcaggcgctcccacagctcaccgaggcctacgagggggacgaaccggacctggtcctgcacgacatcacctcctaccaggcccgcgtcctgggccgccgctggggtgtgcccgtcatctcgctctcgccgaacctggtcgcctggaaggggtacgaggaggagatcgccgagccgatgtgggaggagccgctgaagaccgagcgcggccaggcctactacgcccgctacagcgcctggctggcggagaacgggatcaccgagcaccccgacgtgttcgccggtcacccggcccgctccctggtgctgatcccgaaggcgctccagcccaacgccgaccgggtggacgagacggtctacaccttcgtcggcgcctgccagggcgaccgcggtgccgagggcgactggcagcggcccgccggcgccgagaaggtcgtcctcgtctcgctcggctcctccttcaccaagcagccggggttctaccgggcgtgcgtcgaggcgttcggcggcctgcccggctggcacctggtgctccagatcggcaagcacgtcgaccccgccgagctgggcgacctgccggcgaacgtggaagtccactcgtgggtaccgcagttggcggtactccagcaggccgacctgttcgtcacgcacgccggggccggcggcagccaggaggggctcgcgaccgcgacgccgatgatcgccgtaccgcaggccgtggaccagttcggcaacgcggacatgctccaggggctcggcgtggcccggcgcctggacaccgaggaggccaccgccgaggcgctgcgcaccgccgccctcgccctggccggcgacccggaggtggcacggcggctggcggacatccaggcccagatggcccaggagggcggcacgcgccgcgcggcggacctgatcgaggcggaactggaggcggcccggcacgggggcggcccggcgttctagggtgggtggatgacgacgtatgcggcgctgctgcgcgggatcaacgtgggcggcagcaggaagctccccatggccggactgcgcgcgctgatgcaggaggcggggtacgacgacgtccgcacctacctgcagagcggccaggccgtcttcaccaccgggcacggcgacgaggcatcgatcgcggcggaactcgccgccgcgatcgagaagcggttcggcttcgcagtggacgtcatcgtgcgcgaccacgcctatctgcgggcggtcgccgacgcctgcccgttcccggccgccgaactggagccgcgccagctccacgtcacctacctgtccgcccccgccgacccgtcccgctacgcggacatcgaccgggccgcccacctgcccgaggagttccgcctcggcgaccgcgcggtctacctgtacgcgccggacgggctcggccgctcccggcttgccgagcaactggccaggcggcccctgcccaggggtctgatcgccacgtcccggaactggaacacggtcgtcaagctggtggagatgaccgcaggctgacctgccgtacgccggtgtgcgtggtgtacgaggtgatcacgtccgggacggtcaggcgggggtccttcgcgtacagccggcgcagctcctcctcggtgcgggcggcggcgaccccgtccaccagggcgatgtcgtcctcggtgagcgaggcgtcgtcggagatctcgcggccccagtagtcccagggcagcagctcgaccccgttcagcgcggccaggtcgcgcagcacgtcaccgccgacgaaccacagtccggcgatcccctcgagcccgatcacgccgaaccgccgcgggtccgcccgccccgcccggcaggcccgccaggcgtccgcggccacgaggaaccggtcgcgcggcacgtccatgggatcaaagtccaggccgtcgtacgtgtggtgcagctgggcgtcggcgagccgccaaccgcctcgcggcgtccggaactcggtgacccagtggtcggcgtacgcgccgccctcgaagtaggtcgcgaagccgcaccggacgcgggcgggcgtcccggtggcccgcagcagcgagcagtgcagcagcgcgaagtcgcggcaggttcccacgaagcgcgcctcgggcggccggcgcacggcgagcggcgtgtcggcgcgttcgcgcaggaggcgcaggatctcgctgacgtaccgcgactcggcgtcctggtgcatccggtcccgggggatggcgtagccgaaccgctcgccctcgccccggtggatgaccaggtcccgcacgatccccgcgagcagcccgggatcgcgcggaagtccgctgacgtcgaggtcccccggatcgctgtacggggtctgcctcaagtggaagtcgtccatgtcgtccatggccgcgaccctcggccttgccccaggggcagggtcaaggcgcgagcacgtcagaccagggcgtccagccgggccaactcctctgccgacagccgcacttcggccgcgtccaggttctcctccaggtgggcgagcgtgcccgtgcccggcgtcgggcagaggacgggggagtggtgcagcagccaggtcagggcgatctgcgccggactcgccccgtgtccggcggcgatctgtgcgcacaccgggtgcccggccaagtcgccgttgcccagcgggaaccacggcaggaaggcgatgccgcgctcctcgcacagccgcagcagcggttcactggtgcggtcgagcaggtggtagcggttctgcaccgaggccacctccgtcagctccagcgcggccgagagctggtcggcggtgacggtgtccaggccgatgtgccggatctttccctcggtcctcaactccgagagcacaccgagctgttcagccagcggaacggccgggtccagccggtgcaactggtacaggtcgatcgtctcgcgccgcagccggcgcagactcgcctcgcacatcgcccgcagcgaggccggccgcccgtccacgtgccaggcggcgtcgctcgtgcgcaccactccgcccttcgtggcgacgacgaccgactccgggtagggatacagcgcctcggccaccaactcctcggcgagcgaaggaccgtagttgtcggccgtgtcgatcagggtcaccccgcgccgcaccgcccgccgcagtaccgccaccgcgtcctcggccgcaccgcgcggaccccagtagccggggccggtgagctgggcggtgccgtagccgagacggcgtacgggcaggtcgccgccgagtgtgaaggtctgctggggctgcacgggggactcctgggtctgacgacggacggtgaccggcgcatgggaagctcccggcatgcgctatatcatcatcggggcaggagcggtcggcggtgcggtcggggggcggctcgcgcagagcgggcgcgaggtggtgctggtcgcgcgcagcgccgccag

SEQ ID NO: 772 - DNA, 7618 bp, Unknown
  Kingdom: Bacteria, Phylum: Actinobacteria, Class: Actinobacteria, Order: Streptomycetales, Family: Streptomycetaceae, Genus: Streptomyces
atgcttacggcctcccggcccgcgctggacgccgccaccaccgcggagtcggtcagcctcggtgtcggcatcccgtggtggccggcgacggccgcgcacctgagggccgacggccggctggaggacctccaggccgaaccgctgcgggccggcgactacctgctgtcgtacgggatcccggtccgggcgggccgcgcgccggtgaccgcgctgttcggcacggcggcctggggcgccccggacgacgagctgcgcgaactgctcggcgccggtctgctgctggacgggaccgcggccgcgatcctgaccgaacgcggcttcggcggactgctcggtgtccgcgtcgaggaggtcgccccgcgctccgccaccgggccggctccgtacgccatggagcgtgtcgtcgaggacgggtcgctgctcagcgtcaacatccagccctccctggcgcggctgaccgcggccccgggtgcgcggacgtggacggagatcgtgtcgccggacggggagttctggggcgccggacgcgtcgccgccgtcaacgaactgggcgggcgggtcgtcaccctggccgcggtacgtcccgaggacctgggccggtgcgacgaggggcagcggctggcccaccgtgccgtccgcttcctcggcggcggcgacctgccgctggtcaccggcggtgcgcatctgctgccgcagtacgcgctgaccggcgggcggcaccggctggccgtcgtcaacggctcggccgatcccgcccggccgtccttcaccgcggccggacgggccgagccgtcggcactgctgctggcgccgctggcggagcccgtggaggtcggggtgcgccgggagggcgagggctggacggtcgaggccgacctgccccaccgcggctatctgctcctcacctggagctgacgcccgtcagcggcggcgagcgggcacgcaccccggccggtcaccggtccgggccaccggccggggcggtcaccggttcgggccggggtcgctgaagctggggcggccggtctcctggtggcccgcgaaccgccgcaggtaggccgggtcggcctcgtcggtgaccgctatgtcgtaccagccgtgcgaggccccggtctcccaggtcacccgcgcggtccggcccggcgcgaggtcgacggtacgtgcggcgccgtggccgggtccgtaggcgttgctcaggcgcagcctgcggtgccgggtgcccgggttctcgaggcggagcaccagccgcgggccggcctcgggaccgaggctcaccgacacccggggctccttcgtgtccgccgccgttccggtgaagtggccgaggtacccgttggctccgtgcacgagcaggtcgtagcggccgtggctgtcgcgcgcgctctcgcgggtccagaggtcgctcacggtgtcgtgcgcggcgacggtgtagcggcgcggggcatcgtcggggcgcgcgccgttgcggaccgagaagtacgcgccggcttcgccgcggttgacgaaactcaaggtcacggcgccgtcctgacggccgtcgccgagttcgacggcgaagcggtacggcagcggccgggccggccgcaccccgggctcctgtacgggcatccgctgcggcgcccgtacggagaacggctcgtgccggctctccagcggcttcggcaccgcgggcgagacgggggtgcggtccgggcgcgcgaagtcgaacgccgaggtcaggtcgccgcacagggagcggcgccaggcgctgatgttcggttcggcgacaccgaagcgctgttccaggaaccgcagcaccgaggtgtggtcgaacacctccgagcagacccagccgcctttcgtccacggtgacacgacgatcatcggtacccgcgggcccagcccgatcggctgcttgccgccggggtcggcgcccggcaccagcgggctcatctcctgggggtaccggtcgaggtcgaggatctcgtccgcgaggctggaggcgaggctcctggagacgaggccgtcgctgccgaccgtgttggcgaccggcggcatcggcgggacgacgtggtcgaacaggccgtcgttctcgtcgtagttgatgatgaggacggtcttgctccacacctcggggtcggcgacgagcgcttcgagcacggtgtcgatgtagtaggcgccgtcggtgggcgaggcggagctgtgctcgctgtactggtagggcgggacgatccagctgacctgcgggagcttgccgctgagcgcgtccgcgcggaactccttgagggtgtgggtggacacgccccgctcgaccagttcgcccgacgcgccctcgtctgcctggtagcgggcgaagaactccagcgagttgtcggtgaagttgtcggtcggctcgccgggtacgccggtgcctccctggtagaccttccagttcacgccgtgcgcctggagccgctcagggtaggtcgtccaggtgtagccgccggtggtgtgccgctcccacaggccggggccgttcggcctggagcccatcgcgttgcgcgggtcgacggtgccggtccacaggtagatgcggttcggcgcggtgtcggcgtgcacggagcagaagtacgcgtcgcacaccgtgaaggcgtcggccagtgcgaagtggtaggccagttcggagcgttgcaggtgtgtcatggtgagcacgtcctgcttctggttcacccactggtcgtaccggccctggttccaggccaggtggccgctgctccagccgtggtcggtgccgtccatgtgctcgctcgtgcgcagtgcgtccagcgggaacggcagcacgtactcggcgtcgtcgggcaggccccggctccggtaccgcgcggtgcggacctgcgccgtgggctgctgccacaccggccggccgtcgggcagcacgtgcgggcgcgggtcgccgtagccgcgtacgccccggagggtgccgaagtagtggtcgaaggagcggttctcctgcatgaggatcacgacgtgttcgatgtcggcgatcgtgcctgtccggcgggcgggctcgaccgccagcgcctggccgatcacgccgggcagcgccccggcggtggcgccggcgagcgatgccgtggcgatcccgagaaatcctctgcgactggtgcctgccacctggtcttctcctcgtctgggcccggccggacggccggagggggccgaacaggtcggatccgcggtgtgcgcgtcgggcgtgagccggggcgggcgcgcagggtccgcgcccgccccgaaggtgcttcagcgggtggcgatctcgttggcggacaggttgccccacgtgtggttggcgtccttcaccacgaggcggacaccggtggtggcgacggtggacggcagccgcacggaccgcagttcgacggtcgaggtgttgcccgaccagctgatccgcgcgtcggtgacctgggtgacccaggcggtgccgttccacgtctgcacgtcggccttggtgatgccctggccctggccgaagtgggtggcgaggacgacctcggagacctggcgccggctcgggaaggtcagggtgatgttcccggggtaggtgacgccggcggccggactggcccaactggtgccgtcggagccgtcggtgagcgccgccggggtcgtcgactggccgtcgccgaacgtggtggtggccgtcggggcggcctcgtccttcccggtgcccgcggtgcgctggaggccgccgaggtcgggcatgccggcgggcagtgcggtgccggccgcgtcacggcctccgtcgtgcgcgatgtccaggccgctcgccagggccggggagccggccgccggccggtatccggagaggtcggtgagggacgtggcggtgcccggcgcggtcaggcccgcgtcgccggtgatcgcggccttgtccgacgaggggaccgggccgtcctggtagaggttgcggtcgtaggcgacggctccggcgtcgttgtagggcagcttcgcgccgttgtagatgacgttgttgcggaacctgacgtccctgaccgtgctgttccacaccttgaccaggctgaacgacgccctgtcgggatggttggcgatgaacggcgtcaacggcacccagatggtgttgttgtagacgtcgatgttccgggcgttggtcgagagcgcgaagacctggttggcgtcgccctggctgacgttgtagcggatcgtcgcctcggccgggccggtgccggtggagacggcgatgaagaagccgccctcgttgtcgtggctgaagttgtactggaccaggctgcggtgcgcggaggcgtcggcgtcgaacgcggtgccgtcgctggccagtccccagtacttcgtgccggagacctcgttgtactgcacgaccgtgtcgtcggccccggcccaccagatgccgacgttgccgtggttctgcgcggtcctgtccacccggttgtgctcgatcagcgcgccctgcgcctgcatgacggtgatgccgcccgccgagatgtcgtggacggtgttgccccggacgacgaccccggtgctcggtgtccaggggcggtagtcctcggcggggatgcccatgaggtcggtccagaggttgtcccagccctcccgctgcatccactgcgaccaggtgacgatgccgtaggcgcgggtgtcgaagacctcgttgtcctcgatgcgcaggttctcgtagtacgtggccgtctgcttgccccgggcgctgacgatgatgccgccggaggacggattggacgcctggctgccggaggactcgccctggatcgcgtggaccttgttgttgcggacggtgatccccgggacggcgccgtcgtcggtggcgctgatctggatcccgatccgcggggtggtcccggagccggtgttggtgacctcgaagccgtcgacgacgacgtcgtgctggtcgctgacctcgatggcggcggccaccgtcccgccgccctcgatgagcggtctggcgccggcaccgtaggaggtcagcacgacggggctggtcctggtgcccgaacccctcggccggagctgtcccttccagtcgccgccggacttgaagcggatggtgtccccgggccggaaggtctgcgcgttgaccttgtccagggacttccacgccgtggccggggtgcggccgtcggcggtgtcggtgccgttcggatcgacgtagtacgtgctgcctgccttgagtgcggcaccgccggtacggccgggggcgtgcgcgggcgacgccagtgccgccggagcggtgaggcctgtacctgcgcatatcaggacggccgcgagggccgtttcggcgtagcgccgaccacgggacatgaaaggggctcctgtcggatggctcgaggggctcgaaggggtcgagtcgctcgagtggctctgcggcgccgaccggtcggccggtgccgggaggtgcggaggcggtacctgcgaggccgtggggggcagactgaataatttattcgctgatgattaataattacgaggtcggcgtcaagagggcggtgacgccgagtcggaggaatccggggtgctccgcaggagcgagtgctccaggccccgctcacccgccggtggcggctacgccgcgttgccgccgcccgctgtaccggtcggcgtgggtgcctcgatgggcgcgggcagcggaccgtgcgtgccgcgtccctggtcggcgccgatgttgggcgggtcggcgaccgggttgccgtacaggtcgcggtccggggagcccgggacgggggtgcccgcgtgcagggccgacgagccggagtgcaggcgcaggcccagcggcagggcgccggtgcggtcgctgagcagcgggtcggcggtggtgccgccggggtcggcgggtgcgccgacgatgttgacgaggtcgttgtgggagagggtgacggcaccgctctggaggcggaaggaggcggttcccgcgccctccttgacgacgatgttgtcgtcgaacgcgatcccgtgccgctcggtcgtgttctcgttgacgacggtctggctgacgcccttgcccacgtacacggtgttgttgtggaagcgcacgccggtgaaggagccgcggcaggtctcgatgccgcggtagtggtcgtcgcggctgacgttgtagcggatcacggcgtcgccgagggttccggtggcggtgcacaccaggaagaagccaccggcgttgtcatggctgacgttgtactggaagacggtgccgaaggtgccttcgtcgacgtcgtacgccatgccgtcccgggtggtctcgccgccggagacctcgttgtactggaacaccgtgcggtcggcgttccacggccacatgcccgcgttgtacccggcggagcgccgctggaagccgtcgaggcggttgtgctcgacgagggttccgtccgtggcggtgatgacgatgccgtcgccgccgaggtcgctgagggtgttgccgcgcaccactatgtgagtggagggcaggtaggcgggcccgttcgggtcgtagtcgccgtgcacgggacggttgttccaggtggaggcgaagtagatgccctcgcggtcgacggtgcgcacggtgttgccggagacgaccacgtcgtcgaacttggtcggcacggcggacccggtgacggagaagaggatgcccgcggagccctcggtgcccttggtgtcgtcaccgcggatgtcgtggatgtcgagtccggtgagccggtagtgggtgccggtgccgtagtcctggagctggacgcggactccgcgcttgttgcggccgggagcaccggagttggtgatctccaggttgctcacctcgacccactgggtgttgcgcagcagcagcgtctcggggttgccgccgccgtcgacgacgggtttggcgcccttgccgtacgcgccgatcaccatcggactgccccgtcggccggtgccgtgcggggcgagggtgccggtgcagcggctgccgcgcttgagcaggatcgtactgccggtcggcaggtccagccggttgacctggtccaggctggtccagggcaggccgcgcgagccgttctccttcccgggggcggcgccgcagtcgacgtagtggacctgccgggaaccgtcccggtgggcgtcggccgccgaggcggcgggggcggcggtggccgccagcgtgacggcgaccagcgccgcgcccgctgcgcgcacggcctcgaagcggcgtggcaagggtatgggcatgtgtgtccgctctccttgggttgctgtcccgccgttctcgcaggcgaggccggccgggcaggggtttcttccgtctgtacggccggggcggcgcccggccccgtgtcgcccatcccgggccggcggcggtgagcaccggcgcaccgcggggcagtggcacggcagatgtgacgggaccggtcgccggcgggcgccggcgaccggtcccgtcacggtggtgacgaggcggctgccgcgccgtgcccgccgggtcggcggatcgctccagaggtccgatgctccgacggactccgacggctccgacggctccgacggcagtcggtcaaaggggctggtcatcagggcggttgcggttgcgcctggccggctcgaatcgatcggaacgtagtgcaggttgccgggccgccgcaagggggcggcggcctcgggg

SEQ ID NO: 773 - DNA, 2069 bp, Unknown
  Kingdom: Bacteria, Phylum: Actinobacteria, Class: Actinobacteria, Order: Streptomycetales, Family: Streptomycetaceae, Genus: Streptomyces
gcgcctacggcaccggcgcgctgccgcacctggaaggcggcggcgcgcacgacacggtcctgctacgcaacatggagtacgtcgaggtccgcgacctggagatcaccaactccggcggcacgcccggcaccgagcgcaacggcgtccggctggagctggccgactacggcatcggccaccactacgtgctctccggcctggacgtgcacgcggtgcgcggcggcgacttcaagacgctcaccgggtccagcggcatccagatcgacgtcgccggcacgacgaccgcgagcgccttcgacgacctgcggatcaccaggaaccgtatccgggacgtggaccgggagggcatctacttcaagtcgacgttctccaatcgccccctggtcggcaaccagcaggaccccaaggtctacccgggcccgtggacgcccagcacccgcgtccgcatcgaccacaacacgctgacgtcgatcgccggtgacgcgatgaagctcgacaccacctccggggcggtcgtcgagcacaaccgggtggacggcttccagctgcgttccaaggtcgccaacgccggcatctggacgttcaacaccgacgacaccctcgtccagtacaacgaggtctccggcggcggcaacagcctggacggcatgtccttcgacgcggacggcgcctcgaaccacaccgtgttccagtacaactacagccacgacaacaagggcggcttcctgctgaactgcccgtacagcggcgccaagaccgtcgacgtcgttgcccgctacaacatcagccacaacgacggtgcccggctgctgcagaactgctggggcccgatcctgaacacccagatctacggcaacaccttcctcaacaaggagaccgtccccacctacctggtccaggacgacgccggttcaccggccaccacccagcacgaactgaccatccgcaataacatcttcgccggtccgggcgacaccgccaccggcgcctaccgcttcaagaaccccacaccggcgctgcacttcgaccacaacgtcctgtacggcatcccgggcagcgtgcccgccaacaccgacggcagcggctcgaaccccggcggcagcaccgccgacccgaagctgatcgccgagctcgcgggcgccgacacctccgacaccggttcctaccgcctcgcccagggttcgtccgccctcggcctgggcgtgcccgtgccggacgcgggccggcacgactacttcggcttcccgatcccgaagcgccacccggccgccggcgcctaccaggggccgccggtccgctgacccgggcggagcgcggtggtgagtgcggcgtcgaacccggcgccgcactccgcgagcaccgctgcaccgcaggaccgccgtatgtcgctgcgctgctcgttaggcgaacgtgcgatgcgggcatgcggagttgtcacaggtgaaccgtcgtgcccgcaggcgctgctccacgccctcgggcacacacaggtgattcccccaagccgatcggcagccaccgccacccccacatcagcgacagagcccgtgacccggtccagttgcgcggcgaggagcgccaccgggccctggtcgagatgtgccgcggcatcggcgtccggatcccggaggccgactacgcgcggcgtgtgcaccgatgagacctcccgcatccggacccgtatcccgaccgcgacacctggtgccgggtgcgggtggccgacgccgaacgacggctggcacacccgcttccccgccctcgtcgccgtctgcggccacctgcacatcccccggacgacgacctgcgagggcgtccggtccgaggaggtcggatcctcgggcccgccgcgtgatccgcgcgaccgacccccgtgcgggcagcggcacatcggtccgcaacatgatccgtcatacgctcccggccgcgctggccgtctcactacgatgaccgcatgaatcttctgatcctcggaggtacggcgtgggtgggccgcgaggtcgcccggcaggccctcgaccgcggccatcatgtgacctgcctggcccgtggcgacagcggcgacgtcgccg

SEQ ID NO: 774 - DNA, 7212 bp, Unknown
  Kingdom: Bacteria, Phylum: Actinobacteria, Class: Actinobacteria, Order: Streptomycetales, Family: Streptomycetaceae, Genus: Streptomyces
cgaggtcggctgctgcaccgctccccgcgattcacgtgatcgttcccgtgatcgccttttggggcgccgaccgcctgcggttactatgcagactgcgcgcccgtgtgtccggcctcctggcctacgaactcctccgggcggctaatccgccggacaaccctctggctccggcgaaatccaagaagtcagccacaaggagaccgaaccgtgaagagcgccgtggagaccctgaacccgactcgggttcggctcactgtcgaggtgcccttcgaggagctcaaggacagcctcgacgcggcgtacaagaagatcaaccagcaggtcacggtgaagggcttccgcaagggcaagatcccggcccgggtcatcgaccagcggttcggccgcggtgcggttctggaggaggccgtcaacgacgcgcttccgaagttctacaccgacgcggtcaacgaggccgagctgaacccgctgggtcagcccgaggtcgacatcaccgagctgaaggacggcgagacgctgaacttcaccgccgaggtcgacgtccgcccgaccgtcgagatcccggactactccggcatcgaggtcgaggtcgacgccatcgaggtgaccgacgaggacatcgacaaggcggtcgagcagctgcgcgagcgcttcgcctcgaccagcccggtcgagcgcgccgccgaggacggcgacgtcgtcaccatcgacctggaggccaaggtcgagggcgaggtgctggaggacggcatcgccaacggcgtctcctacaccatcggctccggcgagctgctggacggcatcgacgacgccgtcaagggcgtggaggccggtggcgaggccaccttcacctccgagctgaagggcggctccgcggccggcaaggaggccgaggtcaccgtcaaggtcacccaggtcgccgcccgcgaactgcccgagctggacgacgacttcgcgcagctcgcctccgagttcgacaccctcgaggagctgcgcgcggacagccgcaagcgcctggagaacatgaagcagtacgaccaggccacgcaggcccaggagcgcgtcctggacaagctgctcgagctggtcgaggtccccgtccccgagaagctcctcgaggacgagatcaacacccgtaagcacaacctcgagcaccaccagctcggtcagatgggtctgaccctcgacaagtacctggagatccagggcaagaccgccgaggagttcgacaccgagacccgcgaggccgcggtcaagggcatcaagacccagttcgtccttgacgagctggtcaacaaggagaagctcaacgtcagccaggaggagctcaccgagcacctcatgcggcgtgccgcctcctccggcatgtcccctgaccagttcgcgcaggcggtcgtccagcagaaccaggttccgctgctcgtcggcgaggtcgcccgcggcaaggccctggccgtcgtggtcgaggccgcgaccgtgaaggacaccaacggcgagatcgtcgacctggacgacgaggaggacgaggccaccgaggccgagaccaccgagaccaccgaggccgcgtccgccgagggcgagggcgaggagaaggccgaggcctgatccccgcgcggcgtccgccacgtacgtacgatgggccctggggcactgctccccagggcccgtcgtcctacctggccacccccgcctcccgggtcccggcgctacgcccccggcgaacactcccgtcagcgggattccccgaaggggcccgcgcgttagggtccatgaatacgagggcaggggagtccccgaaaccggccggacggccccacgccccggcagaacacgtgagacggcccggcgccgtcgtaagacgagcaggtggatacgtgacgaatctgatgccctccgccgccggcgagccctccatcggtggtggcctcggcgaccaggtctacaaccggctgctcggcgagcggatcatcttcctgggccagcccgtggacgacgacatcgcgaacaagatcaccgcacagctgctgctccttgccgcggacccggacaaggacatcttcctgtacatcaacagccccggcggttccatcacggccggtatggcgatctacgacaccatgcagtacatcaagaacgacgtggtgaccatcgccatgggcctggcggcctctatgggccagttcctgctgagcgcgggcacgcccggcaagcgcttcgcgctgcccaacgccgagatcctgatccaccagccctccgcgggtctggccggttcggcctccgacatcaagatccacgcggagcggctgctgcacaccaagaagcgcatggccgagctgacctcccaccacacgggccagtcggtggagcagatcacccgcgactcggaccgcgaccgctggttcgacgcccacgaggccaaggagtacggcctcatcgacgacgtcatcacgcacgccgccggcatgccgggcggcggcggcaccggggcctgagccagctcagcccagccagcccccagccgaccgcccagcccctttccaggagacatcgtgaacgacttccccggcagcggcatctacgaccggacgcgcgccgagtacaccggccccacggccgagtcccgctacgtcatcccgcgcttcgtggagcgcacctcgcagggcgtgcgcgagtacgacccgtacgcgaagctctttgaggagcgcgtgatcttcctcggcgtccagatcgacgacgcctccgccaacgacgtcatggcgcagctgctgtgcctggagtcgatggaccccgaccgtgacatctcggtctacatcaacagccccggcggctccttcaccgcgctgacggccatctacgacacgatgcagttcgtcaagcccgacatccagacggtctgcatgggccaggcggcctccgccgccgcgatcctgctggcggccggcacaccgggcaagcgcatggccctgccgaacgcgcgcgtgctgatccaccagccctacagcgagaccggccgcggccaggtctccgacctggagatcgccgccaacgagatcctgcggatgcgcgcgcagctggaggagatgctggccaagcactccaccacgccgatcgagaagatccgcgaggacatcgagcgcgacaagatcctcacggccgaggaggccctgtcctacgggctcgtcgaccagatcatttccacccgcaagatgaacaacgccgccgtccgctgacgcggacaccgcacccgcccgtcgccccttggcgcggtcacgtcgaagtgaaccgcgccaaggggggcccgaacggggggcccggcaaggtaccgtcgacataaggcagcaccaggaaacgctggactctacgcgtccaggcgtctcccaggcgaaggggaagcacaccgtggcacgcatcggtgacggcggcgatctgctcaagtgctcgttctgcggcaagagccagaagcaggtcaagaagctcatcgcagggcccggtgtgtacatctgcgacgagtgcatcgatctctgcaacgagatcatcgaggaggaactcgcggagaccagcgaggtgcgctgggaggaacttcccaagccccgcgagatctacgagttcctggacggctacgtggtcggccaggaggccgccaagaaggccctgtccgtcgcggtgtacaaccactacaagcgggtccaggccggggagaacggcggcggccagggccgcgaggacgccatcgagctggccaagtccaacatcctgctgctcggccccaccgggtccggcaagacgctgctcgcccagaccctggcccgcatgctcaacgtcccgttcgcgatcgccgacgccacggcgctgaccgaggcggggtacgtgggcgaggacgtcgagaacatcctcctgaagctgatccaggccgccgactacgacgtcaagaaggccgagaccgggatcatctacatcgacgagatcgacaaggtcgcccgtaagagcgaaaacccgtcgatcacccgggacgtgagcggcgagggcgtccagcaggccctgctcaagatcctggagggcaccacggcctcggtcccgccgcagggcggccgcaagcacccgcaccaggagttcatccagatcgacacgacgaacgtcctgttcatcgtgggcggtgccttcgccggcctggagaagatcatcgagggccgcgcgggcgccaagggcatcggcttcggcgcgacgatccgctccaagcgggagctggaggccaaggaccagttcgaggacgtcatgcccgaggacctggtcaagttcggcatgatccccgagttcatcggccgcctccccgtcatcacctcggtccacaacctggaccgcgaggcgctgctgaagatcctcgtcgagccgcgcaacgccctggtgaagcagtaccagcgcctgttcgaactcgacggcgtggaactcgacttcgagcgcgaggcgctggaagccatcgccgaccaggccatcctccgccagaccggcgcgcgcggcctgcgcgccatcatggaggaggtcctccagggcgtgatgtacgaggtcccgtcccgcaaggacgtggcccgcgtcgtcatcaccgccgacgtggtcctctccaacgtcaacccgaccctgatcccccgcgacgcccgcggccggggcacgggggagcagaagacggcgtagccgcccgcgcacacggcacacggaaggggccccggtcgcttcgactggggcccttcgttactcacgttccactcaatgtgcgcgcaagcaggccgtctgggctaccgagccgtcgacgccggccttgatgagctcggtgaggcagtaggggtttggggcccacccaaggggcatcttcagggccttgttggcgcaagccgcagagaccttgggtcctacgatgtacccactcacgccgacataggtcttgcagcccgagtagcccacggcggaggccggtgttgcggcagcgacagggatgaggacggcggctgcggtgataccggcggcagacagcaggcgggtagccttcagtgctttcattctgactccttgtgcttccatagccaacgcctgtaggtgatcacgattcgctcacgcgtgcgaggcgtggataggtgttggctcgaagtgtgcggagaaagaccggaagcgggccaagtgtccagtagttgagccctcgggtgagaagctcaacgaagctggctatttcgggacgcggatctccttgcggagcttggtcgtgacctccatggccatgttcttcccacgtcaacccgcccctgatcccgcgcgacgcccgtggccggggtgcgggggagcagaagacggcgtagcggcagggcggcaggcgcgcggaagggccccggtcgcttcgactgggacccttcgttactcacgttccactcaatgtgcgcgcaagcaggccgtctgggctaccgagccgtcgacgccggccttgatgagctcggtgaggcagtagggattggaggcccacccaaggggcatcttcagggccttgttggcacaagccgcagagaccttgggccctacgaggtatccattccacgctacgtagttcttgcagcccgagtagcccacggcggaggccggtgttgcggcagcgacagggatgaggacggcggctgcggtgataccggcggcagacagcaggcgggtagccttcagtgctttcattctgactccttgtgcttccatagccaacgcctgtaggtgatcacgattcgctcacgcgtgcgaggcgtggataggtgttggctcgaagtgtgcggagaaagaccggaagcgggccaagtgtccagaagttgagccctcgggtgagaagctcaacgaagctggctatttcgggacgcggatctccttgcggagcttggtcgtgacctccacggccacgtccttggtgacgcccttggagccgtcgccgggggacactaggagttgtcttcaaatgtcaggcccacatcaggagcgctgcgagggtggcggctgcttggtaggactcggcggtcttgtcgtagcgggtggcgatctctcgccactgtttcaagcggttgaaggagcgttcgaccacgttgcgccgcttgtagaggtgcttgtcgaaggccggcgggcgcccgccgcaatggccgcgccggagccggttgcggatctggtcggaccgttgcgggatggtgtggccgacatgccgccgtctgagccaggcccgcgtcgtcgtcaccgccgacgtggtcctctccagcgtcaacccaaccctgatcccccgcaacgcccgcggccggggagcgggggagtagaagacggcgtagccgtccgcgcccacggcacacggaaggggccccttccgcatgcgatgccgggtgtcaggccttgacgcgtgccgccgagcgcagttgtgcggcgaaggcagccacgtcgtcctgtgtgaagccctggccgccggtcttcaccgcggtcaggtcgacgccgttgaccacgccgtaggtgctgtggtcggcccagatgcaggtgggtacggcgtaggtcttgccatcttcctggatcttggcggtctggcacttcatgagggcgccgtccagaccggtcggcttgacgctctgcgggctcccctcccaggtgaccgtctccttgccgcccatgttgtcgccggtgtccttggagttctcgtgggacttggcgaagcccttgtcgatcgcgccggccgggtcggcgatcttcccgtaagcgccgttgaccagcagcgactttccgatcttcgagaggtcggtcgggccgtagccgcccttcaccgtctgaccgttctcgatcccgagggccttcagcttgtccgcgctgttggcgccggtcgggccaccgtcgtcggagccggagctgtcggacttcttgtagccgccgaccgtcgccgggagcaccagcttgtgtgggccgtcgtccgcgaccgagccgccgccgctgccgctgcccccgccgatcgcgaagtacgcgcccaccgcgatcggcgggggcagcggcagcggcggcggctcggtcgcggacgacggcccacacaagctggtgctcccggcgacggtcggcggctacaagaagtccgacagctccggctccgacgacggtggcccgaccggcgccaacagcgcggacaagctgaaggccctcgggatcgagaacggtcagacggtgaagggcggc

SEQ ID NO: 775 - DNA, 4292 bp, Unknown
  Kingdom: Bacteria, Phylum: Actinobacteria, Class: Actinobacteria, Order: Streptomycetales, Family: Streptomycetaceae, Genus: Streptomyces
cctggtcaggggccgttctctcaagcggtgggtgtgggatttgaacccacggtgactcgcgccacgacggttttcaagacctttcggcgatcacggccgccgaccgctgcaccgcaggtcagacgcgcgcgggcaccccggcggagccgtcgtcatcgtcgtcgtgcccgctacgtgccccaggctcgtgatcgtgcccgctgagccaggagtccgccgcttcggccacctggtcatcgcggccggcgaccggccgggcgtagtggcgggtcgtgacgctcgcgttcgagtggccgagccggtgagcggcggtcatcacgccgtaccggtcggcgacccacgtaccgtgcgaggcccggagatcgtgcggcgtgacgtcggtcaggccggccgccgacaccgcagggtcgaagtacgccttgcgccactggttgtagcgcagcggctttcccgcgggcgtggtgaacaggagtgcgtcctccccacccggcagttcctccaggtagttcccgagccgcttcgcaagggacggacccacccggagaagccgcttctgatgggacttgggcgtgtcgaagacgagggcgccgttggcttcggccaagttctcgtcgaccaagacgaggccgccgcgcacgtcgatgtccgcgcgccggagggcgaacgcctcgccgacccgcagacccgcgtacgcaaggagcgcgatcagcaggtcatgcggcttggccgcgttccgcacgatgcgggaggcttcgagcggcgtgaggatgtgcggctcggtctgcggcatccggggcagcttcacccccctgcacggcgtctgcgggatcatgtcgttgtcgacagcagaccgcatgatctgcgaaagcacgcggtacgcctgcctgatccgcgacgcgctgaggcccctggttctcattccgccgacccactcagcgacggtgatcggtcgaagactggacagctcacgatctccgagcgccggttcgatcagcgagttgatcagcgagcggtacgacgcctgtgtcttgtgcttgagctgtggagagacagcggcaagccaccgagcagcccattcccgcacggtcgtctgtccctccgccgggtcgagccagcgcccctcttcgatctcgatgcgcttccgcatgagccagcggtcggcgtcggtcgacgtcgcaaacgtccggtcggcaggacgcagcacgccgtcagggcccgggtaccgagcttggaaccggccggacggcagcttgcgaacacgcccgaagttgcgacgggacttgcgcttgccgggcatcaggccgccctcctgaaaccggtgggacgcagggagaccggttccacgctgttggcgtccacgtaggcctctacggcgctctcggggatacggacgtgacggccgaccttgacgaaggtgatgcggcgctcctcgatcaggcgccgggggaagcgaacccccgtgccgaggcattcggcgacctggtccacggtgagcagtcgatccacggtcaccactccctctcggcgacgggcaacgcggccaggacttcgcgggctgtctgccggttgaggtggaggtcacgggcgatggtggccgcgagtgcggattcgccgggggtgtggccgtggccggcgtactgccagtcggcgaggacgaggaccgtgtccggctcggcgtcgaccaggtcgagggcggcgcgttcctgcgcggcgcggtagtcggcgcgtgcctggcggagggcgccgagggtggtcgagtaccggcgggacttcgaggagaagtggccgcggaagccgagcatgtgcgcccaggcccacagccgccggtccgggtagagcgggtcgaggagcttgcacgcggcgacaagccgccgggtgtggtcgggtacgccgtggcggtcgagttcggccatctcaccgatgcgccggtcgagggtcccggtgttctcggcggctttggtggcgtacttcgcgacgtaggaggcgacggcctgttcggtcaggtcagagccgtccccgaacgccgtgatgggccgtacgtcgagctgggtgccccagcggaaggtgcgggcgggctgatcttcggcggccgggatggtcaccgacgtgtaggagtgcgcggcggcggcgcggatcgaatcagcgaggaggtcgacggtggcccagaacggcggcggtgtgtccggcccctcgggtccgtcgacgcggatcacggcgtggaagtgcacggcaccgcgcttctggaattccgccaccttgccgtacgacagccgggcgcgctccttcagctcccgttgggtgaggccggcgcgggcggcgatctcgcggcggagacggttggtgaagcgctgccagagctgcccggcgtggttgttgaacagcacggcgcccgcgtagtcgtacgtgctcgggtcgagggcggtgccgagggcgggatcgtcggccgggtggctggtgccgcagcggcagacgccacggtcgggccggttgtggaccgggccgaacgagggggcggtgagggtggcgaagacacgggggtgatcgcggacggtggcggggacgtcgcggcgatcgtcaccggccaggcccgcccggatcaggtggtaggtgtcgcccgcgtacgtccaggcgcaggacgggcagcgggaggcccggcggttgccgcaggcgacgcggagccgtccgcccggttcaccctcggtcgagtagtggtgaagggtctgcccggtcgtcttgtctttgtggagcacccagccgcgcagatggatcgggtcggcgcagccaccggtgcggcgaacctggtcttcccagcggtcgaagccgggggacccggccacccggagaaggtccttcagggtgatcgggtccaggttcgcgagggtcgcggtgtcggtcatgcggcaccgtccgacgcggtgtcggcgatcaggtcgagcgcggaggcggcttcctcggcggcacgggcgagggcgcgcagggcgccggcggtacccggtcgggcgaggaacgcgatgtcgacctgcttaccgccgatgcggaggctgacgaagctgtcaccgtccggcgtgctgtcgaacacgttcacccggatggtggtgtccggctccaggtgggccgaggtggtgatggtcttcacgcgatcaccgccccgggacggacgagaacgttccggcacggcgccggggtgaagtcgggcatcatggagcttccctttcgggtccattggatctggaaggtgggaaggcacccggggcggacgaaacttggcggtagaggccgccccgggggccgctcagcgacgcgtgcggtgcatgccggtcagcgagcgcagaaccacggcgcacacggcgacggagacgccggttatggccacggccagcagcatggagaccaggaccgcgccgacgaccaggaccacggcggtgccgccgccgacgagggcgagcgcggtgccgggggtgagctggacgaccgggcgggacggtgccaccggagcggcgaaagcctgcggcgggaactgagcggcggccggcgtgatggcggtcggctcgatgacggcgggcatggtgacgacgccggtcggggtcggcatggtggggatcttcgggcggagcatgggcggactcctctacttgatgaggccgttgatggcgggggcgatcgtgctgtcggcgaggaggaagccgccgagcagaagcagcgcgatcagccaggcgggcggccggaagagcttgatgccgaggtagccgacgacgagcagggcgagccagagggggacctccatgactgtgacctccggtcagtaggcgcggcaacggtgggtgcgggcggcgagctgggcggcggaacggctggagtagtccgaggaccagccgcagccctcgttggtgcacacggccgcgtgcttggtctcgccgaagcggtcgcggtgagtgccgatctgtaccgggccgatccgcatcacggagtggaagaagtcgcgggcgggcatgggccgttctccttgtgtgtcaggcgaggtgggcggcgatggtgtcggcgagctgggccgggacgccgaggcgggcgcggagggtgtcggtgtcgatctgggcaccggtccgggcctggtggtcggcggcgaccttccgggcgtgctcgacgagcgcggtcgggaccggtacggcgggcggcggtgtcggaaccggctcagcggccgggagcaccggggcgtcctcgggagccgtgaccgggtccggctcggtgacggcgaccggttccggctcgacctcgggcagggacggggcatccgg

SEQ ID NO: 776 - DNA, 1024 bp, Unknown
  Kingdom: Bacteria, Phylum: Actinobacteria, Class: Actinobacteria, Order: Streptomycetales, Family: Streptomycetaceae, Genus: Streptomyces
gggcggcgcggcacggcaggggctggtgaaggcgtgagcggtgccggactacgtcgtggatggggcctggggcaggcagtgaagcagaggagcagctcgacgtgagtgtcgtacccgccgacgtgctggccggcgcgacggccgcgcaggacaccggccccgcccggccggcggtcgccgagctcgggccgcgggcccggctgtggccgtcgctggcggccgtctaccgggcccagctgtcccgggcgcgggtggcgcggatcccgctgctgttcgtggcgaccttccagtccgtcggcatcatgatcatgatgcggggcgtggtcagcggcggcggcgaggcccagtccgtggtggccggtgcgtcgatcgtcgtcgtcgcctacgtcgccctcaacctgctcgcacagtacttcggccagctgcgctccagcggcgggctcgaccactacgccacgctgccggtgccgcccgctgccgtggtcctcggcgcggcggcggcgtacgcctccttcacggtgcccgggacgctcgtcaccgcggtcttcggctgcgcgctgttcgggctgccgctgggcaacctgtgggtgctcgtggcggtgatcccgctcgcgggcgcggcgcttgccgggctcggagccgcctgcgggctgctcgcaccccggccggaactggcgacactgctcgggcagttgggcatgtcagccgcgctgctcctgggggtgctgccgccggagcggatgccggagatcatccggctcgcccgcgacctgctgccgtcgacgtacggcgtggaggcctacgcccgcagcttcgccgaccatcccgactgggcgtgggtgggcatcgacatggccgtctgcgccggggtcggcgtggtctcgctggccgtggccacctgggcctaccgccgggcggccgtccggtgacgcggccggtgaagtcacctggcacgatgacagggtgacccctccgttgactcctcccacgccgccgaaccggcgccccgcccagccctccgggc

SEQ ID NO: 777 - DNA, 3508 bp, Unknown
  Kingdom: Bacteria, Phylum: Actinobacteria, Class: Actinobacteria, Order: Streptomycetales, Family: Streptomycetaceae, Genus: Streptomyces
gcgctgggcggggtgaagggggaagggtttcacggccggtcctgctgtcaccggggcggttagagtcgccgtcatgagttcctcgcccgccgacctcgtccgtcagttccaccaggccttcgggctcgacgtccgcagcacgccggtacaggtgccgccagagctggcggcgcaccggggcgagctgctggccgaggaggcggccgaagtggccgaggtctcggtcgacggcccgctcgaccggctggcgcacgaactggccgacgtggtgtacgtggcgtacggcaccgccctggtgcacggcatcgacctggacgaggtgatcgccgagatccaccgctcgaacatgacgaagatcgggccggacggccgggtcgcccgccgcgccgacggcaaggtgctcaagggagaccactaccgggcaccggacgtgtcggccgtactgcggcgtcagggctgggagcctgaccctgcctgacgggccctgcctgagggctccggctgacggcctcgcctggctccggctggcggcccctgcctgaccgtttccgccgtgctcagcgcaccgggccgggcagctgcggcaccgggtcggaggtctgccgcgtcggccgccgggaagtccgccggggcggccgccgccgcgcgcaccccaggcccaggaccagcgcgagcccgcacagcgtgaccacgtccttgaacgcccgtcgcgtcgacgcctccaggtgcgggaacgcgaactccggcacctgcggcaccagcaccgcccagaaccacggcgagcgcgtcaccgacccggcctcgaacgccccggcgaccagcaggggcacgaccacgaccaggtagtgctcgtaggacggccgggacaccaggaacgacgccagcatgagcatggcggccgtgtccgcgagccgcgccggaccgggatcggcgcgccgccagcgccgccaggcgcacaccacaccggccgcggccgccaccaacggccgccacctccgcgaggagcggcggtaccccgagccgcggcagcaccgcggacagcgagcagtcgaacggccgcatcagggcgtcaccgcccctgaggaggaacggcagcgtgcgcgtgaagaagccgcccgggtccggcatgaccagggccattccggcggacagcgccagcggcagcgccaccatccaggccagggcacgccactgccgggccaggagcagcagcacggccacgggcacgagcagcggcttgaccgccacggacagtccaaggaccaccccggccacgccccagcgcccgcggtccgccagcagcagggccaggggcagcgccagggcactgaccgcggtccagttgccgaggtcgatcagatgaccgacgggtgcccagcacagcaccaggccgagcagccccagcaccgcgaaccggctgagcgccggcacccggaacagccgcacggcacaccaccagccggtcacgaccagtcccacgcacaccatgggcgcggcgaccctcagcacgaccgccggcagcgccgcctgacccgcggcgaacagcacggcgctcgggaggtacaggaaacgccggtcggcgtacggggcgccgccgtgcagccacgtctgcccggcatggacgacgaaggcgttgtccatgcccccttgggcgtggacgaccgccacatgcgcggcgcgggccaccaggacggcggcgaggaggacgagccaggcggctccggccggacgcagcagccagccgcgcagggctgcggccggggccgcgtccggggcggaggtccgcagggcgtcacgtagctgcatcacacgtacctgtccgggaggggctgccgcgggcctgtcctggaggggctgccgcgggcgggaaacaccgctatgggcgagtccgccccattctgggcccgcggctcccgccccggagccaacggccggccgtgtcgcggtcaccgggccgcgccccgcgcaccggccgctcggccgtccgggtgcacttccgcgagcgcctacccttatgggcatgagcagcatcgaccggggccaagaagtgggcgtcacgcgcagctacgagatccgcacctacgggtgccagatgaacgtccacgactccgagcggctggccgggctgctcgaggacgcggggtacgtgcgggccccggagggctccgacggtgacgcggacgtcgtcgtcttcaacacctgcgccgtccgggagaacgccgacaaccggctctacggcaacctcggccgcctcgcgccgaagaagacccagcggcccgggatgcagatcgcggtcggcggctgcctggcgcagaaggaccgcgacaccatcgtcaagaaggcgccctgggtggacgtcgtcttcggcacgcacaacatcggcaagctgccggtcctgctggagcgcgcccgcgtccaggaggaggcgcaggtcgagatcgccgagtccctggaggccttcccctccacgctgccgacccggcgcgagagcgcgtacgcggcctgggtgtccatctccgtcggctgcaacaacacgtgcaccttctgcatcgtcccggcgctgcgcggcaaggagaaggaccgccgtcccggcgacatcctcgccgaggtcgaggcactggtcgccgagggcgtctccgagatcacgctgctcggccagaacgtcaacgcctacggctccgacatcggcgaccgggaggcgttcagcaagctgctgcgcgcgtgcgggacgatcgacggcctggagcgcgtgcgcttcacctccccgcacccgcgtgacttcaccgacgacgtgatcgccgccatggccgagacgccgaacgcgatgccgcagctgcacatgcccctgcagtccggctccgacacggtcctgaaggcgatgcgccgctcctaccgccaggagcgctacctcgggatcatcgagaaggtccgcgccgccatcccgcacgccgcgatcaccaccgacatcatcgtgggcttccccggcgagaccgaggaggacttcgagcagacgctgcacgtggtgcgcgaggcccggttcgcgcaggcgttcaccttccagtactccaagcggcccggcaccccggccgccgagatggagaaccagatccccaaggaggtcgtccaggcccgctacgagcggctggtcgccctccaggaggagatctcctgggaggagaacaagaagcaggtcggccgcaccctggagctgatggtcgccgagggcgagggccgcaaggacggcgccacccaccgcctctccggccgcgccccggacaaccgcctggtccacttcaccaagccggaccaggacgtacgccccggcgacgtcgtcaccgtcgaggtcacctacgccgcgccgcaccacctcctcgccgagggcccggtgctcggcgtgcgccgtacccgcgcgggcgacgcctgggagaagcgcaccgcggccgaggcggccaagccggcgggcgtcatgctgggtctgccgaagatcggtgttccggagcccctgccg

SEQ ID NO: 778 - DNA, 1565 bp, Unknown
  Kingdom: Bacteria, Phylum: Actinobacteria, Class: Actinobacteria, Order: Streptomycetales, Family: Streptomycetaceae, Genus: Streptomyces
ggctgtggacctccggcccgcccctgccccgggagccgatcgggccggaggtccacagcccgttcagccgccgagggtttcgccctcggtgatgcgtgcgccccgtgcccagtccgccgcccgcatgggcttcttgccctgggcctgcacccacagcagctcggccgcgtacgaacccgtgccgacgtggacgctgttcttgccgacggcgagcgcgcccggtgcgaggtcggtgcgctggggcgccggggtgacctggatcagcttgaggcgttcgccgcggaacgtggtccaggcgcccggcgccggcgtgcacccgcgcaccacgcggtcgacgcgcagggcgggggcggtccagtcgacccgggcgtcctcgacggtgatcttgggagcgagcgtcacgccctccgacggctgcggcacggccttcagggtgccgtcctcgatgccgtccatggtcgcggcgagcagccccgcaccggcgagggcgagccgggtgagcaggtcgccgctggtgtcggtggggcggatcacctccgtgacggtgccgtagaccgggccggagtccaggccctcctcgatgaggaacgtggacgcgcccgtgatctcgtcgccggccatgaggctgtgctgcaccggcgcggcaccgcgccaggcgggcagcagcgagaagtgcaggttgacccagccgtgcgcggggatgtccagggcggtcctgggcagcagggcgccgtaggcgacgacggggcagcagtccggggcgatctccttgagccgctcctggaattccgcatcgcgcggcctggccggcttgagcacctcgatcccggcctcctcggcgcgctcggcgaccgggctcgcgatcagcctgcgcccccgcccggccggtgcgtcggggcgggtgacgacggccgcgacctcgtgccgtccggaggtgatcagggcgtccagggcgggaacggcgacctcgggggtaccggcgaagacgagcttcatgagcgggtgcgggcctctcggtcggggtgggtacgcggcccacaagtctatgaccacgcaaggccgtgggcgggaagcggccgagggcgggcaccgcagcgcacgcccgctcctcagggggcgtacgcatatgcccttacgcccccacagcgtgacccgcgggctgaaaacgcgttggtcaagtgagagttgaccaaaaggggccgctcgtacggcccgttcctttcaacgccggttcgagaggcttgttcatggccgaccacgcaacccacgacgcccaggcccgggccagcctgcacttgctggtgcgggacatcgagcgggtccgccggcaggtggacgcgctgcgcacgctcaccgcccagttgggcaacgtctaccgcccgcgccgccccggcccctccacgggcttcgtcgtctacggacgggcccccgccccgaccgtccgcctcgcgcaggaacttcgggacagtgtcgagaccctggtgacggccgccgtcgacttcgaccgctcgctcggcttctcgtgggacgccgtgggctcggcgctcggggtcaccaagcaggcg

SEQ ID NO: 779 - DNA, 1493 bp, Unknown
  Kingdom: Bacteria, Phylum: Actinobacteria, Class: Actinobacteria, Order: Streptomycetales, Family: Streptomycetaceae, Genus: Streptomyces
cgacccgtacgggtcgtagggggccgccgggggtgcgggagccgcaggggcgccagaaccgtaggtgctgtcgtacgcggtgttgtcgtacgcaggcgcgtaggaaccggtggctccgggggcctcgtaggactgcggctggtgcgccggatacggctcgtgggacgacgggtaggtcccgtaggggtcgcccggggccggagcctggggctgctgggcgggcacgccgttgcccgcggcgtacgggtcgtacccgtagtcctggcggccgtacgcgtcgtacgtctgctgcggggtctgctgcgccgggacctgccggtacacaggccggccgtactcgtcgtagccgaccagttcgtaaccgtcgtccccgtacgcagcgtcgtatcggtcgttcaccggtgcccctctcggctcactcgccgcggtacagctcgcgtttggcgatgtagcgcacgactccgtccggcaccatgtaccagatggggtctcccttggcgactctcgcccggcagtccgtggaggagatggcgagcgcggggacctcgacgagcgagacgccgccttcggggagaccggggtcggtgaggtggtggccgggccgggtcaccccgatgaagtgcgccagggagaacagctcctccgagtcgcgccaggtgaggatctggccgagggcgtcggcgcccgtgatgaagaacaggtccgtgtccgggttgagggcgcgcaggtcgcgcagggtgtccacggtgtaggtggcaccgccgcggtcgatgtcgatgcggctgacggagaactgcgggttctcggcggtcgcgatgaccgtcatcaggtagcggtcctcggccgcggagaccttgcggtgggacttctgccagggctggccggtggggacgaacaccacctcgtccagctggaactgcgcggcgacctcgctggccgccacgaggtgcccgtggtggatcgggtcaaacgttccgcccatgacgccgaggcggcgcttgcccgtggacgacgggccgctgccggggccgtccccgagatgcttcaccgtgtcgctccccggaccggtaggcatgtcctgctctcccatgcgtgcagaccctaccgggcccggtccgggggcctgccccagctccgccgggctcagcggtcgcggttgaagcgggtggtgatccagagcaggatcagcaggatggcgagggcgcatccgcccgtcaccgccgggttgaggctgtcgtggctgccgccctcggcctcggcgaggttgaccaactggactgcggtgctggggatgatcatcttcggcagacctatccgggtgtgggcgggataaagacgtccgcccatcgtaagcgcccgcctccacgccgctcaccccgactccacggttgcgccgggcccgcgtattgggcggacggccacggccgtcccgggcggcccggagtgctggatacggccggcccgtcggcccggtcggtcccgctcgcacggtc

SEQ ID NO: 780 - DNA, 4938 bp, Unknown
  Kingdom: Bacteria, Phylum: Actinobacteria, Class: Actinobacteria, Order: Streptomycetales, Family: Streptomycetaceae, Genus: Streptomyces
cgtgcgggctgcggccggcccgtccgcgcaggtcgcggacgacgggcgcggggcgctcgccgcgccggtcgcgggccggggcccctggctgtccgggcagggcgagggcccgggtcgtggcatacgcaggcgcggtcctgttcaccgtcatcgtcctcccccggggtggtgacggttcacctcccccttgagcgtaaagagaaggtaatacgcgggtctgccgtttccgtgcgcgttctgccacaggccggttacagatccggcctgccgcgaagtgtccgggcatgcgatgatgtgcgcgccaactgcataccggccgcttgaatccgcgcgggagagtccccggcagtacgtctgcccggggcgccgaaggagcaagtccctcccttgaatctctcaggccccgtaccgcgcgggcgaggcacatctgaaaagcgggccgctgtcgcagtggctccacccaaggtgcaagccgtgcccgtccgtccgtcggcggtcatggcgaacctctcaggttccgatgacagatggggaggacacccgacctgtcctcgcccgttccttcctgggagaccgaccgatgagcagttccgcgtccctgccgctccgccgtaccgcgctcgacgcggtgcaccgttcgctgggtgcgacgatgaccgacttcgccggctgggacatgccgctgcgctacggctccgagcgcgacgagcacgtcgccgtgcgcacgaaggccggtctgttcgacctgtcccacatgggcgagatcaccgtgaccggcccgcaggccgccgccctgctcggcttcgccctggtcggcaacatcgccaccgtcggcgtcggccgcgcccgctacacgatgatctgccgcgaggacggcggcatcctggacgacctgatcgtctaccggctcgccgagaccgagtacatggtggtggccaacgcctccaacgcgcaggtggtcctcgacgccctcaccgagcgggcggccggcttcgacgcggaggtccgtgacgaccgcgacgcctacgccctgatcgccgtgcagggcccccagtcccccggcatcctcaagtcgctgaccgacgccgacctggacggcctgaagtactacgccggtctgcccggcacggtcgcgggcgtgcccgcgctgatcgcgcgcaccggctacaccggcgaggacggcttcgagctgttcgtgaagccggagcacgccgtggagctgtggcaggcgctgacgaaggccggcgagagcgcgggcctggtcccctgcggcctgtcctgccgggacacgctgcgcctggaggcgggcatgccgctgtacgggcacgagctgaccaccgcgctgaccccgttcgacgcggggctcggccgggtctggatgcgcgacacctacgtcaactgcttcaggatcgcgggccgccgcccgctctacgtcgccaccggcaccacccgggtacccggcctcgacacggccggcccctggaacgacgggatcttcgtgtggacggccgactccctgcgcggcccgtggcggctggccgacacgaccggcatccgccccggcgccgagaagggcaaggtctggtcgccggagttcgccgacgagaaccggcccgggcgcacggtcgtcgccccatggcagcagtattggtacgacgaccggttcggcaagcgcggcaacgtctgggccccggaggtgcactactaccgggacacctggtacatcgtcgcgtgcatgggcgaccgcgcgcgcaaggtcggctccttcgtgctggtgagcgaaggcggcgtcgagggaccgtaccggctcgtcgagggcaacctcgacaagcccttcggcgatgcgctgcccgacgcgccgtacatcgatcccggggcgcgttttcacatcgacggcagcatgtacaccgagggcgacgacgcctggctggtgctgcacaacaacttgtacgcccggttccgggacgacatggaggacatcgtcccgacgacggcactcccggcgttccggcagcagccctacaccccggagccctacctggagggcgcgtacgtcttcaagcacggcgggaagtactacctgctgcacgccgcgtgggaccgcacctcgaccgccgccgaccgcagcacccgccacgcctacgacacgcccgccgccggccggacgcagtaccactacgacgcgatcgtcgccgtcgccgaccacttcgaggggccgtactcccgccgctggaccctgggcgtgggcgccggccacaacaacatcttcgcggacgtcgacggccggctgtgggcgacgttcttccgcaaccccaacttcggctactgggccgacccggcacgtatcgccgatgccgcggtgcccggcgtcgtccgcctggagtggaccggcccccagggcaaccgcctgtacgtccagcgccggaaccggggccttgccatcagcgagtgaaggcccgaggcgacgcgatctgcccgtgcggggcgccggcccacgcagcacaccggccggttgagtcgcgtccatgcccgatcgctccgaccacgttctcctcccggaaggggacactgtgacctgcccgaccgctccgaacatcgtgttcgtgatgaccgatcaactccgcgccgacttcaccgccggcgtgggcttcgacctggacacgatgcccttcctcgactccatcgccgcccagggcacccgcttccgtcgcgcgtacaccaccgccccggcctgcgttccggcacgtaccagcctgctcaccggcagatggcccagcacccaccgggtacggcagaactccaacaccgacccgcaggacgtgtcgcgcggagacgatctgatcgatgtcctgcgcggcgccggctaccaactgttctacgccggcaagacgcacatgtaccgggacaacccggaggactacgacgccttctccggtccgtacgggcacacgaagggccccgacaccaccacggagcagcgcgccttcaccgcctggatgaactccatcgacatgggcccgacgaccgcccccaccccgttcccgccggagcagcagtacgcgtaccggatcgtctcggacaccatccggcaggtcgacgcccgggaccccggcaagcccttcttcgcctgggtctccatgcccgagccgcacaatccgtaccaggtgccggagccgtacttctcgctgttcgacgaggacgagatccccgaccggtcctgcggccccgaggccgcggaggccaagggcggcgcctacaagtggctgcgcgacctggtggaggagaagcgccccggctacgacaagctctggcgccgctaccgcgccacctactgcggcatgctccgcctcatcgacgaccagctgcgccggctcgtcggccacctggaagagcagggcctgtgggagaacaccctgctgatcttcctcgccgaccacggcgattacgccgccgactacggactgcagcgcaagggcgccggcatccccgaggtcctggcgcgcatcccgatggtcgtgcacggctgcggcgtcgaaacgcgggacaacgagaaggacttcgtctcgatcgccgacatccttcccactgtgtgcgaggcggtcggccgccccatccccctgggtgtccagggccgcagtctgtggcagctgctcaccggctccgactacccggccgcggagttcgccgacatcgtcaccgagcgcggctacggcggcctgccctatcccgacgacgcccggccaccgctgcacttcccttaccaaggcaccaggtacgacgagctgaacagcgtgacgcagagcggctcgtcgcggatgatccggcacgaccgctacaagctctacgagcatgtcgccgacgccggtgagctgtacgacctccacaaggatccgatggagttgcacaaccgctgggacgatccgagcctgcgcaaggtcaaggccgacctcatgcagcgactccagcgatggtcggtccggctcaccgacgaccttccgaaagggatctacgaacccagcctcgcccgccacaactggtaccggacctcgcaggaggagggagcatgaccggaccgatccgccgcagcgacggcaaccggcaacctctcccgtcacgccgtacggtcctgcgtggtgccgccgtcaccgtggccacggcagccaccaccgccgccacctccggaaccgcttccgcggccggcgccggttcctcccccgcggtcgtcgaccatccgggtgcgcggtggctgcccgccgaccccgccaactaccggaccgcacggcgcccccacagccatccggtcgaccacgtggtcatccacgtcacgcaggaacacttcgacgacgccgtcgccgtgttccaggaccccggccggaagacctcggcccactacctggtccgctcggcagacggccacatcggccagtgcgtccgcgagaaggacatcgcctggcacaccggtgatccctcctacgacaaccgcggcatcggcatcacccacgagggctgggtcaattccaccgcctggttcaccgaggagatgtacgtcgcgtccgcggcgctcaccgcggcggtatgcgcgcgccatgcgattccgctggaccgggcccacatcctgggtcaccacgagctgcccggcgccacccacaccgaccccggggccaactgggactgggatcactatctcgaactggcacggaaggcgagaaccgacagctgagccggacgccccggggggccgagccgaggggcgtcgcccctcgggcgtgcgccgggacccggaccggcgcgggcccgtcaccactgggcgatgagcggcgtgtccggtgcgtgccgccgccgggcctggatgaggcgggcgacgcgggaggggggcggcgatgcctcgcacggccgcgatcctgccgtcggcgacttacgagttggtgcgtgatagcg

SEQ ID NO: 781 - DNA, 795 bp, Unknown
  Kingdom: Bacteria, Phylum: Actinobacteria, Class: Actinobacteria, Order: Streptomycetales, Family: Streptomycetaceae, Genus: Streptomyces
gtggcgatcatggtcaatcgggcggtgctggcgcatcggctgttcacggggatctctcggcgtcatctcgcgtgtctggtcgaggagttggcggtgccgtggcaagccggcctcgagggtcgtcgccatgctgcacgaggtggagccaggaagcgggccgcgggagccggcgcccgccaccagctggtcttcgtcgaccggctggtggccacgttgatccatctgcggcacgacctgccgcactcggtactggggctgctgttcggcgtcgaccgctcgaccatcacccgcgcgatcgcagagatacgtacgctcctggccgagcgggggtgcgcggtccccgaccgtcccggcctgcggttgcggacgttggcggacgtcttcgcctacgctcaggccgagggtatcgagctgcggatggatgccaccgagatccaggtccgccgaccaccggccggccgcggcggacggcgcgcattcgtgtccgggaagaagaaacagaacaccatgaaggccaccgtcatcgccgactggcggggccgcacactatggaccgacaccctgcggcctggtcgtatgcacgatgccacggccgcccgaaacgagggcatcgccgtctgcttccagcacttccccgacgtcgaagtcctcttggacgacggctacctgggcctgagccgcgaccaccgcgggcaagcgatcacaccacccagaaaaccccggcccggagcactgcccggcagagtcgaacagtgggaacgcgaccgccacggacactcctccgaccgcatcacc

SEQ ID NO: 782 - DNA, 3630 bp, Unknown
  Kingdom: Bacteria, Phylum: Actinobacteria, Class: Actinobacteria, Order: Streptomycetales, Family: Streptomycetaceae, Genus: Streptomyces
ttcgcgctgctgctcgccgcggccgtcgtgctgatccggctcggcgtccccgagggcgcggcgagcagcagcgcgaacagcacacccgccagccccgccgcccgcggagtgcgcagcgcctgctcggtcggcgtgatcgcggcggtggtcacttacggtaaccgaggatggtcatcatgccggactcggagtggtactggttgtggcagtgcagcatccacaggcccgggttgtcggcgtagaagtcggcgacgagcttgcggtgcggcagcacgatcgccgtgtccttgcgcgtgccgatgtcgttgaggccggtcagcgcgaacgtgtgaccgtgcaggtgcagcgggtgccacatgtcggtggcgttgatcagcgtgagccggacccgctcgtcctggcggatgggatggcggtgctcggtggagtacggctggtggtcgaaggcccagtcgtagttcttcatgctgccggtcagccggatccggatgtgccggtccggttcgccgtcgcggaaggccaccgactcctgcggcatgagggcccgggccggcagcagccggccgtccagctcgtccggatgcaccgagggcgaggggaggcccttgcccttgtcggtgcgcagcacggccagcgccctggccttgctgcccttgccctcggccactgcgaccagcgggaacatcccgtccttgacggtgacgaccacgtcgtagcgttcggccatgccgaggagcagggcgtccgtctcccggggctcgaccgggtagccgtcggtgtgcgtcaccgtcatccggtggccgcccagggccacccggaacgcggtgtcggcgcccgcgttgatgagccgcagccggacgcggtccccgggcttggccctgaacacctgggcggaccggggcagatgcccgttgatcaggtagtacgggaagtcgacgttgccgcccatgccgtccaacaggcggctgtgggagtgccgcaggatacgggaggggccgtcggccgacttgccgtacggcgcgctgcggccggccgaggcgtgatgactggcggaaccttcctgctgtgtgtccgcgccgcccatgtccatgctcatcggcgggcgtttgcccccgtgcagctgcgacagcacgccgtccggtgtggagccgtccaccccgtccacccagtcgtccaggacgacgacccactccttgtcgtaggacagcggctccttggggtcgtccacgatcagcggcgcgtacagaccccggtcgagctgcatgccctcgtgggaatggaggagataggtgcccgggtagctcacggcgaagcggtagcggaactcctcgcccggcttgatcccctcctgcgtgaggcccggcacaccgtccatgtcgcagcgcagccgcaccccgtgcgagtgcagcgtcgtcgccaccggcagacggttggccagcgtgaggtcgaggatgtcacccttggtcacccggatcaccccgccgggcaccgcgccgccgtacgcccacgtcctgacggagcgtccgcccaggtcgaacgtggtctcggcggccgtgagccggtgggtgcgcacaggccccgcgccgcgcttgcgctcggcggccagcacctcggggtcggacgggttcacgtaccccttgggccccttgggcacgaaggggcgggagccgccgtccgcggtgccggagcccggcgccgagcccgaacgccggctggtgcccgggtgcggacccgcctccgacggggagcctgacccggagcaggctcccaggagacccgagccggcagccatgatcgaggcactgagcaaggtgcgccgcgtaggtgtgtgcatgaatgaataacacacgttttatggcgatatgtgggagaaccgaagcggcgcgtccggtgatgtcggcggtcaatttccctgtgacggcgcccggcatccggggagggtcacccggtcggccgacaacgtacgcggcgggaacgcgtcctcgttcagggtgacttggccgaaaagcattcactgaccggcgtcggagaacacgaagaagcggcggcaggcaccgggacgccggtgcctgccgccgcttctgtcaggtcagttggcccgggcggccgctcgtcgggcgttgttgtacaggcgcagcagatgcttggcgacggcacacggcacgccgtccgcatgacactggcggcacgtctgcaggtgctgttggtgttcagaatgcgcttgctgcagagcatcgccctgggacggcatgaggatcctcgcacggggtcggacggagaagagcgctcaactcggctgtacggagcacccgaagccaaagttgatcacgttactcccggtagtggaaagcggcatccggccacgctgcgccactgaccgtcacgacccggctggtcactgagggtcagatccgcaggtcagccctgtcgtccggagtacgcccaccagcggccctcgtgccggttcacggcgatcggccggccgaagcaggaggtcagccaggggccggtcaggacgtccgccacgggtccgcgggccaggatcctgccctcgcgcagcagcagcgcgtgactgacggcgggggacagctcctccaggtggtgggtgaccgtcacggtggcgagccgcgggcgtccctcggccagccggtgcatggcctcgacgaggtcctcgcgggagggcaggtcgagagcgttgaacggctcgtccaggagcagcagggcgggctcggccatcagcgccctggcgatgaggatccgggcccgctggccgcccgagcagacgccgtacggccggtccgccaggtccttgatctccagttcggcgaggagttcgtgcgcccgctcacggacctcgtcgtcgtaggaccgccacagcggctgtaccgtgccggtgtgaccggtcagcacgacggtgtgggcgtccatgtcctggggcacgcgctgcgcggaggtgacatgcccgatgagggcccgcagttcgcgcacgtcgacacggccgagccgggcgcccagcacctcgacactgccggtcgtgggatgcatcagcgcgccgaggagccgcagcagcgtggtcttgcccgcgccgttcgccccgagcagcgcccagtgctcacccggcccgaccgtccagtcgatgccgtcgaggatcacctggtcggccgtgaaccggcgcacgcccacgtcccggagcgccacgacggcggcctcctgcgcgggcccggcctgctccgcgggccgtcgctgcgttatgtcctcggccattccagggctcccctcgacgcgttcggcccccgtctcctcgacaccgtagacgttagatgcatctggcatcttgccgccggtctgtccggttcgtggacgcccctcgcggcgggcgggccgcgtggtcaggcggcgagatcccgggagtcacccatgaccaccaccgggtgcaggcgcggatcgagcgtgcgcagcaggtagcgcatcgcgtcctcggactggctcacgcacgcggacgtgccgctgccgtggtccatgtgcagccagatgctgccgcccttgtgctgtccctcgggccgggtggggtcgttgggtgaggtgccgcggaggcggttgtagtcgatcgcgatgacgtagtcgaagtcg

SEQ ID NO: 783 - DNA, 4776 bp, Unknown
  Kingdom: Bacteria, Phylum: Actinobacteria, Class: Actinobacteria, Order: Streptomycetales, Family: Streptomycetaceae, Genus: Streptomyces
acaccggcgccggcgccggccagaccgtctggcacgcccacgcgcacctcctcggcggccgtggcctgcagtggccccccgggtagtgagccgtgtccgtccgtgaactcgtcgtcctcggcaccgccagccaggtcccgacccggcaccgcaaccacaacggctacctgctgcgctgggacggcgagggcatcctgttcgaccccggcgagggcacccagcggcagatgctgcgcgccggggtcgcagcgcacgacctgaaccggatctgcgtcacccacttccacggcgaccacagcctgggcctggccggagtgatccagcggatcaacctcgaccaggtcccgcacgagatcaccgcgcactacccgcgctccggcaagcgcttcttcgaccgcctgcgccacgccaccgcctaccgcgagacggtcgctctcaccgaggcccccgtcgacgcggacggcgtcctcgcgacgacaccggcgtacacgctggatgcccgccgcctctcccaccccgtcgagtcctacggctaccggatcgtcgagcccgacggccgccgcatgctgcccgaccggctcgccgcgcacgggatcaagggccccgacgtgggccgcatccagcgcgagggcaccctgggcggggtgccgctggaggcggtgagcgaggtgcggcgcgggcagcggttcgcgttcgtcatggacacccggctgtgcgagggcgtgcacgcgctcgccgagggctgcgacctgctggtcatcgagtcgacgttcctcgacgaggacgagccgctcgccgacgagcacggtcacctgaccgccgcacaggccgcccgggtggcccgggacgcgggcgtacggcacctcgtgctcacccacttcagccagcgctacaccgacccggaggagttcgagcggcaggcgcgggcggccgggttcgacggggagctgaccgtggcccacgacctgctgcgagtgccggttcccaaacgcctctgaccaggccgtacgatgctctgatgcccctgcccaaagctgaactgcacctgcacgtcgaaggcaccctggagcccgagctggccttcgagctggccgagcgcaacggcgtgaaactgccgtacgaggacaccgaggccctccgcgaggcctaccggttcgaggacctccagtcgttcctgaacctgtactacgagctgatggccgtcctgcgcaccgagcaggacttcgcggacctcgccgacgcctatctcgcgcgggccgccgcgcagggcgtgcggcacgcggagatcttcttcgacccacaggcccacctcgcgcggggcgtggagatgggcacggtcgtcgaggggctgtggcgctcgctccgtcgcagcgaggagaaccacggagtctccacccagctgatcctgtgcttcctgcgcgacgagtccgccgagtccgccctggagaccctcaaggccgccgagccgtacctggaccggatcgcaggcgtcggactcgactcggccgaggtcggacacccgccggtgaagttccgcgaggtgtacgagagggccgccgccctcgggctgcggcgcgtggcacacgcgggggaggagggcccgccggcgtacatcaccgaggccctggacgtgctcggcgtcgagcgcgtcgaccacggcctgcgctgcatggaggaccccgcgctggtcgaacgcctggtccgcgaccgggtcccgctgaccctctgcccgctctccaacgtccggctgcgcaccgtcgacaccctcgccgaccacccgctgtccgccatgctggacgcgggcctgctgtgcacggtcaactccgacgacccggcctacttcgggggctacgccggcgacaacttcgacgccgtgcaccgcaccctcggcctgagcgaggaccgcctgcgcgagctggcccgcaactccttcctcgcctccttcctggaacacgacgaggagcgcaggcagcggtacctggccgaggtggaggcgtacgagttcgggtaggtcccttgacggcttcgggtagatccattgacggctcttgttcgtctacctagtctgcattcccatacgtggacagcattccggtcggaagcgccgggagtgccggaagcgcagggagagccggacagtcgggagacatggtgggagacaaggtgccggaccccgggtccgacctcacgatcaccggcgtgcgtctgacgccggtcctggtcgccgacccgcccctgctgaacacccagggcgtgcaccagccgtacacgccccggctgatcgtggaggtggagacggccgacgggacgacgggcgtcggggagacgtacggcgacaccaagtacctggagctggcccggcccttcgccgagcgcctgaagggccgccaggtgagcgacctcaacggcctgttcacggtcatggacgaggtcgccgtcgacgcctcacgcgtcgagaccgccgtggacgtcggcggactgcgcggcgcgcagaccgccgacaagctgcgcctgtccgtcgtctccggcttcgaggtcgcctgcctggacgcgctcggcaaggcgctcgggctgccggtgcacgcgctgctcggcggcaaggtgcgcgacagcgtcgagtacagcgcgtacctgttctacaagtgggccgcgcatcccgccggagtgccctgcgaacaggacgactggggcgccgccgtggacccggccggagtcgtcgagcaggcgcggcggttcaaggagcggtacgggttcacgtccttcaagctgaagggcggcgtgttcccgccggacgaggagatcgccgccgtacgcgcgctggccgaggcgttccccggccacccgctgcggctcgaccccaacggcgcctggtctcccgccacctcgctgaaggtggcggaggaactcggcgacgtcctggagtacctggaggaccccgcgctcggcacgcccgccatggcggaggtcgccgcggggacgggggtgccgctggccaccaacatgtgcgtgacggcgttcgcggagataccggaggcgttcgcgaaggacgccgtgcaggtcgtgctctgcgaccaccactactggggcggactgcgcaacacgcggcaactcgccgccgtctgccgcactttcggggtcgcagtgtccatgcactccaacacccacctgggcatcagcctcgccgccatgacccacgtcgccgcgaccgtcccggacctccaccacgcctgcgactcccactacccctggcagtcggaggacgtcctcaccgagcgcctgactttcaccggcggtcgcgtcgccgtaccggacgggcccggactcggcgtcgaactcgaccgggagaagctggagttccttcaccggcggtggctcgatgacgacggctcgctgcgggaccgcgacgacgctgcggccatgcgggtggcggacccgcgatgggtcacaccggccgtgccgcgctggtgagggccgcggggctgcccgaggccccgccgcacccggcgtgaccgccccgcccggtgcgcgaagtggtgcacactggcctgatccgcaccatgccaggggagcgcaccgtgaccgcgtccagcacgcccgccggagaaggaccggaccacctgaggggtcaggagtgcccgcagggacaggagccccgcgacgggcaggagtacggcagggggcaggtgtcccgcagggggcaggagtcccccgaggaccgcgagtacccccgcgaccgggagtacgtcgtcggcgcggcgcacgcccccgccgcgccccaggtcgacccgctggccgcgctgcgcacggtggacgacccgccctgggacgtctacctcacgggaccggtcttcctcgacatcatcttcaccggcctcgactccgccccggtgcgcggaacggagtcctgggcgcgcgggatgggatcgagcccgggaggcgtggccaacatggcgaccgccctggcccgcctcggcctgcgcacctccctcgcggcggccttcggcgacgaccactacggggagtactgctgggacgcgctggaacagggcgagggcatcgacctctcgccgtcccgtacggtccccggctggcactccccggtcaccgtctccatggcgtacgagggcgagcgcacgatggtctcgcacggccacgagccgccaccggaggacgtgctcctccaggaggacggccccgtccgcctgccgcccgcgcgggccgccgtcgcctccctgacccccggcaggcgcgcgccctggatcgcgggggccgcccgcaacggcacccgcgtcttcggggacgtcggctgggacgacaccggcgcctgggacctggcgggactcgccgacctggagcactgcgaggcgttcctgcccaacgccgaggaggccatgcgctacacccgcaccgactgcccgcgcaccgccgcccacgcgctcaccgagttcgtaccggtcgcggtggtcaccctcggcgcggagggcgcctacgcggtcgaccggcggacgggggagagcgccgaggtgcccgccatcgaggtcgaggcgctggatccgacgggcgcgggcgacgtcttcgtggccgggttcgtcaccggcagtctggccggctggccgctggccgaccggctcgccttcgccggcctcaccgcggcactgtcggtgcaggagttcggcggctccctgtcggcgccgggctggtcggagatcgcggcctggtggcgccgggtccagtcggtgccgggccaggacccggcggccctgcggcggtacgcct

SEQ ID NO: 784 - DNA, 3258 bp, Unknown
  Kingdom: Bacteria, Phylum: Actinobacteria, Class: Actinobacteria, Order: Streptomycetales, Family: Streptomycetaceae, Genus: Streptomyces
gtccggtggccggccagccggccgccgatgaccgcgacgcaggccgccgcggccgccacggccagcacggagggcagccgcaggatggagacaccgggcccgaagcaggtgaagagggcgtgcatccacaggtagtacagcccgtgcacggcgtccacgtgctggagggtgtgccagatctggccggtcgaccgctgcgccaccagccaggtcgcggcctcgtcccgccacacgctgtgccgccgtgtgagcccccacaggccccacagcacggtccacaccaccgggagcgaccagacgggcaggcggggccggggaccggccgggtgagaggtcatgaaaatggccggtcctcgcagcggtgatcatccggatggaccgcacagggtacgtgcgacgccgacccggatgatcaccaaccgtgaagaaccggccaagggtactactcagtaagacttcaagaacccgcagtgagacctctaagaacccgaggcaagacctcaagcacttgagggcggtgctcagtggaagaagtgccgcgtgcccgtgaagtacatggtcacgcccgccttcttcgcggcctccacgacctgctcgtcgcggatcgaaccgcccggctggacgatggccttcacgccggccgtgatcaggatctcggggccgtccgggaaggggaagaacgcgtccgaggcggcgtaggcgccgcgcgcccgctcctcgccggcccgctccaccgccagcttgcaggagtcgacgcggttgacctggcccatgccgacgccgaccgaggcgccgtccctggcgagcaggatcgcgttggacttcacggcacggcaggccttccaggcgaaggcgagctgggccagctcgtcggcggacagggcctcgccgctggccagcgtccagttggccgggtcgtcgccgtcggcctggaggcggtcggtgacctggagcagcgcgccgccgtcgacgggcttgacctcggccgggtgggagggcgcgcccggcgccttcaggacccggatgttcttcttcttggcgagggcttcgagcgcgccgtcctcgtagtccggggcgacgatgacctcggtgaagatgtccgcgacctgctcggccatctccttgctgaccggccggttcacggcgatgacgccgccgtacgcggagaccgggtcgcaggcgtgcgccttgcggtgcgcctcggcgacgtccgcgccgaccgcgatgccgcacgggttggcgtgcttgatgatcgccacgcacggctcgtcgtggtcgtacgcggcacggcgggcggcgtccgtgtccgtgtagttgttgtacgacatctccttgccgtgcagctgctccgcctccgcgaggccggtgccggtgccgtcgacgtagagcgcggcgggctggtgcgggttctcgccgtagcgaagcgtgctcttgcgctccagggtggcgccgaggaagtcggggaaggccgagtcgtcgacgggcgcgtaggaggcggcgaaccagcccgccaccgcgatgtcgtacgacgccgtgtgctggaacgcctcggcggcgagccgcttgcgggtggccaggtcgaagccgccgtcctgcaccgcggcgaggacgtcggcgtaccgctcggggctggtgacgaccgcgaccgaggggtggttcttggcggcggcgcgcaccatggaggggccgccgatgtcgatctgctccacgcactcgtcgggcgaggcaccggaggcgaccgtctcgcggaacgggtagaggttcacgacgacgaggtcgaacggctccacgcccagctcggcgagctgctgccggtggtcctccaggcgcaggtcggcgaggatgcccgcgtgcaccttcgggtgcagggtcttgacccggccgtccaggcactcggggaagccggtcagctcctcgaccctggtgacgggcacgccggccgcggcgatcttcgcggcggtggagccggtggagacgagttcgacgccggcctcgtgcagcccgcgcgcgagctgctccagaccggtcttgtcgtagacgctgacgagcgcgcgccggatgggccgcttgttgctctcggcggtcactggataactacctttcgtccctcgatgcgatagccgtggcgggcgagccggctcacgacctcgacgagcagccttcgctcgacttccttgatgcgctcgtgcagcgcgctctcgtcgtcctcgtcccggatctcgaccacgccctgggcgatgatcggtccggtgtcgacgccgtcgtcgacgaagtggacggtgcagccggtgaccttggcgccgtacgcgagcgcgtcccgcacgccgtgggcccccgggaaactgggcagcagggcggggtgcgtgttcacgaaccgcccgccgaaccgcgcgaggaactccttccccacgatcttcatgaaccccgcggacacgacgaggtcgggctcgtacgcggcgacggcctcggcgagcgcggcgtcccactcctcgcgcgtgccgtggtccttgaccttccgcacgaaggtcggcagcccggcgcgctcggcccgcgccagtccctcgatgccgtcgcggtcggcgcccacggcgacgatctcggcgccgtacgactcggctccggcctcggcgatcgcgtcgaggagcgcctgcagattggtgccggatccggagaccagcacgacgaggcgcttggccacgggcttggcggccacggtggggccctttctcggggagctgttttgtacggtcgtacgaatgcttcgcgcccccggatacggggaagcctacgaaacggccgaccgccagcaacgataccggcactcccgacggcccccatgggacgggggcgtggccggaaggtagcgtctgcacagacctggtacgccaacgcgccggggacgcccggggagaccgggggaacgcacttggcgctccgggcgttcaaggggtggggacctgtcggatcgccttgcgagacgggccgggaaacggctcgcgaaccgtctcgcggaccggacggcggggccgccggacccgtcggaccagtcgtccggtcgacctgtcgtgactcaccaaggggaagacgctcacttgaagcccgaccgcagcccgcgactcctcacgctccctccgctgtcggtgcagggaggggagcgcggcgccgtgctgctgcgggagcgccccacctcaccgcccaacgcgcccgcgggcggggacgacggcggcgggcgaggcggctccgctcccgacgacaacc

SEQ ID NO: 785 - DNA, 3605 bp, Unknown
  Kingdom: Bacteria, Phylum: Actinobacteria, Class: Actinobacteria, Order: Streptomycetales, Family: Streptomycetaceae, Genus: Streptomyces
cccccggaagacgccctagcggcggcccttcggcgagtccagcagaccggcgcggcgcaacgcgtccgccatggcgctgttggccggcgggggcgcctgacgcgaaccgccgccgccaccgcccccgccgcctccgccgcggctctgacgctgctgcggcggccggccgccgcgctgccgccgctcaccgccgccgccctgcccctggcggtcctgcggcgccgcctcgtcgtccagacgcagcgtcagcgagatccgcttgcgcgggatgtcgacgtccaggaccttcaccttgacgatgtcaccgggcttgaccacgtcccgagggtccttgacgaacgtcttcgacatcgccgacacgtgcaccagaccgtcctggtggacaccgacgtcgacgaacgcgccgaacgccgccacgttcgtcaccacgccctccaggaccatccccgaggacaggtcggagatcttctccacgccctccttgaaggtggccgtcttgaaggcgggacgcgggtcgcggcccggcttctccagctccttgaggatgtcggtgaccgtgggcagaccgaaggtgtcgtcgacgaagtcggccggccgcagcgagcgcagcacacccgtgttgccgaccagggaggccacctcctggcccgtggtcttcaccatccggcgcaccaccggatacgcctccgggtgcacgctggaggcgtccagcgggtcctcgccgtcgcggatcctgaggaagcccgcgcactgctcgtaggccttcgggccgagccgcgagaccttcttgagctgggcgcgcgaggtgaacgggccgttggcgtcgcggtgcgccacgatgttctcggcgagcgagccggtgacgccggaaacccgcgagagcagcggcacggacgccgtgttgacgtccaccccgacaccgttcacacagtcctcgaccaccgcgtccagagagcgggagagcttcacctcggacaggtcgtgctggtactggccgacgccgatcgacttcgggtcgatcttcaccagctcggccagcgggtcctgcagccggcgcgcgatggacaccgcgccgcgcagcgacacgtccatgccgggcagctcctgcgaggcgtaggcggaggccgagtacaccgacgcgcccgcctccgacaccatcaccttggtgagcttcaactccgggtgcttggcgatcagttcaccggcgagcttgtcggtctcgcgcgacgccgtgccgttgccgatcgcgatcagctcgaccgcgtgctccttggccaggcgcgccagcttggcgatggcctcgtcccacttgttggccgggacgtgcgggtggatcacgtccgtggcgacgaccttgccggtcgcgtccaccacggccaccttgacccccgtacggaagcccgggtccaggcccagcgtcgcgcgggtgccggccggcgcggccagcagcaggtcacgcaggttggccgcgaacacgttcaccgcctcgtcctcggcggccgtgcgcagccgcagcctgaggtcgatgccgaggtggacgaggatgcgggtgcgccaggcccagcggaccgtgtcggtgagccacttgtcgccgggccggccgcggtcggcgatgccgaagcggtgcgccacgatcccctcgtacgacgacggtccctcggtggcctcctccggctccaggacgaggtccaggacctcctccttctcaccgcgcagcatcgcgaggacgcggtgcgagggaagctcggtgaacggctcggcgaagtcgaagtagtcggcgaacttcgcgcccgcctcctccttgccctcgcgcaccttcgcggccagccgcccgcgcacccacatccgctcgcgcaactcgccgatcaggtcggcgtcttccgagaaccgctcggtcaggatcgcccgggccccgtccagcgcggcctgcggatcggccacgcccttgtccgcgtccacgaacgccgccgcggcggcgagcggctccacgcccgggtcgccgagcaggccgtccgccagcggctcgaggcccgcctcccgcgcgatctgcgccttcgtgcgccgcttcggcttgaacggcaggtagatgtcctccagccgcgccttggtctcggcgccccggatccgctcctccagctcagcggtgagcttgccctgctcgcgcaccgagtccaggatcgcgctccgccggtcctccagctcccgcagatagcgcagccgctcctcgagcgtgcgcagctgcgcgtcgtcgagcatctcggtcgcttccttgcggtagcgggcgatgaagggcaccgtcgaaccgctgtcgagcaactccacggcggccctgacctgccgctccctgacgccgagttcctcggcgatcctgccttcgatggaccctgctgcgagggacccgggtgtcgtcacgttccggtaccgccttctccacttcgggttgcgccgcaattgtggcaggcggcaccgacatccggggatcagggcggcctccggcgggcgcgtcgccgcggcggaccgcggctcccgaggccggcccgtcccggcgggagcatggccgagcccccgcgggagcgtggcagaaaaggtgggaaatccgtcgttgcggccgtccgcgcgcccgccgagaatcgacgtcatggcgcagcgaaccgttctcgtcgtcctcttcgacggcgtgcagagtctggacgtcaccggcccgctggaggtcttcgccggggccgagaagcacacgccgggcacctaccgcatccgtacggcctcgctggacggcggccccgtccgcacctccagcggcctgaccctcgtaccggacaccgcgctcgccgacgcgcccgcgccgcacaccctcctcgtccccggcggcgagggcacccgccggcccgatccacgcctggtcgaccgggtgcgcgcacacggagcgcgcgtggcccggctggtctcggtgtgcaccggcgcgatcctgctggccgaggcgggcctgctggacggccgccgggtcaccacacactgggcgtactgcgcgaagctcgcccgcgaccaccccgcggtccgcgtcgagcccgacccgatcttcgtacgcgacggccacgtggccacctcggccggtgtcaccgcgggcatcgacctggccctcgcgctcgtcgaggaggacctgggccgcgacaccgcgctcaccatcgcccggcacctcgtcgtgttcctgcgcaggcccggcaaccaggcgcagttcagcgcccagctcaccgcgcagaccgcccaccgcgacccgctccgggacgtccagcagtggatcagcgagcacccggccggagacctgaccgtcgaggcgctcgccgcccgcgccgccctctcgccgcgtcacttcgcccgcgccttccaggccgagacgggcatgacgccgggccggtacgtcgaccgggtccgcctggaacacgcccggcgcctgctggaggacaccgccgacggcatcgaggcgatctcccgcgccagcggctacggcacacccgaggccatgcggcgcgccttcctgcgcacgctcggcgcctcaccggcggagtaccggcgccgcttccgcccggcgcccgccaccccctgacctc

SEQ ID NO: 786 - DNA, 1889 bp, Unknown
  Kingdom: Bacteria, Phylum: Actinobacteria, Class: Actinobacteria, Order: Streptomycetales, Family: Streptomycetaceae, Genus: Streptomyces
ccggcgcccgtgcagcgggcggcgaccgagcccgcccccgcggcccgcgccggggagccggtcgtccagcgcgccctcggcttcacgaaggggcggtggtcgcgggagaacctcccgccggaccggttcgccgcactgctgcgggaggcgtcccaggagcaggagggcaccggcttctccgtcccgtaccgggggctgttcagcgccttgcagcagtcctccgtcacggtggagatcgacgacgagacgccgttcgccgggtcgcgcgcgaacttcgccatcgacgaccagaccgcggaaggcggcgtcctgcgcatcgagccgcccgccgcgaacgcctcggcacgcacgctgcgcgagttcgccgcgacggtgacgcacgagatgcagcacgccctcgactccgtcaccggcggcttcaagtcacagcagcccaagcagacgatgaaggagcggtggatctcctccgagttgcgtgccttcgggatggaggcggccgctgcgttcaaactcgccgtcggggacagctaccccgccagcgaaggcaaaccctccaagatcctccaggcgatctccgacagccggctctcctccgaacgtaagcaactcgccctggaattccaccagatggacggatatctgcgcgcccacaggcagccgctggacgcgttcccgtccgccctcccggtcgaggagagcgcgctgctgaaccgcctcgccggctatctgagcgtctacggactggtcgagaagggcgccgcgtcccgcgaggcggcactggagtggctcagggcgaaaccggcggtcgaggccgccgggctcagggcgggcatcgagctgttccacgacaaccgccctcaggtcgacaggacccgctgacaccgggtccgtcgcgaggcgttgaggccgtgaggccacgatgtctcaggccgtgctgccggggcccggcggcaggtgcactgtcatgatcagatggcaggccgacgtgcccgagccccggtacgtgtgggacgtgtcgccgtcgaaggtggcggtctggccggcttccacggggtgctcggtaccgtcgacgaccagggtcatccggccggacgtgacgctgacggtctccacgacgcccgcctggtgcggatggctcggatactcctcgcccggctccagccgccagcgccagacctcgaccggggccggccccgaggtggtcagcatgagccgtgcctcgccaccgcgcggtccgctccacagcggggtcagggtggcggccgccacgacgcgtacgcggccttcggtacggccctccagcagggcggagacggagacgccgagggtgtcggccagtcgtaccagggtggcgaagttcgggtttccctgcgccttctccagggccaccagcgcgcccttgctgacctgggcgcgcctgcccagctcgtccagggacagacccgcgcgcgtgcgggccgtcctgacgttgtgggcgagcgtccgcagggccgcctcggtctccggcatccggtcctctcctcgatcgctgggacacaggggccactgaaggtcactgggtcactggggcacttggtcactgcaatgtaccgcgcggtcgttcggttgacgcagtgcggtcggtctgttgtacggtgcggtcgttccatcaatcgtaagggatctaccgtgatcgcactgctgctggccctgggcagctccctcgcctacggctgcgccgacttcctcggcggcctcggtgcccgcaaggcccatgtcctgcggaccgtcatggtcgccgctcccgccagcctcgcggtcgaactgctgctgtggcccgtcctcggcgcctccttcagcccccgcgccctcggctggggagccgcctccggcgtcgcctcggccgccgc

SEQ ID NO: 787 - DNA, 5063 bp, Unknown
  Kingdom: Bacteria, Phylum: Actinobacteria, Class: Actinobacteria, Order: Streptomycetales, Family: Streptomycetaceae, Genus: Streptomyces
  misc_feature (4666)..(4799): n is a, c, g, or t
cgggcggccagggcggcggcggtcctcgccgccggtgcactggccctctccctgaccgcgtgcggcggttcgggtgacgacaagaaggccgacggccccagcagcagcggcaccggcggggacgcgggcagcggcgcgaccgtcaccctgcccaagctggacggcgcgtccctggaggtcgccgccgtctggacgggcgccgagcaggccaacttcaagaaggtcctcgcggagttcaccaagcgcaccggcgccaaggtcaccttcgtccccgcacaggacccgatcatcaacttcctcggttcgaagatcgcgggcggtcagccgccggacgtggcgctgctcccgcagccgggcgccatcaagcaggccgtggacaagaagtgggccaagccgctcggccccgaggcgcaggcgcagctcgccaagaactactcgcagggctggcaggacatcggcaaggtcgacggcaagcagtacggtgcctactacaaggccgccaacaagtcgctgatctggtacaacgccaaggtcctggagggtgcgggggcgagcgagcccaagacgtggaaggacctgctgaccaccgcgcaggcggtctacgactccggggtcaccccgttctcgatcggcggcgccgacggctggacgctcaccgactggttcgagaacgtctacctgtcccaggcgggcccggagaagtacgaccagctcgcccagcacaagatcaagtggacggatccgtcggtcaagcaggcgctcaccacgctcgcgcagatctggtccaagaaggactacatcgcgggcggccagagcggcgcgctccaggtggagttcccggcgtcggtcacgcagaccttcaccggcggcgaccagccgaaggccgccatggtctacgagggtgacttcgcgcaggtcaacatcggtgagaccaaggcgaaggtgggcacggacgcgaaggtgttcccgttcccggccgtgggcgcgaccgcgccggtggtctccggcggcgacgcggcggtgatcctgaaggactccaaggcggcgcaggccctggtgacgttcctggcctcgccggacgcggcgacgatccaggcgaagctcggcggctacctgtcgccgaacaagaacgtgccggagtcggcgtacccgaacgaggtgcagcgcaagatcgccaaggcgctcatcgagtccggcgacgatttccgcttcgacatgtccgaccaggccccgcaggccttcggcggcacgcccggcaagggcgagtggaaggacctccaggacttcctgaagaacccctcggacgtcgcgggcacccaggcgaagctggagaaggacgcggcggccgcgtacggcggcggaagctgatccggcgatgacgtcggcagccgcggagggcgtcgcccgcaagacggcgccgccctccgccccccgcccgcgcaagagcgtgaccggcacccgcaagaccgtggcggtgctcttcctgctgcccgctctggtgctgctcggcgcgctcgtggtctacccgatcgggtactcgctcgtccgcagcttctacgactcctcgggccacggcttcgccgggttcgacaactacaaggcgctcttcaccgacgacggcatccggaccgcgctgaagaacaacatcatctgggtggtggtcgcacccgcggtcgccaccgcgctcggtctggtcttcgcggtgctgaccgaacgggtgcgctggggcacggcgttcaagctggtcgtcttcatgccgatggcgatctcgatgctcgcggccggcatcatcttccggctggtgtacgaccaggacccggacaagggcgtcgcgaacgcggtgtgggtcggcgtccacgacaccttcgcgcagtcgtcggcgttcccgaaggcgcacccgggccggaactcgccgctcgagcccgaccacggcggcttcctcaccacgagcccggtgcacacgggccagtcggtggcgctgccgctggtcggcgtcgcccccgaccagatgccgggcggcgcgaagaaggccgtccaggcgaaggcggagccggggaagatcaccggcaccgcctggcaggacttcacgcgcggcaagggcgtcggcaggctcggcgcggtggacccctccgagcagggctacgccgggatgcggatcgaggcggtcaaggacggcaaggtggtggcgacggcgaaggccgccgccgacggcacgttcacgctgtccgcgcaggccgacggggcgcgactgcggctgcccgcgagcaacttcgaggagccgtacaacggcgtcgactggctcggcccctcgctggtcaccccggccatcatcggcgcgtacgtgtggatgtgggcggggttcgcgatggtgctgatcgcggcggggctcgcgggcgtgccgcgggagctgctggaggccgcccgcgtggacggcgccaacgagtggcaggtgttccgcaggatcaccgtgccgctgctggccccggtgctcgcggtcgtcgcggtcacgctgatgatcaacgtgctgaagatcttcgacctggtcttcatcatcgccccgggctcgtcgcaggacgacgcgaacgtcctggccctggagctgtaccgcaagggcttctcggagggccgcccgggcgtggccagcgcgatctcggtgttcctgctgctgctggtgatcccggtgatggtgttcaacatgcgtcggctgaggcgggaggtgcggcggtgaggaggccccacgctccctgccgggggtccgggggtcgccccccgggtgaacacagcaacatgcgacggctcaggcgggaggtgcggcgatgaggaggcctcacgctccctgccgggggtccggggggcgccccccgggtgaacacagcaacatgcgtcggctgaggcgggaggtgcggcggtgaggaggcctcacgctccctgccgggggtccgggggtcgccccccgggtgaacacagcaacatgcgacggctcaggcgggaggtgcggcgatgacgaccgaagctgtcaccgaggcgcgggcggtgcccgccgcgcggcccgcgcgggcccggcagccgctcggttcccggctcgcggagatcgccggcgggggtctggtccgggtgttcctgatcctggtgggcctgttctggctggtgccgacgatcgggctgctgctgtcgtcgctgcgctcaccggaggacatgagcgccaacggctggtggacggtgttcaccaagccctcccagctcaccttcgacagctaccagaagctgctcgagaacggcgacatcacccactccctcctcaacaccgccctgatcacggtcccggcgaccgtgctcgtggtggtggtcggctcgctggcgggctacgccttcgcgtggatggagttcccgggccgcgactggtggttcctggccgtggtcggcctgctggtcgtgcccgtgcaggtggcgctgatcccgatcgccgaactgttcggcaagatcggcctgttcggcaccatcttcggggtgatcctcttccacaccggcttcggcctgccgttcgcggtgttcctgctgcggaacttcttcgcggagatcccgcgcgaactgctggaggcggcccgcctcgacggcgccggtgaactgcgcctgttcgcacgggtggtgatgccgctgggcggccccgccatcgcgagcctcggcatcttccagttcctgtgggtgtggaacgacatgctggtcgccctggtgttcaccaagtccggcacccagccgatcacggtggccctgcagacgcaggtgcgccagttcggcaacaacgtcgacgtcctggcgccgggcgcgttcatctcgatggtgatcccgctggccgtgttcttcgcgttccagcggcagttcgtgtccggcgtgatggcgggcgcggtcaagtgaccgtggcgcgcgggaggcaacccgtgcgggcaagggggcgggccgacaccggtccgcccccttccgttcacccacgatcccccatatgccgtagcgaaccgtaaccaattcactccatcggccgtttccgggcacggcagcaccgaccgcccgcgcgacccttggatgccccgttgcccaggttcagtgtcatcgtccccgcgtaccgcgttcaggcgtatctgcacgagtgcctggagtcggtgctctcgcagtccttcatggacctcgaactggtcgccgtcgacgacggctcaccggacgcctgcggggagatcatcgacgagttcgcggcccgcgacccgcgcgtgcgcgccgtccacctgagcgagaaccggggtctcggcgccgcccgcaacgccgggatggagcgggccaccggcgagtacctgctcttcctggacagcgacgacaccctcacgccggacgcgctgtgggcgatcgccgcccgcctcaaggagaccggcgacccggacctcctggtctacgacttcgcccgcacggactggaccggccgggccgtccgcgacgacgtcaccgccccgctgagccaggaaggcccggcccccttccggctggccgaccgcccgggactgctccgggtgctgatggtcgcctggaacaaggcgtaccggcgggacttcgtgcggcgcgagggcctcgccttcccggacggctactacgaggacgcgccctggacgtacccggcgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgtcttcgcgcagtacgaccgggtgttcgcgttcctggaccggcggcccgaactgtcctgctggcggccggtgctgttccgccgcatggtcgaccacttcaccacggtgttcacccgccccggccggctgccgcgcggctgccgcgccgagttcctgcgccgggcccgcacgtactaccgccgctaccgctgcccgggcgcccggcccggcccgcgcccccggctgcggcacgccctggtccggttcggcctgcaccgcac

SEQ ID NO: 788 - DNA, 1645 bp, Unknown
  Kingdom: Bacteria, Phylum: Actinobacteria, Class: Actinobacteria, Order: Streptomycetales, Family: Streptomycetaceae, Genus: Streptomyces
gccgccgcccgggcggcggccgtgtgcgacgctggccggtatgaaccacgcacagctgacggcgctcgggcgggccctgcgggtggtcggggagcacggtgaggaactgaacgccgagaccccggacgcccggctgcacgagatcaaggcggatctgcggcgggccctggacctgctggaggagagcgtctcgcaggaccggcccgccacccggtgcgccgagcaccccgccgggcccgtcgacaaggacgcgcccgacctgtgcctgctgtgcgagacccggcgccgcgccgcgcgccgggcccagtacgacggcggcccgcgccgcccggccgcaccggcgcccggcgagagcgccccgacccgctacggcgtacgcgaggaccgtccgcagccccagcagcgctggctgccggagctgtggaacggccgggaatggcagctgtgcggcaccccgcgccgggagcggcgcgaggcggagctgttcatctcggcccagcagcgctcaccgcgcgcggcgatggcctaccggctcgtccacgagttcaccgactacgaggtggtacggatctggggcacacccgtacgcgtggacatcgagccgatgggcaacatgtgagcgtcgtgcccggggctatgccttcacctggggtgccttcgcctccgcggccgccgtgaccggcgtggccgccgccgcggtgccccggcccgggatgaaggcggcgatgacgaacccgagcagggcggcgcccgcgcccagcgcgaggacggtgcggaaaccgttctcggagggcagcgcgtaggggccgaacttcgtggtcatgtgggcgagcaccacaccggcgaccgcgctggcggtggaggtgccgatggaacgcatcagcgtgttcaggctgttggcggagcccgtctcggaggcgggcacggcgcccatgatgagcgtgggcatggccccgtaggtgaagccgatgcccgcgctgatgacgcagggcgccagcacgaagtgccacacctggtccatgaggacgatgttcaggccgtacccggcggccacgatgagggcaccgaccatcagggtcaccttcggcccccgggcccgcgacagggacgcggagaacggggccaccgccatcatcaccagtccggagggcgccatgaccaggccggtggtgagcagcgacttgccgaggccgtaaccggtctgcgcgggcagctggagcagctgcgggatgaccagggacatggagaacatcgcgaagccgatcgcgatggaggcgaggttggtcatcagcacctgacggcgggcggtggtgcgcaggtccaccaggggggcctggacgcgcagttcgaaggcgccccaggcgagcaggatcacgaccgccgcggcgaacaggccgagcgtccggccgccgccccagccccagtcggcgcccttggagaccgccaggagcagacacatcaggcccgccgccatgccgacggcacccacggcgtcgaaccggccgccggaccgtaccgccgactccggtacgagcagcagcaccaggaccgccgcgacggcgcccaggaccgccgaggcccagaacagcacgtgccagtcgaagttctcggcgatgaccgcggcggcgggcaggccgagggcgcc

SEQ ID NO: 789 - DNA, 6483 bp, Unknown
  Kingdom: Bacteria, Phylum: Actinobacteria, Class: Actinobacteria, Order: Streptomycetales, Family: Streptomycetaceae, Genus: Streptomyces
ggcgaaggcgccgaccgccgctgcggcgcgaccgcgcagacctccggtcgtacggacgcggcccgcaggcgtgcgcacgaggctgaacccacccccgcccgctcggcagcagtcccagcaacgagccggccactcacgacaccttgatcaccaggtacggcacgagggcagccgccgccgctccgtacgccgccgtacgcccgatccgggcactgacatagatagaaacaataacttctatccccaaccgctcttggacactatagccacaggtcatgcatggtggatctcaccagcccacagggccgatcaccacccgaagggagtgaccatgcaggacctcaccgagggcgtcgcccgtttccagcgggacgtcttcccggccaaggcggagctcttcgctcatctggccacgcatcacacgccgcacacgctgttcatcggctgttccgacgcccgcgtcgtccccgagctgatcaccggtgccgagccgggcgacctgttcgtcatccgcacggccggcaacctggtgcccgcccacacccccggggccgacggcgtcgccgcgagcatcgagtacgcggttgccgcgctgggggtgaaggacatcgtcgtctgcggtcactccgggtgcggcgcgatgaccgccctcgccgaggaccacgacctcagcggtgtcccggcggtcgccgactggctgcggctcgccgacgcctcggtggcccgtgccgccaccgccgcggacggtgacgtcctcaccctggtacggcagaacgtgctcgcccagctcgcgaccctggccacccacccctcggtggcccgcgccctcgcggaggagaaggtcgccctgcacggctgggtctacgacatccccaccggccgcgtcgatgacctcaccgccaccggcaccgtactcgcggcctgacccacccggctcggggttcccacccgcgcgtcagcccgctgggcgccccgtgtccaccccccaacccaccgctccacctcctcgtgaagtggcccacctgagaaggacgtactgatcatggtgcacgcacagttcgagcagaccgctcgtgaggccctggctgccgaggccgtcaaggcgaagaccgtcaaggacctgtcctggaagcagatcgccgaggcctcgggcctgtcggtggccttcaccaccgccgcggtcctcggccagcacccgctgccggagaagtcggccaaggccgtggccgagctgctgggcctggacgacgacgcggcgctgctgctgcagaccgtcccggcccgcggctcgataccgaaccggatcccgaccgacccgaccatgtaccgcttctacgagatgctccaggtctacggcacgaccctcaaggccctggtccacgaggagttcggcgacggcatcatctccgcgatcaacttcaggctggacgtgaagaaggtcgccgaccccgagggcggcgagcgcgccgtcatcaccctggacggcaagtacctgccgaccaagcccttctgaccggcgcccggtgcggcgcccggtacggcgccgcacaccggcggacggggcgacgtcccgcatctgccccgcaggagagcgccgtcgagcgcgcgcctgccggaacggtcgtggtttctcgtacaaccaattcgcctggccggtggtccgactgcgcgaaggaggcacgggtgatgtcccggcccgtttcacgcaggaggagacgctacttgctgtcccaacacccaggtcggcgccgtcttggtgccgccatcgtcactgtcctggccgtcacgctcgccgcgggctcgctgaccgccggcccggcgggtgcggctgacgcacctgccgcggcggccggggcgagcggcctgctcccgatggcgcccgccgcccggctggcatccgcgggttccctcggtttcctcacctacgtccggcacgacggggacgagtcgaaactgcggtggaccccgtacgcgggcggggccacgcgcgacacggtctacgacacgatcgacgggctagccgacacgtccggggacacggtcgtcctcaccaccggcaacacgtacgggacaagggtcctggacatgtccaccggcaccgagttcggcatgcgggagatcgacgacggtctggacaccttctactcgggcgtggcgggttcggccctcttcatccgcggggccacgaagctgtggttgaagaccaaggacgccgacccccgccccgtgcagggcatgccggacggggcctcctacgaccgggtacggccgggggacgccacgcacggcctgctcagcgtccggacggcgcagggcgagcagcgctacggtctcatcgacctgaccgacgcgaccctcaccttcccctacccgcggcaggcgcggaaccccgtggtctccggcaaccgtctggcctgggtcgaggacgacaccgcgacgaacaccctgcgtgtggtcgtccgcgaccggacgaccggcgccgagacggccgtcccggtgccgggtaccaccgcgggtgcggccctggagttcgggttgctcggcgagtgggtgacctacgggacgacggccctgcacctgaagaccggcgagaaggtccggctcctcgaccgcgcggacatctcgtacgccaccccggacggcaccgcgcggatcgtccagggcagcggctccgcccagggcaagggcttctaccgggtctcggtcggcgcggacggccgaccggccgtgcggctcctcgcgcacgccggcactcccacgtccgccctgcacgacttcgacgacaacggcctccccgacctgctcggccgggacgcctcgggcgtgctgtggcgggacagcgccggggacggacagccgcgggtgcggatcggcggcggctggcagacgtacgacaagatcgagacggtcggggacgtcgcggggccgaggatccccggctccacgccggagctgatcgcccgtgacaaggacggcgtgctctggctctactcgggcaaggaggacggcaacttcaccgggcgtgtgcgggtcggcccgggctggcagacgtacgcgcacatcaccggcggcagcgacctcaccggcgacgaccgctccgacgtggtcgccatcgacaagagcggtaccgcgtggctctaccgcggcaccggcagcgcggcccgtcccttcgaggcacgcgagcgcatcggccacggctgggacgtctacaaccagctcgtcgccgtcggagacctcgccgggggccccgccggtgacctcgtcgcccgcgacaaggacggcgtgctgtggctctacctcggcaagggggacggcacttacgcgccgcgcacgaggatcggcggcggctggcaggtctactcccagctcgtcggcgccggcgacgtcgaccacgacggcaaggccgacctcttcgcgtaccgccccgacacgaagaccgtctacctgtactccggcaccggcgaccccgcccgccccttcgaggcccgcgccgtctcggacgcccacaccggccacgcgtacaaccacgtgagctgaaccgggcccccgccgtcgctccgcacgtggcacctgccacaccggaaccgacggcgggaccgcagacccccgtcactgcggcgcaaccgcacgcgcccgcgcgagcaccgcatcggccagctcccgcggggtcagttccccgtccaggaagacggtgtcctgcggaagcgcgtcaaccgccttcaggcaggccggaatccggcccttgcaccaggcacggatctgctcgtcgtgtgcggggtcgtccggcgtgaaactccggccgtcgatgcgctcgaccagcacgtcctgcggaaccttcaggaagacgtggaggacctccacgcccgcctgcgcgagcgtgccgaagacctcaccggcataggccgggtcgaccagggtcatcggcaccagcaccggccgtcggtactcctcgaccagaccgacggccagggcggccacctggcgtcgccagagccgaaggtcctggaagtcgccggtcggcacctccacgatcttccggagcacgaatccgaccgtctccgggtcgaacaccaacgcctccggccagcgggaccgcagctcctccaccaaggtggtcttaccgctgccgaacgcaccgttcacccagacgatcacggactcccccttcaccgtcgcggacaacgccgggcctctccggcgggctatgggtggtcacgatgttcacggcgtcgtggtgcggtgtgcgtagcggcggtgcagggtgcgcggctcggacagctgcgcctcgaaggcgggggtgtcggctcggcggccgacgcggtcgccaggcgtgcggacttgctccgctgcggagggacaactcgctttggccggtcaccctcctcatcctgccatccccggccttccgcacgtagggcagcgatcacaccccgcgagaccggccgtcgccgctcaagtggccggacccatcaccgcagttcgcgccgctgcggacaccatccagtgcagcccgggacgcccggagagcctcctgctacggtgatccaatggcatcggtcaagcagttccaagtcaccttcgactgtgcggatcccgagcgcgtcgctcgtttctggtgtgaggtgttgggttacgtcgtaccgcctccgccccaaggctttgccacttgggacgagttcaaccactcgctgccgcccgaggaccgaggtgcgtggtccgtgtgccaggaccccacaggtgtcagcccgcggttctacttccagcgcgttcccgagggcaaggtcgccaagaaccgggtgcatctcgacgtacgggtcggcaccggactcgtcggggaagaacgcctggccaagcttgaggccgaatgcgaacgactgatcgcgctcggcgcggtacgcgtgcgcgtactgctcgccgatgaggagaacgagtcgtgcatcctcatgcaggacgtcgagggcaacgagttctgcctcgactgagccaggcgtcacaaccgccagaagcctgtcattccttcgccaggagagcggccacctcggggatccgcagacgaggtcacggatgccgtcgcagtacaccggaagcggcatcctggtcaccacgagcggggtgccggcaccggaggccgtgcaggccgccgtgcatctcggccgggcagacccggagccccgaacggcggggccgggttcaggagaaggacggcgtcggaggagaacgactcaggaggcggacggcccgatctcccccgcaaagacgatgacctggtcgatgaggctccgccgcagatggacgacgtccgttcccgccaggcgggggcctccgtccggcgtcgtgaagacccactggtaccgggcccactcgtccggcatgtccaccgccgaacagcgcaccatcgtgccggtgcccgccgggtggcgcctgatgtcgagcacgaaccgctcgaccgcctcgattccctcactgcggcccaacggtccccagaagaccacgtccgaggtgagggcctgggagagcagcgcagtcacatagctgtcgtccgaggcgttgaacgcggagatgaacgtgtcgatcgcggaccgcgcggtctcttcctgcatgcaccagtaataccactcgcctcgcggaccgcgctccgtcccgtgagccgtctcccgaccacgatgaaccatcccggtcacagcaccagccgtacgaggagaccgccgaggcggtggccgcggtgcagaaggccgacctcgcgcccgaggtcaaggacaagacggcgcgcctcaacgcccggcgcgcgccgggtatttgaccggtcgcggcgggggcgcccgcggagatctcggcggtccggcggcccgctcaccgggctccttccggtacggctgcggtccccggtccctcggagttgctcgcgtgcgggcgccgtccgagcgcggcggccacgaaggacgcgaccagcggtcggcggtcctgctcgttccaggcgagcacgaggcggctgggcggggcgtcgctcacggggacgcagaccagcccggccgggagcggctcgaccagcgagcggggcagcacgccgatcatccggttcatcgagatcatgtggagcatctggaccacgtcggcgacctccggaccggtgccgtcacccccggggacccctttccagcggggcagtgtctctccctccaggtcggacatccgcaccgcggcgcacccggccagccggtgtccggccgggacgatgaccacgcggtcctcggtgtgcagcgtctcgtgcgccaggccgtcgaggtcgtcgaagggcacgtagagcaggccgacgtcggcccggccgtcgtgcaggaagtcggcacggtcggcggggccgctgaacaggatgtcgacccggcgggcggcgggcgtgcgggcgtactcggccaggagcccggacagcaggccggcgtcgccgcccggcttgagcacgagccgcaagggggcctcggtgtcgccggc

SEQ ID NO: 790 - DNA, 9172 bp, Unknown
  Kingdom: Bacteria, Phylum: Actinobacteria, Class: Actinobacteria, Order: Streptomycetales, Family: Streptomycetaceae, Genus: Streptomyces
  misc_feature (1133)..(1176): n is a, c, g, or t
cgcggccggggtctgctgctcggtcggtgacgtcgtcgtccgggttgtttcctcacgtgccatgggactcatcatagaatgatgggatgattgactgtccagtccgtccagggtccgggatcccgaccgggtccccgctcccgggccccgcctgcgaaggtgcgccatgcctctgagtcatccgcgccgctcggcgctgtccgagcaggtcatcgcggcgctgcgaagccagatcgcctcgggcgagtggccggtcggctcccgcatcccgaccgagcccgaactggtggagcagctcggcgtcgcccgcaacaccgtccgcgaggcggtccgcgccctcgcgcacaacggcctgctcgacatccgccaggggtccggcacgtacgtcgtggccaccagtgagctggcgggtgtgatgcagcgccggttcgccgacgcggacccgcggcacatcgccgagctgcgttccacgctggagtcggccgcggccaagctggccgccacccggcgcggcgagaaggacctcaagcagctcgacgcgctgctcgtgcggcgggaggaggcctgggagacgggcgacgcggaggcgttcgtggcggcggacgccaccttccacctggcggtggtggccgcctcgcacaacgacgtcatgacggcgatgtacgcggacctgggcgaggtgatgcgggactggctgcgcgcggacgtgggcgcggagctgacctcgcgggcgcacatggaccacacccggctggtcgacgcgatccgcgtgggcgacgcggaggccgccgccgccgaggccgcgagctacccgttccactgccgtccgggtcgggtcggcccgcccgaacgggtgtgagccgcgccgagcggcacccgccgggcagacggccggccgggcccctgtgcggggcccggcagaccggcaccgaacggccctgccgtgttcgcaccgttcggaacacgcacacccacgcgcgcgtgctgagcaaccgcaccggcgctcggatgcctcgtcggtgtccccgcgcgcacgcgcgcgtgccgcaacgccgcgcatgccccggtgcgccgccgattgctcagccgcctgaggggggacaccgaccgcgtgacgccgcggggcccgcacnnnnnnnnnnnnnnnnnnnnnnnnnnnnnnnnnnnnnnnnnnnngtgcgggccccgcggcgtcacagtgaagcggtggcgctcacgcggaagcggtggcgctcacgcgccgatggcgtgcagaccgccgtccacgtggatgatctcgccggtggtcttcgggaaccagtcgctcagcagggcgacgatgccgcggccggccggctcggggtccttcaggtcccactccagcggcgagcggctgtcccacacggcggccaggtcgctgaagcccgggatggacttggcggccatggagccgagcgggcccgcggagatcaggttgcagcggatgttctgcttgcccaggtcgcgggcgatgtagcggctggtggcctccagggcggccttggccgggcccatccagtcgtactgcggccaggcgtactgcgcgtcgaaggtgaggccgacgacggagccgccgttctgcatcagcggcaggcaggccatggtcagcgacttcagggagaacgccgagacgtgcatcgcggtggccacggactcgaacggcgtgttgaggaagttgccgccgagcgcgtcctgcggggcgaagccgatggagtggacgacgccgtcgaggccgcccagttcctcgccgacgatgtccgcgagccgggccatgtgctcgtcgttggtgacgtccagctcgatgaccttggcgggcttcggcagcttcttggcgatgcgctcggtcagcgtgggccgcggaaacgcggtcaggatgacctcggcgccctgctcctgcgccagcttcgcggcgtggaaggcgatggacgcctccgtcagcacgccggtgatcaggacgcgcttgccctcgagaattccgctcatggtgatcagtgacccattcccagtccgccgtcaacgggaatgacggctccagtgatgtacgaggcgtcgtccgaggcgaggaagcgcaccgcggcggcgatctcctccggctgcgcgtaccggccgagcggcacctgcgccacgatgttctcgcgctgctcgtcgctgagcgcccgcgtcatgtccgtgtcgacgaaaccgggggcgacgacgttgaaggtgatgttgcgcgagcccagctcacgggcgagggaacgcgcgaaaccgaccaggccggccttggaggcggcgtagttcgcctgccccgcggagccgagcagccccaccaccgaggagatcaggacgacgcggcccttcttggcgcgcagcatgccgcggttggcgcgcttgaccacacggaaggtgcccgtgaggttggtgtcgatgaccgaggcgaagtcctcctcggacatgcgcatcaggagctggtccttggtgacgcccgcgttggcgaccaggacctcgaccgtgccgtgctgggcctcgatctccttgtaggcctgctccacctgctcggggtcggtgatgtcgcaccggacggcgaggaagccggccggcggctcccccgagcggtatgtgatcgcgaccttgtcgccggcgtcggcgaacgcgcgggcgatggcgaggccgatgccccggttgcctccggtgacgagaaccgagcggctcaacggatcaccctttcgtagcggtctcaatcgtttcgggagcacgcccggacgcctggacgacaggcgatgacaggcggcttcaccgaaaacctatcggtccggccgctacggcggacaatcgggcaccgacagtggcggccgggccgctctgtcgagtccctacagaaaacgtcggacccggcccgtaaacgtgtggtccgggccgccgcccgcacgacatgatcggtccgacaggtcacgagagcagggagacgcccgtgccacatacgatcgacgaggccttcacggcccttccgctgcgcgccctcgccgacgccgccctcgcccgtgcgcgggcgctcggcgccgagcacgcggacttccggttcgagcgggtgcgcaacgcgtcctggcggctgcgcgacgcgcggccggccgggtcgtcggacaccaccgacctcgggtacgcggtgcgggtcgtgcacggcggggcgtgggggttcgcctccggggtggacctgagcatggacgccgccgccagggtcgcctcgcaggccgtggcgatggcgaagctgtccgctcaggtgatcgcggcggccgggtcgaaggagacggtggagctggccggcgagcccgtgcatgccgagcggacctgggtgtcgtcgtacgagatcgacccgttctccgtgccggacggcgagaagtccgcgctgctcgcggacttcagcgcgcggctgctggcggccgacggcgtggaccatgtggacgcctcgctgctcaccgtgcacgagaacaagttctacgccgacaccgcgggcaccgtgaccacgcagcagcgggtgcggctgcatccgcagctgacggccgtgtcggtggacgcggacagcggggagttcgactcgatgcggacgctggcgccgccggtggggcgcggctgggagtacctgaccgggaccggctgggactgggacggggagctggagcggatcccggagctgctggccgagaagatgcgcgcgccgagcgtcgaggcgggcgtgtacgacctggtcgtcgacccgtccaacctgtggctgaccatccacgagtccatcgggcacgccaccgagctggaccgggcgctcggttacgaggccgcctacgccgggacctccttcgccaccttcgaccggctcggcaagctgcgctacggctcggagctgatgaacgtcaccggtgaccgtaccgccgagcacggcctggcgaccgtgggctacgacgacgagggcgtccaggcgcagtcctgggacctggtgaaggacggcacgctggtcggctaccagctcgaccgcaggatcgcgaagctgaccgggttcgagcggtccaacggctgcgcctacgccgactcccccgggcacgtgccggtgcagcgcatggcgaacgtgtcgctgctgccggacccggccggcatgtcgacgcaggacctgatcggcggcgtcgagcggggcatctacgtggtcggcgaccggtcctggtcgatcgacatgcagcgctacaacttccagttcaccggacagcggttcttccggatcgagaacgggcggctggccgggcaggtgcgggacgtcgcctaccaggcgaccacgacggacttctggggttcgatgacggccgtgggcggcccgcagacgtatgtcctcggcggcgccttcaactgcggcaaggcccagccgggccaggccgcggccgtctcgcacggctgcccgtcggccctcttcaagggcgtcaacatcttgaacaccacccaggaggccggtcgatgagtccgcgtacgagcaagccgcacgaggtcgtcgagcgcgcactggcgctgtcccgggccgacgggtgtgtcgtcatcgcggacgagacctcgaccgcgaacctgcgctgggcgggcaacgcgctcaccacgaacggtgtcacgcgcgggcgtacgctcaccgtcatcgcgaccgtggacggcaaggagggcaccgcctcgggtgtcgtgtccaggtcggcggtgaccgaggacgaactggagccgctggtgcgggccgccgaggccgccgcgcgcgcggccggccccgccgaggacgcgcagcccctcgtcacgggcgtaccgcagtcgccggacttcaccgacgcgcccgccgagacctcctctgcggtgttcgcggacttcgcgcccgccctcggcgagtcgttcgcccgcgcgcgcggtggtggccgcgagctgtacggcttcgccagccatgaactggtgtccacctacgtagggacgtcgacggggctgcggctgcggcacgaccagcccaacggcacgctggagctgaacgccaagagcccggaccgcacgcgttcggcctgggcgggacaggccacgcgggacttcaaggacgtcgacccggcggcgctggacgcggagctggccgtgcggctcggctgggctcagcggcgcgtggagctgcctgccgggcggtacgagacgctgctgccgccgaccgcggtcgcggacctgctcatctaccagatctggtcctcctcgggccgggacgcggcggagggccggaccgtgttctcccggccgggcggcggcacgcgggtcggcgaccggctcagcgaactgccgctgacactgcgcagcaacccggaggaaccggggctgcagtgcgcgccgttcgtcgtcgcgcactcctcctccggcggcgaccaggacgagtcggtgttcgacaacgggctgtcgatcccggagaccgagtggatcagcggcggcgagctgaggcacctgaccaccagccggcacagtgccgccctgaccggactgcccgtcgcaccgtccgccggcaacctgatcctggacggcggcggtgaccgctcgctggaggagatggtcgccgtgaccgagcgcgggctgctgctgacctgcctgtggtacatccgcgaggtggatccggccacgctgctgctgacggggctgacccgggacggggtgtacctggtcgagaacggcgaggtgacgggcgaggtcaacaacttccgcttcaacgagtcgccggtggatctgctgggccgggcgacggaggccgggcgcaccgagcggacgctgccgcgtgagtggagcgactggttcacgcgggccgcgatgccggcgctgcgcgtcccggatttcaacatgagctctgtcagtcagggcgtataacctcgtagtcggctgtcacccgactgccggggcccctgagcaccatccctgtgcatcatctgcatcacctaggagacgcgagaaccgtgacggacatcgtcgacgagctgaagtggcgtgggctgttcgccctgtccaccgacgaggacgctttgcgcaaggcgctcgcggacggtcccgtcacgttctattgcggcttcgacccgaccgcgccgtcgctgcacgtggggcacctggtgcaggtgctcaccgtgcgccggctccagcaggccggtcaccggccgctggcgctggtcggcggtgccacgggcctgatcggcgacccccgtccgacggccgagcgcacgctgaacgcgccggagacggtggccggctgggtggagaagctgcgccggcagatcgagccgttcctgtccttcgagggcgagaacgccgcggtcatggtgaacaacctggactggacgcagaacctgtccgcgatcgagttcctgcgggacatcggcaagcacttccgcgtcaacaagatgctgacgaaggactccgtggcccgccgcctggagtccgaccagggcatcagctacaccgagttcagctaccagatcctgcagggcatggacttcctgcagctctaccggcgccacggctgcacgctgcagcagggcggcagcgaccagtggggcaacctcaccgccgggctggacctgatccaccgcctggagcccgacgcgagcgtgcacgcgctggcgacgccgctgatgacgaaggcggacggcaccaagttcggcaagaccgagggcggcgccgtctggctcgacccggagatgacgacgccgtacgcgttctaccagttctggctgaacgtggacgaccgggacatctccaagtacatgcgcatcctgtccttcctctcccgcgaggagctggaggagctggaggagcagacccggcagcgtccgcaggcgcgggccgcgcagcgcgcgctggcggaggagctgacgacgctggtgcacggcgccgaccagaccgccgccgtgatcgccgcgtccagggcgctgttcgggcagggcgagctggccgcgctggacgagcggactctgaccgcggcgctgtccgaggtgccgcacgtccaggtcgctgagctgggccaggtcgtcgatctgttcgccgaggtcggcctggtgcccagcaagtcggccgcgcggcgcacggtcaaggagggcggtgcctacgtgaacaacgtcaagatcaccgccgaggacgccgtgcccgcccgggaggacctgctgcacggacggtggctggtgctgcgccggggcaagaagaacctggcggcggtcgaggtcacggccggctgaccacaggcacagagccggaagtgaggggcggccccgggacactggtcccgggaccgcccctccttcgtggctcgagcccgttcccgactcgtggctcacgcccgttcgcgtcgtctgtgctggttgccccacaccgccatgtacgccatgtcgccgatgaagacgatgatgatcgcggcgacgatctggaagatgtgccggctccagtcgatgccgcgcgtggactccacaccggcggcgcgggcgacggcgttgcccgcgatggcgccgagcatgccgaagatggtggtcagccagagaggactgtgctgcttgccgggaatgaccgccttggcgatcaggccgagaatgaaacccacgatgatcgcccacaaccagcccatggctgcctcctcgtccggctcgacgtgagcattaccgccagtgtcggccggtcgaccgtacgacgcatgtcgggcgtcgcccgtggcaccggcgcgggcaccgccacgggtgccgccgcggggtgcgtgcgcggcgcgcgtgcgccggagtgcgcagggcgcccgcgcgagggtgagtgcgccgttcgcgcaggcagacatgcaggcagcgggggtgccccggcctcgtgggcggggtgggcgcggcgtaccgtggacggtgagggagtgcgagcgggccggtgtcctcggccggccgggagccggagatggaccggggcagtgtccgatgcgggcggatggtggattgtgatgcggaagcagcatggcggtggcggcgtcgaggtgttccggatcacgggcgcacgcacgggtctccaggaggacgtgcgcggccgacagcgccggtacgtcatctccatggcgatccgtacggtggcggtgctcctcgcggtgaccctgtggaacgtcgaacggtacgtggcgatcgtggctctggtgctgggcgccgcgctgccctacatcgccgtggtgatcgccaacgccggccgggagaacgcgccgaaactgccgtcgacgttcgtcaccgtgccgatgaagccgatgatcacaccgccgcgggcgacggacgacggttccgggaccggctcgggagagggcgtcggggacagctccgcggaatccgccgcgcaggacacggcgggcgatccggcggcgggtacggcgggcaccgcgcgggagggacgcgacggggtgtgaccggcggtgtccgcggggatgccggatgggacacggagagtgccgcgcgcaaacctcaagaaatgctcagatgaatcatgttgttccggtgccgggcgacagggcacccgtgacatacttcctacgcgctccgcatcccccgtcggagcgacggaccgacgccgggcagctccccccgtggctgctcggcgtcgccttgtgtgcagtggctgtgagacgaactgtgagtgacgagaccgccccgatctgctccgccaagggctgccgtacggccgccgtgtgggtactggcgtggaacaatccgaagatccacacgcccgagcggcgcaagacgtggctggcgtgcgacgagcaccgcgagcatctgtcgcagttcctcggggtgcgcggcttcctcaaggacgtggtcctgctcaccgagtggcaggcgtcgcagggggcgtgaaccccccggcgcccccggcgccgcccggtccggccgggtgcggtcagccgccgatcgcggacatcgggcggtcgggctgcacgaacgacgggtcgtccaggcccgcgcccgccttcttgccccacatcgcctgccgccagatccgggcgatctcctcgtcgggggcgcccgagcgcagggccgtccgcaggtcggtctcctcggtggcgaacaggcaggtgcggatctggccgtcggcggtgaggcgggtgcggtcgcaggccgcgcagaacgggcgggtgacggaggcgatgacgccg

SEQ ID NO: 791 - DNA, 594 bp, Unknown
  Kingdom: Bacteria, Phylum: Actinobacteria, Class: Actinobacteria, Order: Streptomycetales, Family: Streptomycetaceae, Genus: Streptomyces
  misc_feature (522)..(594): n is a, c, g, or t
gtgcccgactcgggccgtggtgaacggttttgtcagttgtccggtgaacgcaggacacgcaggtggccgcggcgcgcgacctccatcgggtccgccccgcgggcgccaccgccgccggcttcggccgcccgctcctggggacgggccgcctcgcgcacggcgttggcgagcgcctccaggtcgtcgccgctgggccgggcgggagccgaaccgtcgaggagccggacgacctcccagccgcgcggggcggtgaggcgctcggagtgctcggcgcacaggtcgtagcagtgcggctcggcataggtggcgagcgggccgaggacggcggtcgagtcggcgtagacgtacgtcagcgtcgctacggcgggacggccgcaagcggtgcgcgaacagcgacgtacagggctcacgacgttggacggtaccgcactcttgagcgggccgcgacgactctccaccaggtcactcccccgtgtcgtgctgtgaaacaccccacacatcccttccggtacaccttactgnnnnnnnnnnnnnnnnnnnnnnnnnnnnnnnnnnnnnnnnnnnnnnnnnnnnnnnnnnnnnnnnnnnnnnnnn

SEQ ID NO: 792 - DNA, 3046 bp, Unknown
  Kingdom: Bacteria, Phylum: Actinobacteria, Class: Actinobacteria, Order: Streptomycetales, Family: Streptomycetaceae, Genus: Streptomyces
gtacttcccccgtgctcccccgtcttccccccggcctgcggcggtccggtcaggcgaccagttcgccgaaggactcctcgtggtcacggccgaagctgaggacctcgtcgtcgcgcagccggcgcagcgagcgccagatgctggacttcaccgtgccgacgctgatgccgaggatgtccgcgatctccgggtccgtgcggccctcgtagtagcgcaggaccagcatggtgcgctgcggttcgggcagccgggcgagcgcctgccacaggaccgcgcgcagctcggcgccgcgcatcgcgtccgtgtcgccgggcgtctccggcagttcctcggtcgggtactcgttgagcttgcggcgccgccaggcgctgatgtgcaggttggtcatggtgcggcggaggtatccgccgacggccgccttgtcactgatccggtcccacgcccggtacgtcgagaacagcgcgctctgcagcaggtcctcggcctcgaagcggtcgccggtgaggtggtaggcggtggcgtacagggaggcgcggcgctcctggacgtaggcggtgaactccgcctccgacgggctgcggcgctcccccggcgcctccccgtacgcggttcccccatgtgcttccccgtgcgtttcccccgtgtgcgcgtcgaccaccgtcatgtacgcggtgtgctgacgcccggtgccgcgggcgcatccccgcgcccccgccgcaccggtcttctccgttccgcgggtcacgtcgtgcagacgcgtgaccactgcgctggtgctggtgctgtgcagcgtgttcatctcgcgccccccgtcggtggacctctggtgttcggatcattccttgctgatgtcgaaaatcttgcccggggcacttcatggccgtgtccgccgactgtcacagacctgtcacaggccctcaagtcgccggtcggcccgtacagagccgtacgggtgtcgaaaccgcggccccgcatgggccagaatgaggctcgtgccttccctgttgctgatcgaggacgacgacgccatccggacggccctggagctctcactgacgcgccagggacaccgggtggccaccgctgccagtggtgaggacggtctgaagctgttgcgcgagcagcggccggacctgatcgtgctggacgtgatgctgcccggcatcgacgggttcgaggtgtgccggcgcatccggcgcacggaccagttgccgatcattctgctcaccgcgcgcagcgacgacatcgacgtggtggtgggcctggagtccggcgccgacgactacgtcgtcaaacccgtgcagggccgggtgctggacgcccggatccgggcggtgctgcggcgcggcgagcgggaggcgaacgacgcggcggccttcggcagcctggtcatcgaccgcgcggcgatgacggtgacgaagaacggcgaggacctccagctcaccccgaccgagctgcggctgctcctggagctgagccggcggcccggtcaggcgctgtcgcggcagcagttgctgcggctggtgtgggagcacgactacctcggtgactcgcggctcgtggacgcgtgtgtgcagcggctgcgggcgaaggtggaggacgtcccgtcctcgccgacgctgatccggaccgtgcgtggtgtcggctaccgcctggacgcgcctcagtgacgaaagagcaaggagggtccgccgccgggtccgcggaacgcaagggagtactgtcccggtggcggttcaccagtctgcggctgcggctggtcgtcgtcttcgcgctggtggcgctgacggccgccgtgtcggcgtcggggatcgcgtactggctcaaccgtgaggcggtgctgacccgcgcgcaggacgcggtgctgcgcgacttccggcaggagatgcagaaccgtgcgggcacgctgccggtgcatcccgggcaggaccagttgcagcgcaccgccgggcagatggcgggcagcagccagcggttcagcgtgctgctggtcggccaggacaccaacgggcaggcggtctacgcgagttcgggcgggctgagcgggttctcgctggaggacgtgccgcagtcgctgcggaccgcggtgaacaaggagcagccgctctcctcggggaacacgtcggcgtaccacctgtactggcagcgggtgaccgagcacggcacgccgtacctggtggccggtacgaaggtgatcggcggcggtccgaccggttacatgctcaagtcgctggagccggaggcgaaggacctcaactcgcttgcctggtcgctggggatcgcgaccgcgctggcgctggtcggggccgcgctgctcgcacaggcggcggcgacgaccgtgctgaagccggtgcaccggctcggggtggccgcgcggcggctcggcgagggacggctcgacacccggctgcgggtgtccggcacggacgaactcgccgatctgtcacggacgttcaacaacgcggccgaggcactggagaaacgggtcgcggacatggccgcgcgggacgaggcgtcccggcgtttcgtggcggacatgagccatgagctgcggacgccgctgaccgccatcaccgccgtgacggaggtcctcgaggaggagctggagttcgagggcggcggcatcgacccgatgatcgaaccggcggtacggctggtggtcagcgagacccggcggctcaacgacctggtcgagaacctgatggaggtcacccgcttcgacgcgggcacggcccggctggtccttgacgacgtcgacctcgcggaccagatcaccgcgtgcatcgacgcgcgtgcctggctggacgcggtggagctggacgcggagcgcggtctgcacgcccggctcgacccgcgtcgcctggacgtcatcctcgccaacctgatcggcaacgcgctcaagcacggcgggtcgccggtgcgggtgtcggtgcgggagtcggccggggagcgcgaggaggacgcgcagatcgtgatccaggtgcgcgaccacggccccggcatccccgaggacgtcctgccgcacgtcttcgaccggttctacaag

SEQ ID NO: 793 - DNA, 4976 bp, Unknown
  Kingdom: Bacteria, Phylum: Actinobacteria, Class: Actinobacteria, Order: Streptomycetales, Family: Streptomycetaceae, Genus: Streptomyces
gccgcggcctcgtggaagcggtggatcagggcgggcaggacgtgcgaggtctccaggtcgaagttgtcgccgggtccgtagaggttggtcggcatggcgctgatgtaggacgcgccgtactggcgccggtaggactgcacctggacgatgcccgcgatcttcgcgagggcgtaggcctcgttggtgggctccagcggcccggtcagcagggcgtcctcggtgatcggctggggggcgtgcttggggtagatgcaggacgatcccaggaagagcaggcggcccactccggcggcgtgggccccggctatcacactgagctggatctggaggttctcctccaggaactgcaccggttgcgtgctgttggccatgatcccgccgaccttggcggcggcgagcaccaccgcgtcggggcgcagggcggccagctcggccgcggtgcgcgcggcgtcacgcagatccagttcggcacgggtgcgggtgagcacctcgtggccgtcggcggcgagccggcgggccacggcggagcccaccaggccccggtggccggcgacgaagacacgggcacggtcgggcagcagcgatgcggtcatgggccggatcatgccaggcgccgcgccacgaatacgcccgcatcaccaactctggcgatatttcctgtggttcatgacatgcggcccgcgtacggcgggcgcacggaccggatccgtccgagggacgcgtccggcagggaggggaacaccgcatgagcaagaccgcgctgatcaccggcgtgaccgggcaggacggctcgtacctggcggagctgctgctgtcgaaggggtaccgggtgcacggcctggtgcggcggtcgtccagcttcaacaccgagcggatcgaccacatctaccagggcccgcaggaggcggagcgccggttcgtgctgcaccacgcggacctctcggacggggtggcgctggtgaacctgctgcgcgacatacggccggacgaggtgtacaacctcggcgcccagtcgcatgtgcgggtctccttcgacgcgcccctctacacgggcgacgtgaccgggctgagcacgctccggctgctggaggcgatccgggcgagcggggtggagacgcggatctaccaggcgtcgtcctcggagatgttcggctccacaccgccgccgcagaacgaggacacgcccttccacccgcgcagcccctacggcgcctcgaaggtcttcgcgtactggaccaccgtcaactaccgcgaggcgtacgggatgttcgcggtcaacggcatcctgttcaaccacgagtccccgcgccgcggtgaaacgttcgtgacccgcaagatcacccgtgccgtcgcgcggatcaaggccggcctccaggaccgtctctacctgggcaacctggacgcggtccgcgactggggatacgcgcccgagtacgtcgaggcgatgtggcggatgctgcagcacgacgagccgacggactacgtggtcgccaccggggtcccgtccaccgtgcggcagttcgtggagaccgcgttcgcgcacgcgggcctggactgggacgagtacgtgcgctacgaccccaagtacgagcggcccagcgaggtcgacgcgctgatcggggacgcgtccaaggcgcgcgagacgctgggctggcggcccgcggtcctggtggacgaactcgcgcggatcatggtcgactccgatgtgcggcaggtggaggaccagctcgcgggcgtggtggtacgcatcgaccgctgaacgccgggcgtgtgcgggggcccgcgcacgaggtgcggcccggcgggacggcccggcgggcccgatgcgtccggcgcgacggccccgtgctgcgccggagaactcggttcgtggcccgtggggccaccgtgaatcagtggtctttcctgcgggatgagtaaaaagcgttccatgacgtgtcatgtactcgtatggttcgcgagcgaacatgttgatacggcccgtccggatcggggaaacaccggacgggatcgaggcagagggcccgtgagcgggtccgggagccggggggtacatgcaaagatccaggcggttcagcgccgcccttgtcctgtccaccacggcgggtctgggggtggtggccctgccgccacagcccgccgccgccgtgacggcgcccgtcgccttcaccgccgacgacctgccgacctggcagaccaacggcatcgtgtgggccctggcggaggcgcacggcacggtcttcgcgggcggcaccttctcgcaggtgcgcccgccggagggcgcaagcggcaccgcgcagaacgcggtgaacttcgtcgcgctggacgcggcgagcggcgcacccacgtcgtgcaaactgtccttcaccgtcggcagcggcaccgcgaccgtgcgggcgctcgccgtctcgccggacaagaagacgctgtacgcgggcggctacttcggcgcggtcaacggcacgcaggtctccagcctcgccgccatcgacatcgccacctgcacgcccagggcggacttccatccgagcgtctccgccaccgtgcgggcgctcgcggtcaccgacgacaccgtgtacctgggcggcgacttctcctcagtcggcggcagcgcgcacgcgcggtacgcggcggtggacgccgccggcggcgcggtcaagccgttcaacgccgacgtcgacgagcccggccgggccgtcgcggtcaccccggacggcaaggacgtgatcctcggcggtgacttcttcaccgtcaacggcgcgaactcgcacgccctggccgtcgtggacgcgaccacgggcgccaacgtccgcacctacccggggttcatcgagaccaactcggtggtcaaggggctcgacaccgacgccaccggcttctacaccggcaacgagggcaccggcggcggcgtcttcgacggccgtatcgcgctcgacctgtcgacgctgaaccagcgctggcgcgacacctgcctgggcgccacccaggccgtcaagtcgtaccaggacgtgctctacagcgcctcgcacgcccatgactgctccagcgtcggggagttccccgacgggcgccgtcaccacctgctcgcggagccgacgaccggcaccaacaagctgggctggttcccggacaccaacgacggtctgggcgagggcatcgggccgcgcgccatggtggtctccgagacctccgacaacaagtacatgtgggtcggcggcgagttcaccaccgtcaacggctcggcggcccagggcctgacgcgcttcgcggcctccccggacaccggcgcgccgacggtgccgtcggtcggcgccgacgccgtgaagccgaccgaggcccatgtccgctggcgcgccagcatcgacacggacgacacgaagctgacgtacaaggtgtaccgcaacggcggttccacgccggtctacacggtctccggtgactccgtggagtggtcgcgcccgcagatgtcgttcatcgacaagaacgtcaccgccggctccacctacagctaccgggtgaccgccaccgacggcgcgggcaacacctccgcgctgtccgccgcggccacggtggcggtgccggtctccgcccagcagtacgcggcgaaggtgctcgacgacggcgcgaacctgtactggcgctacgacgagtcggccgctcccttcgtcaacgacacctcgcccggcgaccagagcggcatccacgtgaacgggcccgcgctgcggcagacgcccgccgccgtgaccggtccgtcgaccgccatcggcttcaacggccgtaaccagtacgtctacagcgacaagctgaccacggtgccgagccggtactcggtcgagacctggttcaagacgacgtccacccggggcggcaagctcgtcgggttcggcaacaacaccacgcggaccagcagcaactacgacaagcacatctacatgcgcgacgacggccggctggtcttcggcgtgtacacgggcagcacccgcaccgtcacctcgccccgcagctacaacgacggcgcctggcaccaggtggtcgccacacaggggccctccggagtggtgctgtacgtcgacggcgcccaggtcggcacgctcgccgagacgggcaaccagagctacagcggctactggcacgtcggcggcgacaacctcaacagctggccgaaccagccctccagcaactacttcaccgggcagatcgacgagacggcgatctacccgtcggtgctgagcgcggaccaggtgaagagccactacacgctggcctcggttccggccgacagcgtgcagaccgtccgcgcctcggccgacacgtacgtcaacgccggtgccaccggtacgagctacggcacctccacctcgctggcggtgcgcggcagcgcggcctacgagacgtacctgcgcttcgacctgccctcggccccggccgggacggtgctcaagagcgcacggctggcggtgaagaccaccacgctgagcagtgcgggcagcacggacgacatctccgtgcggccggtcaccggggactggacggaggcgggtaccaccttcgcgaccaagcccgccgtgtcgcagaccgtgctcggcaccctgagcggagccaccgacgtctccacgctgtactcggcgacgctcgatgccgcggcgctcaccccgtccctgggcgccaccgctgacctggcgctcacgagcaccgggacggacgcgctgtggctgtggtccagggaggcgtcggccgcggaggacactccgcagctggtgctgaccttcggggcgccgtaatccacacggtgtcccccgcgtgcggggcgccggaccgcagcgtccggcgccccgcccagcccacccgggcccgcactcctcgtgcgggcccgccaccgtagccaggcccgccgggcccaggagacaccatgcgcactcgtcctctcaggcccatccggccgtccgcgcctgtccggcgcggacggccggatgggc

SEQ ID NO: 794 - DNA, 5982 bp, Unknown
  Kingdom: Bacteria, Phylum: Actinobacteria, Class: Actinobacteria, Order: Streptomycetales, Family: Streptomycetaceae, Genus: Streptomyces
gccacggcgccgtggccctcggcggaccgctgcgcgacgccttccccgagatcgcggaagcgacccgtgccagggatgcctcccatgccaccgacggctccggtgccggtaacggctccgctgccactgccgcctccgcctccactaccgcctccaccacctcagacgatctgatgagaaaggaacacccctgatggcaccacccttcaccaccatctaccggtccttcgccgagcaggtggagcggcagccggacaaggcgctgttcgaactgcccgacggccggcagatcacctaccgcgagacggcgcggaccgtgggacggatcgccgcccggctcgtcgccgacggtgtgacccccggtgaccgggtcgccatgcaggtggacaaatccccggaggccatcgcgctgtacctggcgacgctgcagatcggcggcgtcttcctgccgctcaacaccgcctacaccggtgcggagacggagtacttcatcggcgacgcgcggccgcgtgtgctggtgtgctccccgcagcggcggcccgaccacgcgcaccgcgcgggggaggacctcgtcgtcgagaccctcggcacccagggggagggcaccctgctggagggcgacggccgccacgacgaggtcgtcgacgcgtcggccgacgacccggcggcgatcctctacacctccggcaccaccggacgctccaagggcgcggtgctgacccacggcaacctcgcctccaactgccgggcgctgctggaagcctggcacttcacggaccgggaccggctgatccacgccctgccgatcttccacgtccacgggctcttcgtcgccgcgaacatgaccatggccgccggtgcgtccatgtactacctgccgaagttcgacgtggacgcggtcgtggatctgctgccccgggccacggtgctcatgggcgtgcccaccttctacacccggctggtgaagcacgaccggctcaccccgcagacctgcgcgtcgatgcggctgttcgtctccggctcggcgccgctgctcgcgagcgaccacgaggcctttcaggcccgtacgggccacgccatcctggagcgctacgggatgaccgagaccggtatgaacaccaccaacccgtacgagggcggcccgcgcaagccgggcaccgtcggccggccgctgcccggcacggagatccgggtggtggacggcgagagcggccaggtgctgcccgacggcgaggtcggcagtatcgaggtccgtggccccaacgtcttcagcgggtactggcagctgcccgagaagacggcggccgagttccgggaggacggcttcttcatcaccggcgacctgggccgcatcgacgaggacggctatctgtgcatcgtcggccggggcaaggacctggtgatctccggcggctacaacatctacccgaaggagatcgaggaactgctcgacgcccaccccacggtgctggagtccgccgtgatcggtgtcccgcacccggacttcggggagacggtcgtggccgtcgtcgtcccggcgccgggccaggagcctcaggagagcgagctgctggagttcatcgccggcgacctcgcccggttcaagcacccgcgcgccgtgcgcgtcgaggaggagctgccgcgcaacgtgatggggaaggtgcagaaggccgagctgcgcaggcgttaccaggacctgttcgcgggctcgaccgcctgatccgcggcgggccggcaagagcggacgccggatgagctgacaagaacggaaaagaagtgaagggccgtcatggagacggcccttcacttcgtcggcgcgcgccccgcgcggtgcgcggtccctcagttggcctcggccgggaccggggcgagggagcgggaccgtacgatgagctgggcgacggccgtgaccaccaggttggggacgagggcgatgagcccggtgtcgaacgtgccgacgtccacacccccgaaggtgagccaggccaggacgccgacgccggtcaggatgccgagcagcgcgggcaccgcgtcgaggcggaccttcttcgccaggcccatgacgatcgccggggcgagctgggtgaggccgccgtaggtgagcagcagcaggtcggacaggagccccggcctggtcaggccgagtacgagggcgaggccggcggcggcgacgacgcacaggtggttggtgcgcagctgcgcgcgttcgttgcggacgctgagcaggttgcgggacagcaggctggagatgcccacgacgatggccgcggacggcaccatcgccgccgaggccgcggcgacggcgacgacgccgacgagccagccgggcagggtctggcccgcgagggtcagggcgacaccgttcgcgggagagcccggcttcaccagcaggattccggcgaacccgacgatcacggggatgccgagcgcgatctggtagagcggcagccagaccgcgttcttgcgcagcgcgcgcccgctgccggcggcgaggaccggcggccacaggtgggccatggtgccgagtccgccaccgatgccggagatgatgacggcggtgacgaagaacgtggcgtcgtaaccgtcctgatggagcgtcaggaggttcgggtggctgtcccgtacggtctcgaacaggccgccgatgccgccgttcacggacagcgcgacaccgacgatcagcaccacgaggccgacgatcatcagggcgtccttgaggtaggcgacgcgcgcgatgccgcggatgccggaccacaggacgaaggcgacggtgaggacggtggcgagcaccatgctcaggttgccgcccgtgcggctgccggtggcgagctgcacgatcagcccgagcccggtgatctgcagctggaggtacggcagcaggaagacggcgccgacgacggcgacgaccttgccgagcaggggactgcggaagcggtcggcgaagaagtcggcctgcgtcaagtagccgcctgctcggcccatttcacgcatacggggtgcggtgaagtactgcaggacgaagttgatcgcgagatagcacagcgcgaaggccgcggcgacgccgccgccgaaggcgatgccggcgagaccgaggaagctgaaggtcgtgaaggactcgcccgcctgcaggaaccaggtcgtgaaggtggagaacctgcgcttccccacggtccattcgcccagttccccgcggctcggccggcgcccgctcatgccgacgacggcgatggcgacgatgccgaccagggtgatggccatggtggtgttcacgcggtgacctcctcgtgcgcgtcgcgcgtcacgtcgtcgtcctcgtcgtccttgtcggtgtggtgggcgaagtgctcgacgagcgcgagcgaagccgtcgtacccgccgtccacagcaggcaccaggcgagcacggaggggatgccgagccagaggtgcgggccgttgacgaagggcaggaacggtgtactgaggaaagccactacgggcacgagggcccagaggacgtgcgggtttctcatcggggctccatacggctacgggagggaggggcgacggcgtccgtgcccggtggcggcctcgtaggcggcaccggtctcgagcacggtcctctcggcgcggggtgggcccacgatctggaggccgacgggaagcccggccggagtgaagccggcggggacggagagggcgggtgagcccagaacggtgacgaagtacgcggagcgcatccagtcgaggtaggtgtgctgcggctccccgtcgatgtcggtggggtactccgcctccacggcgaacggggtgacctggctgaccggggcgaccagcacgtcgtagcgctcgaagaaggcggtggcggcgaggtggatgcgggcgtgcccggtggtggcacggacgaggtccgcgccggtcaggcgccgcccctcctcgatgttccagacgaggctgggcttgagggaggcgcggtcgctgtcgagcagcgcgccgagaccgaggtggaactcgtgggcgcgcagcgtgcggaacacgtcctcggcgccgtccaggtcggggcagtcctcgacgacgacgcagccgaggtcctcgaagacctcggcctggcgttcgaagacgtcgcgcacgtcgcggtcgacggggacccggccgccgaggtcgggggcgaacgcgacgcgcagcccggccgtgttccgtccgagcggcgcgcggaagccggcgcccggctcgtcgagggagatcgggacgcgcgggtcgggcccggccatgacggacagcagcagcgcggtgtcggcgacggtgcggcccatgggcccggcgacaccgagggtgtcccagaggttgccggaggggtgcgaggggacgcggccgggggtggggcgcaggccgacgacgttgcagaaggacgccgggttgcgcagcgagccgcccatgtcactgccgtcggcgagcggctggaaccccgcggcgagcgcggccgcggccccgccgctgctgccgcccgcggaccgcgtcgtgtcgtacgggttccgggtcgcgccgaagacggggttgaaggtgtgcgagcctgccgcgaactcggggacgttggtcttgccgatgcggatggcgcccgcgccctggatgcgctggacgagcagctcgtcctcgtgcgggacgtgctcggcgaagagcggcgagccgtgcgtggtgcgcatgccgcgggtgaggtgggtgtccttgaaggcgatgggcaggccgtgcagcgggccgagctcctcgccgcgcgcctgccgctcgtcggcggcggcagcagcggccagcgcaccctccggatcgagggtgacgatcgcgttgacggcggggttgtgacgctcgatgcggtcgaggtgcgcctggacgacctcgcgggccgagagttccccgcggcggatgcgggcggcgaggtcgacggcgtcgagcacgcagatctcgtcccggccggggacggcggggccggatgcggcggattcggcggagctgggggcgagcgggccgggagcaacgggcatggcagtcctaggggagcgggcacgaagggcgtcgccgaggtgctgctggtccggccggtggccgagggggcgacgcgtgtggtgcaccacactgaagctgctgaccctttcagtcaataggttggccgtgatgaagctttaagacgcgagatcctccgagttgaagatttaagtcacgctgcggaagatctcaggagcgctacgcaggtccgcggccggtgtccgggaactcgacaccactgcgcttgaaggactcgacgacgaggtgggactgcacggcctccacgtgccgcacccacggcgaggccgtgaggaacgtgtgcagcgcggtcttcgacggctgtgtcacgtcgaccaggagctgatgctcacccatcacgacggccgcgtaccgcacgagcggcgactcgacgagcagccggcccaccttctcgacctcgtcgggcctgaccttgatccacagcagcgcctcgaccggcaggccgagcagcgcgggctcgacggcggcccggatgctcacgaggccttcccgcgtcagcgtctccacgcggcgccgcgcggtcgccacggacaccccggcgacggccgccaggtcctcgtgcgtgcgccgcccgtcctcggcgagggcccccaggatcgccagctcctccggtccgacctcgatgtccgggagcgcgagtccgtcgacgatccccgaaggccccccgagcgcctcgacctccccggcgtccaggatcccgggcgaccactcgtgcaccgtgcggaaataccgcagcaccggtgacacgctctgcgagacgagtcccggcagcgcgggcacctcgtcgagcatcagcggcgccagccggcccggcggacactgcagttcggccacgcagtcgaccggtccggcgagcgcgtaggagaagatgcagtccgcgcgccgggccggtcgactgcgtggccgaactgcagtgtccgccgggccggc

SEQ ID NO: 795 - DNA, 3610 bp, Unknown
  Kingdom: Bacteria, Phylum: Actinobacteria, Class: Actinobacteria, Order: Streptomycetales, Family: Streptomycetaceae, Genus: Streptomyces
gcggtggtgcgcaccaccgcggtgccgcaccgcctggtgcgggcgccgggtcagacggtgaccctgcccgtccgcgacgccctcgcccagcttcccgtgcgcgaggagaaccgcaccggatatgagcggtccaagttcaagcactggatcgacgccgaccgcgacggatgcaacacccgcgccgaggtcctcaaggccgaagccgtcacggccccggagcagggcccgaagtgccgtctcaccggaggtgtctggtactccccctacgacgaccgctacatcagcgggcccagcggcctggacatcgaccatctggtccccctcgccgaagcctgggattccggcgcctccacctggacggccgcggaacgcgaggcctacgccaacgacctcggcgacgaccgcgacctgatcgcggtgtccgcggcgtcgaaccggtccaaggccgaccaggacccctccacctggctccccccggccgccggctaccgctgcacctacgtcaccgactggatcgccgacaaaatccgctggggtctgaccatcgacacccctgaacaggccgcccttgccgacgtcctcgaacagtgccccgacaccccagtcaccgtcaccctcgcccggtagaaacccggccccatccccctggcgtcagccgacctgcaaccggccacccggccgcaatcgaccgcccgccggtctgcgagagggtccgtaggacccgggggccggggccctgcccgctgccgcttcaccgcatggcgccagcggcgacggagagtccgcacccacccccgcaacgactgccgatggcaccccagacgtacggcgcgcagaaggggtggggtgacagcggtgccgctgtcaccccacccctttcaccgtccggccggcagccgcgcccgcccaggcggcgggcgggaaccgggtccagcgcctcccgttcagcggcacgacgtcgctcctcctccacctctgcgcggacgtcaccgtcgggttgtcgagcacggccgtcagcgtctgctcgccccaccgtccccgccgccgccacacagccgtgccggcaccatgctcctgtagctgactccaggttcggagaaccggcgagcgcgagacgaagtgcagcggcgagatcagtttgcaccccaagagtgctaagaatccgcaactaaagcgtcgccgatctgatcaaaagtgcacccgaaatcgaaagagtcggcccaactcctgggccgactctttcgcgtgccgtttcgcgcgccaacgcgtccggctcgtaatccctgttcaatcggttggagccaaggaagcagggcaccgtcgcactgatcggcggtggtacagcaagcatgggggccggacggtggattttccatcacccgcgagacgaatcgacttaaagctgccgaatacgcctgccatcggagcaggtcggcagtgatctgcctgatcagaggttgattaacaatgtctcaatcggaatgcgggattttttgaagtgggacggccttgaaccatctatcgatcgtgcgcgcgacatggcaatcgggtggcaagatgctgtgcggcttcccggtagcgccaactgccgcgaggtttccttgggttggagcatggagtacgcggtccgctgctgcgcgtccgcactgtgaacagggcctgtatgcagtggctcttggtggaaggggaagtgacgcggtgggacgaccagagaaaccgattccagacccggtgagtccactgggcatacttgcggtttccttgcgcaatgggcgccgtgatgctgggctttcctacgctgtgctgtcggagcggacgcggtccatcagcccggggaccctgcagcgtgcggcctccggggctgtcctgcccaagctggaggtggtgcaagctttcgcgcgggtgtgcggcatggatgtcgctgaggtggcccggctgtggcataccgcctatcaggagagcctgggcggacgtgctgccggccaggccaggaagccggagccgcgccctgacctcgtcaacgacctgcccggcctgtgtgctgcgctggaggagttgcggcaggccaacggggcaccatcgttccggatgatggaacgcagggcgcgggatgccggcaaggatctgtcacgcagcaccgccttccgcatctcgcgtggcacggtacccgcgtccaccgactgcctggaggccttcctggtcgcctgccaggtaccgccgcgggaccggacggtgtggttcgatgcgtggctccgggcgcagcggcaggctgtccgtgcccgccagaacgccgacggacgtgaggatctgaagcagatcgaggcggtggtcgccgacaccagccgcggtcaggtgtcgcaggagactgccgtcaggatgctgcggaaggccggcttcgatgccatggagcgctaccggcgtttcgacgccccgtggacggtcgagtgcctgcagtgcgccgccacgctccgtatccggctatccgatgtcgttctggcgcgggccacgtgcccggactgccctaagctcaccgaacacgtgcgggaagcctgggcagaactcctgacgaatccgtccggtcagctcagccgccagctcgtgcgcgcactgcgggccgtgacagtgctgccggcccgcctgcagcgcgaccacctcgacctgcccgtgttcgtggccgaccgcaccaccctgcgcatcctgcagtccagtgcatggcatcccccgttggaagacgtcctgcggcgtcatatccggcggccgttctacctggacgtcctgctcgtccacgactacgacaccatgcccgccccccggaacgggcaacggcaccgccggctcgccaaggccgccggcctcgtggacagccctctggaatcgactcctcacgagcaagggaagggccgcgtgaacaacggcgcgagcaacgaggcggcgtccgggcgagcggctgccgcagcgccgggttccgcccgcaccaccgcgtctacgccgagctcctggaagccgaccagcaacagcggcgtctgaagcaacatccgggataccaggcgaaaccatccagcagaccagcctccgcgcctcgagcggactggcgccctggccatggccggtcatcaggagatcaccgcacgcccctcggcacagccgcaagagcccttccagcacaacaaggacaatcccgatgaaccactgctcagcatcccagctggcggagcacgcctcatcctcatgcactcacctgatactggaaagcgccgcctcccaggacaccttcctcagcacctggacgtggacagccgtcctcagcctcgccgccctgatcatcagcacgtacttctccatcgaccaggtccgcaaaagcaagcgcgccaagcaagcgaagcgcttccagtcggattacgagctgctcaacgagaccgtcgtcctcctcgacaaactggccggcaccacagcacagaaggaggatctgaccaagctcggtgaactcgtgagccgtatcaagcaagccgaacgccgcttccccgagctcccgctcggcaccgtcgtcactcacctcgacgcctacaggaagacccccctgccagacgacgaccgtgctgcaggggtcgct

SEQ ID NO: 796 - DNA, 6302 bp, Unknown
  Kingdom: Bacteria, Phylum: Actinobacteria, Class: Actinobacteria, Order: Streptomycetales, Family: Streptomycetaceae, Genus: Streptomyces
gtgtcgcacccctccggcagctcgccgcgctccaccgcgccgatcaggcgagctgccggaggggtgcgacacggcggtcctgctggaccgcgaggcggcgggaggactgcggcggatcgggttcaccggcgaggccggccgcggcaccggttagcctttcggtcacagcagtggttcccagcaggcggtaggcagatggacttcccggcggacttctccgcggactttccgggggacttcccggcacaggcacacccccacccgcacggcggttggcccggcaacgagctggaggaggtgctctccgcatccctcggcatcccgacggccggcggccggatcatcgaggtgctgggccgcagcttcctctgggtcccgctgcccaacggcggcggcccgcacagcggaccgctcgacctgcccaccctggagatcgacggccaggcgtacgtgccggtcttcagctccgaggagcagctgcgccagggggccggccagcacatggcgttcaccgtcgcgcccgccgtcgagttcgcccgcgggctgcccgcccaggtcggcatcgcgctcaacccggacggcgtggccggcctcccgctgcccccgcaggccgtggccgaactgtgccgggccgggcgcaccgaactggacggccccgcgggcggcggccgggtccgcctgtacgaacccgactggcaggacgacccggtggacttcctgtccgccgccggcaccgagttcgccgccacggacggcctggtccgcaccgcccgccgctgcctggccgccgtcgagacggccgacccggtcatgttcgtcggggtcgaactgtcccagtgggacggcgacctgcgcagccgcccgctggacgcgctgggccgcgccctggccaaggcgccggccgcctggccggtcaacctcgtcctcctggacatcacggacgacccggtggccgaatggatgcgggaaagggtccggccgttctacgagtcgggccactgaggcacctcgcgggccgggtgcctcagtggtgcggcaccgcggtggtgcggcaccacgcactcacccagccgcgcggaccggccttaagctaggcggacagctcggtcgagggcacgacgaaggggcggtagaaggtgagcgccagcggcaccacggccgggcacgtggagcagatgctccgccaggtgacacccgggcggtacgacgcctacgaggcgctgctgcgcaccctcgcgaccccctcctccggccaggtctggatgctgctctggcacggccaggccggttcgcccgacgcccagtacggccacatggaggtcggcggccacggctacgcgccctgcgtcacctccgcccaggagctgtcggcgagcggctggatgcgctcctacgaggtggccgacggactcgacgtcgcccgcaccctctaccccgaccactacggcctctggctgaatccgcacgcccccggcggcggcgtcggcatcccctggctggacctgcgccgtatcgccaccggcctggaccgccagcccgcggggccgctcagtctctccgaacccgccatcgagatcccgcagttctacgcgctgctcacccaggccgcccaccgcacccccgcgctgcgctcgctgcgccgcgcctgggtgcagcccgccgtcggagcggcgtacctggccatcggcctggacgtgtacgacacctcgccgccggccgtcgacgcggtgcgggcgatgatgcagcagtccatggcggccgtcccggacgggctgccggtctcgaccgtggtgatgtcggacgagttcgaccccgtggtgatgtggctgcgcgcccgctcccgtccgttctacgaccgcgaggcgcacgccgtggccggacctcccgcggtggggggctacggctacccgccggccggcgccggacgctgatccggaaccgcacgctccgcccggcggccgtcaccgggccagggggtcttctgcgcgcgtagatgagggcggaaggtccgattctgcggaagaaagccccaactggcccgcgtccgccccccgttacccaacgtccggataacggaacccccctacccgcatcacgtttgcgcatcctttcaccgtcaagtctggcaacagatcgcccgcgcattgaagactcccgcaacaagggggcgttcgcccctgtgtacgacggactgacgatgccgccacagcggcaagtgcgggccggctaccgccggttgagaggggtccctgcctaatgacggcaccattgcacgagccgaccgccgaagcggccccgagcgcggccgatgaagcggcggttgccaccgcgggcgtgaaggccgtccagggccgctccctgggacggatcgcctgggagcgtctgaagcgggacaagctcgcactgacgggtggcgtcgtcgtgctcgtcctcatcgcgatcgcgctgctcgcaccggtgatcgcccatctcgtcgggcaggacccggacgcctatcacgagaacctgatcgacccgctgttcggcacccccagggggtcgctgggcggcatcagcggtgaccacctgctgggcgtcgagccggtcaacggccgcgacatcttcgcccgcatcgtctacggcgcacgcgtctcgctcctggtcggcttcctgtccgccatggtcgccgtcatcctcggcacggtcctgggcatcctggccggcttcttcggcggctgggtcgactcggtcatcagtcgtgtgatggacggcctgctggccttcccccagctgctgttcaccatcgccctggtctccgtgatgccgggcaacatgctggggctgaccggttccagcgtgcgggtcttcgtgatgatcctggtcatcggcttcttcggctggccctacatcggacgcgtggtgcgcggccagacgctctcgatgcgcgagcgcgagtacgtcgaggccgcccgatcactgggcgccgggcggttctacatcctgttcaaggagctgctgcccaacctggtcgcgccgatcatcgtctacacgacgatgatgatccccaccaacatcctcaccgaggcggcactgagcttcctgggcgtgggcgtcaagccgcccacgtcgtcctgggggcagatgctgtcgagcgcgatcgactactacgactcggaccccatgtacatggtggtcccgggtgtggcgatcttcatcaccgttcttgccttcaacctcttcggcgacggtgtgcgggacgcgctcgacccgaagggcgcccgctgatgcgtccaccccaagcgtcccgtggcaccaacacggggtctctcatcaaatccggaggatccgagatcgtgactacccaacgcacctcagggcggcgcaagcaggcgttggccgccgctgctgcggtcgccgcactgctgaccacggcggcgtgcggcggcggcagcgacgacaagggcgggtcgaagaccggcgccgccggctacgacgccgcgaacaacaaggtcgcccaggccacgctggccaagaagggcggcacgctgaagttcggtggcgctcaggacgccgactcgtgggacaccacgcgcggctactacggcttcatgtggaacttcgcccgctactacagccgtcagctggtcacgggcaagacggagccgggcaaggccggtgcccagctcaccccggacctcgccgacggcctcgccaaggtcacggacaacggcaagacctacacgtaccacctgcgtgacggcgtcacgtgggaggacggcaagccgatcacgtccaaggacgtcaagtacggcatcgagcgcgtctgggcgcaggacgtgctgtccggcggtccgacctacctcaaggacttcctggacccgaagggcgagtacaagggcccgtacaaggacaagtccgcggaccacctgggcctgaaggccatcgacacgccggacgacaagacgatcgtcttccacctgccggaggccaactcggacttcgaggaggtgctgggcctggtctcggcctccccggtccgccaggacatggacaccaagtccaagtacggcctgcaccccttctcctccggtccgtacaagttccagtcgtacagcccgggcaagaacctgaccctggtgcgcaacaccaactggaagcaggcctcggacccgatccgcaaggcgtacccggacaagatcaccgtccagttcttctcggacgccaaccagctcgaccagcgtctgctcaacggtgacctggacctggacctcaaccagaccggcatgtcgccccagggccgtaccaccgccctgaagcagcacaaggccaacctggacaacccggtctccggctacatccggtacgcggccttcccgcagagcgtgaagccgttcgacaacatcgagtgccgcaaggccgtcatcctcggcgccgaccacgtctcgctgcagactgcccgaggcggccccatcgccggtggtgacatcggcaccaacatgctcccgccgtccgtcccgggcgccgagggccagcagtacgacccgtacaacctctccggcgcgaacaagaacggcaacgtcgccgaggccaagaaggcgctgaaggcctgcggtcaccccaacggcttctccaccaccatcgcggtgcgcaacaacaagccggtcgaggtcgccacggcccagtcgatgcaggcgtcgctgaagaagatcggcatcaacgcgcagatcgaccagtacgacggttcgcagaccaccggcatcatcggtagccccgccaacgtgcagaagaagggctacggcatcatcatcatgggctggggtccggacttcccgaccgtccagggcttcggtctgccgctgtgggacagcaagtacatccagccgagcggcaacaacaactacgccctgatcaaggacaaggcgatcgacggcctcttcggccagtacgtcaccacgctggacggcgccggcaaggccaagctcgccaccgagatcaaccacaaggtcatggagggcgcgtactacctgcccttcgtcttcgagaagttcatcaactggcgctcggacaacctggcgaacgtctacacgacggacaactacagcggtatgtacgacttcgtcaacctcggcctgaagaacccgaagtaaacccggcacacccgccgtacggcacgaaaggcaggtgaaggccggcgcggcgtggtcgcgggccacccggggaaacccccccacggtccacaagacagtgggggagaccgcaggtggcccgcggtcccgcggcgggccgtaagctgtgctcgcttacctcatcaggcggctcttcgccgccgcagtgatgctcgtggtcatcgtcatggtggtcttcggcatcttcttcctcgtccccaagtgggcaggcgtcgacatcgccctgagcttcgtcggcaagcaggcagacccggccgccgtcgagggggtccggcagaaacttggcctggccgaaccgatctactggcaggtgtgggagttcttcaagggcatcttcgcgggccgcacctactcgggcggcggcgacgtcacccactgcgccgcgccctgcttcggctactccttcaaaagcgagcaggcggtctggccggtgctcaccgaccgcttcccggtgaccctgggactcgcgctcggcgccgccgtgctgtggctgatcttcggtgtcgcggccggcgtgctctccgcgctcaagcggggcagcatctgggaccgcggcgcgatggtcgtcgccctggcgggagtctccctccccatctacttcaccggcctgctcagcctggcgatcttcgccttcgggctgcactggctcgacgcgcagtacgtgcccctctcccagagcttcggcggctggttcggcggcatgatcctgccctggatcaccctcgccttcctgtacgcggcgatgtacgcccggatcacccgcgccaccatgctggaggtcctcggcgaggactacatccgcacggcgcgcgccaagggcctcagggaacagacggtcatcggcaagcacgccatgcgctccacgatgacccccctcctgaccatgctcggcatggacctcggcgcgctcatcggcggcgccatcctgaccgagtccacgttcaacctgcccggtctcggccgcgccgtgctcgacgccatcaggaaccaggacctgcccatcatcctgggcgtcaccctgatcacctccctcgcggtgctcatcgccaacctcgtggtggacgtcctgtacgccgtgatcgacccccgagtgaggctcgcatgaccgacctcagcaagacgggagccgcggtgggc

SEQ ID NO: 797 - DNA, 2001 bp, Unknown
  Kingdom: Bacteria, Phylum: Actinobacteria, Class: Actinobacteria, Order: Streptomycetales, Family: Streptomycetaceae, Genus: Streptomyces
cctcggcgagccggatccggcggcgggcggcgagccggtggtcggcggggacgaccaggcgcagcttctgctcgtccaggcgccgggcgacgaggtcgggggcgtcggggacgggcgaggtcagacagaggtccagctcgccggcgcgcagccgctccagcatggcctcgccgtagttctgcaccaggctgaagcggacgcggggatggtcggcgcggaaggcctggagcaggccgggcacggtctcggcgcccatggtgtgcaggaagccgaaggcgaccttgccggtggccgggtcggcgtcggcgcgcacctcctcggcggcgcgccgcacctcggcgagggcgcgttcgacggagccgaggaaggtgcgtccggcgggcgtgagggacacggtccggccgcgccgcgcgaacaggtcgacgccgaggtcctgctccaggcggaccatggcccgtgacagcgtggactgcgggacgcgcatctcctgggccgcgcgggtcacgtgctcggtgcgggcgacaccggcgaagtacgcgagccggggcgcgagcagcgccgtgacctcctcgacactggtcccgcgcatgacttctgtgtcaccggacggtgacacgcgcccttgtgacctctgctgatgcaccatgggaacgattatggcgagtccgtgcattggacggatgaacgcctccttcctaccgtcgaagcatgtctcccgccgataccggggcgtccgccaccgtggacgccgctcccgccgcctcttccacctctccctcccccgccgcttcctccccgaccgcttcctctgccgccgactcccggatggcgcccggcggccccggttaccgccggatgagcctcgcgctcttcctcgccggggtcgccaccttcgccctgctgtactccacgcaggcactgctcccgctgatctccggggagttcggggtggcggcgagcgaggcgagctggacggtggcggcggcgaccggtggcctcgcgctcttcgtgctgccgatgagcgcgctctcggagcgtttcgggcgtcgtacggtgatgacggcgtcgctgggggtcgcggtggtcgtcggcctgctggtgcccttcgcgccgtcgctgggtgcgctggtggcgctgcgggcgctgcagggtgccgcgctggccgggctgccggcgtcggcgcaggcgtatctggcggaggaggtccggcccaaggcgctggtgaccgcgatcggcctgttcgtggcgggcaacagcgtgggcgggatgagcggccgggtcatcaccggctgggtcgcccaggagtggggctggcgggtcgccgtcgccatcgtcggcgtgatcgcggtggggtgcgcggtcgccttccgcatgctgctcccggcgccgcgccacttcacgccgggctcgctgcggccgcgcgtgctggccggcacggtccgcgaccacctggccaacccgctgctgcgccgtctgtacgcgatcggcgcgctgttcatgacggtgttcggcggggtctacacggtgatcgggtaccgcctgaccgaggcgccgttctcgctcccgcagggcatcatcgggtcgatcttcctggtgtacctggtcggcacggtgtcggcgtcgacggcgggccggctggtgggacggctgggccgccggggcgcgctgtacctggcgggcggcacgacggcggcgggtctgctggtgtccctgatggattcggtggcgctcgtcctgctcggtctggtcctgatcacggcgggcttcttcgccggccacgcggtcgcctcctcggcggtcagcaggaccgccgcgcagggccgcgcgcaggcctcggcgctctaccagtccgcgtactacatcggctccagcgtcggcagcacggtgggtgcgacggccttccacgcccagggctggggcgggaccgtcggcgtgggtctcctggcggtcatgggcgtcgggacgatcacggtgctcggctcgcgggcggcccggcgtgcg

SEQ ID NO: 798 - DNA, 5927 bp, Unknown
  Kingdom: Bacteria, Phylum: Actinobacteria, Class: Actinobacteria, Order: Streptomycetales, Family: Streptomycetaceae, Genus: Streptomyces
gactgcgtcaccgtcgggcagcaccagcacgtggtcggcgccgatctcgacggcgcgccgccagaccccggagtcgtcctggtcccggccgacgagcacgacgccccgtcggcgcagggctccccgcacccgtcgcgcggcgtcgtcgccgaccagcaccagcggtgccgcctcccagctgccctggcgctcgggcacgccgtggtgcacctcgggtgtggcgcccgccgccgcgcacaggcgcagcaggtcgtcgaggagtgcggcgtcctcggtgacgatgagtggtccgccctgccgtcctccggtaccgggcggcgggtcgtgggtgacagttccggccatgggccgttcccccttcgctgcgtcttcgcgcggccccgcggccccgcgaatctggaacaggtgaagaaccggcgagcggtcctccatatgggcggccgataggaaccggccatacgcgcctgacaaacggaaccggccatgaactccgccgcgagcggtgcgcgcaggaatcacggtgcagcgaaccggaaaatgatgtggatcttggtcgaaatctgtggacaactcggcggctgtgaaaatggccgtcacccgaaccggtgacccctgtgctggttcccgtacgacttccacagcgcagcttcgcgactacccggagtcacggatcatgagggtcttaggaagccggcgcgagcagtggctctgcggccggaagccgcgcagcgggcgcgaagggagaggaaaacccacccggacatgcgacgacccccgccgggggggagagcgggggtcgtctccacggccgactcggggggggaggagtcggaccgggttagcacggtcgcgaacgatccgtgacttccatggtgtacccgagagccctctcaggcaaacccacgcgcccagcttacgccgaatgggctgcccctatgctcgacgtcgtggaaaaccactccttgccccgcacagctgccttctttgatctggacaagacggtcattgcgaagtcgagcacgctcaccttcagcaagtcgttctaccaaggcgggctgatcaaccgcagggctgtcttgcggaccgcatacgcccagttcgtcttcctcgcgggcggcgccgaccacgaccagatggagcgcatgcgcgagtacctgtccgcgctgtgccgcggctggaacgtacggcaggtcaaggagatcgtcgccgagacgctgcacgacctgatcgacccgatcatctacgacgaggccgcctccctcatcgaggagcaccaccgggcgggacgcgacgtcgtcatcgtctccacgtcgggcgccgaggtggtcgagccgatcggcgaactgctgggcgccgaccgggtggtggccacccggatggtggtcggcgaggacggctgcttcaccggtgaggtggagtactacgcctacgggccgacgaaggcggaggcggtccgcgagctggccgcctccgagggctacgacctcgcccggtgctacgcgtacagcgactcggccaccgacgtgccgatgctggagtcggtcggcaatccgcatgccgtcaacccggaccgggcactgcgccgcgaggccctcgcgcgcgggtggcccattctcgacttccaccggccggtgcggctcaagcagcggctgcccgcgttctccgtaccgccccgtccggcgctggtcgcggcggcggccgtgggagcggcggcggccaccgcggggctcgtctggtacgccagccggcggcggggcacgctcgcctgaaccgcggtctccggccgaaagcgccggccgcacctcgacggcgcccggaccctgacggcgcccgatcagcccgcttttgaggctgaaagtaaagaagtgcaggcaggggttccgcttgtcacccctgtgcagtacaaaggactcagcggcccgcgagacctgaggacatccgaaaggatcacccttgacaacgcattaggccccacggaccgagcatgaacaccgggcacccacgcgacgtcgacccgtcgattacgggccagccgcaccaggtgacgggcaaagttcccgacctgatgggcgacatatcgaggacgcttggtaactcggtgctcatgccagcggcggtacgagcactcgtaccgccgcaaccctgtttccggccggatcagacccgcccggcggtgaccgctcaggcagccccgcgctgcagcgcctcgcacaccgccgtcgactcgcgcgcccccagcccgaccgcttcggcgcagtgggtgacccaggccgccatgccttccggggtgccggagacgtagccgtcgagggccgccaggtacgccgctctgccgagttcggcgtgtcccacctcggccgggcagacggatttcgggtccaggccgctgcccaccaggacgatgcgctcggcggtccgcgcgaccagaccgttgtgggaggcgaagggacgcagcgccaggagttcgccgtgcaccacggccgccgtcaccagggcgggcgcggaactgcccgcgatgatcagctccgacagcccctccaggcgcccggagacctcggccgcactcggcagcggcaactcgaccagcggctcgtcgacccgctccccttcctggcgcggcctgccgacggcgtcctcgtggccggccgcggccaccaggtgcagcctggccaggacccgcaggggtgactgccgccagatggagagcagctggccggcctcggccgtcagccgcagcgccgcgccgagtacgcgcgcctcgtcgtcgccgctgaagtcggtccgccggcgcacctcttccagggcccagtcggccccggacagcgccgcggagccgcgcgcaccgcgcagcgccgcctccgaggtgaccgcgttgctgcggcgccgcatgatccggtgtccgtagacccggtccacggccttgcgcacggactccacggactcggccaccccgggcagcaccgcgagggcggcgagggggtcctcccgccgcgagcccggccgggggcccggggaaggatcggctgtcgcgcctgacgtactcatgagtacgaccctacgcacccgggcggcgacttccccgaaggagtggtcttcttcacgcagactgccacgtacagctatcgccgcactacgcttcgtgaacatgaaaattgctttcgtcgggaagggcggcagcgggaagaccaccctgtcgtcccttttcatccgccatctcgcggcgaccggggcgcccgtcgtcgcggtcgacgccgacatcaaccagcacctgggagccgctctgggcctggaagaggccagcgcggcagagctgcccgcgatgggcgaccggctgccgctgatcaaggactacctgcgcggcagcaacccccgcatcgcctccgccgagacgatgatcaagacgacgccgcccggcgaagggtcgcggctgctgcgcgtggccgagaacaacccgctctacgacgcctgcgcgcggcccgtggaactcgacggcggggccgtccgtctgatggtcacgggccccttcacggacgccgacctgggggtcgcctgctaccactccaagacgggtgcggtggagctgtacctgaaccacctggtggacagccgcgacgagtacgtcgtggtggacatgacggcgggttccgactccttcgcctccggcatgttcacccgcttcgacatcacgttcctcgtcgccgaaccgacccggaagggagtctccgtctaccgccagtacaaggagtacgcccgcgacttcggcgtcgtcctcagggtcgtcggcaacaaggtgcagggaccggacgacctcgacttcctgcgcgccgaggtcggggacgacctgctcgtcaccgtcgggcactcgaactgggtgcgcgccatggagaagggccggccgccccggttcgacctcctggaggacgccaaccgcagcgccctgcgcaccctccaggtggccgccgacgccacgtacgaactgcgcgactgggagcgctacacccagcagatggcgcacttccacctgaagaacgccgcctcctgggggaacgagcgcaccggggccgacctggcggcgcaggtcgaccccggtttcgtcctgggcgagggcgtcacggcctctgcctgacgaccgccgcctgaggaccgctacggcttgggcgccccgggcactcccttgggcgccggggccgggtggccggacaggaaggacgcccagccctgcttgggggcttcgccgacctcaagacctcgcagcttggcgagggtctgcgggtcctgggcgtccagccagtccgccagctggtggaaggagacgcagcgcacctccggcttgttgcacacctccttcacgacgtcctcgacggcgcgcatgtaggtgccgccgttccacgactcgaagtggttgccgatgaccagcggcgcgcggttgccgtcgtaggcccggtagaagcccttgagcaggccgtcgcgcatctggtcgccccagtagccgaacttgtccgggtcgccctgggtctgcgtgcccgactggttgaccatgaagttgtagtccatggtcagttgctcgaaggtgtgtccggggaagggcaccagctgcatcgacaggtcccacaggccgttgcgcttcttcggccagacctggttgttgacaccgctgctgtcgtagcggaagcccatctggctcgccgccttcatgaagttcttctgaccctccagacagggcgtgcgggcgccgatcagctccttgtcgtagtcgaagggcagcgcggcggtgttcttcaggccgctgttcgtcttccaggtcttcacgaactgcttggcctggtcgatctcgctcttccactcgtcgaccgaccactggccgaccccgccgtcggggccgcagaagtggccgttgaagtgggtgccgatctcgttgccctccagccacgccaggcgtacctgctgcgcggtgtcggcgatgccctgctcgtcgttgaagccgatgtccgaactgccctgtgcgtgctgcggcggccggtacaggtcccgcttctccttcggcagcatgtacacaccgctgaggaagaacgtcatgttcgcgtggttctccttggccaccttgcggaagtgcgagaacagcttctgactgtcctcgcccgcgccgtcccaggagaacacgacgaactgcgggggcttctcacccgccttcagccgctggggcttgggcaggtggggctggactccggtgtacgaggtcgacccgtcgccgatcagccggacgacgctcccgggtgcctgcgcggccttcggcgcaccgtgcgcgccgcgcgcgctgtgctcgggtgcgtcggtgccgctcgcacaaccggcgagcgacgaggcacaggccacggcggcgacgacgctcgcggcgatcctctggttggcggccatgttccgcccaccttcttccttctctcgtccaacgccgtgacggcgtgtgctggtgctgtgccggccctgccgacagcgccgtcaaggtcgcacgaaagcgagagggaattagtacgacaagccgatgaaatgaccacttcacccgtcaaggtgatccgctgccccatttgcgcagaaaatccagactgagactttacgttgcattacctttattttgccaagtgttgcattcgccgtctcctgtacaaggagcagagacatgtcagcctgcgtccccactcatgccgactccgcgcggaccgagcgctcccacccaccgcacagcccgccgccccaccgacgccgcccgcgcatcgcgagtgccgatctctcggccgccgtcgccgtcttcctgatcgccctgccgctctccctcggcatcgccctcgccaccggcgccccgctccaggccgggcttgtggccgcggccgtgggcgggctggtcgccggccgcctgggcggctccccgctgc

SEQ ID NO: 799 - DNA, 3224 bp, Unknown
  Kingdom: Bacteria, Phylum: Actinobacteria, Class: Actinobacteria, Order: Streptomycetales, Family: Streptomycetaceae, Genus: Streptomyces
ccggccgccgcgggcccgggcatctcggtgagcgccaacggttccaccgtgtcggtcaccaccagcgcgtgcacgtcggtcggcggcaactgggggacagcgtcgctgctcgccggcggccagaccagcttcgcccagggccgcaggtcggcactgaccgggacgaccgtgagccagtcggccgcctggcagagtgtgcgaccgggcacctacaccgtgatcgtggtgtgcgcgaacaacatcaccgccggcacccagtcgatcctcgtcaccgccgcctccaggccgacgatctcggccacgtccgcgccggcgaagccgtcgcgcggtgtgatgggcggcctcggtggcggcgtcaaggactaccgtacggtcacgttcgcggcgggcggggccctcgtcggggccgggctgatcgccaccggctgggtgctgcgccgccgctccaggccgtaccggctgtgagggcccgcgctcaggcgccgtccggcaggtcggcgaactcctccagggcgtgcccgagccactgggtccagaaggtctccaggtcgatcccggctcgcagcaccagatgccgcagccggtcctgggcgctgtcccggccgggcgggaagtcacgctcctcgatctcccggtactccgccaactgccgttcgtgcagctccagatggcgcctgaggtcgtcctcgatgcccgccgtgccgaccatcgctgcggcgcgcagccgcagcagcagggcgtccctgagcggcttcggctcctgagccgcggcgctccagcgggccagttccgcacggcccgcgggcaggacctcgtagctcttcttctgcccacgggccggcagctcggccggcagggtgcggatcagtccgtccgcttccagctttcccagctcgcggtagatctgctggtgcgtcgccgaccagaagtagccgatcgaccggtcgaagcggcgcgtcagctccagccccgaggacggcttctccagcagggcggtgaggatggcgtgcgggagtgacatgcggaccatcctaggtacggccggcaggcgggcggcggggccgcggacctacagggccgccgccagttccgtgccctgcttgacggcgcgcttggcgtccagctcggcggccacgtccgcgccgccgatgaggtgtgcggcgcgtccggcggcgagcagctcctcgtacaggtcgcggcgcggctcctgtccggtgcacagcacgatggtgtcgacctccagcacggtgctcgtgccgtcgacggtgatgtgcagtccggcgtcgtcgatccggtcgtagcgcacgcccgggaccatggtgacgccgcggtgcttgagttcggcgcggtggatccagccggtggtcttgcccagtccggcgcccaccttggtggtcctgcgctggagcaggtggacggtgcgcggcggcgcgggccgctcgggcgcggcgaggccgccgggcgcgcggtagtccgtgtcgacgccccacgcacggaagtacgcggccgggtcctcgctcgtcttctcgccgccgtcggtgaggtactcggcgacgtcgaagccgatgccgcccgcaccgaggatcgccacccgctcgccgacggcggctccgccctggagcacgtccaggtagccgaggacgctcgggtggtcgatgccggggatgtcgggggtgcgcggggtgacaccggtggcgacgacggtctcgtcgtagccggtgaggtcctccacgcccacacgcgtgttcagccgtacgtcgacgccgtgcgcggcgagctggtggcggaagtagcgcagcgtctcctcgaactcttgcttgccggggaccctgcgggcgacgtcgagctggccgccgatctcgctcgcggcgtcgaacagggtgacctggtggccgcgttccgccgcggccaccgcgcaggcgaggcccgccggaccggcgccgacgacggcgacgctcttgcgccggcgggtcggcgacagcaccagttccgtctcgtggcaggcgcgcgggttgaccaggcaggaggtgatcttcccgctgaaggtgtggtcgaggcaggcctggttgcagccgatgcaggtgttgatggcctcgggcgtcccggcggcggccttggcgacgaagtcggggtcggcgagcatcggacgggccatggacaccatgtcggcgcagccgtcggcgagcaactgctcggcgagttccggggtgttgatgcggttggtggtgacgagcgggacggagacggcgcccatgagcttcctggtcacccaggtgtaggcgccgcgcggcacggaggtggcgatggtggggatgcgggcctcgtgccagccgatgccggtgttgatgagggtggcgccggccgcctcgacggcccgggcgagggtgatcacctcgtccagggacgagccgccggggaccaggtcgagcatggacagccggtagatgacgatgaagtcctcgccgaccgcctcgcgcacccggcggacgatctcgaccggcagacgcatccggttctcgtacgagccgccccagcggtcggtgcgctggttggtcggcgcggcgatgaactcgttgatcaggtagccctcggagcccatgatctcgacgccgtcgtacccggcccgccgggcgaggcgggcggtgcggacgtagtcgtcgatcgtccgctcgatgtcggcgtcggtcagttcgcggggcacgaacgggctgatgggcgcctggagggggctcggggcgacgaggtcgcggtggtaggcgtagcggccgaagtgcaggatctgcagggcgatccggccgccctcgcggtgcacggccgcggtgacggtcgcgtgccggtccgcctcggcctcggtggtcagcttggcgccgccctcgtacggacgtccctcgtcgttgggggcgatgccaccggtgacgatgagacccactcccccgcgggcccgggccgcgtagaactccgccatgcgctcgaagccgccctcggcctcttcgagcccgacgtgcatggagcccatgaggacgcggttgggcagggtggtgaagcccaggtcgagcgggctcagcaggtgcgggtaacggctcatcgggccctccgtgcgtggtgtcgtacccgctagttgtagaggacctggggctcattatgcaactagttgcaaaaagacgggacgcaacgaacgcccgcccttgcccggcgggcggctgggcggtcgggcggccggacgg

SEQ ID NO: 800 - DNA, 3023 bp, Unknown
  Kingdom: Bacteria, Phylum: Actinobacteria, Class: Actinobacteria, Order: Streptomycetales, Family: Streptomycetaceae, Genus: Streptomyces
tcgtcgcggcgggcaccgcggcagcgaccgtccgttcaaccgcgaccgccagggcgaccgccccggcttccggtccggtggccacgagcgtccctacggccgccgtgacgaccaccgcggcggcggctccttcggccgccgtgaggacaagccgcgctggaagcgcaacggctgacagcctgtgagctgacctgagagggcccgcacgactgatcgtcgtgcgggccctctcggttgcgttgcccggtgatgcatgtcacacacccgggaagggaattgctgggggcatgacagatgacgtgagcgcggccaggaacgcccgaccgtcggatcaggagccgggccccggaccgtcggacgaggagcggctggcccagctcggctacacgcaggtcctcgcgcgccgcatgtcggcgttcgccaactacgcggtctccttcacgatcatctccgtgctgtccggctgcctgacgctgtacctcttcgggatgaacaccggcggccccgccgtgatcacctggggctgggtgggcgtgggcctgatgacgctgttcgtcggcctgtcgatggccgagatctgctcggcgtacccgacctccgcgggcctgtacttctgggcgcaccggctcgcgccgccgcggtcggccgccgcctgggcctggttcacgggctggttcaacgtgctgggccaagtggcggtgacggccgggatcgacttcggcgccgcgtccttcctcggggcctacctcaacctccagttcggcttcgaggtcaccccgggccgcacggtcctcctcttcacggcgatcctgctcctgcacggcctgctcaacaccttcggcgtacgcatcgtcgccctcctcaacagcgtcagcgtgtggtggcacgtgctgggcgtcgccgtgatcgtcgccgcgctggccttcgtaccggaccaccaccgctcgacgtccttcgtcttcacccacttcgtgaacaacaccggctggggcagcggtgtgtacgtcgtgctgctcggtctgctgatggcccagtacaccttcaccggctacgacgcctccgcccacatgacggaggagacccgcgatgcgtcgacggcgggcccgaagggcatcgtccgctccatctggacctcgtggatcgccggcttcgtcctgctgctcggcttcacctacgccatccaggactacggccgcgagctggactccccgaccggcgcgccgcccgcgcagatcctcctggacgcgctcggcgcgagcgcgggcaagctgctgctgctcgtggtgatcggcgcgcagatgttctgcgggatggcgtccgtgacggccaacagccgcatgatctacgccttctcgcgcgacggcgcgctgcccttctcccgcctgtggcacacggtcggcccgcgcacccgcacccccgtggccgcggtgtggctcgccgcgctcggcgcgctggtcctcggcctgccctacctgatcaacgagaccgcgtacgcggccgtgacctcgatcgcggtgatcggcctctacatcgcctacgtcatccccacgctgctgcgggtgcgcaagggcgacgccttcgaacgggggccctggcacctgggccgctggtcccggcctatcgggatcatcgcggtggtctgggtcggcgtcatcacggtcctcttcatgctgccccaggtctccccggtcacctggcagaccttcaactacgccccggtcgccgtcctggtcgtcctcggcttcgccgcgctgtggtggctcgtctcggcccgccactggttcctcgacccgtcccaggcacaccgccgcccgcgccaggacaccaccggcgccaccaccccgccaccgcccgccgcccagcagcactgaacgccactccggccgggagcgcccgacggcgacgcccgtacggaggaagcgcccgcacgccgcgccgacacggagtccgcccgcacgcgacccccgtacggcacacttccggccgcgctgcccgatacccgatctaagacgcggcctcctacggttatgctcgggggagcaacatcgcccgggcccttagctcaattggcagagcagtggacttttaatccattggttgtgggttcgagtcccacagggcctaccgaggccagggctgctctgtggccctgaccagcggtttcgtgaccccgaccagtcctcttggccggggtcacgccgtgcgcggagtccgtctgcgtaagcgggtgtgccggcaggcagcgtggcttgttcggtcgccgcgtccttcctcagggttcgccggcgcagacgtgcctctcctggtggcatcgaaggcattggtgaaaccatcgaggcggtcggcaagttcccggagccgatccgcgtgtgccgtgagggtgtccgagaggcggcgcaagtcgtcggagccgtgcggatgccagtcgccgtccatctcgacgttcatgaaggggacgcgaccgggcgggcgctcggtgaaggggcgctgttcgaagcacacgcgcagaaccacgggcgtgccacgactcgttggggtcgtgaattcgtagacagggctcgcgtgtgcgatgtcgagacggtagccgccgggctgatgctctgtatcgcctccgctgcaccagtcgggttcctggacggtgacaggtccgtggtcgcacgtggggacagttaccggcctggacgagttgtcatgatccggcatgagcgcgttccttgttccagtagtcatcggtccttggccggtgttgcggcagggatcctggctcaatcctcgttcaggaggtcagccgcggctttcggatccatgagcgtcgaccaggcttgctcggcgggaggaagggggcggctggggagggcgtactcggggtaccaggcggcgggatcgcagccgcggacatggcgcaggacgaccgcggccgcaggcgcagtgacccggatcacagcagatgagtgcatagaactgcggcagccacagccttgtccccgggtgtaggcgactgggcgggaacgcgggaacgcggg

SEQ ID NO: 801 - DNA, 5950 bp, Unknown
  Kingdom: Bacteria, Phylum: Actinobacteria, Class: Actinobacteria, Order: Streptomycetales, Family: Streptomycetaceae, Genus: Streptomyces
cggcgagggcgggacggccgtgggggtggaacgccgtgacgatgtggagggcggcggtgccgacgagtcccggtagttcgggaaaagagggctcggccgtgccccgcggactcggttcgacgcgtaccgttcggtccgggaatcggatgtcgacgaccgcccgccggtagagttcccagttcgggggtgtggtcgcagcgtcggtgacctgcatgaggggcctcctggtaacgaaggacccccttacccaccggcagggagatcggtgctcgctcccacacggccgcgggagccggtcctcggcgcgatcggcgtcgtgaccgagcggaacgatgccacaccaccggtcatggggtaaagcgttgtggatcacgttgtgctgaatcccgacgggtgctactttcgcgcccggtcatgagttattcggtcatcgcggtcagcgtcgttcgctccagccgtacgcagcaggcgccgggctcgggggcaagtacggcctgtatgccgttgacctccgggcccgtgaggcagccgctgaggaagaactggttcatgccgcagaccagggcgggggcttacgccggtcagcggatggaacgggcagttgagcaagcgcagccgggtgagggtgtcccgggcgtgttcgttgccgtattcctccagccgttcctcgcaggcggtcagcccgcactcgggacccagccgcccggggcgggtcttctcccgtgcggcggcgctcagccgcagaccgcgctgctgggcggtccgcatgaccgcctgcgtggcgttctcgtccgcctcatcggtcagctccgcctccaggtatacggcgagttcgtcgccgacagtgtcaagtacctggtcgagcaaccctgacggcagaagacacctcggggccgacgtggtcgatctcgatgtggcgcacgggcgtccgagcatcggaagtcgtcaggaaggctcgtgcggccttgtgaaggacggacggttggcagacgtaccagtccctccggccgtagccgtcctcgacagcctggtcggtggtgcttttcgccgcggtgagcagtcagtcccacgtcgattccgtggctggcggcggtgttgatgacagcccgcgcgccgccgcggctgacacctcgccagacttactcgccgaggtattcctcacggatgatgaggagcctcatttgttcggttcggtggaccagcgctgagattctccgaggtcagctaccatagatcgaagaaagagtgctctctacgaccactgcgtttgccaaccacaacgatgcccggacgggggcaggtactgtccatgacaggtgactggaagagcggctcggaccatgccgcgcgggggagtcagcggctcgccgaaaccgtggcggggctgatcgagaaggacatcatggaggagggctggcgcaccgggtcggtccttggctccgaacgggagctgatcgaacgctacggggtgagtcgcgcggtgttccgcgaggccgtgcggctcgtcgagcatcaccagatggcgcgcatgcggcgcggaccgggtggcggtctcgtcgtcaccgaaccggatcccggcatcgtccgtgatgccgcacgtgtctatctccggcacgccgctgtcagccgtgtgcagctgttcgaggcgaggatggccctcgaactcgccggtgtcaccaccgcggccgaaaagctgacggagtcggggatcgctcgcctgacaggcgcgctcgacaccgagagcgagctgatcgatcagggtgtgacgctcggccacgcacggaacctccatcgcgtgatcgccgaactggcgggcaatccggcgatcacactcttcgtcgaggtgttggcccagctcgaccaggacatggtgcagcacgaatgggagtccggtgatcaaccgggcgaggggcatcgcagtgccgccgtcgagtcccacgaggcccaccgggccatcgtggaggcgatcgtggccggcgacgctccgctcgcgcaacaccgtatgcgtcggcacttgcaggccatcgcggcactcttgcagaacgggtcgccgggataggcccgggcagtggatgccaacggctgcagaacgccatggcgggcagccgttggccacagaagcaggggaagggcgcgtctggcaccttctgatcagttcggccggagcggctgccgaccgtggtgtgcggcgcgttgccgggagttgactctgcgtccggggcggcgtcttgacgagtatcgtcgcgccgtcacgccacggcgatcggccggaggggcgagccggtaccaccgcgaatggtgagcggcaggcccacgaagaggaagctggagaccgcgtcggccgcgaggccctcgcagttgacccactccatgatgtgaattccctgcccatggaggaggtacaggtgcacggggagctgatttcccggcaccgtcgaaggcctcacctcgaaggacatggtgtccgcgccgacgtagcgagcaccctgcgctgcgagccactgtgctccgtccagagcgacaccactgccgccgctgtgcttgtggatgcgatcgatatcgggccagaacttcatctgccccgttcggacgagcacgatgtccccgtcccggatcgagacctcggcggcatcggccgcgagccgcagatgctgttcaccgatcgcgaagtgcggcggcagcacctccagaccgagcgctcgggggacgtccagcagtactccgcttccgatgatgggagtcagctccgaggcgtcaccgcgctcggcaccgtaattccctagtgcgtcgttggctgacaccccgccgtgccattcgtcgtttgcgccgcacgtgacatggcagagtgcgtcgatgtgggtgccggtgtgcaggcttcccgacacgagttcggagacgtagccgaactggtcctggttctcatcggggttgtcgaacgggaatcgccgggcagcccgctggccctgtggtgagttgtaggtgacgacctcgaaacgcgggtagccgtcgaaagcaggcatgtgccgccaccagcccgaggacaggtcgtacaccgcacccctggtggggatggcgagatggcggaggaggtcgtccgcgccgctgtgcggctggatcggcgagttcatgggacgtccctttcacgagtcgctggaggtggcccgcacgctgttgtcgatcacgtcgagaccgacattcctgcgtcggcagtcaataccgtgccggtgatcgcgccggccagcggggagagcaggaagagcaccggcgcggcgatctcgtgcggctggacagggacaccgcgcggtgtccgggcaagcatgcgccggcccgcctcggagggcaggaagtccttcatccgccgcgtatcgaccatgccgggcgcgaccgcgttcacccgcaccccgaacggagcggcgccggcgaggtagcgcgtgtaaccggcgatgccggccttcccggccgagtaccagccgactccgccaccgatcaaggtgccggcgatggacgcgatgttcaccaccgccttcgcctcgtcctggacgcgctccagccaggaagtggtgacgagctcgaccgacccgagcacgccgacgatgcccgatgtgaagggttgcggagtaccgctcggtggccccgcgttgttcaccagcagtcccggcgtgtcccagtccagggttcgggaccatgccgcgtcgacggaccgacgatccgacacgtccacctggaccgcgagtgcccgcccgtccgagcgctccaccagttcggccacgtcggcggctgcgtcgccgtcgatgtcccacaccgccacggcgacccccagctctgcggcaccgagcgcgacggcccggccgatcccgttgcccgcgccggagaccacgacgcaagttccgtctgtgaagcccatgtcactcagcatcagttcagtgtactcatcactcactggcgaggtccaggtcgtgtgccgggtgccgcgtccggcgacctcttgcatcgcgtatgcgctcagaccattgtgatcacgcaggtaaagaggatactttttccgcgtcttcgcgggctcgggcaggtcggcttccgtcagggagccgtctgcgatgtgaccgcaggcggcgcaagagtgatgtccccacgacgggcggacgaggaatgatgaacggcacggtcttctctgcattgactccggtggcgttcgccgagcgcgccgccaaggtgttcgcggatcgccctgcggtcgtcgatggcgcattgcggtactcctacgcagaactctggcagcgggtacaagcgttggccggtgtgctggccgggcacggagtccagccaggggaccgggtcgcggtcctcgcgcccaacacccatgtgctcctcgaggcccattacggggtgccgctggccggcgcggtactcgtggcgctcaacaccaggctcgcgcccgccgagatcgcctacatcctcgaccacagcggggcgggcgtggtgatcgtggacgccgcatgccgtgacgtgctggccgaggcgctgaagcacagcggaatccgaccggcggtgatcgactcaggacggccgcaggacgagtacgagtccctgctggcaggcgccaccccgcgggcggtggcagtgaccgacgagagatccctcctgtcgatcaactacaccagcggcacgaccgggcggccgaagggcgtgatgtaccaccaccgtggcgcctacctccaggcgttggcgatggcctaccacgccaagctggacacgtcggcacggtatctgtggacgctgccgatgttccacaccaacggctggtgcttcccgtgggcggtgaccgcggccggggcggtgcaccactgtcttcgcaaggtgaacccgtctgacatctggcgtgccgtccgcgagagcggagtcacccacttctgtgccgcgcccaccgttctggccatgctggccgaggaccccgcggcagcgccggttccccatccggtccaggtgttcgccgggggtgcgccgccctggccggcactgctcgccaggatgagcgcgctcggaatcgagatccgccatctgtacggactcaccgagacgttcggccccgccgtcgtgtgtgaatggcagccggagtggcgggacctgccgctcgaacaacgcgcaccactgatggcacggcagggcatcgcgaacatcatcggcgagcccctgcgggtggccgactcctccggcgccgacgtgccggccgacggcaccacgctcggcgagatcatgttgcgcggcaatgacgtgatgctcggctactaccgcgacgaggaggcgaccgcggccgcttcgaccgccgatggctggttccgcaccggcgatctcggcgtcatgcatccggacggctacgtcgaactgcgcgacagggccaaggacgtcatcatctccggtggggagaacatcacctccgtcgaggtggagaacgcgatcgccgatcacccggcggtgctggaggccgctgtcgtcggcgtgccgcatccgaagtggggtgaggtgccgatcgcctacgtcacgctgcgggccggcgcttcgatcggggaagcggaactggtcgcgttcgtgcgggacaggatcgcgaggttcaaggcaccgcatcgagtggtcttcggcgagctgccccggacgtcgaccggaaagatccagaagaagctgttgcggcagcgagccgcacaccctcagcagtaggactcccccgggcgggccggtagcgccccacggggtccccgtcatgtctgaacaaccgacaacccgccgccgcaccaggaagcaccccggatcgtgccgggcccctgccgctcggtgaacggccgcggatcaggaggaaccgtgatcaagctcaggaggccgctcgtggcggcggccgcgttcgtggtggcgctggtcctcggcggctcagcggttacgtccgccgccacgagcggcctcc

SEQ ID NO: 802 - DNA, 8536 bp, Unknown
  Kingdom: Bacteria, Phylum: Actinobacteria, Class: Actinobacteria, Order: Streptomycetales, Family: Streptomycetaceae, Genus: Streptomyces
cttccggcccctacccggtgcaccacggcgcggccgaaccggcgttcgccggcggcggcccgggcgcgggcgtccacgcaggtcagatgcccgtcgtcttcggcggcgggacgagtctgcgcccacatgatgagactcccgtcccacccacttgacagtggatgcgcgccggggggagggtcatttccatgcgcacccgaattctcgtacttggacagcgcgtcggctgagctgggacccaccggagacgatccggaactcccagcgaccctcaccggcgcgctcccctcgcttgcctcacggcacgaggggttttttgttgcacgggcacctgccgcaccgcggctccgcaccgtgcgaacctggcgaaagccgacacccgaaccctcgcagaacctcagcatcgagaagagaatgccgatgaccgagcaggccaccggggcccaccatccgcagccgcggccccgatccggaggacaccagtccgcgcccgagcacgtcacgggtgcgcagtccctcatccgctctctcgaggaggtcggcgccgacaccgtattcggcattcccggcggtgcgatccttcccgcctacgacccgctgatggactccacccgggtgcggcacgtcctggtccggcacgagcagggcgccggtcacgcggccaccggctacgcgcaggccaccggcaaggtcggcgtctgcatggccacctcgggcccgggcgccaccaacctggtcaccccgatcgccgacgccaacctcgactccgtcccgctggtcgcgatcaccggccaggtggcgtcgtcctcgatcggcacggacgccttccaggaggcggacatcgtcggcatcaccatgccgatcaccaagcacaactggctggtcaccaaggccgaggacatcccccgggtgatcgcgcaggcgttccacgtcgcctccaccggacgccccggcccggtcctggtcgacatcgccaaggacgccctccaggcgaagaccaccttctcctggccgccggtcatggacctgcccggctaccggcccgtcaccaagccgcacgccaagcagatccgcgaggccgccaagctgatcgtccaggccaagcggccggtcctctacgtcggcggcggcgtcctgaaggccagggccaccgccgagctgaaggtgctggccgaactcaccggagcgcccgtcaccaccaccctgatggcgctcggcgcgttccccgacagccacccgctgcacgtgggaatgccgggcatgcacggtgcggtcaccgccgtcaccgcgctgcagaaggccgacctgatcgtcgccctcggcgcccgcttcgacgaccgcgtcaccggcaagctggacagcttcgccccgtacgccaagatcgtccacgccgacatcgaccccgccgagatcggcaagaaccgcgaggccgacgtgccgatcgtcggtgacgcccgcgaggtcatcgccgacctggtccaggccgtccagaaggagcacgccgaaggccaccagggcgactacagcgcctggtggaaggacctcagccgctggcgcgacacctacccgctcggctacgacgagcccgcggacggctcgctgtccccgcagcacgtcatcgagcggatcggacagctcgcccccgagggcacgatcttcgcggcgggcgtcggccagcaccagatgtgggccgcccacttcgtccgctacgagcagcccgccacctggctgaactccggcggcgccggaaccatgggctacgccgtcccggccgccatgggcgccaaggcgggcatgccggagcggaccgtctgggccatcgacggcgacggctgcttccagatgaccaaccaggaactgaccacctgcgccctgaacaacatcccgatcaaggtcgccgtcatcaacaacggcgccctcgggatggtccgccagtggcagaccctgttctacaaccagcgctactccaacacggtcctgcactccggccccgacgacgtcaacccggacgcccgcggcacccgcgtccccgacttcgtgaagctgtcggaggccatgggctgccacgccatccgctgcgagcgcccggaggacctggacaaggtcatcgaggaggcgaactcgatcaacgaccgcccggtcgtcatcgacttcatcgtccacgaggacgcgatggtctggccgatggtcgccgccggcacctccaacgacgagatcatggccgcccgggacgtccgccccgacttcggcgacaacgaagacgactgacagagagctgagcgataaccatgtccaagcacaccctctcggtcctcgtcgagaacacccccggcgtcctggcccggatcaccgccctgttctcccgccgcggcttcaacatcgactcgctcgcggtcggcgtcaccgagcaccccgacatctcccgcatcaccatcgtggtcggcgtcgaggagttcccgctggaacaggtgaccaagcagctcaacaagctcgtcaacgtgctgaagatcgtcgaactggaacccggtgcggccgtgcagcgcgaactcgtcctggtgaaggtgcgcgccgacaacgagacgcgctcccagatcaccgagatcgtccagctcttccgcgccaagacggtcgacgtctccccggacgccgtcaccatcgaggccaccggctccagcgacaagctgaccgccatgctcaagatgctggagcagtacggcatcaaggagctggtgcagtccggcaccatcgcgatcggccgcggcgcccgttcgatcacggaccggtcgctgcgcgccctggaccggtcggcgtaacgacacgaagcgacgtgtacgggcggtcgggtgacaccgcccgcccgtataccgagaccccgaaacttcccgtccccccaccggcatacggtgggacgcacaacctgcacaccaaggagagaacccagtggccgagctgttctacgacgccgacgccgacctgtccatcatccagggccgcaaggtcgcggtcatcggctacggcagccagggtcacgcccacgccctgtcgctgcgcgactcgggtgtcgacgtgcgtgtcggtctgcacgagggatcgaagtcgaaggccaaggccgaggagcagggcctgcgcgtggtgagcccgtccgaggccgccgccgaggccgacgtcatcatgatcctggtgccggacccgatccaggccgaggtctacgagaagcacatcaaggacaacctgaaggacggcgacgcgctgttcttcggtcacggcctgaacatccgctacggcttcatcaagcccccggccggcgtggacgtctgcatggtcgcccccaagggcccgggccacctggtgcgccgtcagtacgaggagggccgcggcgtcccgtgcatcgtggccgtcgagcaggacgcctcccagggcgcgttcgcgctggcgctgtcgtacgccaagggcatcggcggcacccgcgccggcgtcatcaagacgaccttcaccgaggagaccgagaccgacctgttcggtgagcaggccgtcctgtgcggtggcaccgccgccctggtgaaggccggcttcgagacgctggtcgaggcgggctaccagccggagatcgcctacttcgagtgcctgcacgagctgaagctcatcgtcgacctcatgtacgagggcggcctggagaagatgcgctggtcgatctccgagaccgccgagtggggcgactacgtcaccggcccgcgcatcatcaccgacgccaccaaggccgagatgaagaaggtcctcgccgagatccaggacggcaccttcgcccggaactggatggacgagtaccacggcggtctgaagaagtacaacgagtacaagaagcaggactccgagcacctgctggagaccaccggcaaggagctgcgcaagctcatgagctgggtcgacgaggaggcgtaagcctcgtggccgaggggccggagcatgctccggcccctttcggcgaccagggggcgaggtcgcggtccaccgtcggcccgcggcgttgtccaccccgtccagccacggacgggtgatccttccgcagcggcgcaatgcgaagcacccgacgccactagactgctgcacaacaacgcgtcaggcccacagcgtcgtgcgtcttccacgcggctagcaccccgcccactccaccgcctgcggccgtcgggacggccgtccgcacgcattggacttgtgaggactcacgtgagctcgaaacctgtcgtactcatcgctgaagagctgtcgcccgcgaccgtcgacgcactcggtccggacttcgagatccggcactgcaacggcgccgaccgggccgaactgctcccggccatcgccgacgtcgacgcgatcctgatccgctcggccaccaaggtcgacgccgaggcgatcgccgccgcgaagaagctgaaggtcgtcgcccgcgccggtgtcggcctggacaacgtcgacgtctccgccgccaccaaggccggcgtgatggtcgtcaacgccccgacctccaacatcgtgaccgccgccgaactggcctgcggtctgctcctggccaccgcccgcaacatcccgcaggccaacgccgcgctgaagaacgccgagtggaagcgcagcaagtacaccggtgtcgagctggccgagaagaccctcggtgtcgtcggcctcggccgcatcggcgccctggtcgcccagcgcatgtccgccttcggcatgaaggtcgtcgcctacgacccctacgtgcagcccgcgcgcgccgcgcagatgggcgtcaaggtgctgaccctggacgagctcctcgaggtctccgacttcatcaccgtccacctcccgaagacccccgagaccctcggcctgatcggcgaggaggcgctgcacaaggtcaagcccagcgtgcgcatcgtcaacgccgcgcgcggcggcatcgtcgacgaggaggcgctgtactcggcgctgaaggagggccgcgtcgccggcgccggcctggacgtgtacgccaaggagccgtgcaccgactccccgctgttcgagttcgaccaggtcgtctgcaccccgcacctgggcgcctccaccgacgaggcgcaggagaaggccggcatcgccgtcgccaagtcggtgcgcctcgccctcgccggtgagctggtcccggacgcggtcaacgtccagggcggtgtcatcgccgaggacgtcaagcccggcctgccgctcgccgagcgcctcggccgcatcttcaccgcactcgccggcgaggtcgccgtccgcctggacgtcgaggtgtacggcgagatcacccagcacgacgtgaaggtgctggagctgtccgcgctcaagggtgtcttcgaggacgtcgtcgacgagaccgtctcctacgtcaacgcgccgctgttcgcgcaggagcgcggcgtcgaggtccgcctgaccacgagcagcgagtcgacggaccaccgcaacgtcgtcaccgtgcgcggcaccctcgccgacggcgaggaggtgtcggtctccggcacgctggccggcccgaagcacgtgcagaagatcgtcgccgtcggcgagtacgacgtcgacctggcgctcgccgagcacatggtcgtcctgcgctacgaggaccgtcccggcgtcgtcggcacggtgggccgggtcatcggcgaggccggcatcaacatcgcgggcatgcaggtcgcccgggcgacggtgggcggcgaggcgctggccgtgctgaccgtggacgacacggtgcccgccggggtgctcgcggaggtcgccgccgagatcggtgcgacgtccgcccgttcggtgaacctcgtctgaggtcgccgcactttccggcacgcacgaaggcgccgggtgagctggaggtttccagctcacccggcgcctttgcgcgcgcgccgtgaccctcaggccaccgcctcgaccgttccggcctgctcggcctgcccggtctccgcggtgtgctcgaccggccgggcctcttcccgtacgttcacccggcgcagggtcgccgccgccgcgatgccggccaggaccagcagcgccgctcccgcgagggccgcgccctgcatcccgctggtgaacgcctcccgggccgccgtcaccagggcctcaccggcccggcccggaagccgaccggcgaccgcgagcgcgccgccgagcgtctcgtgggccggagcgggggcgccggaggggatctcgtggcggtagaccgccgtgccgatggagccgagcgccgccatgcccagcgcgccgccgaactccgagccggtctcgaggagcgaggaggccgcgcccgcctgctccgccggggccgcgcccagcgccaggtcggtcatctgcgagatcaccatcacgatgccggaggacaggaccgcgcaggccgccaggaccagccacagggagtcggtgccggccagcgccagcatcacgtagcccgccgcgccgatcgcgaagccggtcgtgacgacgtaggcccggttgacgcccttctgcaccagctgggtcgcgaccggggccgccatgccgatcggcagcgagggcagcagcgcccacagggccgcctccatcgcgctcttgccgagcaccgactgcaggtactgcgtggtgaagaaggccgaacccatcatggcgaacgaggagatgaggttgaggacgaccgcgggggcgaagccccggccgcggaacagggacggcgagatcatcggcgaggccgcggtgcgctggcgctggacgaagaggacggcgaagagcaggccgacggcgatcgagacgacgtagagcgggtgcacgccctcggaggggatctccttcaggccgtagaccacgggcaggaccgcggccatcgacagcggcacgctgaccaggtcgaagcggccgggggcggggttcttcgactcgggcagcaggagggggccgaggacgagcagcagcgccatcgcgggcaggttgaccaggaacaccgagccccaccagaagtactgcaccaggacgccgctgagcacggagccgagcgcgatgccggccgtcatcacgccggaccagatgccgatcgccttggcccgctggccggggtcggtgaacatcgtgcgcaccagcgccatggtcgagggcatcagcgtcgcgccgccgatgccgagcaccgcgcgggccgcgatcagggtctcggcgctgttcgcgtacgcggcgaccagggaggcggcgccgaaggcggtggctccgatcagcagcagcttgcggcggccgatgcggtcgccgagcgagcccatcgtcatcagcaggccggccaggacgaacgcgtagatgtcgaagatccacagctgctgggtgccggacggctgcaggtccgcgctgatggccgggatggcgaagtagaggaccgagacgtccatcgagaccagcagcagcggcagcatcagcacgccgagggcggtccattcgcggcggccggcgagaccggccgcggtcgtggtggtgctcgtcgagttcgtcatggcagggactgtacgggcgtcttaaacgtttgtctagtacggccgtataaatcgagcgtctaggacgatcgtatagatctggagtagggtcagaggcatgggacatcgtgaggatctgctcgaaggcgcgaagcgctgcctgctggagaagggcttcctgcgcaccaccgcgcgcgacatcgtcaaggagtccgggaccaacctggcctccatcggctaccactacggctcgaaggacgcgctgctggtgcaggcgtacgtctcgctgatcgaggagatgggcgagggctacgggcccggctgggcggcgggaggcaccccccggacgcaggccgggtcgctggagcgcttccaggaggtgtgggcgaacgtcatccgctccgtgcccgagtcacgcgcgatctggctgctgagcttcgaactcatcttccagggcgatcaggtgcccgaggtgcgcaagctgctcgccgaggcacaggagcagggccgctcggggatcgtcccgatgttcaccggcatccccgagccggaggtcgacaaggagaccgtcgagaccgagggccgtctctaccagaccctgctgcagggcctgatggtgcagtggctcttcgacccggacacggccacccacgccgaccagctgacggaggggctgcgccgggtgatcgcgggagccacgaggaattcctagagccgcgccgccttcagcgccatgtgcagcagcagccggtcctcgccgtcgtccaggtccagcccggtgagctgctccacccgggacagccggtagtagagggtctggcggtggatgcccagctcggcggcggtgcggccggcctggcccgcgcagtccaggtagacctcggcggtgcgcgccagctcctggtgggcgggggagaggagcgggcccacggcgacgtcgtgccgcgcctcgggggacagcgaggtcagcaggcggtacgggccgaggcgggcccactgcgccaccgggccgaggcggggctcggcgagcgcggcccgcgccgccgccattgcctgcgtccaggccg

SEQ ID NO: 803 - DNA, 3428 bp, Unknown
  Kingdom: Bacteria, Phylum: Actinobacteria, Class: Actinobacteria, Order: Streptomycetales, Family: Streptomycetaceae, Genus: Streptomyces
agaagccgttgccggtgttgatggaccagttgccgccggactcgcactgggcgaccgcgtcccactcggaggtggtggcggcggaggcgttgccggccgccatcagcggaccggcgacggcgacacctgcgacaccggcgagtgcgatggcacgggtggccttggacggacgacgatgcttgcccttgccggaaaacagcatggaaggatcccctcaccgacgcctgcgaggtgagctgtcgggttcgggccggttgagttgcccggccgtgcccctggagaggcacggcttcacccccagccgctccggtcaactacccggcgcggcaacttaccttgggtcccccgctcctgccttcggcgctcgaagcgacgactgttcccgtacggccgctggcaggattcggcgttgcggcagccggggctcgcggtggcgagcggtcatgaccgtagacaggtgatccgccggatttcaaagacgatcagggcttctgagactcatcccacactttcaccgaatgggacattcggtgcgaagcatgacgtgaactctccctacttttgggcgatttcggtggggacatccaggctctgaccggcgacgatgtggtccgggtcggcgccgatggagcccttgttcgcgtcgtagagcgcgtgccatccgccgtggaggtcaagggagtcggcgatggacgtgagggagtcgccggtgcggacggtgtaggagtcggcggacgaggtgtgcgcggcgcccgcatcccgcgaggcgtgccggccgcccgtcgcgcccgtacggccctccccggccccttggtcggccgagccgccgcggtggcggccactgccgagcgcaccggtgtcgacgagggtcgaagagccgacggcctgggcgtagttgtccggggaaccggagtcgccggagccgccgccgtcactgtcatcgcccgcccacggggtggcgccggaggtccccgagccgtgggaggtgccgccggacttggacgagttgtccgtcttcgtcggcgaagagggcgaagagggcgaagtggagggcttcgtggaggattcgccgggtgtgccggtcccgtgggaggagcccggggtcgtgtgaccgcccgtcgaagagtcggatgaaccggacgagtcgcccgtaccgatctgcgtgtcgtccgacagaccggggtcgttcacgccggacgttcccgaaccgctcgatccgccgtcggaagaaccggatgatccggaggaatgcgacgacccggaggagtcggaggagccggaggagtcggacgcatcggaggtgccggacgacccggatgtccccgacgagccgttcgaaccggtcttcgaggacgacgagtcgccgcccacgcccgtgtcgacgaccgccgcaccggaactcctggtgagcccggagagcagcccgcaggtgtgccaggcgcccggcccccggtcggcgaggatcttctcggccacggctatctgctgggagcggctggcctggtcggcgctcggcgcgtaggagagcccgccgtacttctcccagtcgtcctgggtcaggagcaggccgccgtagtagccgttgccgttgtcggcgctccaggagccgccggtctcgcactgcgccaccttgtcccaggtggtgccgtcggcggcgctcgcgccggaggcggcgaccagcgggatggcgatggccgatccggtcactccggcggcgacgatgagggccggagcctgacgggggcgacggtgacgaccgttcccggagagcatgcggtgacctttcgcacgacagcagtgacccgcgtggcggcggggccgaaaggctccggcgtcacactgatgggtgaaagtagcgggtgacgatcacttgtcacaagttaatgccgcacagatcacgtgacgatcacatagttgagcgtgtgtcacctttaccgctgccgacgcggggtgcagagccccgcccgcggctctttccggccactgtcaggcgggcggtgcgggagtgaagcggaccgggagggtccgcagtccgcgcatgatgagtccgccgcgccagcgcaagtcggccgggttcgcgtccagttgcaggtcgggcagccgggtgaggagggtggccagcgcggtctgtccctccagacgcgcgagcggcgcgcccaggcagtagtggatgccgtgcccgtaccccacgtgctggttgtcgcggcggccgaggtcgagggtgtcggggcggtcgaaccgctccgggtcgcggtcggcggcggcgaggacgaccaggaccggatcgcccgcggcgatgtcctgcccgcccagggtgagcggccgggtggcgaaccgccaggtggccagctccaccggcccgtcgaagcgcagcagttcctccaccccggtctccagcaggccgctgtcgccgtcggcgagggagcgctgcagccgctcgcgctcgccgggatgggtgagcagggcgtacgtgccgttgccgatgaggttgacggtcgtctcgaaaccggcgaacaggaggatgaaggccatcgcggcggcctcgttctcggtgaggtgctcgccgtggtcggaggcgcggatgaggccggagatgaggtcctcgcccggggcgggttcggcgggcagcgcctcgcgcttcttgtggatcagctcggccaggtagccgcgcatcttcttcaccgaacgggccactccgccccggggccccttgccgtgccggatcatcatgcccgcccagtcccggaagtcgtcctggtcctcgcgcgggacgccgagcaggtcgcagatggcgtagatgggcagcgggaaggcgaactcgtggatgaggtcggcggtgccgcgcccggcgaaggacgcgatgaggtcgtcggccagctcctgcacgcgcggcgcgaactcggcgacccggcggggcgtgaacgccttgctgaccagccggcgcagccgggtgtggtccggcgggtcgatgttgagcagatgcgtcatcaggtcggccttgcgctcgccggggatgccggtcttgcccttggcgtgcgcgggctcgtcgtggtgggcggggttcttggacagccgggcgtcggcgagggcctgccgggcgtcggcgtaccgggtgaccagccaggcctccacaccactgggcagccgggtccggtgcacgggggcgtgctcgcgcagccaggcgtacgccgggtaggggtcgctcgcgaattcccaggtgaagagaggggggggggcgggggtgccggaggagggggtgtctggctggtcgtgcatggggcgacagtagtcggcgggggtcccccggacggtctgcgggctcagaggttgtgttgtcgggtgcgggccgtgggggctggtcgcgcagttccccgcgccccttcagggcgcgatctccagggcgctacctcaggcgccctccgtctttc

SEQ ID NO: 804 - DNA, 3368 bp, Unknown
  Kingdom: Bacteria, Phylum: Actinobacteria, Class: Actinobacteria, Order: Streptomycetales, Family: Streptomycetaceae, Genus: Streptomyces
ggagggccgggcgcaccttgagtacgagggggccgaggggaccctgcggctccagggcgccatgccggtgagcggcaaggaccggctgggcgcctacggggtgggcgccgacatcgcgcgcaaggttcgcagcctgggccacccagacgacaagattccggcagtgctggaggagatgcgcgcggtttcgccgccagggcccggctcagggaaccgcggccacagccgcgcggcgtgctgccgtccaggagacggacgccgtccttcagcagatgatcgccgcttggcaggaggccgtcaccttcgagtggatcagcgacacctgatccactcactcacgtgagtgccgtggccgccgacggttcgcagtggccagctgtacagaacgaactgttcgaatgatgcgaacagttccttccaaatttggaagctcagcggtcaggcacggccttcaggatgcgggatgcgaggtggccttcagcttccggccgctgccgctgcaggactcatgcagcggcgggaaccggtgcccctatggacaggcgctggtgctcggctcgcctatccctggggagccttccgctgtgcggctccgggccccgcccgcaaaagtgcctgtcagtagtgctgccctcggtagacgccgtcggtgccgacgccgcggctccagtctccgaaactcgtgttccccagctcgaggttggtgatgaaggagccgactgcgacgagggtgatcctgaacgggtcgtcgtcctcgtcgggcaggttgttcacggccagcaacggccactccgccgaggtcagggtctgttcgtcggcgatgaggaggaaagggctgtcgggccagccctcgtcatcacggccgacccgctcctgcagccggccggccgtgaagcccgtgtagagggggttgtcgatgacggtgaccgacccgtagtgctccgaaccgctctccagggcctggagcaggcgcgcccaggagtctggctggtcgaaggaggtgcggaccaggagggggccggcgctctcctcgatcgtggggggtaccggtcctggtccggcgccggtggggtcgccggggatgatctggatgaggaagcggggctttttgccgtccgtggagcggtcggcggcgtggacgcggaccaggtaggggcctggtcccgcggtggcgaggttctccttgcgcacgggtgcgtatccgctgtcgcacagggccaggaagccagtcgtggagatcacggtggtctcttcgacctcgtcccagccgctctccgccccggggtcgtctccggcgtagagggtgacgacggggttctccagcgtgctgccggcgtcgatgtgcagccagtccttccccgccgacaggagtccgtggccgtgcggctgggggccgccggtgtcggggtccatgacggtcaggtcgccccactccttcatcttcaaagggcgggtgcggccctgcaggtggggccaggtggagcgcggcatggagaacccccgtcgtctgtgcggtgctggtgcctgccggtcatgtggtgcctggggtcagtgtggcaggcgcgggtgtggtgccgggtctacttgatgtggacgtagtaggcgtcgccgttcaggacgcgctggctcttgtagaagccgccgaggcgggcgccggcgctgcggttgtcgccggccaagatgatgcgggtgctgccgcggcgggggttgccgccttccttgctggcggcgaaggggtactcgtcgcagtcgtacttcttcgggtcggggttgtggaccttggcgcacatggccttgcggtgggcggcgatggtcttggcgtcggtgatgcggtgcaggggggtggaggcccccgggtgtccggtgatcttgcgctgggcgtcgtagatgtggttcgcggactgcttcacctgggcgtcgctgcgggagagggtgaaggtgggggcaaaggaggggaagacgcagccggggttcttggtgcgcttggtggggccccagaacgtgtcgtcgcagcggtacttggcggagttgtaggtgaagccgccgggtgtgtagccgggcttggtgaacgtgaaccggtaggaggccgggctggtgagctgcttcttcttcgcgacgcttgcggcgtagccgacggtgcccttgtgggcggggccgagggtggagccctgggggaacttgaccgcggtcttcacgcccttgccgccgccgaccgagacactcatacgcaccccgctggcgttgacgagcgtggccttgccgacggtgaagctctcgccccacttgagcttgctggtctgcaaggtcatggagtgcttgatgtcgaaggtcgcgtagccgaccggcttgccgttctgcaggatgttgagccgggcgccgatgtccatgcacatgctggtgcgggtgatcgtgatggtgttgatgcggcagctcgcggccgcctcggtggagacgaaggcagtcttcaccggcttggtctgggtgacggtgatgctgtacttggcgggtgtggcctgcgcgctggtggcgctgatgccggtgccggtcaggaggagcgcggtgagagctgttccgatggccgcattccgtggcgcgctggtccgcatgagcatgtcccctcgttggtggaaggacggcaccgggtcaggggcgccgtccatgcggcggacacactaagcgcaccaacgccccgctgttcacgctttattggcgatgcgtacgtatttggacaggctgaggccctgcctccgcatatggcggtaaaggcccgcttcgggcgccagtccgaaaagggctgtcgctcaggcacggcagacaccaccgagccgcatccccagcgcaccccggcgcgcgcggtcacggcctcacgcgcgactccgactcaccccccccccgcaacaagcgcacccctactaccgcaatccgaggccacacccccgcaggggctcgcggtgggcaggcaggcgcccggccttcggccggccggactgttcccggacggccaccgtccctggtggaacggcggcctccgcgaggccctcagggcagccgctgcgccgaaggacaccatccaacggccggctcgcccaatccgcccggatcaggtgatccggaaaatacggcctaaagggccgtcttgacgaagcagcgaactcaccgaacagccagccgcgccaccccggctcccgcgcgcgcaagagtggtccgggcaccgttggcgctgtcccagacgaatcgagtcgccagtcatccccgtcaccgcagtcccgtgccgaccccggggtcactgtcttcaaaccgcggccgattcctcagaccgctacctgacgctggggacggaccggggaccccggtcgggtgaatcacca

SEQ ID NO: 805 - DNA, 6416 bp, Unknown
  Kingdom: Bacteria, Phylum: Actinobacteria, Class: Actinobacteria, Order: Streptomycetales, Family: Streptomycetaceae, Genus: Streptomyces
cgcccccgggggcgacggcgatcttccgttcctcatagggcagcgcctccgtttcgaagagctgtgcgatgccctggcggccctcgacctcgacgaggagcgtccgcttccccttcgtggccagggccagcgcgagggctgcggcgaccgtggtctttccggtcccgcccttgccgctgacgacctggagcctgctcacgccttcgagcctaaccagtccgcgctcgggtcacgcgggaggctgtggacaaccgcctcggcggtggcgccgcggtgccggtcccgtgcggccgcggcgggggctgacggcaggcggacggcgcggtcacggcagccgtcccggcagcggctacagtcggcccatgaccaagtgggaatacgcaaccgtgccgctgctcgtccacgccacgaagcagattctggacaactggggcgaggacggctgggagctggtccaggtggtgcccgggccgaacccggagcagctggtggcctacctgaagcgggagaagcaggcatgagcgcggtcgaggcgaagctggccgagctgggcctggccctgccggaggtcgtgccgccgctggccgcctaccagccggccgtgcagtccggcccgtacgtctacaccgccggccagctgccgatggtggacggcaagctcccggtcaccggcaaggtcggctcggaggtcaccccggaggaggccaaggacctggcccgcacctgcgcgctgaacgcgctcgcggccgtcaagtccgtcgcgggtgacctggaccgcatcgctcgcgtggtgaaggtcgtgggcttcgtcgcctcggcgacggacttcaccggccagcccggcgtcgtcaacggtgccagcgaactgctgggcgaggtcctgggcgacaagggcgtgcacgcgcgcagcgcggtcggcgtggcggtgctgccgctggacgcgcccgtggaggtggagatccaggtcgagctggctccctgagtcggcacccggccgctcggcgggcccctgacctcgggtgtctctcgggcatggcgcctcgggcgctctccggcacgggttcgggcgcggcctcgggtgtcgctcgggcgcgaacgcgggcagggcctcgcgtgtcgctcgggcgcgaacgcggggcaggtcctcgagcttcgctcggacacgaacgcgggcagggcctcgggcgcctctcgggcagctctcgaacattcgcgcgccacgggatagcctccggccatggcgaatgggcagtggttccctccggactggccggaccgcatccgcgcgctcgcggacggcaccctcactccggtcgcgcccagacgggcggccaccgtcatgctcctgcgggacaccggtgccgggcccgccgtgcacatgctgcgcagacgcgcctccatggccttcgccggaggcgcgtacgcgtacccgggcggtggtgtcgatccgcgcgacgacgaccagcaggtgcgctgggcgggccccacgcgcgcgtggtgggccgaccggctcggtgtggacgaggcggcggcccaggcgatcgtctgcgcggccgtccgcgagacgtacgaggaggcgggcgtcctgctcgccgggccgggccccgactcggtcgtcggcgacaccacgggcgcggactgggagaccgaccgcgccgccctggtcgcgcgggaactctccttcgccgagttcctcgaccgccgcggcctgaccctgcgttcggacctgctgggtgcctggacgcggtggatcacacccgagttcgaaccccggcgctacgacacctggttcttcgtggccgtcctccccgagggccagcggacccgtaacgcctccacggaggccgaccgcacggtgtggatccggcccgcggacgccgcctccgggtacgacaagggcgagctgctgatgatgccgccgaccgtcgcgaccctgcgtcagcttcttccctacggcagccccgcgcaggtcctcggtgcggcggcggagcgggacctgacccctgtgctcgcgcgggcccgcgtggtggacggcgaggtcgtgctgtcctggccgggacacgacgagttcacccggcacatcccgaccggcggtacggcttccggggaaacggcttccggcggaacggcttccgcatgacggcgcaccggcccgggtcccggtcccggcactcgctccggcccaggctccggcccaggctctggccccgtacgaccgatgcccaggaaggtcccctcgcatgacggacgcagcagcgctccccggccagccccgcggcggtgttctgtccgggcccgccaccgcacgggcggtcaacgtcctcgcgcccaacgcctccgccatgaccctggacggcaccaacacctggatcgtctccgagcccgactcggaactggcggtcgtgatcgaccccggcccgctcgacgagggccacctgcgcgccgtcgtcgacaccgcggagaaggcgggcaagcgcgtcgcgctgaccctgctgacccacggtcaccccgatcacgcggagggcgccgcccgattcgccgagctgaccggcacgcgcgtgcgtgcgctcgatccggccctgcggctgggcgacgagggcctcggagcgggggacgtggtccgggtgggcggcctggagctgagggtcgtaccgacgcccggccacacctcggactccctgtgcttccacctcccggccgaccaggcggtgctcaccggcgacaccatcctgggccgcggcaccacggtcgtcgcccaccccgacggccggctcggcgactacctggactcgctgcggcggctgaggtccctcacggtcgacgacggcgtgcacaccgtcctgccgggccacggcccggtcctggaggacgcccagggcgccgtcgagtactacctggcccaccgcgcccaccggctggcccaggtcgagacggccgtcgaggacggccaccgcagcccggccgatgtcgtcgcccacgtgtacgccgacgtggaccgctccctgtggccggcggcggaactgtccgtacgggcccagctcgactacctggaggagcacgggctcatctagcacgggctggtccagcacggcctcgtcgagtacagcctcgtccacggcccgcaggggccgttgctcaggggcggggcgccttgacgccgtgcacgcgcgcgtactccccggcgagccaggggccgaggtcgtcgacgtaggaacgcaggacggcgcggtcaccgacgggctcgtacccgtgcacggccaccgcggccatctgcgcggcccgcaccgggtagtacgtcccgaaggcggcggccatctcgtgcagatcgctggtccagccccgccagcggcccatcacgagcgtgaacccggtacggacgaggtgccgggacatgaaccggaccaggggcctgcgggcctcctcggtgtcctcggccccggcgatccgttcccgccagcggggcaggaacagggagaggtccccgttggtctcgcgggccagcagcgggtcgtccggccggtagcgggggagacgggcggcgagatcgtcgccgagcagcggcgtgcacaggcaggtgacgaaccagcccaggtcgtaccgctccaggccgctcagcagcctctcccggctgtacagcagcgtgccgacgccgtcgatctgggggaactcctgatcgagcgccgcgccgagcgcttgcgtcgcctcccggtcggtgccggtcggctcgtcgcgcagggcgaccagcaggtccaggtcgctgagccctgcccgcgcggtgccgcgcgggatcgacccgtagaggtacgcgctgtgcaaccgcgtcccgtacaggcggggcagtcgctccccggccgcctcgacgaccgggcggaaggcggcgggcacgcgcgcgagagacccttcgcgggcgatgtacccctccggggtgaggcccctgcgcgagccgtcggcgcgggagatcagcgcgaccgcttggccagccgctccacgtcgagcaggatgaccgcgcgcgcctccaggcggagccagccgcgctgggcgaagtcggccagcgccttgttgaccgtctcgcgggacgcgccgaccagctgggccagctcctcctgcgtcaggtcgtgcaccacgtggatgccctcctcggactgcaccccgaagcgacgggagaggtccagcagggcgcgggcgacacggcccggcacgtcggagaagaccaggtcggacatctggtcgttggtcttgcgcagccggcgggcgacggcgcgcagcagggcgccggccacctccggccgtacgttcagccagggctggaggtcgccgtggcccagggcgagcagcttgacctcggtcagcgccgtcgccgtcgcggtgcgcgggcccgggtcgaagagcgacagctcgccgatcagctcaccggggcccacgacggccagcatgttctcgcggccgtccggggacgtgcggtgcagcttgaccttgccctcggtgaccacgtagaggcggtcgcccgggtcaccctcgtggaacagcgagtcgccacgtgcgagagtcacctccgtcatggaggcgcgaagctccgcggcctgctcgtcgtcgagcgccgcgaagagcggattgcgccgcagaacgtcgtccacgagttctctccttgtcgacctgctcaggggatcttgctcccccgtcgccaggggaccgtgttccccattttgccggacggtccaaacagtgtgatctgtcacaaggatgccgtacaggtgtcccggggtacgcggcaggggtccaatcgggcgccggtcctcggcgtccggggcggatgtcggtgccgggccttaggctggccgggtgtccgaatcgccggtgagagcacaggcctagggggctgggcgggtggttgtacggaaggattccgctgtgggcgaacagagttccggcagtgctggaaaagcggcggaagcggcgaacgccgcgaaaaaggcgccggtgaagaaagcggccaggaagggcaccgccggcaagcccgccgccaggaagaccgcttccaagaagtccgccgccgtgaaggggtcggccgccgtgaagaaggccgcgccgcccaagaaggtgaccgtcgccccggagaaggccaccgcggccgtgcgggaggcctcgcccgtgaaggccctcgccccggagccgccgaggaacgagtcgcgcaccgccctggtccgccgggcccgccgcatcaaccgcgaactggccgaggtgtacccgtacgcccacccggaactggacttcgagaaccccttccagctgctggtcgccacggtcctgtccgcccagaccaccgacctccgggtcaaccagacgacgcccggactgttcgccaagtacccgacccccgaggacctggcggccgccgacccggagcaggtcgaggagatcctgcggccctgcggcttcttccgggccaagaccaagtcggtcatgggcctgtccaaggcgctggtggaggagttcgacggcgaggtaccgggccggctggaagacctcgtgaagctgcccggcgtgggccgcaagaccgccttcgtcgtcctcggcaacgccttcggccggcccggcatcaccgtcgacacccatttccagcgactggtgcggcgctggcagtggaccgaggcgaccgaccccgacaagatcgaggcggccgtcggcgcgctcttcccgaagagcgagtggaccatgctctcgcaccacgtgatcttccacggccgccgtatctgccacgcccgcaagcccgcctgcggcgcctgcccgatcgccccgctctgcccggcgtacggcgagggggagaccgatccggagaaggcgaagaagctgctgaagtacgagaagggcggcttccccggccagcgcctcaagcccccgcagtcgtacctggacgcgggcggtaaaccggcaccgcccctggcgggccgatgaccggcgaggaacgatctcggtgccctcgggcgttggacacggcaggacggcgacgaagacgggcacacgcatggacggaggtacgggtacggacacgggcacaagcgcagggacgggcacagacgggggaactgctgcgggcagcgggatgggcgcggattccggtacggggacgggggtggcggtgacgcgagcgagcgagacggcggaagggttccgggcgagcccgccgcagggcggccaggcggccctgagcacggagggactgccgcagtggctggaaccggtcgtgcgggtcgtcgagacggtccagcccgtccagctgagccgcttcctgccgcccgaggacggcgcgggccgccagtccgccgtcctcgtcctcttcggcgagggcgagcgcgggcccgagctgctgctcatggagcgggcgagttcgctgcgctcgcacgccggacagccgtcct

SEQ ID NO: 806 - DNA, 5037 bp, Unknown
  Kingdom: Bacteria, Phylum: Actinobacteria, Class: Actinobacteria, Order: Streptomycetales, Family: Streptomycetaceae, Genus: Streptomyces
ccgaggagccggtggcgtccgtggagccgacggcgcccacctgggccgaggtggtgccgcatgccgtcgcggccaggagcagggtgaccacggggaccgcggtgcgcagggtggaccgggtggaacggtggccccgggtccgtcggacacgtgccggcataacttcttctcccgccttcgacgtttcccgcgcccacgccaggggagcgggcggggcgtgcgaccgcgttcctcacgcgggccgcgccttttccgtcctctacacggtacgtcggtgtcccacggctcacacccgtgcaccaggcgccgcgcacggcccactgccgggaaagccgtgcgaggcccgccggacagaccgggcgggagtctggtcggagccgtcgggcagacccggcgcagtcggtggcgagcccgccggacaggccggtacgggccggtacgggccggtcgagcggaccccttcggacttcccgggaccgtcaggcggaccggtcgggaaccctgcggtgcagctcctgcagcagcgcctgcccgggtttcacggcggcccgggggaactccaggcgggccacgtgaccgtcggccaggccgatgtccgcccgcagcgccatcgccgccccggtcgtcaagccgcctcgcgacacccaccgcacctcgtccagcgggaagtcccactggatcttccgcggctgcggcgtgatcaggccacccagcgagaagaccagcagcctgccgctcgtcagcgccagcacgttgcgctcccgcacgggcaggtccgggccggccgagcggtccagcgccgcgtcgacctgcttgcgccggcgctcccgcccggcgtgcttccccacgacggccccgaccgggccggccgccgcggcgccggcgacctccgacttcagtccggacatgagcgtcgacacccgtcccgccgggtacgcgagggcgacgcccaggacctctgcgtcctccagtccggcagacgccaagtacttccgcacccgtgcgacttgtgacggtttcacgcgcccctcccgatcttcctcaggccaccccgaagtctcccggcaggcaagggagttgtccagcgcaggggggcatgccgcgtcccgtgcccggagccggggggctgctccctgggcgggtgcagggcggtgacgcgggcgaggacgaggccggcccgcgagagggaccgccacacccgcggtccgctgcggggccggaggcatgcgtgagtgcgggtgcggctgcggccgtccgcggaagggacggcgcgtcgcgcccttcccgctcaccgcaccggcgtcccacgacggctgagaggcctcccggccgatgcccaggcccggcggccggccctccgggtcagcctgcccaggcccggagggcgtccttccggtggacgccgcggagggccaggtcctagggtcctcgcccgtgaccgaacttgcctcccatctgtccgccaccgccgacgcctacgacgccgtcgcggtcctctacgccgacctgttccgcgacgagctggacggccttccgctggaccgcgcggtgctcgccgcgttcgccgactgcgtgcgcgacgccggcgccgggcccgtcgtcgaactgggctgcgggcccggccggacgaccgcgcacctcagggacctggggctcgacgtgtccggcatcgacctgtctccggtgatgatcggcctcgcccgcgaggcctacccggacctgcgcttcgaggtcggctccatggacgccctggacctcgcggacggcacgctcggcggcatcctctcctggtactcgttgatccacaccccgccgcaggaagtgcccgcgtacctcgccgagttccggcgggtactggcgcccggcggccatctcctgctcggcttcttcgagtcggagggcggaccggtcacggcgttcgaccacaaggtgacgaccgcgtaccggtggccgatcgacgagctggcccgactggccggggaggcggggttcgcggagaccggccggatgctgcgcgagccgcgcgaacaggaacgcttccgccgcggccacctgctgatgcgcctcggctgaccggttgcgaccggggcgcgtcatcaggtggcagggccctgcagatcagccatgtgtcccggccggccggtcagcccagcgagaacggcagccgtgccgcgaggccgcccagctctgtcctttccacgtcggtcgcatggcgccgtccggtaccgacgagcagcgcgtccgtgtcggagaacgacggcgggaaggcggcaccgacgatcttctccagcagttcccgcgaccgcgcgagcgactcggcgggcgggcgcgccgcgtcggacagccgcggcaggtgtgcgacgaggtcgagatggtgcagcgtccactccaggacgtacgcgtcgaggtagtcgcccgcggtcagcacctgctcccgggtgctgacccgcagtccggggccgaccagccgggcggcgcgtccggcggcggaaccgacgtcgtcgagatggaacttgagcagccacggctcctcgtacgcggcggccaggcggacgatcagcgcgtcgagcgggtcgtcaccggccggtgtctccacgaggtcccagtaggtcaccgcgttccgggtcggtgccgcctcggtgggtgtcaccagggtgatcaggacgtcctgcgcgtcgatgaccaggtggcacacgaggtcccgtaccagccagcccgcgcagccggacggccgtacgaagtcctcgtccgcaagcgcggcgaccgccgaccgcagggccgtccaggagagcgtgaagagatccacggcgtcaggcgggcgtcgggtccgcggcgcgcagctgagcgatgccccagtccagagcggtctccaggtgggtgacctggccggtggcgagcaggagcgccactccgccctggatgccggtcagcagggccgcggcggccgtgtcgacgtcgaacgtgtccggcagccggccgccgcgctgcagcgccctgatcccttcggcgatgtgctcctgccacttgcgcatcagctcgacgaccacggcttgtgcgccgggagaggcggcaccgacctgcctgagcagtgagccgagggaacacgtgtcgccctgctcccggtaccggtcgacgaccgagtcccgccacctgtaccacgtgtcccagtcgtccaggtgccccagatgcggctgctggtcgtccaggacccggtcggcctcgaactgggcgacggcgagcaggagttggtctctgccgccggggaagtagtggaacagctggctcttgctggtccgtgtccgctcgcggatgtcgtccagggtggccgtgaggcccgcttcccgcaggacctcggaggcaccgacgacgatccgctgccgcgtcgcccgccccttgggggtcagaacgtgggccatactccagctccccttcaccggccagtgcgggttcattctacggccggcggtgtcaccgcagacggccacgaacacgtccccggacggcacgccggtgccggtcctaacccgcggcgccgggggccgcgccactacggtgacccacggcgggcgcccccgcgcgcccgccctggaacccggaaggtccgtcatgctggagggattcgaccgatgagggcccagctcacccgtgccgccgccctggccgccgtactcctgacgacaacgaccgtcacgaccgccacgaccgccacggctctgcacgccgccgggcccgcgcaggccgcatccgtgccgcccgcgcccgcgcggtcgcacgaggtggtcacctggggtgcgagcgccgcccggctcggcagcgggacgccccaccgcgcctaccggctcgtcgtgcacaccagcgtggccgggagcgccccgaggatccgcctgagcaacgccttcggtgaccgtccgctgaccttcgacagcgtctgggccggtgtccagggctccggcgccgcactgcgccacggcagcaaccggcggctgaccttcggcggcgcggccgccgtcaccgtccccgccggacggaccgtcctcagcgatccgctgcccggccggctgcccgccgccaccgatctggtcgtcagcctgcacagcccggacgcggccggcccggcgaccggccacggcatggcgctgcagacgtcgtacacgacccagggcgaccacactgccgaggagggcgccggccactggacgcagaccatcggctcctggttctacctggactccgtctcggtacggaccgctgcgcgcaccgccgccgtcgtcgcgctcggcgactccatcacggacggccggcactccagcaccgacctgaaccgccgctggcccgactacctcgcgcgccgcctggggcaggcgcacagcggcgtccggggtgtggccaacgagggcatctccgggaacaaggtgctggccgacggcgccgggccgagcgccctgcaccggctggaccgtgacgtgctgtcccagccaggtgtgcggagtgtcttcctcttcgagggcgtcaacgacatcaaggcacacaccggggtcacggccgccggcatgatcgccgggtaccgcgagatcatcgcgcgggcgcacgccgccgggaagtgtgtggtcggcgcgaccgtggggccgttcaagggctggggcgagtgggaccgggccgccgagtccgtacgccaggaggtcaacgcgttcatccggtacagcggcgagttcgacgcggtgaccgacttcgaccgcgtcctgcgcagcccgtacgaccccgagcgcatggtgccgtccttcgacggcggcgaccatctgcaccccgacgacaagggcatgcaggcgatggccgacgcggtggacctcaccgccctggactgcacggcgggcccgcacaccaccggctgacgggtgtcgttcccgcgttccggcccgcaccggtgcggtgcgggccggaacccggatgagggtgcgtcacgcggcggggttcctccggcggcgcatccaccacaccagggccgcgccggccacggcgagggcggcggcgatgccggcg

SEQ ID NO: 807 - DNA, 9420 bp, Unknown
  Kingdom: Bacteria, Phylum: Actinobacteria, Class: Actinobacteria, Order: Streptomycetales, Family: Streptomycetaceae, Genus: Streptomyces
tcgccgatcgcggtggcctcggcgagcgccttggcctgcgcgccctcggcctcggcccgcatccgggcctgggtgccctcggcctccgcgagcatccgggcctgggtggcctcggcctccgcgcggccggccttctcgatgacctcggcctccttgtcgcggacctgcacggcggccagcccctcggcggcggcctccgcctggatgccctcggccatccgcagcttggcgcgggcctccaggtcggcggacttcagcttggcctcggccagggtcagcgactcggcggcgcggtgggtggcggcctgctcggcggcctccgcggccttgatgtccttgaccagcttctcctgcgcctccgcctcggcggcgatgatgatcgcctgccgctcgcgctccgcctcctcgacggcacgcagcttcttgatggactcctcctgctcggcgaccgtacggtccaccgcgacccgctcgcgcacgacctccgcgatctcccgcttctccgactcgacctccttgtcggcggagatcttcgtcagctgggtctcgcgctcacgggcgatgacctccagcatgcggtccttctcgatgcgctcgttctcgacggcgatgacccgctcgcggttcttcgccgccaccgcgatctcgcgggcctggttctcccgctgcacgccgagctgctcctcggtacgcaggaaggcgctctgcgcgcgcagccgctcctcctccacgacccgggcggtctcggcctcctcgcgggcccgggaggtctcgatctcccgcttctgcttgatctcggcgtccgcctgccggcgctccagctccaggatggcctcgcgcgcgtcgacgttctgccgggtgatctccttctgctcggtgcgctgcgcctcgttggtgcgcacgtgctcgatggccgtcagctcggtgatcttccggatgccctgtgcgtcgaggacgttggccgggtcgagctgggacagcggcgtctgctccaggtagtcgatcgccgcgtcctccaggtggtacccgttgaggtcgacgccgatcaactcgatgatgtggtaccgcagttcctcacgcttggtgtagaggtcggtgaagtccatctgcttgccgacggtcttcagcgcctcggagaacttcgcgtggaacagctcctgcagggtgtcctggtggctggcgcgcgcggtgccgacggcctgggcgaccttgatgacgtcctcggcggtcttgttgaccttcacgaagaacgagatgcggatgtcggcgcggatgttgtcccggcagatgagcccgtcgcgccccgagcgggtgatctcgatggccttcaccgagatgtccatcacctcggccttgtgcagcaccggcagcacgacctgcccggtgaaggtcacgtcgaccttccgggtcttggagacgatcagcgccttgccctgctccaccttgcggaacagccgggagaaaacgaacagcatgagcagaacgacgatcagacaggccgcgatgagcgcgccgatgacaaccatggcaaacgtcccctgaagtaacgaaggtgtggcgtgcgggcggcgagatgggcctccggaatggggtccggcgtctcggtgtcaggttctgacgcccgctcgccggtccccggttccgaatcccgcccgccgttctccccgccgatgaccgcgacccgccccgcgctgccggcgcctggcatccaccgcccggcgcggaaacgttccggcctaggaacgtcgtccatgtgtacgggcgtcaggtgtcgggcgtcggcgggcggttgccggtgcgatgcgatgcgatgcgatgcgatgcatcaggagcgtttcgtgccgtaccggcgggccgtgtggccgctgacgtggttcccccctctcccccgtacggttcccgggcccaccccggcacctgccggggcccggcaccggaaaccgtccgtagtgctcccctgcgaccatgatgcccgcgcccggccgcgaagcgcattgccggttcccggcagtcttggggcctgcatcagtgccgggtcgatacccatgttcacatcaaagaggcgtcaaggttcggcaagtcgcttgacgcgcggcggatgacgggcagggtctcgatcaatccctgtaccgggcgcttcgagcagctaagctcccggcgtgaagtcggcacggccgaaggactctgcggccgacgagggcccgcacatctccggaaacggatctccccacgccatgagcaacacctggatcacgcgcgccgaaaccggcgccgacatccccgccgtccgctagatcgtcctcgccgcctctccccaccccggtggaggcagacctcgtcgaggccctgcgcgccgacccggccgcctggatcgaaggtctctccctcgtcgcggcggacgaagccggacacctggtggcccacgccctgctgacccgctgccacatcggcaccgcaccagccctgtgcctggcaccgtgcgccgtccgccccgagcaccagcgcaccggcgccggcagcgcggcgatccgtgccgcactggccgcggcgaggtcacggggagagcaccacgtggtcgtcctcgggcaccccgcgtactacccccgcttcggcttcacccgcgcccgcgaccacggcatcgccctgaccatcgacgtaccggacgacgccgtgatggccctcagcctggacccggcccgcccactcccgagcgggaccgtccgttatgcagcttcgggatctgacgggggggccgcctgggccgtgaacacccgtgtcaggcgctgctgacagcatcaccgccatgaacgccgccccgtacccctccgcggccggtggacgtgaccgtcctcttcctccgactggccccgctgcgcgcacggcgacccggctgtccccgaggccggggccgccgaccgtgaccgtgcacggcagctccgtcggggggccgctcctgtggcccgccgacgagccgtggccgtactgcgacgagccgcacgccagacgcgcggcgccggtggtccactccccgaacgacatccggctcctccgccgcaaccgagcgactgcgccgcgaccctcatacgccggacgaccacttcacaacgctgcgcaacgacctggctccgtacgtcaagtcccgtgccgtgcgcagcctttccgggcggatccgggaggtcgcggcggcaaaggcctgagcgtcccggcgtcgcgcagcgaatgctttcttcactcagtgcgttcttgtgtgcacgttccgtgcggtagcgtcacctcgacagcacagtcttcgacccgccgagtccggcgcaagaagacggcccccgcaacggctgcaaccgtttcgcgagggcctgaaccactgatggaagtcgagcctcccaccgtgatgtaccggcaccatatcgcgccgccgcgcgccttcagccagttctcgcacgacatcatccggcatccccggctgtcgtcggacgccgtacgcctgctgacctggcagctctcccttccgcagggggcgcgcgaatctttgtcccgcactgccgaacgtgcccggatcggagcaaccgccttcacccgggccaagcggcagctcaaggaagagggattcgtgcacgagcgccgggtgcagggacccggcgggctctgggtgacccaacagctggtctccaacgttccgttgaacgccggggaggcggccaagctgttcgggcggacgccggtcggcacggcgggcccggcgggcgccttggacgccgtacaagtcgtaccggccgcgccaccgccccgccccgcgcccacctccgctgacaccgcgtcaccgcaggtcgcaccgagtgctcccgttccggccgccggcgctccggcccctccgctcgccgacggtcatccaaagaaagacccggaaggaaacacctcccaccatcccgtcgagccgctcccggccgtcaccgaacaggcccgcgcactcgtcgccgcgcttccccggctctcccccgacctccgccgcatcccgcggggcatgtacgacgagctgacccggctcaccgcccgctggctcgcggccggtcacagccccgccggcgtccgcacccacatcctgcgcggcctgcccgacgacggcagccccgtccaccgcccgggcgggctggtgcgctacttgctcagggacgtcccgccgcgcccggagcgaacagccctcgggcccacacccgtcgccgatccatcaccgtccaccactccccgcctgtcggcccggctggccgggacgcgggagtgcgagggcgagcacgtccacccacgcctcttccggccggtcgacgacgagcggttctgcgcagagtgccgcacgtacccccgcaggagctgaacctcactccggcggctggtcgagcctggcggccaccgcgtcgaggacccagtccaggccggtcgcgaaggacgtctcggggtccacgtgcgtgccgtcgtggaccgccttggccagggccggaagcggcccgtggccagcaggcgcgtcacgtgcgggccgttggcgcgctgccagtcgcgctcggacaggcccgtggtgcgctcggcgcgcaggttggcgatctggcgtctgatcgcgccggtgacgtacgcgctgacggtctccaccgcgcgcaggaccgtgtcgatgtcggcgaggccgtccgaggaggccagcttggcctccgtcacggccaggccgcctgggcccagggacgggcgggcgccgagcaggtcggccagccactcatggcggagggctgcctgccgggtgcggtgggcgaggacgctcagcgcctcccgccagtcaccgggcgcgggctgctcctcgggaggatctcggcctggacctcgtcgaccatgaggtcgaacagctcctccttggtggagatgtacgcgccttccactgcgcggccgcccgaggtgatcgccgggtagctggcgccgcccgcgcccacttctcccgtctgcgaagggggctttgggctttcccgctcgacgtacgctggttgggaagggtggtgacgcatgtcggatgaactcgcgcacaacgtacggcgctaccgacgagcgaaggggctcagtcaagagcagctcgcgcatcgctccggtctctctatcgggccggtccgaaggatcgagcagggcgacgacaacgtccgcatggagacccttcactgcctcgcgcggggtctcggagtgaagacctcggacctgatggcggcagggccgcccgagccggtcaagcacgacgacccgaacagccagaacctgcgggacctgcgtatcgcactcactcccgcgctcagcctcggcccggtcagcgccccggcgggcgaggagcccgacctgcgccgcctgcgccgcatgacgtacgacaactcggtcctctacttcagcgacacgtaccagagcatcgccgcggatctgcctacgctcatcagggcggcgaacgatgccgtggcctactacgactccggcgagcagcgcgcgaacgctctggtcgagcgctcgcgggtgctgaacctggtcggtcggtacctgacgcagatcaggcagttcgacctcgctcacgtggcagccaggggcgcgatcgaagacgccaaggcggcaggggacaacctcgtggccgcgtctggcgtcggggggatgtgctggctcctcgtacggaccgagcggttcgacgaggcggaggacatcgcggtcgcgacgatggacatcgtcgagccgaagatcacgggtgccactccggacgagtattcgacgtggggcggcctggcgatggaggccgccgctgcggcagcgcggaacaaccgcccgaaggaggccaaggccctgcgcaaggcggccggcactgccgcgaaggcagtgggccggacgcacaagaacctcctgcgccactggtcgatgttcggtcccgtcacggccgccatgaaagaacttgaggacttcatgatcgcgggtgatgcccggactgtggtccgcaagtccaaggatgagccgacccttcaggcgaagcactgggagcagctcggcggcccgagcaccaacgacggcaaccgctaccgcctcgacctcgcgcgggcctatgtgcggaccggtgacgcgaccctggcgatggaggagttgtcgtatctcgacgagatcgcgcccgagtggttccgtcaccaggcgtccgctgcgatcaccttcgaggaggtcaccaagaagcgccgcaccctgacgacggagatgcgtgaggtgggcgctcacctgggagtattcgcgtaactacactgtctcgatgcacttctgacggatcgtctgtcgaagtgcatcggcttgtgtctggccgcctgctgttgcgcctcgtagcttcatggtcatggacggtcacgacgagcacagcaagccgggcatcggcaacctggccaaggacacggccatggccgagaagaggccggtactggtgatcaccgaagcggatgacgtcaccgcggacatggtgatcaccgaactcaaccggcgagatgtgccggtagttcgcttcaaccccgccgacataggcgagggcctcacggtctcggctcggttaggcacctgcccggcccgcctggctgggtaggtgcgcactccgtcgagatctgcacgtctggacgacgtccgttccgtgtactggcgccgccctcgctggcccgacttcgcgcatctccgtgacgacgatgcacggttcgctgccgcgcaggtgcgccacggccttggcggcatcctgtacgcgctcgacggaccgctgtgggtgaatcacccgctccgcaacgcggcggccgactacaagcctgctcagctcgccgtcgcggagcagctcgggctcatggtcccgccgacgctcgtcaccaacgacccggacgaggcccggagcttcatcgtcgagcacgagaacgtcgtcttcaagacgctgcgctggacgccgtaccagcgcgacggcgtaccggtcaccggctgggccgagccggtcacgccgttcgagatcgaccagagcgtgcgagtcacgccccacctcttccaggcgtgcgtgcccaaggtggccgacgtgcgggtcctcgtggtcggccggcgcctgttcgcggtccggatcgactcccaccttctggactggcgcaggaactactccgccgcccgctacagcgtggtcgacctgcctgaccaggtgagcaaggccctgctcgcctacctggatcactacgagctggtgtccgggagcttcgacctcgccctggatgcgtacggggcctactggtggctggagctgaacccgaacggtcagtgggggtggctcgaagagaacaccggcctggagatgtccgccgccttcgccgacctgctcacagaagggcatgcctcatgaccgactccgccgacgagcgacgtcgcctcgccgaactgctgacccaggacggcgtcctgaaaaccccttggctgcgtgcgtccgtcgaagccgtcccgcgcgatctgttcttgcaccctggcgtcttcctcccggaggacgggggcaagtggcgaccggtcaccgcggtggggtcggacccggacgagtgggtgaagctcgcctacagcaaccggacgttgaccacccagctcgacggccacgtgaccgccgaccaggtcggcgagcccgtgaccggcgtgcccacgtcgtcatcgaccaccccgaccaccgtggtcgacatgatcgagaagctcgacatcgaagacggtcatcaggtgctggagatcggaacgggtaccggatactccacggccctgatgtgccactacctcggcgaggacaacgtcgcgacggtcgaggtcgaccccgaggtggccgagcgcgcagacgccgcgctggaagaggccggcatctcgacatggaccgcgaccggtgacggcctcctcggtcacccgcgcaacgccccgtatgaccgtgtgatcgccacgtgcgccgtccgtcgcatcccctacgcctgggtccgccagaccaagcccggcggcgtcatcctcagcaccgtgggctcctggccctacggcaccggcctcgccaaggtcaccgtggacgaggacggcaacgctcacggcggcatcatcggccagtcctcgttcatgcaggctcgggcgcaggctgtggtgcccgtgtccggcgacctgtccgcccggaccttctacgcggacagtgagcgggaggtgaaggtcgccgtgagcctgctggacgagtggatgccggctttcctcgtccagctcgcagcaccgggggcgcacctggtgcgcgccaccgcgaacggtggtcggccgctgctgtacctgttcgaccccgaccgcgagtcgttcgcggagttcatcgcaggcaacggcacgtggacggtccgtcagggtggccccgtccccctgtgggaccgcgtggaggaagcgctgctcgcgtggcgggcggccgggcggcctggcatcgaaacggtgcagctcaccatcacccaggagtcgcactcctactggatcgacccggatctgcactgggaacaccgcctcgactgactggaagcagcacgcccgtacgacaagaccctcggcctgacgaccgggggtcttgtcgtttgcgatcaaggcgcgctccacgtagcccacttggcgctaaacgagcccccaacggtttggggacttgtccggccgaaaggtccatcggccgtctcgactgatgccaaagggggctccccgcaacctagtacggcggggggctgcgagtacgacctgagttgtgtacgtaccgtggaccagtacgaggacaaggccgttccgcgccttcgaggaacggatgtgggcacgggccggcaggtgggcggagatgacgagagcaggcctggaacgcctggtcagtccggacccgggcgaagcggtcgccctcttcgacgaggtccagccgtcctgaccggccggcacaccaccgctcacgccgacgtcgtccaccgcggccccgtgcccgaccatgccgtctcccaggcggtcaggttgcggcggcacaggaggtgggccgtggtggcgtacgcggtggcggccagggcggcgaccgtgagagcggccaggagggaccagcccatgcacttgctgcggatctggtcgggggtgagcggaggggcggtgatgcggccgtgggcgtccacccagatctctaccgtgctgcccgccggcaggcccggaggtacgtcggcgcgggccacgcgcggccggccgccggggtccgtgtagcggacctcggcggggtagagggtccctctcgcctcgggggagccgggttcggggtggcgggcggagccgtggacgaggacggcggtcgtcttgcggcgggcgctgtcctgccgttcggccgtgtcccggtagtggcggtgggccgtgtccccggcgaggagcatc

SEQ ID NO: 808 - DNA, 10023 bp, Unknown
  Kingdom: Bacteria, Phylum: Actinobacteria, Class: Actinobacteria, Order: Streptomycetales, Family: Streptomycetaceae, Genus: Streptomyces
cgtagagccggtcgacggccgccgtgtggtggcgtacgtcagcccggccgtcgaccggctctacggcgcccggatacgcgcctacctggaccgccatgtacggccggggcagtggagcctgcacgtcctgcccaccggcgagcaccgcaagacgctcgcctccgtggaacacgtgtgtgccgtagccaaggcggacggtctcgaccggcacggggtgatgctcgcggtcggcggcggcatcgtcgcggacgtcgtgggtttcgccgcgtccatctacgcgcgcgggatccgctacatcaaggtcaacaccacgctcgtcggccaggtcgacgtgggggtgggtgtcaagaccggcgtcaacgccctgcacacgaagaacatgttcggcgcctaccaccccgcgcacgcctcgctgaacgatcccgccttcctgaagacgctgccgccgagggagatccgctgcggcctcgcggagatcgtgaagatggccgtgatcctcgacgaggacctcttccggaccctggagcggcacccggacgtgttccgcgggccggccggcgagagcggcgccgaccctgcgcacggcgagctggaggagtacgtcctgcgtacgtcgatgcggctgatgatggaggagctgtgcccgaacctgcgcgagcacgacctcgcccggctcgtcgacttcggccacaccttcagcccggtcgtggagaccgcgggcgggcaccggctcaggcacggtgaggccgtcgccgtcgacatggcgctctccgcacacgtggcgaggctgctgggcctctcggacgaggagacctgcgagcggatcgtccggctgctgcggcgggtcggactgccggtgttcgacacggacacgtgcacgcccgagctgatgacgcaggcgctgcgggcgtcctggcagcggcggggccgcaaactgcacctggtggtgccgaccgggatcggcaaggccggcttcgtggaggagctggaggacgtacccgcggacgtactggtggccgcgctcggcgcgctggctcaggacgcgggcggaccggacggcgtgtcccacctcttgggagaggagcggcacgatggctgaggacgtggtcaatctgcgggagctgctgagcggcaaggagcgtgaccacggcggcgtcggcacgatcctcgcccgccgcctcttcgcacgccgacctggttcgccgggcgcggagttcatcgacctggcggtgctgccgccgggcacgtcgatcggccggcaccggcacggcgccgaccgggagacgtacgtcgtgctcgacggcggcgggctgatgtaccgcgacggcgtcgagttccgcgtgggccccggcgacgtcgtcgtcaacgacccgcacggggagcacggcctgcgcaacgactccgagcgcgaggaactgcggctgctggtgttcgaggtcgtcctgcccgacgggccggagggaggggcggacggtggtcatgacgcgtgacgacgggacgttcaccgtgctcgacgtgggcggcacgacgctgcggatcggctcctacgacccggtgacgggcgtcctgtcccgggtgcgccggatgccggtcgacggcatgcaccgcgaccccggcgcgcccgtgccggtgctccagcggcgcgtggtggaccagatcgtgcgggaggtcggcgcgcacaccggcgggcgcgtcccgcgggcgctcggggtggcgttcgccgggccgatcacggcgggcggcctcgtcctggccgcgccgacggtgtggggcaggcgcggcgatccgctgccgctgggcgacctgctcaccgagcggaccggcgcaccggcggtcgtcgtgaacgacctgacggcggcggcctggcgctacgcggccaccgaaccgggcgacttctgcctgctgaccgtcagttcgggcatcggcaacaaggtgttccgcggcggtgaggtcctcgtcgacgccgacgggcacggcggggagctgggccactgggtgtgcgacgtctccccggccgccccgccgtgcgactgcgggggacgcggccacctgggtgcgatcgcctcggggcggggcgtgctggccgcgacgcggcgggccgccgccgccgacccggccggcttcggccgctcccggctcgccgcgctgtgcggcggccgggccgacggcatcgacaaccgggccacggcccgcgcggtccgcgagggcgacgccttcgccacggaggtgctgcgcggcacgctcacccacctcgcccaggcgatctcggcggtgttcacgtcgatcggggtgtgccgtttcatcctcatgggcggcttcgcactggccgtcggcgagccctaccggcggctgctgaccggcgagttggtgcggctcggctgcttcggtctggacgcggatcaggtcgacgcgatggtggcgctgggcgtggccgacgacgaccacgggctgatcggcgcgggccgtctgctcgcggaccgtacgccggtcccctcatcgcagggggcgccgtgaacgtccccgctccgggcggagggggcgcggcgcgcacgctcgtggtgggcagcggcctgatcggctccgccctcgcccgtcacctggtcgcctccggtgaggcggtgacactcgcctcgcgccgccgtcccgtcccggctccgcagtcgtacggggcgcgctgggaggcgctggacgccaccgacgcgcgggcctgcggccggctcctggcccgtatccgtcccgaccgcgtggtcctggtgcacgggccctccgacgccacctggtgcgaggagcaccccgccgaggcgcgggcggcacacagggcggcggcggagaccttcgccacactggcccgcgacgcgcggatcgtgctgatctccaccgacaacgtcttcgacggcacctcggcgcacaacaccgagagcactcccgtgtgcccggccaacgcctacggccgggccaagctcgcggccgaacaggcgctgctgtcctccggcgcgcccggcgccgtcgcgctgcgcgtcagcctcgtctacggccacgagggcgccgacgcgggcaagtggctcaacttcttcgccgtctgcgcccaccggctgctgcgcggcgagcgcgtcgaggcccccgacgaccactggacgaccccggtggtgctgcccgacgtgacggaggtgacggcggccctgctgcgcagcgcggacccgctgcctccggtgctgcacctgggcggccccgaccgggtcacccgcgccgagtgggccacggtgatcgccggcgtgctgggcgcaccggccggcctggtcgtcccggtgccccgagcccgtacgcgctacgcctcacgcccggcgaacgcctgcctcagcagtgaagtgctgcccatgctcgcggccacggagcagatcaccgtgcggggcgtgacggagggggcgcggctgctggcgcccgcgttcaccggaagcggaacggacacggagacggagacggagacgggtcctgtgcgggcgtagcgcccgtttccgtgcggcctgagcgccgcccgtcgtgcgtcgtgcgtcgtccgtcgtccgtcgtccgtcgtccgtcgtgcgtcgtgcgtcgtgcgtcgtccgtcgtgcgtcgtccgtcgtgcgtcgtccgtcgtgcgtcgtgcgtcgtccgtcgtgcgtccgccccggtaccagtccgtccgcccctcccgccgttcacccggcgacgacctctcgtgggagcacccatggcaagttcatcgatcccctccggctacgacgtcgtcatcctcggcggcggtgtggcgggctgtgtgctggcggcccggctgagcgaggaccccggccgctcggtctgtctcgtggaggcgggcccggactacgggccacggcagcgggactggccggagaaggtgcgcgacgcgcgcgccctgccgcgtgacgacgtgtgggagcggcacaccgcgttctaccgcatccgcgcccgtgtcctgggcggctcctcgtgcatcaacggctgctggaacacgtggggttcgccggccgaccacgcggagtgggtccgtgcgggcggcgagcgctggtcggcaccggcgatggaaccgtaccggcgcagggccgtggaccggatggggctgcgcgcggtcccggaccacgaactgtccgcgtggagcgcgggcgcgctcgacgcggcccgccggctcggttacgcggaggtcgacatgggctcccccgacggcggccccggccgtggcggaccgctgctgaacgccgtggacggcctgcgccgcaacacggccttcgcctacctggacccggcgacgcgggcccggcccaacctgacggtgctcagcggcgccctggtcgaccggctgaccgtgcgcggcggacgcgtgcacggcgtggaggtgtgcatgggcggcgaggacgggcgcgcggacggcgtggacgggcgcggcggcgggctcacgaagcggacgctgacgctcacggcagacacgtacgtactggcggccggtaccttcggctcgcccgccgtgctgctgcgcagcggcatcggcccggccgcgcacctgacggagaacggcatccgctgcgaggcggacctgcccggggtcggcgcgaacctgtccgaccagcccggagtgttcctgccgctgtccccgacggccgcgctgaacgcggcgctggccgcccaggaggcggccggtgagctgtatgtgagccggatgctggtcagggcggcgagcgagcgctgcccggcggggtcgtgggacctgcacctgctgcccacggcgggcccgccgctgttcggcaagctgccgccgggagagtacgaggccggtgtgtccgcgttcctcatgaagccggtctcacgcggccgggtccggctccgctcggccgatcccgccgaaccccccgagatcgacccggcgttcctgaccgaccccgacggacacgacatcgccgtgctccgctccgggctggcgaaggcggcggaactggccaccgcccttgagtacttggccggcccgccactcgccgagggcggtgtcccggtgcgcgaactgcccgacgcggcgctgcgcgaccgggtgggcacctactggcatcccgtggggacctgtgcgatgggtccgcaggacgacccgctcgccgtggtcgacggcgagggccgggtgcacggcgtggccgatctgcggatcgccgacgcctccgtcatgccgacggtgcccgccgcgaacactcagctgccggtgctcgccgccgccgagatgctcgccgactcgctgcgcgcctgacccccgcgccacaagacgccctcctgtcccccactcccacccactcccccacggagaccgccatgacggcatccaacgacaccgacatccgcgcgcaccggctgctgtacggctgcatgggcctgggcggcggctgggacaccctgccgtacaccgccgaggacgtgggccgggccgaggcggctgtcgaagcggccctggccgccgggatcacggcgttcgaccacgccgacatctaccggttcggcaagtcggaggccgtcttcggcgaggtgctcgcccgctccccggggctgcgcgagcgcatcaccgtgcagacgaagtgcggcatccggctgccccagggtgaccgtgtgggccactacgacctgcgcgcggcgagcatcgtgcgccgggtggaggagagcctggtgcggctgcgtacggacgtggtggacgtgctgctgctgcaccggcccgacccgctcgcggaccgcgacgagatcgccgcggccttcgcctcgctgcgctcccagggcctggtacggcagttcggcgtgtccaacatgagcgggccgcagatcgccttcctccaggcccgtctggacgtcccgctggtcgtcgaccaggtggagatgagtctcgcccaccgtgactgggtggaggccggggtgctgttcaacaccccggccgccgccggtaccggctggccgccgggcacggtcgagcactgcgcggcggccggcatccggctccaggcgtggggcgcgctggcccggggccggttcaccggcggcgacgacaccccggccggccggctcgtcgccgatctcgcccggcgcaaggggacgacaccgcagtccgtcctgctgtggtggctgcaacgccacccggcgggcatcgccccggtcgtcggcaccacacgtcccgagcgcatccgcgcctgcgccgacgcggtgagcggtgagacccggctctcccacgaggagtggtacgagctgtgggtcgccgcccggggcacgcctctgccgtgacccgggcgggggttgcttgcgcgatgccccggacgggggcgtggctcagccgcgatgccccggggcgggggcgtggctcagccgcgatgcccttcccgctccaccggaagccacagttcggcgtcggtctccgtcccgccctcctgcggacgggtgcgcaggatctcggggccggggcggctgcggtacgggttggacgggaaccactgggtgaacacgtcccgccacagttcctggatggcccggggcgccgggccggtggtggcgaacaccgcccaggtaccggccgggaccggcagggaggtcatgccgtcgggcacggcggcggaggtgatcgcgccctggtagtagtcgaactcggtgccctcggcgcgtgacgggtcgatgccgtcgcagacggcgaccacgccccgcggctcctggtccgagagcttctccaggcgctccagggccggccggccgagtccgcggatgaagtcgatcatcggctggttcggcccctggtgcaccaggggcagccgggccttgtacccgacgacggcgaactccggccggtccactacgcgatatcgcatgctgctgcttccttcgacggtgagacggaaggacagccggggctgggagacgagcgcggtgccggtgcggcgcgcctcgccgggtccgacgccgtgcatcgcgcggaacgcccgtgcgaacgcctcgcccgagccgtagccgtggcgcaccgcgatgtccagcagcgagtcgcgtccggcgagcacctcggcgcccgcgacggtgagccgtctgcgccgtacgtactccgacagcggcatgcccgcgagtgaggagaacatccggcgcaggtggtactccgaggtggccgcgatccgcgccagggtgggcacgtcgacggactccgacaggtggtcctcgatgtgctccatggcctggttgagccgctccagcactcccggtccccttccttcctttcctgtgcccaccacgctaggcagcgggcggggtgcccgacccgactttccgtgcccgaagaagtcgggtgccccggcgaccggcccgcgcccggatcagggcaggtcaccgcgccagtcgaagcggtcggggtcggcggggcggggcgcgtacacgctgcggccgccgggaccgtacctgcctatctccgtcggcaggacgacactgtccgcgcgggtgtgcgcgggcaggtcggtgacgtccagcagcagcccgtcgagcggcccggccaccagttgcgcgtagcggcgcccgggccggggcgcggcgtcctcgtggtcggccccgtagacccggccccgcatgaagtcctgctcgtccatacgggacagggtcgcagccgccactgacatcggcgcggggcctgcctcgcacccgccctccggccgccgtccgcgcatcgcggccgcggtagttagggtgtcccaggcggttggcaaagaaatggtcaagccgcagggaccagtgagggagacgagcgtgggaaccgcacgcatgagcaacacaccgctgccgggcatcggcatgcgctacgacctgacgacccgtgagcggcgccgcctgtcggtggtggcccaccgggacggtacgcggacgctcagcgcgtaccaggaggacgacgccgacgcctgcgcgctgtcggtgcggctgaccccgggcgaggcggagagcctcatcgacgcgctgatgccggcgcaccacagtccgaacctgctgtcgacgaccgaactggggctggtggccgagcggatcacactgtccgccacctcgtactggaacggcagggtgctgggcgacacgcagatgcgcacccggaccggcgtgtccatcgtggccgtgctgcgccgggccgaggcggtgccctcgcccggccccgacttccggctcgccggcggtgacgtgctgatcgtcatcggcaccctcgaaggggtggaggcagccgccggaatactcgggcgggagtgagcgcatgcactccgctgtcttcctcatcgagttcggcgcgatcctcctcggactcgggctgctcggccggttcgcgggccggctgcgcttctcgcccatcccgctgtacctgctggccgggctggccttcggggagggcgggctgctgccgctcggggccagtgaggagttcgtggcgatcggcgccgagatcggcgtcatcctgctgctgctcatgctcggcctggagtacacggccagcgacctggtctccaacctgaagacgcagtacccggccggtctggtcgacgccacgctcaacgcgctgcccggcgccctcatggcgctgctgctgggctggggcccggtcgcggccgtcgtgctcgccggtgtcacctgggtcagctcgtcgggagtcatcgccaaggtcctcggcgacctcggccggctcggcaaccgcgagacacccgtggtgctgagcatcctcgtcctcgaggacctgtccatggccgtctacctgccgatcgtgacggccctgctcgccgggagcggcctggcggcgggcagtgtcaccctggccatcgccctcggtgtggccggtctggtgctgctgctcgcggtgcgcttcggccggcacatctcgcgtttcgtctccagtgacgaccccgagaagctgctgctggtcgtgctgggcctgaccctgctggtcgccggtgtcgcccagcagctccaggtgtccgcggcggtgggtgcgttcctggtcggcatcgcgctgtcgggtgaggtcgccgagggcgcgcaccatctgctctcgcccctgcgtgacctgttcgccgcggtgttcttcgtcttcttcggcctgcacaccaaccccgccgacatcccgcccgtcctcctgccggccctcgcgctcgcggccgtcaccacggtgacgaagatcgccactggttactgggctgccaagcgcgccggtatctcggcgaagggccggtggcgggcgggcggcacgctggtcgcgcgcggtgagttctccatcgtcatcgccgggctcgcggtcaccgcggggacagaggcctcactcggtccgctggccaccgcgtatgtgctgatcctggtcatcattggtccgctgacggcccgttggaccgagccgctggcgctgcgcctgaccgcgcgacgcacgaagcgatccgctgaacccacatgtcaggacaccggtaaggcgcccgtcccggctccgcgcggtgcggtggaacaccatcatgacaccgccgatccgtcctgagccggggttggccgcaggcatgtgcgcccactgacggggaacgcccgggaacggtcgagagccgtcgagacatctccgccccggtgggtcgttcgtcaactgtgaaaggccactcattgcaccatccactacgctgcaaccagccacatggcccataatccacaattcgacgtcaagtggcgtcccagccaaccggggcaacacgagaagaggccaacaccatgcccgaacccaccgcttcacgcgatctggcatcgcagtacaccgctcaggtgaccggggacctggagcagaacctcaaggagcaggaccgcgtcagcgccgagatcgcctcgctgcaggaccagttgaccgtcctgaggcgtgaccacgacgtgctggtgaacatgcagcaggcactcggcctgaacgccgccgcggtggcggcgcagtccgcaccggcaccggccgcggcgccgagcgcgggcaccggcacggtgccggtg

SEQ ID NO: 809 - DNA, 7274 bp, Unknown
  Kingdom: Bacteria, Phylum: Actinobacteria, Class: Actinobacteria, Order: Streptomycetales, Family: Streptomycetaceae, Genus: Streptomyces
gggcggaccggccgtcgccccacggacggccaccccgccgagcgcccggcggcccgcatcagacggcgccgccgggcctcgtccagctccggtgtgagcagcgcccgctgccgcgcctcgcgcagcaggaggcggggcaccgcgccagggcggagccagccgcgccgggtcagtcgccccggcgcaggtccagcatgcagaagaccttgtcgtagcggtgttcgccgacggcgacgaaagcgggcagacgcccgtactcggtgaagcccagcgaccggtagaggcgcagggcgtgggtgttgtcgccgcgggcgtccagggtgaggacctcgatgcccgcccggcgggcgtcggcgatcagggcggcggtcagcgcccggcccgcaccgtggccctgggcggcggtgtcgacggcgatcttctccagatcggcgtgcggccggtgcgtcggccgggagtagcgcagccagtaccccagcccgacgagccgccggtccaggtacgcggcacgcagggccgcgtcaccggcccgcgccgcggacaggacgtgccggacaagttcactcacctcgtcccgtgagggcggtgcgacccagcccagtgcggcaccgccgtccaccaggtccgcgaggatccggtgggccgactccgcgaaccggcccgccagttccgggtcggacgtcagtccggtggcgtcgacgatgacgggctgagggctcactccgctggtcaggggctgctgcatgaccgacagcctagtcaccccgatcacaggccccgtggcggtgggactctctcgccggacggtccgtcactctacgggggcgtacgggcgcattcgccggtcatgcccctcggcgaacgcctactgtacggacgtaccgcgttgaccgccgcggtcgcacgaggaggcatcccatgtcatcgccgtcgccctgtgatccccagcatgctcccgtcggcgatgtcggcgcggtgctgatgatgatcgactcccacctcagagccgttcacggcggcaggaccgtgcccgggccggaacagaaggcgctgaccgaccagttcgtcgcctcgctgggccccgaaggcatggacgacgtgctggacggcgcgtgcacgctcatcttcatgttcatgaagtggctgtgcagggcctacgaggaccacggcaaggacgtgctggagtacgtggtgccgaacctcgtggccacgatgcgcatgatgcccaagagcttcccgcccgaggtcatccccaccatggccggtctgctcgtcgccgcgggcaccgacctgagccccggcctgtggcgcaagcagtacgggtactggaccgaggcggagatgactccgctggaaggcaccgccttcctgctcgcggagcacatcaaccgcctcaccgaggaccgggacttcgccacccgcctgatcaccgacgcgctgacccgggtggacgagggctgacgacccgggcgccaccggtcggcgtgtcaccggcggacgtgtcaaccggtcggcgcgtcaccaggaggtgtcgtagaggacgtcgtactcgtccttgcgcccgtccctgggggccggtccgcgcatggacgcggccggcctgggggtcttgaccggttcggagccgccgacggccaggaccgtggagacggcgagcccgcccagcaggaacgacaccggcatcctcggccgcagtccgccgatttcgcggtcctggacgccggcgccggacacgcgccggtacacgaggcggacgacgaggctgagcagttgccacacggcgagcaccgcgccggccaggggcagcagcaggaacacgatctgcagggccgcggaggccgtccgcaggagggaactgtcgtcggcggtggcgctgccggcgagggactcggcggtgtgccaggcggtggccgccaggtcgggcatccgggtcaggacgagaccgagctggaacgccagcgcgggcaggaccatgagcacccagcccgtgacgaccagttggggccagcgcttgagggcgtcgaggcgtgcgtccgccgggcggcgcaggacggcccgcttcaggatgggaccgatgtacttgaacaggtcggggatgccgaccaggtccgcgatgatgtagtagccgtcgaaccgcagcgtgggcagcaactgctgcacgatctccatgttcgtggccagcacggcgaccaggaggacgggcgagccggtccgcaggtgcagcagcaccaggccgatgacgaacagggcgttgaagtagacaccgcccaggtcggtgcggatccgcccgctgcggcccagccggtaggagttggtgacgtcggtgtagaaggcgggccacaccaggtagatgccgcatcccatgtggccgggggccacaccgccgtaccggcaggccgccgcgtgtccggtctcgtggaaggcggaggaggccagcgtcagcagcgccacgaccagcacgctcgtcgggtcggccatgacctgcgccatcgcgagccccggactgcgcgtcgagaacacccagatctcaccgatgaggaagagcgtgaggctcacgatcagtgcgaccgggtggaacagccaggagaacagcccgctgatgaaccaggtggcccgttcggacaggacggtggcccggaagcgcaggcccaggaaggggttggccttcggcacgtcggggagcgaaccgtcgctgtggctggtgatgccgagcggggcgagtttctggtcgagcaggaagacgacatgctcggccgcgaagtcccggccggtccgacggctgaggtcctcggccgtacgggacagcacgtcccggacatcctggccgtcgacatcctggccgtccgcggtttcgggtgtgccgggtccggattccctcccggccgcctccgactgctccttcagtgccagtacggcctggtagaggagcggcgggagctgaatgacctggccgtcgaagcggtggacgagctggggaggcgtacggtatccggagccttcgaattcaccgaccggctcggtaccctcggtgagccggggcaccgccggcgccgccgtcagggaacggtcggagcccggcgtggaatgtcgcgtgcacatggggttcttccaggatcggggagccggccgcgctgaaagccagagggcgagcgaagcctctttgccggtccaacgaccgggattcccctcgggcacgcaccgcccgtacgcgtgccgcccgaacgtgtaggtgtgtcgaccgtgcgtgtgtcgaccgtatgtgtgtcggtcgtgcgtgcgccgtccgtacgggtgccgccggggcgggtgccgtccgtacgggtgccgccagggcggtggatgctcagtgcgagacgacggtcgcgggcatgcacgtcatgctgctgctgggattgttggaacccaggccgagcgtgccgagcagtccgggggtgccctgggagtcggtggcctggcaggcgtaggccacggtggtgccgccgcccgactcgccgccgcctccgtttccctggccggggaagccgtacgaacggctgttgtccacgtgaacgtcgatgatggacagcagcacccgctccggcagcagctcaccggcaagttcgccgagttcgccgtaactgaccgcggacatgggtttcctctctgcacgcggagaagcgcgtgccctgaactcaggtgcgaaggcctgaagcggccttgggcgccggggagccggccgcagcgggctccccggcgccgaagacggctgttaggagatcgcggttcccgccggcgtgcaggtgacggcgttgaccgggttgttcgaaccgaggcccagcgcgccgatgaggcccggggtgccctggttgaacgtgctctggcaggcggagctggtcaccacgctgtggtggtcctgaccgcccagagcgagggccgagctgctggagctggcaccaccgtcgccgtgaccgccgcccatgttgttgaacgggatgacggtggacagcacggagcgctcgggaagcacctcgcccgacaggttgccgagctcctccaggctgacagcagacatgaaaatttcctctcggatggtttcacaaggcagctcttcctgccccgcagggaaatgtttagcagaaaggagagggatatcccaatccatatccaggccgctccgaggagttgcttcagggaatagaaaagatgagtgtattaatcttttcgaaatcgcattttcgagtccgggaaagtgtgctggtgggggcgcgggcgtcggcgtttcgggtggtggtgcagacatcagtacgtgcggcggtgcaggcatcagtacgtggcggtgcggacaccagtgcgtgcggcgcaggcatcaagacctgcggacgcgcggacagcagtgcaggcggagaggccgtcacggacctcgccgcctgctggtcagcacaccgccgaagggcggttccggatcagaagatcaccgtcgtcccgggtacgcaggtcaggctgctggagtggtgaccgctgatggcctggcatgccgagctgaccacggcgccgtgcgcgccgccgcctccgccgcccaccacggccacggagctgctcgagctgctggagctggagccgtggccgtggccgcccatggcaccgaaggggttgaccgtggacagcacggcccgctccgggagcagttcaccgttcaggccgtcgagttcgtcgaagctgatggcagacatgagtcttccctttcgcgtcttatccgcgtcttgcacgggcagcgggtgatgcccgcaaggtcagacgtatcaaggaaaacgaatactggtcacattattgagccgaatggatgcgtgtacccgttcgtggcgtcggcgatgcgcgcccggaagagtggaaggcggcagggcggagtcggggtttcgaaagcagacgtcatgaatgagtggttcagagtcgtctgcaggcggcctgcttgagcagccagctctgggccgcgtccagtgcggcgtcctggtggcgggccgccggtcgggggtccttgacgacctcctcgtccggcgggatcggcgcgtcgtaggcacggcctgtgcggtccgcgtccttgacgccggtgatgaagagcgtggctccgtcggacaggcggtaggaggcgtttcccgtggggacgccgagggtgggctcgccgaaggagcgggtgtccggacgtccgcggaaggccaccgcgaccgcctcgcccgcgctggacgtccgccggccggtcaggacggcgaccggtggcctgctggtggcgagggtccggccgccggtgctccagccctgcgacctgccgtccaggtacggggcaccgcccttgatcgaccacacggacttcttgccgtccgcgtcgacgaacatgcccgccgtgccgtcgcccaggatcggccccgccacggcgagcacgggccacatgccgccgcccgtctccggcctcaggtccaccacccagccgcaggctcccgcgccgtccgccttcgccacggcggcccggccctgccgtacgtactggtcgtacgtcttctgggaaccgtccacgccgggaagggcgacgtacccgatgccgttcttcagggaacgggcctgcggcgggtcgtaggaaggcgccgaggagtccatggtctccctgctctgctccgggctccagaaggtgctgtgccggtcgcccagagagcccagcgccgactcgatcgcccggtaggtgtccgccggcttccgcgcaccgcgcgcctgcgcgaacgccttgctccgcaggtccggccagtcgacctggcggcggcggagcgagtgctcctgcatgatgctcagcgccttcgacaggtacgtccgcgccgcgggcgccatgtcgccgccggacgagtcctgcgcgccgccggtaccgctcgtaccgctcgtgcatgccgtggccgcgacgacgaccccggccagcgcggcaccggcacgggccgctccgcgcactgaacgtccccgcttcatggttccgatccccccagctcccccagcggaagcaaccctaccgccgcaaggtcggatcatcggacttgcttgcctaaaagtattaggcaattgcataatgcctctcggacagcacatctcgatcaagaggctgggaccatgaccaccaccggacacgactggatcaccacaccggtcaccgcggacctcctgcgcggtttcctcgacctggaaccgaccgcgcacggcctgctgccccaccggctgcccgcccgcgcgcgccggcagatcccggacgaccagctggccgtggccgaggcccagccttccggcgtgcgcctggccttccgcaccagggccaccaccgtcgaactcgacaccctgcccaccaagcgggtctaccggggctttcccgccccgcccgacggcgtgtacgacctgctggtcgacggcgccctcgccgcccaggcctcggtgagcggcggcaacgtccgcacgatcaccgacatgttcacccaggccgccgaactgagcgagggaccggccggcaccgcccgcttcaccggtctgccgacgcgtgacaaggacgtcgagatctggcttccgcacgccgagatcaccgagctgatcgccctgcgcaccgacgctccagtggagcccgcgccggacagcgggcgcagggtgtggctgcaccacggcagttccatcagccacggctcgaacgccgcccacccgacggccatctggcccgcgctggccgcggcccgcggcggagtggaactggtcaacctcggcttcagcgggagcgcgctgctcgacccgttcaccgcccgggcgatgcgggacgcgcccgcagacctgatcagcatcaagatcggcatcaatgtcgtcaacgccgacctgatgcgcctgcgtgccttcggcccggcggtccacggcttcctcgacaccgtgcgcgacgggcatccgaccactccgctgctggtcgtctcgcccatcctgtgcccggtgcaggaggacacccccgggcccctcgcacccgacttcgccgcatgcaccctgcggttcaaggccacgggcgatcccgccgagcgcgccgccggacgactgacgctcaacgtcatccgcgacgaactcgcccgcatcgtccgggcgcgcgccgccgacgacccgtacctgcactacctcgacggccgcgacctctacggcgagcaggactacgccgagttccccctgcccgacgagatccaccccgacccggcggggcaccggcgcatcggcgagaacttcgcgcggcacgtgttcggcgacgg

SEQ ID NO: 810 - DNA, 2126 bp, Unknown
  Kingdom: Bacteria, Phylum: Actinobacteria, Class: Actinobacteria, Order: Streptomycetales, Family: Streptomycetaceae, Genus: Streptomyces
gagtggccgcccagccgctcgaacagcgacccacgggaagctgtgcgagcggctgggcggccactcggccgtcgtcgttccgttgaacgcccgccgcaaccgctacgggatgctgaccgtgggccgcgccgtgggctcgcccgtccccacggccgcggaggtgcggctgctctccgacatcggccgccggctggggctggtgctggacaacgcccggctctaccaggagcagcgcaacgtctccgagaccatgcagcgccagttgctctccccgctcccgcaggtgaaccacctgcgcatggccgcgcgctatctgcccgcgcagagcgccatggagatcggcggcgactggtacgacgccttcccgctctccgacggggtgatggccctggtgatcggcgacgtggtcggtcacgacctgcaggccgcggcgcacatggccgaggtccgcaacatgctgcgcgcgctggcgtgggaccacggcaagccgcccagtctgatcatgtgccggctggacgaggcggtcacgaacaccagcgacgcgccgatggccacgctcgtcttcgcccggatcgagggccccgagggcggcccgtggcggctgaactgggtcaatgccggacatccgccgccgctgctggtgacccgggacggcgagacgcggttcctgaccggcgggcacggtccgctgatcgggatgagcgcggtgctgcacctggggctgaactggccggacgcgtacgaggacctgccgccggagtcgacgctcctgctctacacggacggcctggtggagagccgggaccggcccatcgacctgggcatggccaaactccgccaccatgcctccgtgctggcccggcggctggccagggacacggtggacaccttctgcgacgagctgctggagcgcatcaggcccagcggcgacgacgccgccctgctcgcgctgcgcctgcccccgagcggtgcgggcactccggccgaccgggagccgccgccgccctcgcagtcgccgtacggcagcccggcggcgccgagccggtcggcgccgggctcggtccaggaggacgctccggtgtcggacccgacccgggtggcaccggaggaggggtgaggcggggcaggggcggtgccggaaggcggacggtcctcggcaggggcccgccgctgcccagcgggtcgtggctcagcccgcgacggagatctccggctctccggaggccacgccgtcggcctccatctgctcggcgagcttcatcgcctcttcgatcagggtctccacgatcttcgactcgggcaccgtcttgatgacctcgcccttgacgaagatctgccccttgccattgcccgaggccacacccaggtcggcctcacgcgcctcaccgggaccgttgaccacacagcccatcacggcgacccgcagcggcacctccatgcccgtcagacccgccgtgacctcctcggccagcttgtacacgtcgacctgggcgcgcccgcacgacggacacgagacgatctccagaccccgctgacgcagccccagcgactggaggatctgaaggccgaccttgacctcctccaccggcggcgccgacagcgacacccggatggtgtccccgatcccctgcgacagcagcgcaccgaaggccaccgccgacttgatcgtgccctggaacgccggtcccgcctccgtcacccccaggtgcaacgggtactcgcactgctccgccagctgccggtacgcctcgatcatcacgaccgggtcgttgtgcttcaccgagatcttgatgtcccggaaaccgtgctcctcgaacagcgacgcctcccacagcgccgactccaccagcgcctcaggcgtcgccttcccgtacttctgcagcagcctgcggtccagcgaccccgcgttcacaccgatccggatcggcgtgccgtggtccttcgccgccttcgcgatctcccggacctggtcgtcgaacttcttgatgttccccgggttcacccgcaccgccgcacagcccgcctcgatcgcggcgaacacgtacttcggctggaagtggatgtccgcgatcaccgggatctgcgacttcctcgcgatcgtggcgagcgcgtccgcgtcgtcctgc

SEQ ID NO: 811 - DNA, 5645 bp, Unknown
  Kingdom: Bacteria, Phylum: Actinobacteria, Class: Actinobacteria, Order: Streptomycetales, Family: Streptomycetaceae, Genus: Streptomyces
cgggccgccacgggcgcgggtcccgcgaagttgccgcgcagcgcgccggtgacgcccacgaagaccatcagcaggccggccagcgagccgagcccgatcagccccgcgcttcccgtgaagccgagcgagaaggggacgacagcggcgatgacccgcgtgtgatcgagggcgagcttggtggtgatgtgcagcaggaggaacacgatcgaggcgaccgctgtggtccggtgcaccgcctggcccacgatccgctggcgcgtgtcgaggaagatccggtcctgtgcgaccagcccccagatcaccgagcagctgagggagaccagcgagaacacgcccgcgccgaagttcaggaactcgcggaactgactgccaccggtcagcacggccacgggtatgacgagcaggacgagggcggacgccgctccgtaggccgagcggcccggcctggggagcgagctggtactgcggcggggaatcggatgacggggcatgggagactccgagcggttcgggtgagcggtcccgggcacgcactctaagccgctccaaaccgggcggtacgggctttgagttattgtcttgttatcaaaggggttcgcggggcgtccattgtcctcatagcagccgttacgccgggtaaccacagggctgtcgcggggcgctcgacgcctgcggtaccctgacgccatgcgtgccgtacgccttctgcttagcgagccgcgctgatcagtcccgaccgccgggcgaatcggttggtcggaatcggcgcggcgtcccctcctgtgcgaggggatttttcatttccggaaagtcgcagccgcgggcagagacgatcgatggagctttgaggatcatgagcgagacgaaccccgccgccaccgccgccacgtcggcggaggctgcgccgcaccgctacacggccgcggtggcggccgacatcgaggcacgctggcaggacttctgggacgccgacgggacgtacgccgcgccgaaccccaagggtgacctggccggcgaccctgagctggtcgcccgccccaagaagttcatcatggacatgttcccgtacccctccggtgcgggcctgcacgtaggccacccgctgggctacatcgccaccgacgtgtacgcccgcttccagcggatgaccggccacaacgtgctgcacaccctcggcttcgacgccttcggcctgcccgccgagcagtacgccgtgcagaccggcacgcacccgcgcgtgtccaccgagggcaacatcgagaacatgaaggcccagctgcgccggctgggcctgggccacgacaagcgccggtcgttcgcgacgatcgacccggagtactacaagtggacccagtggatcttcctgcagatcttcaactcctggtacgacgacgaggcgaagcaggcccgcccgatcaccgagctgatcgcacggttcgagtccggtgagcggcccgtaccggggcacacgcgcgcgtggggcgagctgaccgccgccgagcgcgccgacgtcctgggcgagttccgcctggcctacgcctccgacgcgcccgtcaactggtgccccggcctgggcaccgtgctggccaacgaggaggtcaccgccgagggccgctccgagcgcggcaacttcccggtcttcaaggccaagctgcgccagtggaacatgcgcatcaccgcctacgccgaccggctgctggaggacctggaggagctggactggcccgaggccatcaagctgcagcagcgcaactggatcggccgctccgagggtgcccgcgtcgacttcccgatcgacggcgagcggatcaccgtcttcaccacccgcccggacaccctgttcggcgcgacctacatggtgctggcgcccgagcacccgctggtcgagaagttcaccccggccgcctggcccgagggcacccacgaggtgtggaccggcggccacgccacccccgccgaggccgtcgccgcctaccgcgcgcaggccgcgtcgaagtccgacgtcgaacgccaggccgaggccaaggacaagacgggcgtcttcatcggcgcgttcgcgaccaacccggtcaacggcgagcgggtccccgtcttcatcgccgactacgtcctgatgggctacggcaccggcgcgatcatggccgtcccggcgggcgaccagcgcgacttcgagttcgcgcgcgccttcgagctgccgatccactgcgtcgtcgagcccaccgacggccgcggcacggacacctccacgtgggaggacgccttcgggtcctacgacgcgaagatcatcaactcctccaacgacgagatctccctggacggcctgggcgtcgtcgacgccaaggcgcgcatcaccgaatggctggagcggtccggcaccggcgagggcacggtcaacttccgcctgcgcgactggctgttcagccgccagcgctactggggcgagcccttcccgatcgtctacgacgaggacggcatcgcccacccgctgcccgagtcgatgctgccgctggagctgcccgaggtcgaggactactcgccgcgcaccttcgaccccgacgacgccgacacccagcccgagacgcccctgtcgcgcaacgaggactgggtcaacgtcaccctggacctgggcgacggcccgaagaagtaccgccgcgagaccaacaccatgcccaactgggccggttcctgctggtacgagttccgctacctggacccgcacaacgagcagcggctggtcgacccggagatcgagcagtactggatgggcccgcgcgagggcatcccgcacggcggcgtcgacctgtacgtcggcggcgccgagcacgccgtgctgcacctgctgtacgcgcgcttctggtccaaggtcctgtacgacctgggacacgtctcctccgccgagccgttccacaagctgttcaaccagggcatgatccaggccttcgtctaccgcgacagccgtggcatcgcggtgcccgccgccgaggtggaggagcgcgacggcgcctactactaccagggcgagaaggtctcccggctgctcggcaagatgggcaagtccctgaagaacgccgtcaccccggacgagatctgcgccgagtacggtgccgacacgctgcgcctgtacgagatggccatgggcccgctggacgtctcccggccgtgggacacgcgcgcggtggtcggccagttccggctgctgcagcggctgtggcgcaacatcgtcgacgagaccaccggcgaggtcaccgtgaccgacgccgagcccgacgagcagacgctgcgcgccctgcacaaggcgatcgacggggtgcgccaggacctggaggggctgcggttcaacaccgccatcgccaaggtcaccgagctgaacaaccacctgaccaaggcgggcggcccggtggcgcgcgcggtcgccgaaccgctggtgctgatggtggccccgctggccccgcacatcgccgaggaactgtggcacaagctgggccacacggactccgtcgtccaccgcgacttcccggtcgccgacccggcgtacgccgtcgacgaggcggtgacctgcgtcgtccagatcaagggcaaggtcaaggcgcgcctggaggtctccccgtccatctccgaggaggagctggagaaggtcgcgctggccgacgagaaggtcgtcgcggcactggacggcgcgggtgtccgcaaggtgatcgtgcgcgcgccgaagctggtgaacatcgtgcccgcgtgaaccgtgggcatcgcgtccgcgtgtccgcgtgaacagtgtgtccgcgtgacgtgaggcgcacgcctcggggtagtcccctacgggcaggttcggggttctgacggaacccgggacctgcccggtgcgtttaccgtggaagagcggcgcggcctgcgccgccgagccgaggaggagcgtcgtggaagcagtcgtcgcggtcttcgccgtgctcttcgtgctctgcctggtcctcggcgcgtacgccacggtcaaggccgtcggtgccgccaagcgcggagtggaccgcacgatcagccaggcccgccgtgccgtggaggaccagtccctgcgggcgaagtccttcgcccagccgggccctgcgggggaactggcccagctccggctcacgctgcgcacctctatgcgcgccacccaggacgccctgtacgcgggcgtggccgaggacgagtcactcaaggaatccgtcgccctgttccagcgcctcagcgttcacggacaggagttggaccgggaactcaagcggctggagagtgagccggaccgggcgacgctcgccgagcggctgccgcacctgaccgagcggacccggcgcatcacagagtcggccgacgccctgcgctgggcggcccgcgaccgcgcccgccgcttcgccgacgacgacctggacaccctgagcgcacagatcggcgtggaggccgacgccctgcgccactggaccagcgcggacccggcccccggcgccaccgcgtggggcgacccctcgacggagcaggcccccggcggcgcggaccggcggacgccggcggactcccggccggagccggacgccgcccaggaccggtcccgggccgccatcaccccaccaggacgccgcccggtgtactcctggcagaagaagccccgccccgagagcaccacctgatccggccacgcgcacacccggtcagaggggctgggctgccgccccggcgctacggcaggtaacctccagctcatgtcccgccatgtcgcgatcgtcaccgattcaacggcctacctgccgccgcggacgatggagcgccacggcatcaccacggtcccgctgaccgtggtcctcggtgaccaggcactcgaagagggcaccgagatctcgacccgctccctggcccaggccctgcagaagcggcggtccgtcaccacctcgcgtcccagccccgcactgttcgccgagacctaccgcaaggtcgccgagtccggcgcgagcgacatcgtctccctgcacctgtccgcggagctgtcgggcacctacgacgccgccgtgctcgcggcgcgcgaggcaccggtgccggtccgggtcgtggacaccgggacggtcgcgatggcactcggcttctgcgccctggccgccgccgagaccgccggcagcggaggaacggtggacgacgcggtcacggccgccgagaagcgagccgccggcacctcggcctacttctacgtcgacaccctcgactatctgcgccgcggcggtcgcatcggcaccgcacaggccctgctcggctccgccctcgccgtgaagcccctgctccagctccaggacggccgtatcgaactgctggagaaggtacggacggcgtccaaggcgatcgcccgcctggaggagatcgcggccgagcacgcgggcggcgccgacgtcgacctcgcagtccaccatctcgccgcccccgaccgtgccgcggccctcgccgaccggctgcgtgcccgtgtgccaggccttgccgacttgcacgtcagcgaagtcggcgcggtcatcggcgcgcacaccggaccgggactgctgggggtcgtggtctctcctcgctgaggtgcgggcggacacgacgtggacggtgagacgcggccggatccctcctgtgggtgacggagttgtcca

SEQ ID NO: 812 - DNA, 5584 bp, Unknown
  Kingdom: Bacteria, Phylum: Actinobacteria, Class: Actinobacteria, Order: Streptomycetales, Family: Streptomycetaceae, Genus: Streptomyces
gtgaccggggccccgtccgcctgatgtgctccggcggacggggccccggtcacgtacgggaggggtcacacggtggcgagaccctggcggtgtgcgcggacgatctccgcgtagcgccgtccgctcgtcttgacggtgcgcttctgggtctcgtagtcgacgtggacgagaccgaagcgcttgtcgtagccgtaggcccactcgaagttgtcgagcagcgaccaggcgtagtagccggcgagcggggcgcccttgcgcacggcgcgggcgcaagcagccaggtgctgctccaggtagcgggtccggcccgggtcgtcgacgctgccgtcgggggcgacggtgtcggggaaagccgagccgttctcggtgacgtacaggcggcggacgccgtagtcgtcggtgagccgcatgagcaggctctccaggccgtcggcgtcgatctgccagtccatgccggtgcgcgggacgtcgggcagccggatctcacgggcgtacggggccggcccggcggggtcgtcggtgaccgtggccgggaagtagtagttgagtccgtgccagtcgagcggcgtggcgatggccgccaagtcgcccgactgctcagggagttcgactccgtacagctcccgcatgtcggccgggaagccgcggccgtacaccgggtccagccaccagcggttggtgtggccgtccatgcgcgccgccgcggcgacgtcctcggggcgtgtcgaggcggcggcgaccgtcgaatggttggtgaccaggccgacctgtgcgccggggacggcggcccggatggcctgcgtggccagaccgtgggcgaggagcaggtggtaggaggcgcggacggccgcggtcaggtcggtgaggccgggggccatccggccttcgaggtggccgatccaggcggagcacagcggctcgttcagggtggcccagtgggtgacccggtcgcccaggcgctcggcgaggaccgcggcgtagcgggcgaggtgttcggcggtggtgcgctcggtccagccgccgcggtcctggagagcctggggaaggtcccagtggtagacggtgatgtggggagtgaggccggcttcgagcaggccgtccaccagccggtcgtagaaggcgaggcccttggcgttgacggggccgtcgccgtccgggaccacccggggccaggcgacggacagccggtaggcgttcgtgcccagttgccgcatcagcgagacgtctccgggccagcggtggtagtggtcgcaggcggtgtcgccgtggtcgccgttgtcggtcttgccgggtgtgtgcgagaaggtgtcccagatggacggcgcgcggccgtcctcggcgacggcgccctcgacctggtaggcggacgtggcggtgccccagaggaagtcgcgggggaaggcggcgaggtcgatcgagtcggacacggagaacctttcggagaaaacgggggcgctacttgaccgcgccggcggtgaggccggtgacgaggtagcgctggaggagcaggaaaccggcgacgacggggacgctgacgacgagcgaggcggccatgatctggttccagtagacgtcgttgagcgtggagtagccctgcaggcccacggcgagggtgcgggtggcgtcgtcggtcatgacggacgcgaacagcacctcgccccaggcggtcatgaaggcgtagacggcgacggcgacgatgcccgggatcgccgccggtacgacgacgcggaacagggcgcgcagtggtccgcagccgtcgaccagggccgcctcgtccaggtcgcgcggcaccgagtcgaagtagccgatgagcatccagatggcgaagggcagggtgaaggtgaggtacgtgaggatgaggccgccgcgggagccgaacagggcgatgccggtggcgttgccgatattgacgtagagcaggaacagcgggaggaggaagaggatgcccgggaacatctgggtggacaggacggtgaccgtgaagacacgtctgccgcggaaggagtagcggctgaccgcgtaggcggcgaagacggcgatcaccaccgagcccgcggtcgccgctccggccacgatcagcgagttcaggaagtacttcgcgagcgggatcgtcgaccagatgtcgatgtacgggcggacggtgagtccgctgggcagccagcggaacttgcccgagacgtcctgcagcggcttgagcgagctggacaccatcacgtacaccggcaccaggacgaagccggtgagcagggtgaggaagatccgccgggaccacaggaacgaacgtggcggcgccatcggcggacgggacggcaggggtgtccggggtgtcccgggtgtccggacggtgctagccatcggccgtcttccttcctcgggaggtcagcagcaggtagacgcccgtgatcaccaggaggaacagcaggagcaggacggacatggccgatccggtgccgaagttccaggtgacgaaggacgactggtagatgtggatcgagacgaggtccgcggcctcgggcgccgacttgccgaacagcacgtacggtgtgttgaagtcgttgaacgtccacaggaacagcaccaggaccaggacctggttgaccgggcgcagggacggcagggtgatgcggcggatctgctgccacagtccggcgccgtccagggcggcggcctcgtacagctctttggggatgttctgcagtccggccatgacgatgaggaacgcgaacggccatcccttccacaccgacacgacgagcagggcgtagaagctgttgtcgccgatgagccagaaggagggtttgccggtgaggtgaagctggtcgtgcaggaggtggttcaccaggccgttgtcgtgctggaacatgaacgcccaggtgatgacggccgcgtagacgggcagggcgtaggggatcaggaagacggtgcgcagcaagccgcggccgcggaaggtgtcctgcatgaagacggcggcggcggtgccgatggcccagcacaggcctaccgagagcagggtgaagccgacggtgacgaggaaggagtgcagcagggcctcgccgaccgggccattgacgtccaccgacagcttgtagttgtcgatgccgctccagggcgcggtgccccagtcacggatgtagaactgggtgagttccttgaagctcatcacgatgccgatgaccatcggcaccaggtggacgaggagttcgaggatcagcgcgggcagcaggagcaggtacggcagtgcgatgcgcttgagccgcccggggcggcgcgggccgcgcgccgccccgggagaactcttgtgcaccggccgtgtgcccgtttcgggaacagtggtcgtcatgagggtgtccgtgctcacttcgccggcatctgctgctgggccttgtgcagcttggccttcaccgagtcggtggtcaccgggcggccgcccgccgcgtcggcgaacagttccttgactgccgtgccgacggccgtctcgaactgggactcgtcggcgacctggggcagcgcggcagcactggtggcgagggtctggcggagcaccccaatgccctgggagttgaacgcggggtccgcctgggcggacttcaccggcgggatggacccgtaggcggtgttgaggatcttctgctcctcgtcactcgtcatgaacttcacgaaccgggtggcgccgtcgaggttgtgggtgttcttgaagacggccatgttgatgccggccaccatggaattggtctgcgttcccgtgcccggagtgcccgactgcacgggcgcgggggcggcggcccagtcggagtccttcatgcccagcgacttgaaggtggcggaggcggtctgccacagcaccatcgccgtcctgcccttggcgaagtcgctcagggactggttctgcgcgtactcggcgttgctgggcgggatgaccttgtcctcggccatcaggtcgacgtactgcttgaccgccgcgacagcgccgtcgctggtgaagtcgggcttgccgtcggcggtgaagaagtcggcgccgtgctgcttggcgagcacgaagacctggtggatgttctccgagaggttggatccctccgccccgatgacctgcttgccccgcgcctggatcttcttgccgtcggcggtcagctccgcccaggtggcgggcggcttggtgatcccggcgtcggcgaagatcttcttgttgtagtagagcgcgtacgacatcgagtagagcggtacggccgccgggtccttgcccggggccccggtcgagcccagggcggagtcgacgaaacggtccttgccgccgatcctggcgaagttctccgcgtcccacggcaccagcgcgccggtcgcctggagggaggcgctccaggtgttgccgatgttgaggacgtcggggccctgcccggaggtggtcgcggtcaggatccggttgagcagatcggcccagggcacgacctccagcttcaccttgatgcccgtctgcttctcgaacttgtccagctcgggctgcaggaccttcttgtcgacggaaatgctggcgccctggttggaggcccagtaagtcagcgtcttgggcgagtcgttggacccgccgccggtggacgaaccgccgccgcaggccgtggccgcgagagcaagagacagggtgacggcgcctacggccgcggctcggatgttacgcatggctcctggtgtccctttccgggagttgaccgccgtggaccgcactcggaacgccgggagcgttcgactcctgaaggggaaccacggcttaatttaggatgtgagttaagacccacgagaacaacgcgtcaagaggttcgaccacgaacctcggtcaggcaggcggcggaggagggggccaggtggccggaggcagtggctgcacggggtatgacctggggcgggagagccggggcggcgttctgcaacagttgtgtttcggcgggctggcctacaactcgcccaagacggcgaccggttcgggttcggggcttgatcagcggcgtggtgaccgattcgatcgccgaggttccggcgtggcgggtcctcttcggctcaggcgtcggcgcctgtgtggtcaacgacggcgtggagcgacgcgggggcgggaacgggccgggttgtacgtacgccggctgcgaaccgctcggtgctcacgcggtctcgcgcacgatcagttcggggtcgaagacgacggacgtcggctcggcgcgctccttgcggatgtgttcgtcgaggagccgggccatctccgccgccatccgctcgaccggctggcggaccgtggtcagcggcggaacgcaggactgggcgatcccggagtcgtcgaaaccgatcaccgcgacatcgtcgggcacccgtcggccgcgctcgcggagcagttggcagacaccctgggccatgaggtcgttggcggcgaacacgccgtccacgtccgggtgttcggcgagcaggcgctccatgcccgcgaggccgctgccgaaggtgaagccgccttcggcgaccggcacgtacggatgtccgcacgcggccatcgcctcgcggaagccggcgagccgttcctggctggcggacacggcgagcggcccggcca

SEQ ID NO: 813 - DNA, 10725 bp, Unknown
  Kingdom: Bacteria, Phylum: Actinobacteria, Class: Actinobacteria, Order: Streptomycetales, Family: Streptomycetaceae, Genus: Streptomyces
cgccgtaggccgcgccgtccgcgcctccggaggtgagggagagcatgaggtcgtgcgccaccgtcggcgaacagctctccaggtcgccgcagtacgcggtcagcgcggaggtgccgttttccgagccgcgcggacgtccggggcccgggccgggagggtttgggcccaccggcgggacgggcggtcttcacgcggaggtggcggaatccccggcgggcctgggcgggaggtgagccggcagggctcggcgggccgttcccatgggcggcgcaggtcctcggcgaaggggcgtgcgaggcggagctgggtgtgggcgacgatgatcagccaggtccacaggtcggccgtgtgcgggtcgcgggccttggcgacggtccagcccagggtcctgcttgatcagccggaaagtgtactcaagatcgaatctgtgggggaacgcctgccgccgcaggtcgacgtcttcgccggtcgtcccggtgcgcgaggaccacagccagacgggctttgggccgcggtcaccgggcgggtgatcaaccttcagccgaatcaacgtaccctggaccgcgtggagttcgccgccgtggtcgagccagggccacgggccacgggcggtcaagcgggggtgcgtccggtgccaggccaaggtctcggcccggccgtagcgggggcgtcgcaggcggtggcctggtcgggagtgtgccaggagaccggcttggagaaggtgagggcgctgccatgcttgcggggctgtccgccgcgcggggtggggcggcatggtccggcgtggcggagcatgacccgctccgagcgtagtcggccgaccagctcgacaccaccaccgcgaagagccaacgtactaccagcagttcaaccgtgaccacgcccgactgagagcccccggcgaacgcgccttcgcccggctgacatcctggcggctgctccgacgagccagatgctccacatgccgcatcggcaccatcgtccaagccgtccacccactgctgacctgcaaaattcaggatgaaagaagttcaccggggagtacatatgagatcgcgtttgagggactgcggcaggggccttatgacctgcctcggcattgcttggttcggttaccagaccctctacggagcgggaatgctccggatcgtctcggccctcttgctggtggtgggcgtggtgacgactgcaggggccgttctcgactacatccgcccccggccgaagcggcgacggtctcgcgaacgcgagaccggtgggcggcccgtaccaccgtctaccgattgacgccgcccgcaatcaggacctcgcgatgctgaccgagcactccggcccctcgccgaccggggcggccgagtacccggtgtgcggatgagcggagggagagccccgcagggggaccgcctcgccacgatttcgtcgcccgaggcttcgactcgcggcaggcgacgggcacggcgaggcacgattgtcgatctccacgaacagcagcggcaccggcgccccgtcctcgggctcggtgatgacgatgtccgcctgggcgccgccttgcccgggttgaatcgggtaccggtcgggggcagcgccacctcggtcccgtaagaggcgagggtgcccaacccggcgtgcgcggcgacggcggcctgcgcggcggcaaggacatcggccggctcgctggagagccggaccagtccggcttggggcacctgctggccacaacggctcgcgcagaacgccgggtggcgtgtgcgggtgcggcgcctggtgtgtcccatgcgcggctgccgccacacctcccgcgagcaagtgcccggcgtcctggaccggcaccaacggcgaaccgcccgcctgaccaggcaagtcaaggactgcgtcaaggagttggcggcccgagccggggcgcgtttgctggcggtctcgcgatcggcctgtcgcgtcacacggcactgcgcacgctgctgcagatcccgctgcccgctgagcgggtgccccctgcgatcggcgggcccctggttcatacggacgatcttgtggtgagaactgtcctaccaggggctccgtgtctgcccgctacttgccccatgcatacgcactcggatgcttcgcgaagtccattccgctgaggacacctcgctcgcgcgcagggggtccgggtgaggggccggctcgatcgtcccgcgctgggcgtgcgggaagacctgctggtacaggccgcggcgacctgcatggagaacgtgaaggtcaagcggccgataaccgggtgcgccctgacagcctgtgctgggaaactgccagcatgccgattgctgaagcctcgcccggagtgtccatcgagtacgagaccttcggtgaccccagtgatgcacctgtcctgctcgtgatgggtttcggcgctcagatgatcgcctggcacgaggacttctgccgtgagctcgcacgtcgtggccgctacgtgatccggtacgacaaccgcgactgcgggctgtccaccaagttcgacgatcaccccgtggacatgggccagttcatcaccgctgtgagctcgggagacatttcgtccgcccttgcgatggttccctacacgcttcaggacatggcagacgacggcctcggcctgctcaccgcgctcggaatcgaacgagctcacgtggtcggatcctcgatgggcggcatgatcgcccagacgatggccatcacccagccggcgcgggtgctgaccctgacgtcgatgatgtcctcgaccggcgagcccgaatacggccagcccagccccgaggcccaggcggtgctcttcagtccaaagccagccgaccgcgagggatacatcgcagcggcggagaaggaactggtgtgggcctccaagcgctacggagacgcagcgatccttcgtgagctggctgccaacagctacgaccgcgcttactacccagccggagtggtgcgtcaactcggcgcgatgatcctcggtggctcacgcgcagacgcactccggaagcttcgggtgccgactctggtgatccatggcttggatgacacgctgatcgaccccagcggtgggaaacgcaccgcacacctggtgcccggagcgaagctcttgttgatccccggcatgggtcacgaccgcccccgcgaactctggtccgagatcatcgacgctctggaagcgcactccgactgagcgctccttaccctcctggttgagaaaacctcattgagtccgccctcgtgctgtagggccagccaggtagtgatggccgcccgcgcctgagtgacgcacagcgttcccggctcgctgtgcgagaacgacctctcagggaagagggcaggaagcgcgtcacgcccccgggccgggcctggcagaggtgcagtgccacacacgcaccggtcggtcggccgatggggccgatcggcccatgtgcgacgcggccggcgccgtccaccctggacacgtcgggagaatccggcgacaggacccgataccgagagggtgcggatcggtatgaagggctacgtcttccatggccccgggcgttcagcctgggaggaggtgcccgacccggacgtcaaagagcccaccgacgccgtcgtccgggtcgacacggtcacgatctgcgggacggacctgcacgtcctcaagggcgatgtcccggaggtgccccggacacggtgctggggcacgaggccgtcggtgaggtcgtcgagaccggcaccgatgtgcggagtgtccggccgggggaccgggtgctgggttcctgcatcaccgcctgcgggcgttgccgcttctgccgtgagggtgcgtacggccagtgcctgggcggcgggggctggatcctcggccacttggtcgacggcactcaggcggagtacgtccgtgtgcccttcgccgacctgtccgtacatccgctgctggcctcggtgacgaacacggacgccgtgctactggcggacatcttcccgaccgcctacgaggtcggcgtgctgaagggccgggtccgtcccgggaacaccgtcgctgtggtcgagcaggccccatcggcctggcggccgccgccaccgctcgtctgttcgcgcccgaacgtgtcatcgcggtggacgtcgccccggcccggttggaggcctcgtaatcctccctccacccgcgccgtcggcacggaacgtgccgtgcgcacgaatgcccccccggtgagcacgaggggctttcgtacgcacggcacaggccgagccggcgcgacccgcacccacggaccggccgggcgtgccgtcgaccggtaccggtcaggcgcctctcgcagggcccggtgcggggccgttcgtgtctcaggggccgcggcgcagactccgtccgagcagcggcaccgaaaccaggagcagagcgccttccacggcgaggctggccagtcccagcggctccgtccagttgcccacgtcatccgtgtagtccgggagccccggacctctggagaggacgtagcccagcacgggaccggcggcgactcccacggccagcagccagccagggcggacgaggcggaggaggagcagcacggcggcgaccacggccgcgatctccaggacgtggtaggcgatgccgacgtaggtggggtcccgtgtggcggtgacaccgccttgatccacgacgtggatgccggccaccaccaggcacaacagggctcctgcccacctggccggccaggtggcctcgggccctgtcagggtgcggtccggcatacggcgtaccttccctcgcttcatccgcccgacctgccacgccggtgtcccgttccaccggatcgttcggcaaaggcagcaggccgtgccctctcagctaccaccttcgacgggagggagcggaccgtccctcctgacggcgcaagcgagtgacggccacgagcgggaaggtggcgtcggtcggcccgttctagggggccggtcggaggccgggcgggcccttcggcccatgtgcgcggcggtggtcgccgacgaggctcgtctgtgaggcggtgctgtgacgcggcgcacaccggcaccgcgtccgaattccacgaagcatccacgccggggcggccgcaatcggtgcggcgtaccggacctcgctccttgacccgatgccggccgcgggcgagcgcctgctgccggccgacagtgcccggcgcacgtccgggagcgaagcgggttgatagcccaagagcgccgatcaggcaggcccgggcagggtccccgtcccgaacctggaggcgtgggagcgggccagggccgagggcgccaggatggaggaattgatgtccgcgcccgtggtgtgcgcacggcccgagtggaccgtggtcgaggcggcccggctgatggagacccagcatgtcaagcggctgcccgtcgcggacgaggccgatcggccggcgggcatcgtcagccgtggtgacctgctgcgggtctttctgcgccgtgacgaggccatccgtgaggagatcgccgcagaagttctgcggcgtacgctggggatcgacgaccgggacttgaccgcgacggtaggcgacggacgggtgactctcaccggcaccgtggaggaccgccgtctggttcatgtcgtcgagcaactgtgccggcgcgtcgacggcgtcgtgtcggtcttcgggaacctcggctaccggacggacgagtccggacaggcgcccggcggggcctgaggcccaccggggccacgcgggatgccggtgccaccgggcagggcggacgacgtcgagcagcttctccgcccctggtcgaccgggtggtgacggtcagggggagccggtcggcttactgacgcacagctcccggcggggtgtgttggaccacgtcctcgagacgagccgtgagggcgtcggtgcggcggagcgcgcgatgcctcacggagcgacacgacgacgcccggaccgaccgcgtgtgggcactcgctgtgggcagccacggcggcggccggcagggacagggccgccaccacgggcaggcccgtaaggcgttctgcggtggtcccttcccagatcggcctccatggtgcggcggctcgcgcgtcgccacgggccactcaccccgggctccggaatcagaccagtacagcagggcgccgacgagcgggagcagggactttcggagcccgtgccggggctgttcggccggaatgtttcgccctggcgaaagctctggacaggccccccgggaactcgtggtgcacgcagtggaggtggcggacgtgggactcggcacaggtctgagcgaggccgtccgttcggtgccgcccccctggtcgaccgcgccgccaccgtaggaaggcatacggccaccggccgtgagcggcgggtcggggtacggctttcgtccgagggccgggccgagcggccctggccgtccgtccgggcccgtatgaagattgccaggacggctgcgacgccgtgatcacaccagccacgcggtgatcatttcaccaccacatcgataccggggctggctcctcacccagcttcccggccgccggccagacgtcgacgccaccagaggtcagaacgccactgccgatgagtggcgagcggatccggcagcgtgcgtgccaggtacctggcgtccaacacacggactcgctgttccaactcggcgcggggccgggaaggcaactgccgcaggacctcatcaagcacgtcgcgggcgtgccgcacgtcatcgaaggaacaaccgcggcacgaacactccgaatcctgcggatagagcggccgccgtcccggtacttgcagaaacgctcgataccgtcgcagcgcacggtcggtggcacccgggtagacgtagtagtcgcccgaagatctctcaactcgatctaccgcgacgctggtccgggcagagagaccgtggatgcggtgtggaggcacactccacgcgacacgaggagactgttcagcgcgcagcgcgcctggccgtctacgcggcatcggcctttcggtacgtggtcatgagcatcatcatgccagcacccatggtccgttgacattccggacgtcgcatcggatctcggtccatcactccagcgctcaaccccgcacgctccgggagcggagtagcgggacagcaggccggcgatggcctggacgatgtcgctcatgtgctcacggcggccgaggtggcgggtcaatgctcgccagttcttcaggtgtgcggcgggcgtgttcacacgcccgccggtctgcgcgtccaagctctggtagccggtgtcggcgagtatgtccactgtcggcccgtcggccaggagcttgaccagccctgactggcgggcctgggtgatgtccgcacagctgccggggcttgtcgggctgcagagcagcacgtgcccgttctcgtccgtgacgaccatggtcttgacggcgttctgcttgctcttgccggagatgaagttgtcccggtcctcgcgtccggcggccggccgtcggacgcggatctcggtgccgtcgacgattccggtcttgctgtcggtgccgaggtggtcgacgatctcggcgagggtccggcaagtgcacaccgggactgacggtgcagccgcgctcggtgagcagtggccgcggttcaccgatggcacgggtgatggtggagcggtccacgtcgaaccagcgggccagtgcgtcgtgagtgaccccgtggcggagatggacgagcgtggccaggagccggctgatgaacatcagtcgatgcttcgccccggcgcccagggcccgcttccgcggccgcgagaggagcctggcctggtgctgctcgtgccacaaaggccctgtttcggctacgagttctgcattcacctcagccgacaagcccgtgattctccggtcgctgacgttcgctgcacgagaaccgttccccaccacacacccgtgatcaacgatcacgggctcgacgtctcaccgcctaccgtgcacgagctcgttaggaacctccgatgtggctctgcgccgctggcaccactttgccgatcgtggtggcgagcgtggctccgaggacgctgacgccgaccagggtcagccagatcgcggctgcccccgtggacagcaacccggagagggcggctggagcgaccgctccggcgacactcacggcgagctggttgagagccaagtaccggccgcggagagcgtctggggcgctctccgcggcgacagtcgacgtgatggggccgccgacgatttcaccgaaggtgtagctgattgcaccgagcagcacgacgccgaccgcgagggcgagcgcagccacgcgatcggcggcgaggaacaggaggtagctggtcgcgaagcaggcgtgtcctacgatgaggatgcggctgcggatctgcccgctgagccgcccgacgatgatgccttgggtgaagccgaccatcagggtgttgagcgtgaagacagcgccggcggtccagccaggcagtcccagcacgtccacggcgtagaccggtatcgcgacgttcagggcgaacaaggagatggcgaagcacagttgatgcgcgaccactgacaggtaccgcaggtcccggagtacacgcccccagcctccagcggcgtcctggcccatctcgggtcgggtattcggcacggcccgcatcagagcgaaggcggtgaggtaggacaaggcattgacgaccacgatcgcggcgtagacgctgtgagtaccgaagctgacggcgaccgcggtgaggaggccgccgagtgcgtagccgaggttgcgtaccgaccccagaagtccgaaccagcgctcgcgttggccgggtgcggccagcgccgtgacggtcgcgccgtagcagctgaagaacaccgcccgtccggcactgttcaaccaggcgcagatggcgatctgccatgtctggcccacgacaaggtacccggcgaagccgagcgcctgggccaggttcgccgcctggagtgccggcttggcgccgtacctgtcgaccagtcctccgaccagagggcccaccgggagcgccagcagcccggccgtcgtcagtgccgcgcccacctgcaccagcgtcagcgacgtcgtggccaggaagtacagcatcgagacggggacgaagacgccggtgccgatcgagtcgatgacgatcgctgcgacgaaacggtggtgccgagctatcgagggagggaccgtgcgatcgggaaaagtcacagcccggacggtatacattcgataccggtatctacaacgctaccgggagtcgtgcatgggtaacgcctacaacgtcatggccgcgacctgccccagtcgcaccgttctgcaccggatcggggcgcgctggacggtgttcatcgtcaatgcgctggacaacaggccgatgcggttcaccgagctcaaggcgcacatccgggggatcacatcgaaggcactcaccgagacgcttcgcgcgatggagtacgacggtctggtctcgcgcacggagattcccgcacatcccccgcatgtcgagtacgccctcaccgacctcgggcggtcactgctgacacccctacgggccgtccgggaatgggccgagagccacgtcccggacatcgaacgcgcccgcgcacaagccgaatcgcaacggtgactccggtcgctgatgggtgcggttggccgtgccttccggatcacgtcgagttgatggccttcgcaagtcggcggtagcagatcagggcggcggcaattccggtgaaggcgaggagtcgccttcggtgggccaggccgcaccgtcaggctgcacgcggtgcgcggccggtaccttctgcgtcggacctcccggtccgaagacgccgcaccgcgcgagtcgtcgctgacggggagttcgctgcggtcaccgaggcaccgcgcccttcgcgacagaagtctccggacgccgaggcggccgaggacatgcgccgctccggcgcggcccgcctccttccgcacggccccaccggtcgtcgcgcacggcgcaggttgctcggtacccgtacaggacggcacccgtcccgtcgtgccgccctggctgctgttcaacgaccccgtcctgcgtgccctgtacgacgactgggaggccggcgcacacgcatgcgcggcctacctgcgcatgcacaccgcccgccgcccggacgacccccgcctcctgcgccttctggaacggatggcgcatcacaccgacttccaaggctggtggcagacacgtgaggtcgcagtccagggcaccggcaacaaggtcttccaccatccgatcgccggcaccctcgtcctcgactgggacaccctgaccagctccacctccccccaacagcccatcgtcatctggacggcgcagtccggcagcccctcggagaaggcgctccaacgcctggcggcagccgcagccgcacaaggaggggacgagtctccccgcacgtcgtctgtgaacgcccccggttactgaccttttcagggtggtgtcggggtgggcgtcgcgatcgtcgcgatcgtgattccggtctcggcggggcagccgtcgagcaggtggggcctgcgttggaggcaggcgaggccgtgacggagggtccgggtgaggtggtcgggatccgcgaatgcgacgctggccatgtagcaccggcgcaggagcgaccagaccagacgccttcgaccgggttgaggtctggtgcacagctgcgggccatgcgctccttgagcgtggcgtccttgggggtgcgtccccggggtgcggcgggacctgctcggcgtgggcgaggcggc

SEQ ID NO: 814 - DNA, 6279 bp, Unknown
  Kingdom: Bacteria, Phylum: Actinobacteria, Class: Actinobacteria, Order: Streptomycetales, Family: Streptomycetaceae, Genus: Streptomyces
cagccggccggaccgggcggcgtacggcccagccggaagcgggtggcggcgccggcccccgccatgagggcgcgcaggcggcgccggacggtgcgctggcccgtgccgagctggcgggcgacgggccgcgtcggtgaggccgacgtgcaacagggcgacgatctgccgttcggttcgggacggctacagccgtacggtggccgcgcccctgggccccacggtgacctggcggctccaggcgccggccaccacctgggtgccggtgccgggggcgccgtgcagggtgaaggcgcggaccttgccggccgaccacttcacgtcgacggtgaaacccccgcgcacaccgatgcccgtgacctcgccggaggccgcccaggccggcggcagcgccggcaggagctccaggcggccggggcgggactgcgccagcatctcgatcatcgccgagggcatgccgaagttggcgtcgatctggaacaccgaactgctgccgctcagctggtacatgtcgaagaagttgacggccgccccgttgctgaagtcgacggacggtttcagcacctcctccaggagctggtaggccttgccggcgttcttcagccgggcccagcacagcgcgcgccaggcgctgccccagccgtagctgaccatgcctctggcggtgaggagcgcggtgacgccgtccaggacctcgtccggggagtcctggaggttgatgcggtcacccgggaagagcccgaccagcggggagaggtggcggtgcctggtctcaccgaggtcggcgtcggtcatccactcctccagccggccggtggtggcactgacccggggcagatggaggcgcgagcgcaggccgcggatcgtcgcggcgtaggaggcgtcgaggcggagcctggccgcggcctcttcgtagttgccgaacagctgccagaccagctcctgcgcgtaggtgatgccgatcgcgtcggtggggccctgctcgggcgaccagtcgtggtcgtcgacgaggacctggcgccgcgccccggtggcggggtcggtgacggtcgtggtgacgagccgggcctcccagaactcgcaggcgctcttgaggagcgggtagatccgccgcaggtgggcggggtcctgcgtgtactggtagtggtcgtagagggcgttgctgagccaggcgccgcccgccgggtgccaccaccagccgttgcccccgaagggattggtggagatcgcgacggtcgagccggcgacccttcctgaggtgttgcggaatccgttgcgggggtcctggaagagcttctgcgtggcggcctgccaggacgggagctggctgacgcagtagtcggtgagcgcgtcgaagcactcgggcagaccggcgcggtcgggcagccagtagttcatctggacgttgatgtccgtgtggtaatccccgctccacgccgggtcgttgcggtccacccacaggccctggaggcccagcggcaggctgccgcgtgagccgcagatcgccagatagcggccgaactgcaggtaggaggcctcgaactcggggtccgcgggcgcccctgacgcggcgcgggcgcgcaggcgggcgggggtgtccatggcccgctgctcgggcgtggaggtgcccaggttcacctgcatcctgcgctgcaggtgctggtagtcggcgacgtgcgtgcgcagcagcgacctgccggggaccgccgccgccgcgcgtgctttggagacggccaccgcgagcgggtcggcgccggggttcttgaagcccgtcgaggcgtcggccttgtagttggtgccgccggagacgatcaggacgacttcgcggcatccgctgaagcgcacctgcgtgccggagacggagacgcggcccccggcgcaggcggcggtcaccgctgtcgcgtaggtgagcccgttgccgagggcggcgctgaaggagacggtgccgctgctctcgtcggccgtcacgctctccccgcgggtgccctggagtgtcagtgcgcccgtgtaggagccgccgccgtgctgggtgagccggatgacgatgacgtcgtcggggaagccggcgtacgtctcgcggcggtaggtgacgccgttcgaccggtaggagacgagggcgaggccgttgctgaggtccagcgtgcggcggtagtcggtgatcgcgtcgggagtgtgcgcggggatgtccaggtagcacctggcgagctggccgaaggacccgaagtgcgaggtgtcgtaggggaactgaccgtccgactggagggcggcgttggccccgccggtccacagcgtgatgtccgtggcgtggaccgcctcgtgcgaggggtgaccggtcaccagcgcgccgagccgcccgttgccgatcggcagcccctgttccatgatctgggactcgctgccggggtccgggtaccacagggtcacggcctgcgtgtccggcaccactcgtaccgagtccggccggggcgccgcactcgccgcggcggtgaactccgggagggacgagagtgcgaggaccgtgcccagggaggtggccgtgcgcagcatgccgcgccgggtcatcccgtccggggaggcggtggcggcagggcgggcgtcggagtggtcagccatggcctgtccttctgtgtcggggaaaccggcgaacgggccgactcgggtggccgaggagcaaggggccggcagaagtggtgcggccgccgcggggacggccgcgggcggggtgcgtcccacaaggacgcgagtcggcccgccaacgtgcactgttaccgatgccatgaccttacaggctgccgtcgcaacctgaaccccttgaggagggaagagctttcagactctgctgttatcgataaccttcccttaccgtcttccgctgagtgtcgaggcagggcagggcgttgccgtgcttgaggctctcgatgacgccggccgggaggttgtacgggcaagcgggcgaggcgaagaccaggccggtcagtgatctcgccgatcacgcccaagccctcctccgcctcgcccgccaccgcgtcagcgtcctgtgcgccggggagcgggcgtcagccctggcggccggggagcatggacagtgcctgggagcgctgggcgacgaggtcgtcgtaggtgccgtcgcgctcggcccagcggtgcatgaggacgcccttcacgaggatctcgcggggggtggggtcctgcgcgagcaggtgcatgacctcggtggcgaagtcgtcgagcggcagggcgcgcgggttcaccttctcctggcccgctgtggcgacggccggggggacgagttcgacgacgccgacaccggtgccgtcgagctgtgcgcgcagggcctcggagtaggcgtgcaccgcggccttcgaggcggcgtagctcggcatgggcgggaagggcaggaaggcgatgccggaggtgacggtgatgaacgtgccggcaccccgccggacgaggtgcggggtgaaggcgtcgatgacccggatggtgccgagcaggttggtgtcgatcgtcgtcgctgccgcctcgaagtgcgcggggtcgcgcaggtcctccaggagcatgacgcccgacatcgtcaccaccgtgtccagctcggggtaccgggcgagcgcggcgtcacgggctgctgcgacggaagcgctgtcggtgacgtcgatgcggagcgtgccgaagccttcttcggcgaggtccgcaagtgcctgggggctgcggccggcgacggccacggtgctgcccgcagcggcgaaccgccgggccagctcacgcccgatgcccgaggttgcgccgacgatgagaacggtgcggtcggagagatccacgaggtcttcccttcagtgtggggcgccggcggcgttcggtcccgcggcgcggacagtgatgctctctgctctttcgaacagtgcttcttcggcagtgcttcttcggaaccgtgcttcttcggaaccgtgcttccgcagtcttgacggcatgcgccgggtgcggcagggcccccgtcttccctggtcctggcagggccccctctgagacacgcgcaccgcattacggtgtcggtatgaaggatgaggaatccggtaaccggctcggcagctaccttcgtgcccggcgtgagctggtctccccggctcaggcaggactgccgccgggcggcaaccgccgcgtgcccgggctgcgccgtgaggaagtcgccctgctggccggaatcagtcccgactactacctgcgcctggagcgggggcgggacaagaacccctcaccgcaggtcctcgaatcgctcgcgcgcgtcctgcggctcgacgacgtcgaacggacgtatctgctcggcctcgctgccgcacgccccagggcgccgcgccgcaaacggcccgagcacgtaccggcgcgggtccacgagttgctcgcccaccttcagatccccgcgttcgtcgaggggcgcgcgttcgatgtcctggcctccaaccccatggccgtcgcgctctccccccgcctgcggcccggccagaaccggctccgttcgctcctcctcgatcccgaggaacaggccttccagcaggactggacgaaggccaccgccgatttcgtcgccgcccttcgcaccaccatcggggacgacaccgacaacccccggttcgtcgagctcgtcggagaactcgcactgtccagtcagcggttccgcaccctgtgggcccgccacgacgtccgcggcctcgacgggggcacgaccacggtcaaccatcccgtcgtcggtgaactgcgcctgcaccgcgacaaactccccgtcgacgacgtcatcctcgtcgtctactaccccgacaaggacagcgacagcgacgagaaactgcggctcctcgccgcactctcccacaccgggtccgccggcacggcggacgacagcccggtggacgccccgcgctcgaaggcaccctgaacgaaccggcaccgtccgcgcgttgccggcgcgggcggtcgcgctgtcccagaatcacaggcgatcgcgctgtcccgaatcacaggcggatcgcgctgtccccagaattcgggggatgcactcccgccgggacctcgccgaccatgggcgtcagtacgtgtccacacaagccctctacctcgccgacagggcagggatcggacggtcgaccggtgcgtaggttcacggtgctctgcgggggctacatcgccagcatgacgggcacagcgctgaccgcgttcgcgctcacggtctggatctatctggaaaccggctcgacgatccagttcgccgtcgggttcgtcctgtcactgctgcccgcgatcgcgctctcccccttcgccggagccctggtcgaccgctggaacaggcgcacggtgatgctcgccagcgacatggtgggggtgtgcacgagcctttccctggccgtactctccggcctgggtgtccttcagccctggcacatcttcatcaccatcaccatccgctcggcgctgggggcgttcctcgtgccggcgctgaacgcgagcgtgacgcagctcgccccgcgaagccaactggggcgcgccaacggcatggtgatgaccgcgaccgcggtgagccagaccgtggctccggctctcggcgggctgctcatcgtcgcgatcggcctgcccgggatcctcaccatcgactgcgcgacgttcctgctcaacatcgccattctcctgcggatccgcataccccggcccgccgcgcccgaggagaagccggccggcattttcggggagatccgtgagggctggcaccacctcaccaccaggcgcggtctcgtcccgctgctctgcttctacgccgctctcaatctggcggtcggtttcgtcgacgtcctcttcacaccgctggtgatcgggatggcctcggtgacggcactcggtggggtgctgtcggcgggcggggccggcatgttcctgggcggcgccaccatggccgcgtggggagggccgccgaaacggatccacggcatcgcggggatggccgtgccgctcggattcttcctctgcctgggcgccctgcgcccgaacatcgccctggtcgccgtcgccgccttcggcttccagttcgcctcgatgatcatcgagggcaccagccggagtgtgctgcagaccgaagtggagcccggcatgcagggccgcgccttcgccaccttcaacatgatcaccaacacggtgctgttcaccggctacatgctcgccggtcccgtttccgagcggatcttcgaaccactgctgcgtcccggcggtgccctggccgacaccgtcggccagggcaccgccggg

SEQ ID NO: 815 - DNA, 5995 bp, Unknown
  Kingdom: Bacteria, Phylum: Actinobacteria, Class: Actinobacteria, Order: Streptomycetales, Family: Streptomycetaceae, Genus: Streptomyces
gcccgggcgtgcgccgccgggccccgccgtccggcagtcccgcctcggccggtgtcacccgggcccgcctgctcatcaggaactcgcgcagctcgcgccgccgtcggctcttgaacacgtccgtgtcgggcacgtaccgatccccctcgtgctgtctggtggtgccaccaccaccataagtgccgactccccacgggtattccggccgcacgaagctcttgcccatggcgatcgacaccacgaccacctcacccacgaccacctcacccaccgcccccggctccgaccgggcgacgtccggcaccccccggctgtcgacgcgcgacaagctggtcctcttcgtcctgtgcgcggcccagttcatggtcgccctggacttctccgtcctgaacgtggccctgcccgaactgggcaccgacctcggcatgagccgctccgcgctccagtgggcggtcaccgcgttcgcgctgccctccggcggcttcctgctgctgttcggccgcgtcggcgacctgttcggccgccgcaggctgttcctggccggcctcgccctgttcggcgtctcctcgctgctggccaccctcgcctgggacccggcctccttcctggccggacgggcactgcaagggctgggcgcggcggcgatcgtgccgaccggcatgtccctgctgaccaccaccttccccgagggcccggcccgcgaccgcgccctcggcatctccggcaccctgctgtcgctgggcttcaccgtcggcatggtcgccggcggcgtcctcaccgacaccctcggctggcgctccaccatggcgctgctcaccgtcttcgcgctgatcgtgctgccgctcgcccccggcctgctccccgagtcgcgcactccggaccgcccgcgcctggacgtgcccggcgcggtcaccgtcaccaccggtctgctctcgctgatctacgccctgtccaccgccgccgaccacggcttcggccgcgccgacgtcatcgcggccctggccgcgggcctcgccctgctgaccgcgttcgtggtcgtggagtcccgctcgtccgccccgctggtctcgctgcccatgctgcgccgccgtacggtggcctggggcaacgtgggcggtctggtcaccttctcgatgatgtcgacggtcgtcttcgtcctgaccctgtacctccaggagatcctgcacctgtcggcgttcgagaccggcctggtcttcggcgcgcagggcgtgctgtcggcactcgccggtacgtacgccgccaaggtcatcggccgcttcggcgcccgccgcacactggtcggctcgctggccggacagggcgcgctgatcgcggcactgctcggactgggcaccggatcctggtcggtgtggctggccacggccgcggtctcgctggccagcatgtgccacctgggcgcgatcgtctcctacggtctgaccgtcacctcgggcgtccccgacgaggagcagggcctggccaccggcctggtcacctccacccagcaggtcggcatcacggtcggcatcccgctgctgggcgtgctggccaccacctccgacgacctgctcgccggcgcccacaccgtgctggccctggacgcggtgatcgtgctcgcggcggcggtgctggtcggactcggcctgcgcggccggaaggaggcgcaggaatcagcggcctgagcgccgcgcggctccagacccccgaccgcagaccccagaccgcagacggcagaccccagaccgccccggacgtctctcaggggcggtcgaggcggagccgctccgcacgcggcagaccggccaccaccaggtcgtacgagtcctcgaccagctcccggaccagccggtccgggagctcgccgtcggccgtgaccgtgttccagtgccgcttgttcatgtgccagccggggacgatcagccccgggtactcgccgcgcagccgcaccgcgtcctcggggtcgcacttgaggttgaccgtcaggggccgcgcgtccaggccggtcagggcgaacatcttgcccagcaccttgaagaccgaggtctgcggggtgaaggggaagtcctccacggccgcgttgaacgacaggcacagggcgcgcagctcctggggcgtcactcgggtttctccccgtcctccggcggctcgaccggctccaccagcaccgtcacgatcttgttccggcggcccgccgcggactccgcggtcagccgcagcgcccgcccgtcgggcagctccacgaccgccgaggcgccggcgatcgggacccggccgagcgccttggcgagcagcccgccgaccgtttccacatcctcgtcgtcgtactcctccaggccgtacagctcgcccaggtcggtgatgtcgagacgcgcggtgacccggtggcggccctcgccgaggtcctccaccgggggcagctcacggtcgtactcgtcggtgatctcaccgacgatctcctccaggatgtcctcgatggtgacgatccccgccgtgccgccgtactcgtcgatgacgaccgcgacgtggttgcgttccttctgcatctcgcgcagcaggtcaccggcgttcttcgtgtccggcacgaagacggccgggcgcatcgccgtcgacaccagctcgttctccgcgtcccggctgatgtgcgtgcgccgcaccaggtccttcaggtacacgacgccgacgacgtcgtcctcgctctcgcccgtgaccgggatccgcgagaagccggagcgcagcgccagcgtgagggcctggcggatggtcttgtaccgctcgatgacgacgaggtcggtgcgcggcaccatgacctcgcgcaccagcgtgtcaccgagttcgaagaccgagtgcaccatccggcgctcctcgtcctcgatcagcgactcccgctcggccaggtccaccagcgcccgcagctccgcctccgaggcgaacgggccgcgccggaaccccttgcccggggtgagcgcgttgccgatgaggatcagcagcgacgggatcgggcccatgatccgcgccagcggcaccaggacgtacgccgccacggtcgccgtgttcagcggatgctgccggccgatggtgcgcggcgagacgccgacggcgacgtacgacacgaggaccatgagcgcgatcgcgaccaccagcgcctcggccgtaccggagaacgcctccaggcaggcgtacgtgaccagcgaggccgccgccatctcgcaggcgacacggaccagcagggccacgttcagatagcgggtggggtcggcggcgacctgggccagcttggcgccgccccggcggccggacttcacggcctcctcggcgcggaagccggagacgcgcgcgaggcccgcctccgcgcaggcggcgagccaggcgacgacgaccagggcgaccgcgccgacgacgatctgcggactcatcggcggttacgagaccgtcggcgccggggaggggccctccaggccccgctcgccgcgccagccgtccacgatcgccgcctggaggccgaacatctcggccttctcgtcgggctcctcgtggtcgtagccgagcaggtgcagcacgccgtggacggtgagcagctgcagctcctcgtccatggagtgccgcgtctccgcctcggcgccctgcttcgcggcgacctccgggcagagcacgatgtcgccgagcaggccctgcgggggctcgtcgtcgtccttgcccggcggacgcagctcgtccatcgggaaggacatgacatccgtcggccccggcaggtccatccactggatgtgcagctgctccatggcgtcggcgtccacgacgatcaccgacagttcggagagcgggtggatgcgcatccgcgcgagtgcgtagcgggcgatgtcgaggatcgcctgctcgtcgacctcggttccggactcgttgttgacgtcgatcgacatggtcgtgctggtctacttccccttgtgcccgtgcccgtgaccggcgcccctggctcggccgccgcccttgggcacgccgccgttctcggtgccgtgcgtgctgtcgtacttctcgtacgcgtcgacgatacggcccaccagcttgtgccgtacgacgtcctgcgacgacagccgggagaagtgcacgtcctcgacgccctccaggatgtcctgcacctgccgcagcccggatttcgtgccgctcggcaggtccacctgggtgacgtcacccgtgatcacgatcttcgagtcgaagccgagccgggtgaggaacatcttcatctgctcggggctggtgttctgcgcctcgtccaggatgatgaacgcgtcgttgagcgtgcggccgcgcatgtacgccagcggcgccacctcgatcgtcccggccgccatcaggcgcgggatcgagtccgggtcgagcatgtcgtgcagcgcgtcgtacagcgggcgcaggtaggggtcgatcttctcgtagagcgtgcccggcaggaagcccaggcgctcgccggcctcgacggcggggcgggtcaggatgatgcggttgacctgcttggactgcagggcctgcaccgccttggccatggccaggtacgtcttgccggtaccggcggggccgatgccgaagacgaccgtgtgcttgtcgatggcgtcgacgtaccgcttctggttgagcgtcttggggcggatggtgcggccacgcgaggacaggatgttctgcgtcagcacctcggccggggtctcctggccgtcgctctccccgttctcgctcgccttgagcatggcgatcgagcgttccactgcgtcctccgtcatcggctgcccggtgcggagcaccagcatcatctcgtcgaacacgcgctgtatcagggcgacgtccgacgtggcgccgaccgcgctgatctcgttgccccggacgtggatgtcggcccccgggaaggccttctcgatcacgcgcaggagggagtcgccggaacccagcacggtcaccatggggtgctgggcggggacggtgaactgcgctctcgcctgcccctgcgcgggggtgttggctgcgggtgtctgagtcatgggccggcgctcgacgcctgcgattcctcctcgtcacggccgcacagctgagggcggcctcgcgcttcccagggtacgacggtgcggtgacatcgccgtagggcttttcggcaccgcgggtccgtcccggcggcacgcggcgccgcgggcggtctcagtccacgcccctgacacggcccacgaggaccgcaccggccagcccgatcaccgccgccaccaggtagagcgcccggtagccgcccaggtacgtcacgatcggcgccgccatcgccggggccgcgacctgggggagggcgttggcgatgttgatgacgccgaggtccttgccgcgatccagggccttgggcaggacgtcggtcatcagggcgaagtcgaccgaggtgaagacgccgaagccgacgccgaggacggccgccgcgacgatcgcgcccggccaggtctgccacgccgaaagggcggccgtggccaccgccatcaggatgccggaccacaggacgaacggcttgcggcggcccacccggtccgaccacacgccgccgaccacgacggtggccagcagggtcagcccgttcaccgcggtgaggacgagcacgccctgctcggggtcggcgtaccggacgcggtcgcgcaggtagtagaggaggtagagcagcaccagggaattgctgaggttgatcaggaagcgggtcagccaggcccaggccaggtcggggtggcggcgcgggctgagcaggaaaccgcccaggaaggcgcgccaggaccagggcgggcggtccgccggcgcgagccgcaggtcccggtggaggaggacgtacggcaggacgcccgccagcgtgaacaccgcgcaggccgcgtacccggcgccggtgccgcccgcgaccgtcgccaggcccgtcccgccgaccacgccgaggatctgcgccgcacccagccagccgcccaccgacccgcgctgcgcgcgcggcacccggtcc

SEQ ID NO: 816 - DNA, 3910 bp, Unknown
  Kingdom: Bacteria, Phylum: Actinobacteria, Class: Actinobacteria, Order: Streptomycetales, Family: Streptomycetaceae, Genus: Streptomyces
acaccgcgaccccgccgacgctcgcggcggcccggcgcagcacctgcggcacccgctcgtcgacacggtgcagcaccaccgcggcgcccagcgtctcccggccgatgacgttggcctccggcaactcgcgcagtgacatggcctgttcggggaatccgtcccgttgccaggtggcccacaccagggtcgccccgccgatcgggacggccccttcggccacgcatcgccgtgcttcggacaccgatgtgggcagacgcaacagcaccgcggccgacctgccttcctgaggagctttcctgaggagttggatgccgggcggccgggcccttggtcgtccgcccgtccggcacggcgcattcttgccgctgcggccgggggcgcgtacagggctcacacgagcatgcctgcgccgcgccggcgacgtcgtgtgccccgacgcgccaggtgcaccgcgtccgtgtcggccgacgcgacccgaacgccgcgccggtggctacgccgggtacgggtcggtcgcgagccgtgcgtgtgtctcggcgtcgtgacggacgccgtcccaggcgagtttcccccgttgcagtccttcggcggcgaagcccgcggcgcgcgccacccggcaggacgcgggattgtcggtgcggtgtcccaactccaggcgatataggccgagttcggcgaagcaccagtgggcgagccccgcgcagccgtgggtcgccacgccccggccgcgggccgcggaggtggtccagtaggagatccacccggtgccgtgccgcaggtcgaggctcccgaccgcgacaccgcccagcgcctcgtcctcgctgtcggtgacggcgaaggcgtaggcggtctcgcggcgccactgggcgcgccgtcggccgatccaccgctcggcgtccgcgagcgtcgcgaggggcgcgtcggcctgccgctccatcaagggttccgcaaacgcccgcagcacggcccgcgcgtcggagggcacccaggtgcgcagcgacagcccctccggcaacggcacatggtcccgcatgtaatccaactcccctgtttccgctacgccttggccgcgcagatcacgtcgtagggcctgccgacggcgatcgtcagttccatgggctcggtggttcccgaggggcatgcggagcggtccttgacgaggccgagcaccttgtacgtgtccgaaccgccggaggagcaccttacttcctgggccgtggagctcacgcagtcgcccttgaccaactggccgcctccggcgcccgggtcaccgggatggtcgcccgacaggttgcgcccgcacaccgtcttggtgggaatgccgccgcccttgccgctcttgccggtgccgtaggagacgctgacccggatgatgacgtccgtgccgcccgggcactggatggagtcgggcaggatgctgccgtccatgaccgcgacggctttgaaggtggcgtgggagtcgccgcagccgtaggccttgtagccgtcgggcgcgtcgtcggggtcggggccgccgcagtcgcccgtcttccagtcccccgagtcatgcgagcccaaggacgacgacgagcctccgtcgtcgccgaagagcttgagggcgccgaacccgaggccgatgaccacggcgagggcgagcaggttcagcaggcagccccgcccgcgcgggcgccgcgcgggcgccgccggggttcccccgtgatggaccatgaccgtgcccctccccgtgaccgagtccgcaccacgacgccgtgcgcacagggggacgccctgtgcgcacggcgtggttccgtccggccggtcaccggggcggaagcggcgggtcgaggtgccgggtcagtcctcgccctccaggtttccctccgtctccaggtacacctgccgcaactgctccagcacggccgggtcgggcttggcccacatccctcgtgactccgcctccaggagccgttcggcgatgccgtgcagcgcccaggggttggcctggctcaggaactcgcggttggccgggtccaggacgtacgcctcggtgagccggtcgtacatccagtcggcgatcacgccggtcgtggcgtcgtaaccgaacaggtagtccaccgtggcggcgagttcgaaggcgcccttgtagccgtggcggcgcatcgcctcgatccacttggggttgacgacgcgggcgcggaagacgcgcgaggtctcctcggtgagggtgcgggtgcggaccgtctcggggcgggtggagtcgccgatgtacgcctcgggggcggtgccgcgcagggcgcggacggcggcgaccatgccgccgtggtactggaagtagtcgtcggagtcggcgatgtcgtgctcacgggtgtcggtgtttttcgccgcgaccctgatgcgccggtaggccgtctccatctcctcgcgggccgggcggccctccagtccgcggccgtaggcgtagccgccccagaccgtgtagacctcggccaggtcggcgtccgtgcgccagtcgcgcgagtcgatgagctggagcagcccggctccgtaggtgccgggtcgggagccgaagatgcgggtggtggcccggcgttcgtccccgtgagccgccaggtccgcctggacgtgcgcccgtacgtggttggcctcggcgggctcgtccaggctcgcggccagccgtacggcgtcgtcgaggagggcgacggtgtgcgggaaggcgtcgcggaagaagccggagatgcgcagggtgacgtcgacgcgggggcggcccagctcctcggcggggaccggttcgagaccggtgacgcggcgggaggcgtcgtcccagaccgggcggacgcccagcagcgccagtgcctcggccacgtcgtcgcccgcggtgcgcatggcgctggtgccccacagggacaggcccaccgaggcgggccactcgccgttgtcggtgcggtagcgctccaggagggagtcggcgagggcctggccggtctcccaggcgagtcgggaggggatggccctcgggtcgacggagtagaagttgcggccggtcggcaggacgttgaccaggccgcgcagcggggacccggaggggcccgccgggacgaagccgccggccagggcgtgcaggacgtggtcgagttcggcggtggtcccggccagccgcgggacgacctcacgggcggcgaactccaggacggcgcgtacctgttcgccgtgctcggtggggacggcggccgggtcccagccggcgtcctccatcgcctggaccagcgcgcgggcccgctcctccgccgcgtccgcgctggtgcgggtggcggcggactcgtccaggccgagggcctcgcgcagtccgggcaggctggtggtgccgccccagatctgccgggcgcgcagcacggcgaggacgaggtcgacgcgctgggcgccctgcggggcggcgccgaggacgtgcaggccgtcgcggatctgggcgtccttgacctcgcagagccagccgtcgacgtggagcaggaagtcgtcgaagccgtcgtcgtccgggcggtcgtcgaggccgaggtcgtggtcgagccgggcggcctggatgagggtccagatctgggcgcggatcgccggcagcttggccgggtccatggcggcgatctgggcgtgctcgtcgaggagttgttccaggcgggcgatgtcgccgtaggagtcggcgcgggccatcggcgggaccaggtggtccacgagggtggcgtgggcgcggcgcttggcctgggtgccctcgccggggtcgttgaccaggaaggggtagaccagcgggaggtcgccgagggccgcgtcgggcccgcaggacgcggacaggccggcgttcttgccgggcagccactccaggttgccgtgcttgccgaggtggatcatcgcgtcggcgccgaacccgccctcctcgcgcgcggcg

SEQ ID NO: 817 - DNA, 6348 bp, Unknown
  Kingdom: Bacteria, Phylum: Actinobacteria, Class: Actinobacteria, Order: Streptomycetales, Family: Streptomycetaceae, Genus: Streptomyces
atccgccgtggtgcccggcctgatcgtctcgtcggtggtcaccggtgccggtgaaccgggcacgtggaccggcacgatctcgcgctggaacgcaccggaggcggccgcgtcggccgcgagccggtgcgagcgggcggcgaagtcgtcgagccggcgcctggacagcttccagtggtgcgcgatgagttcggccgagacaccctgggggatcaggccgggggcgtagcgggcgttgacggaggcgccgtggatgtcggcgccctgccggttggagccgatgggtacgcggctcatggactccactccggcgaccacgaccaggtcgtatccgccggccatgacgccttgcgcggcgaactgcagggcctgctggctggagccgcacttgcgctcgatcgtcaccgcggggacgtgctcggggtagccggccgcgagccaggccatccggccgacgttcccggactgctcggaggactgggtgacgcatccgacgagcacgtcgtcgacggtcgcggggtcggcgccggtgcgttccagcagcccgctgacgacctgggagaggagttcgaccgggtggagcgcggccagcgcgccgtcgggccgggcgcggcccatcggggagcggaccgcgtcgatgaccaccgcctggttcatggccgctccgtcctttcgtggcccgccggggcggcgggcgcggtcacgatcccgcccgggccgcgagcgaggtgggcgcgggctcatcggcgaggaccgcggactcggagccgtaggggacgccgaggtcgccgccgacatcgtgggcccgcaggcgcgggaggacctcctcggccaggaggtcgaagttggcccgggcgacgtccgcgggcatcccgccgaacgacggcgccagcagcaccccgccggcgtccagccgctcgacgtagcccagcagctgctccaccacctcgtccggggtgccccagacctgaaggtcggcgaggaagttgcagaacccgtcgacgccgtgcttctcgatgttgcggctcaggccggcgtagtactcgtaccccgggatctcggcgaagccgacgttgtcgaactcgtagtgctggacggtggattcggcgtaccgctgcagatagacccgccgcatccgctccgcctccgcggacgtgcgcgccgcggcgacgaagacacagatgacgggcttgggcgcctcgtggccgttgatctccttgaaccgggcgcggaaggcgatgagctcctcctcgaccttgtcccacggcttctgcgcgatcaccatcaccccgatgcccagctgggccatcaggtcgatggactgcggcgacaccgccgacgcgaacgtccgaccgcggaaggaggcgtacggcttcgggcgcagctcgacgcggggctgccggtacaggtccccgtcgtactccatgacccccgactccaggccccgcacgatcgcctcgctgtactcgcggaacagctcacgcgactcgcccatctccaggcggaacccgtcgaactccacccgtcccagccctcggccgacgcccatcaccgcccgtccctgcgagaggtggtccagcacgcagaacgactcggccgtgcggaccgggtcctgccagggcagcaccgagaccatcgtgcccagcttgatcgtcgatgtcctgcccgccagccacgacaggagctggggcacctgcggtgtcatcccgtacccggtgaagtggtgttccggggtccagaccgagtcgaacccggcgccttccgcacgctccgccagcttgagctcgtcccggaccacctccgcgtcggaccgcccgccgtcgaggttctggaacagaagagtcagaccggtatgcatagcgctgtcgcccccttcgggcagtcaatggaccgaccggtcggccttagcgaccgaccagttggtatcttacggatacacgtagccgctgccaaccgaaatgaaaaatcgtcgttccgcagtgccgggccccggccggcaggctcggggcccttttctggcacaggtgccacggaggaatcacaaacaccggacggaccggacgtccgctcggtgccacgctcgtgtcagtggtctttccggataccgctgacggccatctccgcgtacgttttaccgatttccgtcggagaaaccggtccctcggcgtcgagccacgaatacgtccaggcacccatgccgatgatgccgaacgccatgatgcgcggcgggccgaggcggcggaagacgccctcctcgatcccgcgctcgatcacgtcgaggaaatagcgctcgaactcgtcgcgcttctgctggatccccgcgaacgcctctccggagaggtacctgtgctcctggaggtagatggtgatctccgacttgtagatcgccatcggctccagcagcgcctcgatgatcagccgccgcagcacctcgtcggccggcagctccgagttcgcggccacttttcgggcccggtagagctgatagtcgatgaactggtcgtggacctggacgagcaggtcctctttggtcttgaagtggtggtagaaggcccccttggtcaggttcgccctgtcgatgatgctctgcaccgacgtgcccgcgtacccgtgcttctcgaacagctgaatagcgctggtcagaagtgcgcggcgggcgccctccgggtcgcgcacgatactgcgccccccgcgcctgccccgacttccggaagcctgatccaccacgtcacctctccgcaatccgagcgagtgatccgtacaccgcacgccccgtgccaacagaccgaaaggtatgataacagttgcgccttgcgagcggtcgcgggcttgacgggacggggcggggcggtcagccgaggatccggttgtagccgcgccggcgcaggatcggcagaacgtggtcgcgtatctgccggatgccgcgctccgggtcgaagaaggagagcgcgaactgaccgacgcccgcctcgtggagcgcgatgagctggtcggcgaccgtctcgtaggagccgaagagctggtaggcgcccatgcccatgcccagaccctcgtagtgctccttgccgatgccgagataagggtcctcccgtacgcccgaggaggcgcgcgcatccccgacgacgtcctcggacaccttccggtcctcgctgttgaggatgtggccgctgcgcgtgagccaggtctcgatcgccccccggtcgatctcgctgcgcatccactgagtggtctcaagcgcctgggcgtcggtctcctccatcaccacgtagcacatggcggcgatgcggaccttgcggccgtgctcggccgccatgccgtggatcttcgcggccttcttccggtagccgtccacggagttgtcgtcggaggtgatgaacagcgcgtcgcactggcgggtcgcgtagtccagaccgatgtcggacgccgccgcgcagatcagcagcggacggggccggctggtggcccgcgggttgatctgcgcgccgtacagctggaagtattcgccctcgaagtcgacgggctcgtcggaggtccacaacagcttcagcgcggtggtcatctcgtcggcgatcgcgtaacggaccgcctgggagggcggcccctccaggccgaactgggcgtagtcgacggcgttctgcccggcgacgatgttgacgcccaggcggccgccggagatgtggtcgatgtcggagaagaccttcgcgagcagcaccggcgggatgtcgtagccgacgtggaccgtggaatagatgccgatccgctccgtcaccgccgcggaggcggtggccgcggtggcgaagtcgagtccggcgtcgttccagccggtcgcaccgccgtacccgctccacatgccgtactggagctggctgtcgaagcccgcctcctcgatggcccggatgagcttcgaggcggtcggccacttccagaagtcccggtggcgcgcgacgtccgacaggaccgccttgctcgcggacaggccgctggagacgttccaggcgaacaacgaaaggtgcaggtgacggtcggtcgtcagctgcggctggcccccggggtcgaaggggccgcgcagggtcggggcctgcgcaccggggcgggcaccggcggggcggctgggcatggactgtgctcctttgctggacaggacgggtacgtgcacgggcgacggaggtcagccccggcgcatcgaccacatctgggtcgtgcgctcgaactgcagcgcgacgtcccagggcatcggcgtggccccggtctcgcgccggaacgaggccaccgccgcgcgcgccagttccgggtccttggcaacgcgccgggccagctccagggcccggtcgtcgagttcctcggcgtcgacgacgtcccaggcgagtccggcccgtacggcctgttcgccgctcagttcctcaccgaacagcgccatcgcggcggtcgtctcgcggccggcgacgcggtcgaacagcgtgaagtggccgccgcccgggtgcagtccccgcttgaggaaaccgctgatcagccgggcgtcccgggcgacgatgcgcaggtccgcggcgagcatgaggttcatgcccgcgcccacggccggcccccgcacggccgcgagcgtcggtacggacacctggccgagccgcgtgaaggtctcgtagagggtgctgaggttcgcgaaggaggccgcgtccagcgggtccttgccggcctcgctcaacgtcgccaggtcggcgccggcgcagaaggccttgccgctgccgcgcaccacgagggcaccgatgtccggggtccggtcgacctcctccatggcctcggtcatctcgccgcacatgggcagggtgagcgcgttgtagcgctccggggcgtccagcgtcaggacggccacgccgtcctgcacgtccagggtggcctcgggcttcgaacgggtcattgcgtcctcctcgggacgggcgcggttccggccgcgcgagagtacaggggaaagccctgcttcaacaggaacctgaggaccgacgacgccgtctgctcgtaggcgctcacgaagatgtcgtgcaggccggggacctcgacgatttcgtccacgtacggttcgtaggcggcgcgctgctcgggtgtgacgagctcgaacgcgggggcgtagagcagcatgaccggcatcgtcagggtctccggtgccggggaggggccggcgaactcgctgaagacggagacgatcgccgcctggcaggtccgcctgcggacccggccgtccggcagcgggtcgaagtaggcggccgcctccgcgaaccggtccggcggtatctcgccggtggccccgtgccccttcaggaacgcccccacggactcccacacgtcgccggtgagttcctcggtggcccggcgcatcgcgagttccggcgggatctggatgacgggttccaggagtacggcccggtcgacgaggtccggctccttcgccgccaggtccagcagcagccggccgccgaaggagtacccggcccagtgggcgcggtcgatgccgagcgccctgaccgactcgacgaggtcgtcgacgtaggtcgcgtgggtccacggcggttcccagccggaccggtcgtggccgcgcaggtcgaaggcgatcacgcggaagtgctcgccccattcctcctcggccacgcgccggaaggactccgcgcgggagcccaccccgtggatgaggatcagtgggggcgccgacgcgtcgccccactcgtagcgttcaaggatcacggtcccacacctctcctcaccgcggccgcggtgatgcgttcttgcggcggcctccgttcggcagcctccgttcggcggcccgccgcccgggacgcccggtcagccgaagctgcggccaccgcacacgtagagcacctgaccggtgacgtagccggcctcgggcgaggccagccaggccaccgcctcggcgatgtcctgcggctgtcccgcgcgggccaggggcacgctgcgcagcacacgctcgcgcacctccttgggcatggcccgggtcatgtccgagtcgacgaacccgggcgccaccgcgttcacccgcagccggggcgcatacgccagtgcgaaggcccgggtgcacccgatgacgccggtcttggagacggcgtagttgaactggccgacgttgcccagctgggcgcgcgaactgaggttgacgaccgagccgccgtcggcgatgcggctcgccagggcctcggtgagggcgtacgtcccgccgaggttgacccgcacgacggcgcggaagtcggcctcggacatcttgtggacgagcgcgtccgagccgctcgcgaccctggtcaacaacgccggcatcacccgtgacgcgctcgtccacaagatgtccgaggc

SEQ ID NO: 818 - DNA, 779 bp, Unknown
  Kingdom: Bacteria, Phylum: Actinobacteria, Class: Actinobacteria, Order: Streptomycetales, Family: Streptomycetaceae, Genus: Streptomyces
cacggtcgtcctcaccaccggcgcgtacgccgaccggttcacggacggtgtcaccgtgctcgacctggccgccgaggccgaccggatcgcggcccgcccgacgacggcacccgccgtccccggcgacccggaccgcctcgcgtacgtcatctacacgtcgggttcgaccggtcgtcccaagggggtggccgtcactcaccgggggctcgccaaccacctgggctgggctgccgccgaactggcgggtgcgggcagtgggggcggggcggtgttctcctcggtcgccttcgacctcgtcgtccccaacctgtgggcgccgctgctcaccgggcagcgggtgctgctgctgccgcaggacctcgacctgtccgagctgggggagcggctcacggcgcacgccccgttcagcttcctcaagctcacaccgggacacctggaggtgctgtcgcaccaggtcggcgacgagcaggcccggaacctggccggggtgatcgtggtggcgggcgaggccctccccggtgaactcgcctcccgctgggccgagctgctcggcgcgggccgcctcgtcaacgagtacgggcccacggaggcctccgtcggcaccagcacgctgccgctgacccggccggtggccgccgaggtggtgcccgtcggacggccgctgcccggcatggtgatgcgggtcctcggccccggtatgcggcgggtgccggccggtgcggtcggcgagctgtacgtcggcggcaccggcgtggcccgcggctacctcggccgcgcgg

SEQ ID NO: 819 - DNA, 6761 bp, Unknown
  Kingdom: Bacteria, Phylum: Actinobacteria, Class: Actinobacteria, Order: Streptomycetales, Family: Streptomycetaceae, Genus: Streptomyces
ctgcctgatcgacgccgcccgtccgccctgggcggccgggcggcgtcgatcaggcagtagtcgccgccgccgtcgccggccccgcgtactccaacgactacgaggtccccggtaccgagtccggccgcgccacccagctgctgcaggagggcttccccggcctgggcggtgacagcgacaccgtcgtctggcacaccgacgccggcaccgttcgggccgtcgacgtcgagcagacgatgacccgcaccctggaccgcatcgaatccctgcccggcgtcgcctccgtgaccagcccctacaagggccagggcgcccaggccaccgaccagatcagccgtgacggccacaccgcgtacgcgacggtcaccttcgcccaatcggccgaggacatccccaaggcccaggcggaggccgtcgtccacacggccaaggaggcccagaccgacgggctccaggtggagctgggcggcagcgccgtcggcaccacccaggcccccggcgggcacctcgccgagatcctgggcgtcgccgtggccgccgcggtgctcctggtcgcgttcggctcgctcgccgcgtccatgctgcccatcgccaccgcgctggtgagcgtcggcaccgcccacgccgccataggactgctcggccacgccatgacggtggccgacttcgcgcccatgctgggcatgctcatcggtctcggcgtgggcatcgactacgcgctgttcatcgtcacccgccaccgcagaggcctcaaacgcggcctgtccgtcaccgaggccgccacgaacgccgtcgccaccaccggacgcgccgtggtcttcgcgggcgcgaccgtctgcatcgccctgctgggcatgctgatcctgcggctcggcttcctcaacggcgtcgcggtcgccgccgcgtccaccgtcgtcctcacggtcgccgcctcggtgaccctgctgcccgcactgctgtcctacatcggcccacgcgccctcagccgccgcgagcgccggcgcctggccgagcacggccccgagcccgaggtgcccaccggtttcgccgcccgctggtcggccttcgtggaacgccaccccaagctgctcggctccctcgccctcgccgtcatcaccgtgctcgccctgcccaccctcttcctccacctcggcacctccgaccagggcaacgaccccgcctcctcgaccacccggcgggcgtacgacctcgtcgccgagggcttcggccccggcgtcaacggaccgctcaccctggtgacccgcgtcgacggcgccggggaccggctcgccctggacaacctcggcaccaccctgcgcgccaccgacggcgtcgccgcggtcacgccggtgacctacaacaccggcggcaccaccgcctacctgaacgtcgtccccgactccgcgccccagtcgcagcgcaccagcgacctcgtcgaccggttgcgcgagcaggtgctgccgcgcgccgagaccggcacctcgctcgacgtgcacgtcggcggcgtgaccgccggatacgacgacttcgccggtgtcatcgtcgaccggctgcccctgttcgtcggcgtcgtcgtcggcctcggctgcgtcctgctgctgctcgccttccgctcggtgggcatcccgctcaaggccgccgccatgaacatcgccgccgtcgccgcgtccttcggtgtcgtcgtcacgatcttccagtggggctggggcagtgagttcctcggcctcggccgggccggtcccatcgaacccttcctgcccgtgatcatggtctcggtcctcttcgggctctccatggactaccaggtcttcctggtcagccggatgtacgaggagtggctggagaccggcgacaaccggcgcgccgtccgggtcggcctggccgagacgagccgggtgatcaactccgccgcggtcatcatgatctccgtcttcctcgccttcgtgctcggcggcgaccgggtgatcgccatgttcggcatcgcgctcgccgccgccgtcgccctcgacgcgttcgtgctgcgcaccctgctcgtgcccgcgctgatgcacctgctcggtcgcgccaactggtggctgccgcgccgcctggaccgcgtgctgccacgcatcagcatcgagccgcccgagtgccgcgccgcccatgagaggctcggcgacgtcatggcggaactcgagagggagcacgaaccggatgtacgcgatatccctgggtgacggcggcgaactgcggccgctggaaccctggcacgccgaggagttcctcgcgcacctcgaccgcggacgcgcgttcatcacccggcacatcccgttcggggcgaacgcgaccgacgtggactccgcccgtgccgtcctccagtcgtacgcggacaagcacgccgccgacagcggcttcctgcacggcgtgtggctcgacggcacactggtcggcgggctgctgttccgcgtgttcgacacggcgaccggcttgtgcgagatcggctgctggctggaaccggccggaaccggccgtggcctggtcacccgcggggcccggatcctgctggactgggcgttcgacgagcgcggcatgcaccgcgcggagtggcacgcgtcgtcggccaacgaggcgagcatcaacgtggcgcggcgcctcggtctgacccgcgagggcgtactccgcgagagctacccctaccggggcgtacgccaggacacggagatctgggccgtgctcgcccccgagtggcgtgcggcacgcgcgcgcaccgatcgggacgaccgttaaggcccctctcagacggcgtccgtacggtgcccggcatgggaaccacgaccgcagacgaggcccgagccaccaccggcaccgaggcgacgaacgagacgggcaccggcagcgaggcggaggcgacgagcgaggcgcagaagacggagcaggcggagcctgaggcgaggggcgccgccgaggcgtcccccggagcggccggcgaggcggggcaggacccggagaccggtgcagccggtgagaccggcaccggcaccggtgaggccgctgacgtcggtaccgaggtcgccggctccggaaaggcagcgtcctccggcgtccgacagggcgccggcgccgtcgtgtccgccgccctgggcctcgtctcgctcagcggcagctggctcggcaccgtcgccggcgcgcgcgagcagctgatcggccagctgcggacctccacctccgcgagcgtcgccacgcagatcaaggaggtctacggcgacgcctggcacaccaccgccctgtggggcggcctgttcgcgctgctcgccctgatcgtcggtgccgtggtgctcgcccggcccgcgttcggcgctccgggcaggccgcaggcaccctggatcaagtcggtcgcctgggcgggcctcgccctcggcgtcgtcggtctgctgctggccgtcctgaagtacaccgacgtgctgctgggactcccgtccgcctgagcccgacacggtcgtacgggacttccccatggccgtaacgggcctcccgacgcccgtaagggacctggcgggccggtctaaggccccgtacgcgcccctaaggcccccggtcgccgccgaagatgcggaactcgcccgatgcggtccgcccccctgggcgacgaaggtggtgtccggcaccgcgacaagcgctgccggacaccacctcaccaggggagacaccatgttcacgtacgagttccacgagctgcggtccagcgaactgcgccgccaggccgagcaggagcgcctggcccgctcggcgctccgtcaccgccgcgccgcccgccgcacagcctccaaggaggcaccggaggccgaggcgcatagcaacggcccccgccggcaccggttcacccgggccgcgtgagggcaggggagcggacggcgtccggcccgcccgagcagggccggcgcctcccgccgggcgacgacggcacgaaaacctgtcccgtactgtcgtacccccgtgcgatgctcgggcccgtggagaccaggtctgtcagtccggtgttcgtgggccgcgcgaacgagtcggacacgctgcacgacgcactcaccagcgcgaacgcgggcgagccgcggacgctgctgatcggcggcgaggccggggtcggcaagacccggctgatcgaggagttcgccgctgccgccgcccgccgcggcgcggtcgtcgcggtcggcggctgcgtggagatgggcgccgacggactgcccttcgccccgttctccaccgccctgcgcgccctgcgccgcgaactgcccgaggccttcgccgccgcgaccgccggccagcaggaggaactcgcccggctgctgcccgaactcggcgagcaccccgcaccgcgcggcaccggccggcacgacgaggagggcatggcccgcctcttcgaactcaccgcccgcctgctggagcacatcggcgccgaccacacggtggtcctcgccctggaggacctgcactgggccgacgcctccacccggcacctgctcacctacctcttccgcaccctgcgcaccggccggctggtcgtcctggccacctaccgctccgacgacatccaccgccgccacccgctgcgccccctgctcgccgaactcgaccggctgcgcacggtctgccgcatcgaactcgaccgcttcacccggcacgaggtcggccgccagatcgccggcatcctcgccaccgaaccggaccccgcccaggtcgaccggatcttcgaacgctccgacggcaacgccttcttcgtcgaggaactcgccgtctgcgcccacgagggctgcgccgacgacctcagcgactccctgcgcgatgtcctcctggtccgcgtcgaagccctgccggaagccgcccagcgggtcgtccggatcgccgccgagggcggatccaccatcgagtaccggctgctcgccgccgtcgcccggctctgcgaggacgacctcatcgaagcgctgcgcgccgccgtgaacgccaacatcctcaccgccgcccccaccggcgacggctaccgcttccggcacgccctggtccgcgaggccgtcggcgacgacctgctccccggcgaacgctcccgcctcaaccgccgctacgccgaggcgctggaggacgacccgtccctcgtcgccgccgaccagcgcgtcatgcggctggccagctactggtaccacgcccacgaccccgccaaggccctgcccgccgtcctggacgcctccgtcgccgcccgcgcccggcatgcctacagcgagcaactccggctcctggagcgggcgatggaactctgggacaccacccccgaggacgtacgggaccggctgcgtcccgtggactacacagaggtctgtccgccctgcggcggcgaccccgccaccacccccctgtgctacctcgacctcctggccgaggccgccgtcgcgggccggctctgcggggaacgggaccgcgccatgaagatcatcaagcgggcgctgcgcctcctggaggacgagcacgacccgctgcgcgccgcctggttctggatccagcgctcccgcctggtccaggcgaaggcccagggcaacggctggcgtgaactggcccgcgcccaggacctggtgcgcggtctgccgccgtccgaggtgcacgccgaggtgctcgccaacgtcgccaactggtccatggtccacgagcccggccccgaggccttctcggccgccgagcgggccgtggagtacgcgcgcatggtcggcgcctgcgagatcgagatgaccgcccggctgaccctcggcggcctccgggtccaggcgggcgaggtcgaggccggactcgccgagatgcacgaggtcaaccagcgcacggtggaacacggcatcaccgccgtcgccggccgctcctacgtcaacctgccctccgaactggagtccgtcggccgctcccgcgaggccgtccccctgctggaacagggcatcgcctacacccagcgctacggcctgctcgaccacgaagcctgggcctggggcaacctcgccgagtccctgttcaccctgggccgttgggaagaggccgccgaggccgcctcccggtcccggcgcgtcggccagagcgccaaaccgcgcgccttccacgcccgcatccgcgccgaactcgcgctcgcccggggtgatgtggccgaggccgccgcgcagctcgccgacggacgctcctgcttcggcacccatgactgcgcgccgcagcacaccctgcccctggtccgcatcgcgatcggcgtcgcggcgggcgagggccggctgctggacgcccgcaccgaactcgcacccgccctggaagacggcttcccgcccggcacccagcgctacggctggccgctgctgctcgccgccgccaccgtcgaggcccgcacggccggactgcccgccgccgacccgggccgccccgacgccctcgcccgcatccggaaggccgccaaggccctgaccgtcaacgtgcccgtctggcaggcgcacgaacgctgggtgcgcgccgaactgctgcgcgccgaagggcacctctgtcccgacgactggaccgggatcgtctccgccttcgaggccctggagcgcccctacgacctcgcgcgcgtccgcctgcgcctggccgaggccctgctcctggccggcgaggaccagcgggacggcgccacggaactgctccgcctggcgatggcggtcgccgagcacctgcgcgcccggccgctcgccgactccgtcgccctgctcgcccagcgtgcccgcctcaccctgacc

SEQ ID NO: 820 - DNA, 3595 bp, Unknown
  Kingdom: Bacteria, Phylum: Actinobacteria, Class: Actinobacteria, Order: Streptomycetales, Family: Streptomycetaceae, Genus: Streptomyces
gggggggcttccggtccgcgtgagaacggcgccggcaggggctggcggttcccgtcagggccggacgcggcccctgtcagggccgaatgcagtccccgtcgaggccggatcggcagccgtcgaagccggatcggtccgtgtgcgggccggatccggcgcggacccctgtcgagccgggggcgatcacgagatatcttgatgtcgagcaatgttgcagacgtggagcggagcacccggtgactgactcgaccatcatctacacacacactgacgaggccccggccctggcgacgtattccttcctgccggtggtccgggcgtacgcctcgcaggcgggtgtgactgtggagacccgtgacatctcgctggccgggcgcatcatcgcgttgttcccggagtacctgcgcgaggaccagcggatccccgacgcgctgtccgagctgggcgagctggccaagacgcccgaggccaacatcatcaagctgccgaacatctcggcgtccatcccgcagctcaaggccgcgatcgccgagctgcagggccagggctacgcgctgccggactacccggacgacccgaagaccgacgaggagcgcgagatccgcgcccgctacgacaaggtcaagggctccgcggtgaacccggtcctgcgcgagggcaactccgaccgccgcgcccccgcctcggtgaagaactacgccaagacccacccgcaccgcatgggcgcctggaccggcgagtccaagacgaacgtggcgacgatgggcgtcgacgacttccgctccaccgagaagtccgtcgtcatcgccgaggacggcgccctgcgtatcgagctgaagggcgacgacggctccaccaccgtgctgcgcgagtccgtgcccgtgcagaagggcgaggtcgtcgacgcctcggtcatgcgggtcgccgcgctgcgcgagttcctcaccgcgcaggtcgcccgcgccaaggcggagggcgtgctgttctccgtgcacctgaaggccacgatgatgaaggtctccgacccgatcatcttcggtcacgtggtgcgcgccttcttcccgaagacgttcgcgaagtacggcgagaccttcgccgcggccggcctgaccccgaacgacggtctgggcggcatcttcaagggcctggagagcctgcccgagggcgccgagatcaaggcgtccttcgacgccgagctggccgagggccccgagctggccatggtcgactccgacaagggcatcaccaacctgcacgtgccctccgacgtgatcgtggacgcctccatgccggccatgatccgcacctcgggccacatgtggggccccgacggccaggagcacgacaccctcgccgtcctgccggactcctcctacgcgggcgtctaccaggccgtcctcgacgactgccgcgccaacggcgcctacgacccgtcgaccatgggctccgtcccgaacgtcggtctgatggcgcagaaggccgaggagtacggcagccacgacaagacgttcgagatcccggtcaccggcacggtccgcctcgtcgaccaggccggcaacgcggtgatcgagcaggccgtctcggccggtgacatcttccgcgcctgccagaccaaggacgccccggtcaaggactgggtgaagctggccgtcacccgcgcccgcgccaccggcgacccggccgtcttctggctggacgccacccgcgcgcacgacgccaacctgatcgccaaggtcgagcagtacctgccggagcacgacaccgagggcctcgacatcaaggtcctctccccggtggaggccaccaagctgtcggtggagcgcatccgccgcggcgagaacaccatctccgtcaccggcaacgtgctgcgcgactacctgaccgacctgttcccgatcctggagctgggcaccagcgccaagatgctgtcggtcgtcccgctgatggcgggcggcggcctgttcgagaccggtgccggcggttccgcgcccaagcacgtgcagcagctggtcaaggagaactacctgcgctgggactccctcggcgagttcttcgccctggtgccgtccttcgagcagtacgccgaggccaccggcaacacccgcgccaaggtcctcgccgacaccctcgaccgcgccacggcgaccttcctcaacgaggacaagtccccgacccgtcgcgtcggcggcatcgacaaccgcggcagccacttctacctgtccctgtactgggcgcaggagctggcccggcagaccgacgacgccgacctggccaaggcgttcgcgccgctggccgagtcgctcgccgcgaacgagcagaagatcgtcgacgagctgatcgccgcccagggcaagccggtggagatcggcggctactaccagcccgacccggccaaggccgccgaggtgatgcgcccgtcggccacctggaacgagacgctggcgtcgctgagctgacccggccgacacctcgtacctgacgctcccgccccgaccggtcacccaccggccggggcggagccgtcccgggcccgggcagatccgtgccgggcccggcaccggcccgggcgaaccgctcgccgagccccggagcgcactggagccggatcggccgtccagcccccgacggtgccgctcaccagtcccgcggtgcgatcagttcctccgcgtcggcgtccgtgaagccgtaggactgggcgatgaaccagaagtcctccgctatcgcctcgcgggccaccgtctcgatctcgctgccgaccacctcgaagtcgtcctggaggtcgttgaactcctcggtggccgcgtgcgtcaggacgtacagcgccgccaggtccgcgggacggcgcgcctcgatgcgctcgcacagccgcaccagcaccgccctgcccaggtccacgacctggtccgggtagtagccggaccggtacaggtccttcaagaacgcgtggtcgcgcatgcgcggctcggtgacgggcatgtctcttccctcccccggttcccggccttccgccggagacccgaccggtctgacaccccgatactgccgcatcccactgacaacgccccgccaccggccggcccccggacccgccggccgccgcgcgacgcaccgcacggctggagcactcccacgcgacaagcggcccggtcgcggtcagggttgatgcatgacccaggagatcaccacgccctcacccgaccaggtggctctgcgacctgccgtccgggtcgtgccgatcaccgccgagccgccggccccctcgccgcctccggtccgggagtggcccgctctcgacctggacggaccggagttcgacccggtgctcgcgagcctgatgcgcgagggtccgatcacccgaatacgcctgccctacggcgagggctgggcatggctggccacccgctacgacgacgtgaagctggtcacgaacgatccccgcttcagccgcgccgaggtcaccggccgccaggtgacgcggctggccccgcacttcaagccgcgccccggttcgctcgcctgggccgaccagcccgaccacaaccggcggcgcaggccgggcgccggcgccttcaccgtctgcgcgatgaagcggggg

SEQ ID NO: 821 - DNA, 1035 bp, Unknown
  Kingdom: Bacteria, Phylum: Actinobacteria, Class: Actinobacteria, Order: Streptomycetales, Family: Streptomycetaceae, Genus: Streptomyces
cccccgcgtcgccctgtgggtcgatgaggcccactggatccgtttccgccgttggctccgcggagttctggtgccggtgggtgggccgcgggcgcggctttccggggtcggggctcacctgtcctcccaggttcgggcccgcgtcgtcgtgcgcgggctcgggcaggcgtggcgcgacggggccgccggacccggaacggtcgcggcggccccgcgcgtggctcatcggcgcgctgccgggactgccacgccggtcaaccggtcttgccgcgcccggacagcgcgtccctgatccggtcgaccatgccggcacccggcgccagcagcttgttcgcgggcggtgtgtcgggggcggaggggtgcggtcgcgtcggcgcggtcttcttcgccgtacgcaccttctcgccgagctgctccagttcctccggggtggtcgcctcgcgcagctgcgggaacaggttctgctcctcgtccgtcacgtgttcgcggatctcccgcatcagacggcccatgagctggtcgaaccgcgcgtcgtcggcctggcagccctccaggtccttcatggtctgctcggcctcggcatggtcatggacctcccggtcggcgatggcgtcgccgtcccggacgtactggcgcacggccgggtagaggtacatctcctcggccacggagtgccggaccagttcgatggtggcctggtccgcgaggtccttgcgcctcttgtcccccgtcgggagagcctcgatctgcgcgaagatctcctccacctcgcggtggtcggtggtcagttcctggatgacgtctccgccgtgtcccatggcagcgctcctcactgttcgaaggtggtgtgtcaccggtggaccgcccgccgggttcccggggcggcccggaccacaccgccggacgaaggctcacgcgagcgggcgcgtccgggttgccgtccggctcggggtgtgcgcgacgcggctcgtggccggggaaggggccggtccgcacggggccggggccggcggggcggcccggcgggtggaggcg

SEQ ID NO: 822 - DNA, 8381 bp, Unknown
  Kingdom: Bacteria, Phylum: Actinobacteria, Class: Actinobacteria, Order: Streptomycetales, Family: Streptomycetaceae, Genus: Streptomyces
acccggtcggccggggtgcagcccgcggtcaccgccgcctgcaccccggccgaccgggtgtgggtacgtccggggtccggcgcactggtgcgggccgagtcgagcgcgggaacgggcgactcccggtatctggtgccggaaaacggtgttgtctacccgctcgcgccgacggccctgaaaagcctggggtattcggaatcctccgcgatcccgttgccggcccggctgctgaggcttctcccgcggggcccggtgctggatccaacggccctggcggcgaacggagttgtcgcaccggcgtccggcactcggccttcacgtgaacagtgcggcggcgcaacctcttaggttcctcaaatcacgaagacaggcagtcagtttcggtctgcatctatcagtttcaagataatgtgactgcctgttcggacggacccccagagttcgaagggctacttctgtgagcgaagccagcggcatcgaccagaccggcggcatgtacaaccgggcacaggccgacatcgacgcggcccgggccgcgatcgaggacaacgtcgcggccatggccaaggccggcaacacggtgcagcagatccacgacgacgtccgcctcgcctacgtcgccgactcctcgaacatcttctcctccaagctccaggagtggatgcaggcgtacatcaacgtcaagcagaaggtggacaccctccaccaggcgctgaccgacgccgacaagacgcagaaccagggcgagatggacgcccagcagtacggcagcgcgtggagcccgagcgccggcagctactacgacgcctcggccgacgcctacgccgccctcggcggcggcgccaagtgaccgcccgcaccgccgcgcaccacaggacgacaaggagctgacgacatgccggacgtaaccctggtgaaggccgcggccaacaccgccatcgaggagatgacccaggccaacaaggccatggtggacgccctccaggacatgctcgaccgcatcaggccgctgcagaactccttccagggcaccaccgccgtcgcctggaacgacttccagaacacggtcaacacctcgatcaaccagatgaaccatgccttcggcgagggcacccagtccctggagcgcatggtcgacgcccagatcgaggccgacctgcgcggcggccagatcatgagccactagccatggcgaaggacgacggcggcaccgggacctacaaggtcaccgacgcgaagatcgacgaggtcgtcaccaacatcggcggcctcgtccaggatctcgagggcaacaactgggtcaccctgctgaaagccttcggcggtgacaagtccgtcgacgggttcgaccgcatctacgcgggttcgggcaacggcgtggtgagcgccagggcactgcagaacaacttcgccgtcttcgccgcggagatgacacggcagctggacaccatggcgtcgagcctgaaccaggcgatcgtcgacctgaaactcgcccaccagtacctgcaggagggcgaggacggcgcgtccatcaccgcggaggcgatgatggcggacctgcgggacgtggtcggccacttcggaggcaccgtctcgaccaccgtcccaccggtgagcgacaccaccgggaagtgacggccgagcccaccggcgacgaagcgagcaggcacgaaggagcagcacgatggcgtccgggccgtgggagaacatcctctccatgtacacctgggatcagcccacgacccgggaccaggtggcgggcagcggcgaggggttcgccagctggttcgccgagcacgtggtcgtgcccgcgggcatgaacgacggcctgccgggtggcggctgggacatcggctggtccatcccctacgtggtcgaggtcgagcaggtcaactcggagaccggcggggcgtacctcacctatgagaaccgctactaccagctcggcgtacggctggcccgcgaggtcggttcgaacgactccggcaccccgctgagcaagttcgtccacgaaccactcgacctgctctggccgtccgtcaccgaagcgggcaccgatgtcatcaagctgctcagcttcgactcggccgggatgaccgtccgcggcgtcgagaagttcctcaacgacgcccaccagaagatcagcggctgggcccgcgacatcgacgtacccgagtccgagctccagggcagcgccgccggcgcgctcaaggacgcgctcaccggcatcgccaacgagttccaggacctggccgtgcagatgaccacgcccaaggagttctccggcggcatcgactccgcgcgcagccgcctccaggcccgcaccggcgagttgcagacggtgtacgagacctggcgcaattcgagggaggcctggccggccaacctcatcgtggacatcctcacggaggtccacaacaacctcagcccgaagtccggtgctcccctgctggtcgccgccggtgacctccccgcgttctccgacgcgaactacggcaatcccatggaccagtccttctgggacaaggtggaggaccaggccaagacccgctggaagaaccacgtcgcacagagtctggacccgacggccaccacggcacacgacgacctggaaaaggcatacggccaggacatcttcatcccgcacatcacccagcccaagtggcgcacccccggatcggcccaccaggcgaccggcccggacgactccgccaagtcgtccctcaccgacctccagaaggaactggacaagtccaagcaggaccagcagaaggcgctggacgacgccaagcagaacctgggcgacggcagcctgcagcagaacctccaggaccagaaggacctcttgggcggcggcggtcagaaggacaccggcggcaccggcacgggaaccgtcgtcgaccagcagagcctcaagaacgcgctcgaccggaccaacaagggcggcgtcttcaccgacggcaccaccaagaccggtggcacgacgaagaccggcgccgacgccctcgccgagctgccccccggcgccgtcgtcaacaaggacgggacgatcaccggctccgacggcaagctgctcaagaaccccgacggcagcatccgcaaggccccgcccggcacctacgacctccagcagcagcggatccagcagcagaacgagcagcgccggcagcaggcactccagaaggccgcccaggaacaggagaaggcctaccaggaccaggccaagcagcgccgccaggccctgcagaaggccgccgaccagcaggagaaggcctaccaggaccaactgcgcaagcagcaggcggaccagcagaaggcgggcagccagcagcgcgcctacgaggaggcgctgcgccgggcccggctcggcacccgcacctccagcgccgacctgcacacgctggagaacgcgcgcaacctcaagggcggcgtccgcgtcaagcagccggacggctccttcaccgagcacggacccaccacaggcgagcggccggggcccggccgcgccacccgggtgcgtacctcgtcggccggaccgggcggcctgaccgccgaggagacggcgctgaccaccggccgccgtacctcgtccaacgcgccgatgatgcctcccatgggcggcggcatgggcggtggcccgggcggcggcggccagggccgtgaacgcaagagcttcctcgacgaggaagaggagacctgggggacgcagcagtcctcgggaacaggggtgatcggctgatgagcggtgccgaggcacaggggttcacgtccgcgttcggcgcgatcctgcagtccgagctgggtgacatgaccgagcggctcaaggcgcagcgggagaaactgatcgccgcccagcgcgagctgaacgcccgcagcaccaccgtacgctccaaggaccgcgccatcagtgtgaccgtcggcgcgcgcggcgaggtgcgggacatcaagttccacacggaggactaccgcagcatggaccccgcccggctgagccgggcgctggtcgacatcgtcacccgggcgcagcagcaggcggccaaggaggcctacgaggcgttcgcgccgctgcggggcgcgggcgcggcgatgcgcaagtccatggaggcgggcaccgcggtcggtgacctgctcgccccgctgcgcgagctgacgaaggacccgctcgcggaccggcgcggcaccgaagggggcgacgatgcctgaagtgatccggaccaccagccagctcgcgcagctcttcgccgagtacccccagctcggcgctgcgctcgccgacgccaacgcgaacgtcacccgcatcaacgccctgaacaagagcggcggcggcaacaacgaggacgagtcctccaagcagtaccacgccacggtcgatgcgggcatgcctccgctcaacgacatcatcagcctgctcaacaccctcgtgaaccagctcggcgtggacggcaccgacgtcatgaaggtcttcgacaaggccgagggcgaggccaagcagttcgccgccgactggaagacggcaacggggcagtgagggaaaggcgacacggctcgtgctgacaccgtccccgcaggcgcaggagctgatgaaggccctcaccggcatggactggccgtccatcaacgaggacgagctgcgcgaggccgcggctctctacgaggccacggcccgggacttcgatgtcatcgagaacgccctgaacgagctggcgaagcggatcaacgcggacttcgcgggcgaggccgcctcgaagttcgcggcctacgcgtcgctgatcagcggcggcgaccccagctccctggccgcgatgaaggagcaggccgccaacctggcgaacgtcgcgcgtgagacggcgaccgacgccgagtacgcgaagtggatgatcctcgcccagctcatcgaactcgtcgcggaactgctgttcctggccgcggtgtggtgggtgccgttcctgggcgaggccgtcgccaccgaggcgtcgctcctcgagacgatcgtcagcatgctcgtgcccaagatgatcgagggcctggtcaagagcatcgccatgcacacggtgatgagcgccgcgctgggcgtcgtcatggactccctcatccagggcatccagatcggtcagggcaaccgccacgactgggacggcaagctgacgctgcaggcgctggagtacggggccgtgcagggtgtcatcggcggtgcgctgggcttcgccggagccaaactgggcatgaagctcggcgggatcatcggcaaggacttcacctcggtgctcaagaccggcctcgccgagtccctgaccaaggtggccggttcggaggcggcggcgaagaagctggcgggcgccctcggcaacaccctcggcgacctcaacttccacctggccaagggactcaacaagtccgcaggcaagaagttcaccgccgagttcagcacgaagatcggcaagctgttcgccaagcacggtatcggcggcgcgagcggtgagacggcgcacctcatcggccaggcctgggcgaaggacctggtcaaggagtgggcgggcgccgagtccgcgggcgccttcggcgcgcaggtccgcaagaccttgggcaacacggtcgtcggcgaaggcgcggcgaagctcaccgcggacaagctgctcggcggtgcggcggtgaaggtcctcgcggacgacatcccgcagctgctgaccaaggccggcatgaagcccgactggcggttcctggtcgggctctacggcaccgacatggtcgtccagggagcgtcgcagaacctcgccgagggcgccttcaacctcatcacacaggggtcgttcacgaccagcggcggcacgttcctcgcgggcttcctgaccaccgggatcggccacgccgggcgccacttcctggtgcaccccgcgatccactacttcgccaaggacagcgccggcgtgtccaagttcggccagcacctcgcgatgctcagcagccccgaccgcggtccgctcgccttcctgaacacaccaggaccgaaggcggaagcaccgctcacacccatgccgacgccggcaccgaccgagtccacgccggtgaacaccaggggccccgaagcgatccccaccacgaccgcgggcacctccgccgcatccagccccacctctacgtccacgagtacgaccgcgcccgtgtcggccccccaaccggtcacgacctcctcgtccgccccgtccgtcgcgacgccacaggcgaccacctcggcgcccccgaagacgtcggtcaccgccaccccaccggctggggagcagccgaagaccgccccgggcacctcaccggtgccgcagcagcaccgtccgctcaccgagagcacgacaccgcagaacgtgaccccgccgacgcggacgacggacacactcgcctccccctccgcggaccagcacacacaggagaaccaccccgcctccgaccaacaaccctccgagcagcacaacccccaccagcagtcctcgcaggagcacaccccgcaccaacagccgtccgagcagcacaccccgcaccagccccccgcccaccactccccggcgcccgacctcgacggcacctcccacgaccccgcgcgcgaacgcacctggcacgaacggcagaccgacctcacccagcggcgcgacaacgcgctcgacgacgcccagcagcacgcccaggagcaccagcgcgcccagcacctcgacgccgtactggacgagtggagccgcaaacacggcgtcgacgaccccgagacgctccagcgactgcgtgacaccctcgacgggcggctcggcccggcgcaggatccagatgtcacaccgaccccggacctgaccgtcgcgaagcacccgatggccgccctcgacgacgcctacgccctgcaccagcaggtcgacgacgtgatcggccagatcaccgaccacaccgtcaccacggtcctgaacgcacctcccacggccgccgcccggatcttcaccgcccacccggacagccgggccggcgccgagcagcatctgcgcaaggtgatcgaccggcgggtccgcgaggtcgccgaaagcctgatccaggccgaactgacctccgcccacccgcgccccgaccgcatcgggcaagccgtcaagacagccatcgcctccgcgctcccggccctgcacgacctcactgtgagcgccgcccgccaggcccgcgaccggggcctcgcggacacccacttccacaccgtcttcgaccagctcaccgcccagttggacgaccccgcgcaccgcgccgagaccgacaagcggcgcggacacctgctgcaccagtggggcctggagttcgaggacgactggcacgacaccttcggcgaaccggcgatccgccggggcaccgccgacaccgccaccttggacaagtggcgcgcgctgcgcgaggaacggcaccagtcgctggccgaacggctggtgaagcagctcgccaaggagcacgccgcacacatcgccgtccagcagaccgagaccgccgcccatcagccccgtaccggactggcgacactgggcgaccacttcacggccgagttcacggcacacctgccgtcccacgggcccgcccccgcggcagcccgcaaccgggccgcccacaccgtcgggtccgccctgcacacccgcatcgacaaccatgaacagggcttcggtaccgacctgaaagcggcgttcacgttcgcggcggacctggaccccgcggccgtgcaccaccaggtgaccctggaagccgtccacaccgcactgcacaccgcggcggaggccgaggcccgccgtttcgccggccagtgggcgaaggagcaccccggcacccccctgcccgacgacgccgtcgagcgtttcgcccacgcccacgccgaggccgtcacgcacctcttcgacgagcggttcaaccggcctctcacggaaaccacggcgaccgccgagacgctccagcagtggcgcgacgcgcacgccgagctgacgagcggcctcggcctgcggtggtccttcgaactgcacgcggcgctcggcctggaccgctgggcggccgggttcaaggaggccgccgagggccgcggcctctcccaggaccagctcacgcagctcggacgccagacccgcgacgagtggttcgagtccttctacgacctgtgggcgcgcggccacctgcccggccttgacgtccacgcgtggctcgccgaggagaccgcgcacggcaagcggttcgtgcccggcgccaccggccagggcggccacgacgacacccagctgcccggcgggaccggcgcgcagcacctcgacggcccggaggacaccgctcagcccccggctcagcccaccgccgagcacaccgaagacccgggcggcacccccggcccgctcgcc

SEQ ID NO: 823 - DNA, 1660 bp, Unknown
  Kingdom: Bacteria, Phylum: Actinobacteria, Class: Actinobacteria, Order: Streptomycetales, Family: Streptomycetaceae, Genus: Streptomyces
gacacgggcgaggcggtcgtgccacgggcgcgggcggcggtcaggctcgtgacccgcaccagttcgccctgggccagggccagcaggtcggcgaggcccaggcccacggcctgggcctcgccgacctgctggccctggcccagggcgaactggtgcgggtcacgagcctcaccgcggcccgcgcccggggcacgaccgcctcgtccgtgtcctcgctgtcctcggcgccgtccgcctcgcccgcccccgcgtcccgtttcgacgggctctgcctcgccgcctgacagcgccgtcctggccggcgcctcagactgtggcgaggcgccggctcagtacctcgtcggccaggccgtacgccaccgcctcgcgggcggtgaacaccttctcgcggtccatgtcggcgcgcaggtgcgcgacgccgtggccggtgtgccgggacagcacctcctccacctgggagcggatccggaccatctccttggcctggagcgccaggtcggagacggtgccctgccggccgcccgcggcaggctgcccgagcagcacccgcgcgtgctccagcacgaaccgccgccccgggtccccgcccgccagcagcaccgccgcggtggagaccgcctgtcccacgcagaacgtggagatcggcgaccgcacgaacgtcatcgcgtcgtagatcgccatgagcgaggtgaaggagcctcccggcgagttcaggtagatggcgatctcctgctccgggttcgccgactccaggtggagcagttgcgcgatgacgacgttggcgacgccgtcgtcgatctccgtgccgaggaagacgatccgctcgttcagcagcctgctgaacacgtcgtaggaccgctcgccctgcgccgtccgctcgatcacgtacggaaccgtgtacgaccccatgtcaccaccccatccgtcggtgcgcggacgggcggacgtcggtcagcgactccaccacctggtccaccatcccgtactccctggcctgttccgcggtgaaccagcggtcccggtcaccgtcgcgcgagaccgtctcctcgctctgcccggtgtgctgggcggtgaggcgttcgatggtccgcttcgtgtgctccaggttctccgcctggatctcgatgtccgcggtggtgccgccgatgcccgccgacggctggtgcatcatgatccgcgcgtgcggcagcgcgaaccgcttgccgtgcgctcccaccgtgagcaggaactggcccatgctcgcggcgaaccccatggccagcgtcgacacgtcgttcgggatgagccgcatcgtgtcgtagatggcgagccccgcgctgacggaaccgccggggctgttgatgtacaggctgatgtcggcgcgcgcgtcctcggcggacagcagcagcaactgggcgcacacgcggttggccgacacgtcgtcgacctgcgtccccaggaacacgatccgctgcgcgaggagcaggctcgccagatggtcgtcgaagcggctgggcggcgtgtcgccctcctcggcgcgtggtggcagggcggtgagtggagtcatcgggaggtctcctcgtcgtggcgtggatgccgtcgactccactgtcggccgcgtgcggccgactctgatggtttctctgcccgtggcagatctgccacgggcagagaaaccatc

SEQ ID NO: 824 - DNA, 1095 bp, Unknown
  Kingdom: Bacteria, Phylum: Actinobacteria, Class: Actinobacteria, Order: Streptomycetales, Family: Streptomycetaceae, Genus: Streptomyces
gtcccggggccgagacgttcggccccgggacccggacggacgtcctgctggcgctgcgccgggccgcccgggcctggcctcccctggctccgctgctgtcggcgaccgtgccggacaccgtcgaactcgcggacgaggacgtcgccgaactgctcggcgagggcatgcgggcgctcggcgcggccggggtggaggtgcgctggcccgcggcgacgacccgcgggctggcctccggcgcgaccgtcggaccgcccgacggcgcggaggattcccggggcacctcgccggggcccggagcgccgctgtccgccgacgcgccgctcgccttcgactggtggttcgcgctgggcggccagcggctcacgcgggaggagctggaccgcctggcggaggcgaaccggccactcgtcaggctgcgcgaccggtgggtgctggtcgaccccgacgaagtacggcgcgccaggtcccggcaggaccggaagatcacctccgtggaggccctgggcgccgctctgacgggctccgccgagatcgacggcgaccagatcgaggtccgccccaccggatggctggcggccctgagggaccgtctcacgggctctcaggccgaggagccaatcgcgcagccggccgcgctcgacgcccggctgcgcgactaccagctgcggggcctcggctggctggcgcggatgacgtcgtccgggctcggctgctgcctggccgacgacatgggcctcggcaagacgatcacgctgatcgcgctgcacctgcaccggcagcaggaccccgcggcgagcggtccttcactggtggtgtgcccgacgtcgctgatgggcaactggcaacgcgagatcgagaggttcgcacccgggacaccggtgcgccgcttccacgggacgcggcgcgacctggcggacctcgcggacggtgagttcgtcctgaccacgtacggcacgatgcgcctggacgcgccgcgactggccgaggtggcctggggcatggtcgtggccgacgaggcccagcacgtgaagaacccgtactcggccacggcccggcagctgcgcaccgtcggcgcacgcgcgcgcgtggcgctca

SEQ ID NO: 825 - DNA, 1579 bp, Unknown
  Kingdom: Bacteria, Phylum: Actinobacteria, Class: Actinobacteria, Order: Streptomycetales, Family: Streptomycetaceae, Genus: Streptomyces
caggcgcacggcgaaccgcgcccgccgctgcgccgtgcgcggttcgccgtgcgcctgcctcaggggccgctcctgctgcgatattgccactgacccgacggaaggtggcagaaccgtgcagtggacgaaacagaacgaacagactgtgtacgcaaaccgctggttcaccgtcaacctcgcggatgtggcgctgccggacggccggcacctcgaccacttcctcatacggctgcggcccgtcgccgtggccaccgtggtgaacgacgccaacgaggtcctgctcctgtggcgccaccgcttcatcaccgacagctggggctgggagctggcggccggcgtcgtcgaggacggcgaggacatcgcgcacgcggcggcccgcgagctggaggaggagaccggctggcggccgggacggctgcaccacctgatgagcgtggagccgtccaacggcctcaccgacgcccggcaccacatctactggtcggacgagggcgagtacgtcggccatcccgtggacgacttcgagtcggaccgccgggaatgggtccccctcaagctcgttcccgacatggtcgcccgcggtgaggtcccggccgccaacatggcggcggcgttactgctcctgcaccacctgcggctcggacaggacaccccgcccggacgcggaggcaggccctaacggcccagggcctgccacagggccacgaccagggcgcccacggccgccagtgccgagacggcgggcagcggccagcgggagtgctcgacggtgacgagccgcgcgctcagctcgtcgacctctttcgcggtctcctcggtgcgatggttcagcagggccagtccgccctccacgcgggcgtacgccacgtccagacggcgtcgtaactctgcgagttctccgggaacggcgggatgctcgggatcggcggtcacaggtccgctcctttccgtagtcgtctcacatcccttgcatgtgcatgaggagtcaacccgcctggtgggcgcgaggggagagtgtgcgaacggcatatgcgagcccgccgcgcacacgccgtgtgaacgacgcgggcccggcaccttcccggtgccgggcccgtggggcgtcgcgctgcgtggtcagccgtaggtgtggctgccgtggtcagccgtacgtgtagaagcccgagccgctcttgcggcccagccggccggcgtcgaccatgcgctggagcagcgggggagcggcgtacagcggctccttgtactcctcgtacatcgagtacgcgaccgaggcgaccgtgtccaggccgatcaggtcggacagcttcagcgggcccatcgggtgggcgcagcccagctccatgccgttgtcgatgtcctcgcggctggcgatgcccgactcgaacatccggatcgcggagagcaggtaggggatcagcagcgcgttgaccacgaaaccggagcggtcctgggcgcggatcgcgtgcttgccgagcaccttctcggtgaacagctgggcccggctcagggtgccctcggacgtggtgagcgccgggatcagctcgaccagctgctgcaccggggccgggttgaagaagtg

SEQ ID NO: 826 - DNA, 4615 bp, Unknown
  Kingdom: Bacteria, Phylum: Actinobacteria, Class: Actinobacteria, Order: Streptomycetales, Family: Streptomycetaceae, Genus: Streptomyces
  misc_feature (487)..(589): n is a, c, g, or t
gcgacggccgcacgccgctgtacgacaccctggagaccaactggttccgcggcgagcagcagcaggcgggcgcgcagagcccggcaccgcagcagcaggcgccccagcagcaggctccgcaggcgcccgcggcctcccaggcccctgccgcaccccagcgtcccgccacctccgcctggcgcagctcgccgaacgacgaactcgtccggcaggcagagcgcgtccggcagccggcggcgggcggcgtcaccacctccggcctgccgcgccgggtgcccagggcgaacctcgtcccgggcacggctcagcagcaacagcaccagaacggtccgcaggtctcgcgtgcgcccgatgaggtacgcggccggctgaccaatctccgtcggggcatcgcacagggtcgtcaggccggcaccggccagacgggcagcttcccgagccccactcaccagcaggagcgttagttgagcccgatgagccaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagatggcgctgctcgtcgaccgcgcgggggctgtcctcacgcccgacctgcgcgctgaactacagggcagtctgctccactgaccggccccggcaccacccgcgtcaccaaatcaccgtccggccgccacaatccccccaccggcccgtccgacggcttgcccgaccgacttgctgtcccgcccggaggattcatgaccccgcccaccgcccatcatgatccgtacgccgagccgtacggggacgagggcgaccagccgctggttcgtccgtacgcgatgaccggcggccggacccggccgcgctaccagctcgccatcgaggcgctgatcagcaccacggccgacccggcagcgctgatgggactgctcccggagcaccagcggatctgccatctgtgccgcgaggtgaagtccgttgccgaggtgtcggcgctcctggcgatgccgctgggtgtggcccggatcctggtcgcggacctggccgaggccggtctggtggccatccaccagccgggtggcgacgagaacaacggtggcgcaccggatgtgacgctgctcgaaagggtgctcagtggacttcgcaagctctgacgggggccgggccaccacctccgcgaagatcgtggtggcgggtggcttcggcgtcggcaagacgaccttcgtcggtgccgtctcggagatcaacccgctgcgcaccgaggccgtcatgacgtccgcctcggcgggcatcgacgacctcacgcacaccggggacaagaccaccaccacggtggcgatggacttcggccgcatcacgctcgaccaggacctgatcctgtacctgttcggcacgcccggccaggaccggttctggttcatgtgggacgacctggtgcgcggtgcgatcggcgcggtggtgctcgtggacacccggcgcctggccgactgcttcccggcggtcgactacttcgagaacagcggcctgccgttcgtcatcgcgctcaacggcttcgacggccagcagccgtacacgccggacgaggtccgcgaggcgctgcagatcggtcccgacgcgccgatcatcaccaccgacgcccggcaccgcacggacgccaagtcggcgctgatcacgctggtcgagcacgcgctcatggcccgcctgaggtaacaccgggacacatctcgcatagcgcccaagtcggcaaggccatacggcagttgtcgtagacgcaccggagccggctgtgtcgtttgacacggccggccccggtgttcataacgtttcggcagaggaatcgggtggcaccgccacgcgtcgcacacatgtggtctcactgcgcacatgagcatcccgctttttgacgcggctcgctctttatgaccgttttatctaggacttacatcacttcgaatcagtggtttccactgtttggaagagcgcatgtcggcgtgctggaatgcctgaactgccccatggtcgtagacgtactcctcagtacccccggttccctccggtcctggagtcgtccgcggcggacggggcgctgagacactgcggcacagcgtaggtgccgaccgccgagaggttgttggtcgagtgaggcgaagcaagaacggccccgagccgtcggcacggggcaacttcaccccgccgcagcgcggagcggcgccgacgcacgtgcccggttcggagccggcggccactcccacgccgagcgggggacgcctctccccgcgcaactggcgggtgcccacccggctgaacgcgatcctgctcatacccgtgctggtcggcctcgtcatgggcggcttccaggtcaagagctccatcgacacctggcaggacgcccaggacgccgagaacaccgcacgcctggtgcgggcctccctgacctacgccaacgccctctacaacgagcgcgacaccagcgccgctccgctcctgcagggcaagggcgcgaacgacccggccgtcacccaggcccggcacctcaccgaccaggccgccgacgccttcgaccaggccgccaagagcatgccgcacaaggccggcctggagcgccggctgaagctgttccgcgagaccgagccgcagctgcggtcgctgcgcgccgccgcgtacacctccaagctgaacggcgtgcagaccgaggagggctacgtccaggtcgcgcacccgctgatggagttcgccaacgaactgggcctgggcaccggcaacatcacctcctacggccgcacggtctacgccatctcgctgaccaaggccgccctgtcgctggaacgctcgatcggcatgcacctgctgatcaagccgggcccggacaacggcaacctggccagccagcgcatcgccctgtcctcctacgcctacctggagaacatcgccctcgaggagtacctcggcggcggcacccaggccgacgcggaccggctggacgcgcagaagaaggacatccaggccaaagccgccgccctggcgcaggacgccaagggcaaggacccctcctacgtgcccccgccgtccgacccgcagaagatggtcacggcgctggccacgctgaaggacaccgacgccgccacccgcgaggcgctcgccgccaagggcgtcaccgcgcagaactggtgggccgtcgacaccctcaagttcgacgcctaccgcaagatcgagtcggacatggccgacgccgcggtgaacgaggccgccggcatcgccgacgacgccaagcagtcgacgttcatcaccgccggggtcgtgctggtcgccctccttgccgcgttcatcctggccgggctggtggcccgccagatgagccgctcgatgcgccggctgcgcaacgccgccttcggcatcgccgagcagcgcctgccgatgctggtcgaccagctctcgcgcaccgaccccggccgggtcgacacccgggtcgccccgatcccgatcacctcgaccgacgagatcggcgaagtcgcccgcgccttcgaccaggtgcaccgcgaggccgtccggctggccgccgagcaggccctgctgcgcggcaacatcaacgccatcttcaccaacctctcgcgccgcaaccagtcgctgatcgagggccagctgaccctcatcaccgacctggagaacaacgaggccgacccggaccagctggagaacctcttccgcctggaccacctggccacccgtatgcgccgcaacggcgagaacctcctggtcctcgcgggcgaggagcccggccgccgctgggaccagccggtcccgctggtcgacgtgctgcgcgccgcctcctccgaggtggagcagtacgagcgcatcgagctgtccggtgtccccgaggccgagatccacggccgcgcggtgaccgacctcgtgcacctgctggccgagctgctggagaacgcgaccacgttctcctcgccgcagaccaaggtccgcgtcaccgcgacccggctgcccgacggccgcgtcatggtcgagatccacgacaagggcatcggcctgaccgccgaggacttcgcggacatcaaccacaagctggccaacccgcccaccgtcgacgtggcgatatcccagcgcatgggcctgttcgtggtcggccgcctcgccgaccggcacggcatccgcgtccagctgcgcccctcgggcgagcaggccggaacgacctcgctggtcatgctgccggacgccatcacccacggcggtggcggcgaacagggcacgggcggcgacgagttcaccgtctcgcagatcatctccgagcagcagttccggggcgaggacttcaaccagagccagctgccgccgatgcgcaccgcggcggaactcggcttcgacgacagccgctacaccgaggtccccgacgacatccgggacctggacccggtcggccgctcgctcaagcgcgaggagcgccgcgcgaccctggaggcccaggcgcaggacgccccggccgccgccgagtccgcggcacagcagcagccctacgacaccggtcagcagcagtacgacaccggtcagacggcctacccgcagcagggcggctacg

SEQ ID NO: 827 - DNA, 2197 bp, Unknown
  Kingdom: Bacteria, Phylum: Actinobacteria, Class: Actinobacteria, Order: Streptomycetales, Family: Streptomycetaceae, Genus: Streptomyces
gtgaagatctcccgcagccgggcgaccggctgcgggagatcttcaccgagatgggcggctcctgcgaactgaccgactacgggctggtgttcaccggctcgggagcggtgcacggcatcgacgtggacctgggcgaggtcggcgagctgaccccgggcatcacggccgtcgccgcgctcgcggactccccctcgaccctgcggggcgtggcccacctgcggctgcacgagaccgaccggctggccgcgctcaccaaggagatcaacgaactcggcggtgacgtgaccgagacggccgacggcctgcacatccgcccgcgcccgctgcacggcggcgtcttccacacctacgacgaccaccgcatggccacggccggtgcgatcatcggcctggcggtcgagggtgtggagatcgagaacgtggcgacgacggcgaagaccctgccggacttccccgaactgtggaccgggatgctcggggcgtagggcgcggggaacaggtcatgcgccgctacggcaagcacaccgacgaggacgacatccgctcccggcccaaccgccggggcaaccggccgcgtacgcacatccgccccaagcacgaggacgccgccgacggcatggtgctcaccgtcgaccgggggcggctgacctgcctcgtcgacggccgtacggtcgtcgcgatgaaggcccgcgaactgggccgcaaggccgccgtcgtgggcgaccaggtggccctcgtcggcgacctgtccggccagaaggacaccctggcgcgcgtcgtccgcatcggcgagcgcacctccgtcctgcgccgcaccgcggacgacgacgatccctacgagcgcgtggtggtggccaacgccgaccagttggccatcgtcaccgcgctcgccgaccccgagccgcgcccgcggctgatcgaccgctgcctggtggcggcgtacgacgcgggtctcgacccgctcctggtgatgacgaagtcggacctggcgccgccggacaagctcctggagctgtacgggacgctcgacatcccctacgtcgtcaccagccgcgaggaactggagaccggcggggcggcggaccgggtgcgcgagcatctcggcggccgggtcaccgcgttcgtggggcactccggcgtcggcaagaccacgctcgtcaacgcgctggtacccgaggagcgccggcgcacgacggggcacgtcaacgccgtgaccggccggggccggcacaccaccacctcggcgctcgcgctgccgctgggaggcggcgagggctgggtcgtggacaccccgggcgtacggtcgttcggactcgcccacatcgacccgtcccgggtcatccacgccttcccggacctggagcccggcacggagggctgcccgcgcgcgtgcagtcacgacgagccggactgcgcgctcgacgcctgggtggccgacggccacgccgacccggcccggctgtactcgctgcgccggctcctggccacgcgggagcgcacggagggcgactgacggcggtcgcgggcggtcgaaccgcccccggcgatcgcgttgtttgccgcacccacgggcaggtaagtgcataatcgcaccgagccggagcggccacggaacgcgcacacacgggaggacagcacatggcgtggctgctggtcatcgtcgcgggaatgctcgagaccggcttcgccgtctgcctgaagctctcgcacggcttcacccggctctggccgaccatcgccttcgcctgcttcgccctcggcagcttcggcctgctcaccctgtccctgcgcaagctcgacgtgggaccggcgtacgcggtgtggaccggcatcggtgcggcgggcaccgcgatctacggcatgatcttcctcggcgacctggtgtcgacgctgaagatcgtctcgatcagtctcgtcatcctcggcgtgatcgggctgcagctgtccggttccacgcactgaccactcatggggcacggctccagcgccgtggctcaggcgggcatgtgacggtgcagcacgccgtgcacgaggtcgtcgatccccgcgccgcccggcggggccgcgacgcaggacagcgcgaggcggaacaccagttcgcagacaccggccagttcggcccgctccgcccccgtcgctcccggctcggccagggccgccacggcgcggtcgcggaccgtcgcgagaaggtcggcgg

SEQ ID NO: 828 - DNA, 3115 bp, Unknown
  Kingdom: Bacteria, Phylum: Actinobacteria, Class: Actinobacteria, Order: Streptomycetales, Family: Streptomycetaceae, Genus: Streptomyces
atgccgtacggctctccgtggcgtccgggtgcgcggcgggcgcggtcgtacgtccctcgatcgcggcggcgatcgtcccggccgtcaggaccagtcccgtcgcgccggtgcaggagacggcgatgtctgcacgtgtcagctcggccggtaccgcgtccatcggtaccgcgcgggccggcacgtacgtgtcgtcgccctcggtgaggatccgcgcgaggcgctcggcgcgctcctgggtgcggttggcgatgacgatctcgccgacaccggcgcgcgccagcgtggccgcggccagcgacgacatcgagccggcgccgatgaccagggccttcttgccgcgcgcccagtcggtgacggccgcgcccgcggacagctgctccagaccgaaggtgaccagggactgcccggcgcggtcgatgccggtctccgagtgcgcccgcttgccgaccctgagggcctgctggaacaggtcgttcagcaggcgcccggcggtgtgcagctcctgcgcgcgggccagggagtcctttatctggccgaggatctggccctcgccgacgaccatcgagtccaggccgcaggccaccgagaacaggtggtggacggcccggtcctcgtagtgcacgtaaagatggggagtgagttcctccaggccgaccccgctgtgctgggcgagcagcgtggacagctcggcgacaccggcgtggaacttgtccacgtcggcgtacagctcgatgcggttgcaggtggccaggacggcggcctcggtggcgggctccgcggcgaccgtgtcctggagcagcttgatccggtcgtccgtgttcagggaggcgcgctccaggacgctgacgggggcgctgcggtgactcagaccgacgacgagaaggctcatgccggcatcacggcggggacgtccccgtcgggtccctggtcggcggagtgcttccgggcggcagcggcggcgggcaccgcggtctcggcggcggcctcctcgccggccttgcgctgctcgtggaaggcaaggatctgcagttcgatggagaggtcgaccttgcgcacgtcgacgccctcggggacgttcagcacggtcggcgcgaagttcaggatggaggtcacgccggcggcgacgagccggtcgcagacctgctgggcggcgcccgcgggcgtcgcgatcacgccgatcgagacgccgttgtcccggatgatcgcctccagctcgtcggtgtgctggaccgggatcccggcgaccggcttcccggccatcgcggggtcggcgtcgatgagcgcggcgacgcggaagccgcgcgaggcgaaaccgccgtagttggcgagcgcggcgccgagatttcctataccgacgatcacgaccggccagtcctgggtgagccccagttcgcgggagatctggtagacgagatactcgacgtcgtagccgacaccacgggtcccgtaggaaccgaggtaggagaagtccttgcgcagcttggcggagttgacgcccgccgccgccgccagttcctcggaggaaaccgtggggaccgagcgctccgacagtgcggtcagggctcggaggtacagcggaagccgggcgacggtggcctcgggaatccctcggctacgggtcgccggtcggtgagttcggccagttgccacggtgctcctgcgggtagagcggggctgtgggcggtcatacgttcccagaccgccccgtcgacagcaggctatgtctttgtgaacgcgtgcacaaagatggtgtccgatttgcccggccaacgtgaccggggtcacgcgcccccgacgtgaacatgcggaaccgacgcacccgcgcccgcgttccttactcgttgggggcaaaaccgcacacgctccttcaagatcaccgcccccgagaccaagtcgccgtcgatcctaagcgactttcggccactttgtacccaccggtcagttgccgtacggccacccggaccccctggaacccctcagccggccagctcgcggcgcagccgttcctcgttcacccgccagaaggtgtgctgctccccgtcgatgagcacgaccgggatctgttcccagtactggtcgtgcagctgcggatcctcggtgatgtccttctgctcccagcggacacccagatccgcgcacaccttctcgacgaccacctgtgcgtcatcacacagatgacagccgggcttgcggatcagggtcaccagccggtcctggggagcggagggcttgcggcggaagagcggactcatgcgggccattgtcgccccggcgccccgcccgcttccaggaccgcccgcgcggtcgccttcgtggcgcctgcgccgagggaccccgccggtcccttcggcgaggcccctcactgatccctttaacggcgcggtcgcgcagagttcacggcgtccgaacctcgcggctccggaacccccgaacagactggctatgctcacgccatggccgctctcggatggctcaccccccgtaggcgctccgccaccgcgcggagcgtgttggcaggcgaggcctcggcggaggcagcgcgcaagtccacccaggagacggacgtcacggcgcccgcactggcggaaccggagttccccgtgcccggcgacgaccgcgccgccgccttcttcgacctggacaacaccgtgatgcagggcgccgcgctgttccacttcggccggggcctgtacaagcggaagttcttcgagacccgcgacctcgcccggttcgcctggcagcaggcgtggttccggctggccggcgtcgaggaccccgaacacatgcaggacgcccgcgactcggccctgtccatcgtcaagggccaccgcgtctccgagctgaagtccatcggcgaggagatctacgacgagtacatggccgagcgcatctggcccggcacccgcgccctcgcccaggcccacctcgacgccggccagagggtgtggctggtcaccgcggccccggtcgagatcgcccaggtcatcgcccgccgcctcggcctgaccggtgcgctcggcacggtggccgagtcggtcggcggcgtctacaccggccgcctcgtcggcgaaccgctgcacggcccggcgaaggccgaggcggtccgcgccctcgc

SEQ ID NO: 829 - DNA, 1893 bp, Unknown
  Kingdom: Bacteria, Phylum: Actinobacteria, Class: Actinobacteria, Order: Streptomycetales, Family: Streptomycetaceae, Genus: Streptomyces
cggcctcgtggcgcacgccgttctgcacgtccatcacggcgtgcgccacgaggccgcccatcgggtcgtgccggatcaggtcccgcagccgggaacgggacgagcgcccttcgttgcccggatacaggtgcttgccgagaccgaccgcgtgggccagtgcggcgagcgccgcggtccgcgggtccggcggaacgccggtgcggatcgcggagtcgagccgggccctgatctcccggctgatcgcgttgtccgtcgcctgatagcgagtcgtcggcagcaccccgcacatctgtccggccacggcgtgcaccatgccgcaccgctccagatgcgagagatacgtctggcggagcccgagacggggcccgccgatccagtggacggcccgtaccggagcgccgcgccttcgcagcaactccaacgcgcagtccagagtcggatctcctgtcggccgtggtaccaccacggcgatacgatccccgtccggggctatccgtccggccagcgccagctccactagctgcgctccggccagacccaggtcgagcgactgcggctgtgcagtggtacccgtggccgggtccagtgccagcagcagaagctcctccggaagtgttctgcggctcctgcccatccatgcctccccgcgtggatgaatgacagggtgacccctctcacattggtctgtcgagggtgcgtgaccgcttcgtagtggaaccagtaggtatgtcgttctcgtcttccgctcgggtttggtccgcacacaggacactggtacatggttcggacagcggtacgaccgcgtggtacaggcggtcgtagggccactgctccggccggtcggtacggctgtcgtgcgggcggcggttcacggttcgtagcggcacgcggggcgtgcggcacatggaggaggcatcggtggcgggcgagtcccccgacaggtcgaagcagcgcgagtcgtcggcagaaccgacgtcggggagcgcgggtccggttcccggggccaggagcgaggcagacgatgcccgcgatcctcgcctcacgttggcgggggagtccggagcttccggtacgtcccgtacgtctcgtacgtccgacgggtccggcgcatcggatgcggcggagagccgcggcggcgtggatacggccacgcgagtgctctcggtgcggggcgtggtgacggacgcgaagggcgacgcggactccgaggagtccccggcgtcctcggagtccggggactccgaggcttcggagtcggctgaggcggccgagggggcccgtacggcggactccggcacggaggacgcggaggcgaacggcgacgcgcaggaagggcagggcgagggcgacacgcgcctgcgggcggccgtggccgcgtgggtggactccggggattccgagaagtcggagaagtcggaggaggccgagaaggccgagaaggccggcgaaccggagaaggccgacgcgtccgagcgcgagcccgaagccgagcgcaagcaggccacggacgacaagaacgacaagaacgacaagaacggcgagggcggcaaggacgacaagaagcccgaggccgagtccaaggcgcccgagtccaagggcgagcccaaggccgcgcagcccaagccgcccgtcgaccagcccaccgccgtcttcaagacgcccaggcccgccgtcgaccagcccaccaccatgctgaagctgggcggcgcatccaagagcgacgcgaagagcggaccgaagggcgacgcgaagggcgacgcgaagaagggggccgcgaagcccgctcccgggtcccctgagtccgaggccgagcgcaccagcaagttcgtcgcgctcaagcccctcgacgacgccccgaaggcgaagcccgccgcgcccgccgggtccgcggag

SEQ ID NO: 830 - DNA, 1290 bp, Unknown
  Kingdom: Bacteria, Phylum: Actinobacteria, Class: Actinobacteria, Order: Streptomycetales, Family: Streptomycetaceae, Genus: Streptomyces
ggtggcgacgagcgagccgagtgcggcgcccagcaggacgtagccggccagcggccacaggtactcccggcgcagccggccggcccggtgctgtgccacggtggccgagacggcgttcacgaccatgaccgcggtcgaggtcgcgacggccacgtgcatggcgtcggcgccgtcgccgtgcgcggtcgcgcccaggaagccgtagacgacggggacggtgacgaatccgccgccgaagccgaagagcaccgtggtgacgccggtcaggcagccgaacaggaggagggtgaggaacgaggaggtggtgagcacggtgacgacgctagggaccgacgcggctggcgggcaatcgactgtccgccaggttcttacgcgcagacgacagcgcgaggacagccggaggtgacgacggccggaggtagggtcgtcgcgtgcgcaacgtctccgtcgacgaggtggacggcctggaccgtgcggtgctcgccatcggcaccgactatccgcacgagcatctgctgcccttccacgagcaccggcgtgcccaggtgctgtacgcggccaccggggtgatggaggtcgagacggcggacggctcctggacggtgcccacggcccgcgcggtcctcgtcccgccgcgggtgcggcaccaggtcaccatgaccggcgtcagcacgcgcagcctgtacatcgagcccggcgctgcgccgtggttcccggtccgctgccaggtggtggacgtctccgcgttgctgcgggcgctgatcctggacgccgtcgacatggagccgcgctatgccgagcacggccgggacgcgacgctcgtcgagctgatcctgcacgagctgcgccatctgacaccgctcccgctcgacgtgccgctgcccgtccatccggggctgcggcggttgtgcgaggcgttcctgcgggctcccgacatccatgatccgccggcccgttgggcggcggccctcaacgtcagcgagcgcaccctgggccgtctcttcctgcgcggcacggggctcggtttcgcccagtggcggcagcgggcgtgcgtcctgcggtcggtgcacgcgctggcggcgggcacgccggtgacccgggtcgcggtgtcgctcgggtacgagaacccggccgcgttcacgacggcgttccgcggcctgctcggccgccctccgtccgcgtaccggccccagccgccgtcttcgcccgccgggcggggcatcagcgttcggtcagacggaacggatgacccgccggggcggtgagaacccgccaccgctcatccacggg

SEQ ID NO: 831 - DNA, 845 bp, Unknown
  Kingdom: Bacteria, Phylum: Actinobacteria, Class: Actinobacteria, Order: Streptomycetales, Family: Streptomycetaceae, Genus: Streptomyces
acgaggagaccgccgccctgcgcgaagccccagtcgagcagggcggcggtctcctcgtagacggcgttgctgccgatcccggggtgcatcacggtgacgagcagggtgcggccaccgcggaccgcggctccggtgaaggtgttcccggcatggctggtgtaaccgttcttcaccccgatcatcccgtcgtagggcctcaggcccagtgaaccggtcagcaggcggtcggtgttctggatctggaacgtcttcctcccgccggccgggaagttcgcggtgcgggtgccgcagtagccgcggaagtcggcgttgcgcagcccgtgccgggcgaacagggtcaggtcgtacgccgaggagatctggcccgggtggtcgaacccgtccgggctgaccacgtgggtgtccagggcctgcaggtcctccgccttggcctgcatctcggcgacggtgcgggcgacaccgccgttcatgtgggccaggacgtgcaccgcgtcgttgcccgagcgcaggaacaccccctgccacagctgctcgacggtgtacgtggtcccggcctggataccgacgagactggaaccggcggggatgtcggccagttcgtccgcggtgacggtgtgccgttcggtgcggtcgaacttcttcagcacggtgtccgcgaagagcatcttcagcgtggaggcgggcgcgagacgctggtgcgcgccgtaggaggccagtacctccccgctcgcccagtcggcgacgagccaggcgcgcgcggagagcttgcccggcaggccgctcaccccgcggacctgcactccggcacgggccagccgctcaccgccgatgacaggggtggcggg

SEQ ID NO: 832 - DNA, 3903 bp, Unknown
  Kingdom: Bacteria, Phylum: Actinobacteria, Class: Actinobacteria, Order: Streptomycetales, Family: Streptomycetaceae, Genus: Streptomyces
gcgtacgtcatctacacgtccggatcgaccggtgtgcccaagggggtcgccgtcgcgcaccgcgacgtcgccgcgttcgccgccgacaggcgctggcgcggcggcgcccacgaccggctcctgatgcactcgccgcacgccttcgacgcgtccacctacgagatctgggtgccgctgctcctgggcgggcaggtcgtcgtcgcaccggcggccggcctcgacgcaccgggcctgcgcgcgctcgccgcccgtcacgggctgaccggcgtcttcctcaccacggccctgttcaacctcatcgcgatggaggacccggccgcgttcgcgccgctgcgcaccgtcctgaccggcggcgaggccgccaacccggcggcgatgcgccgcgtccgcgcggcctgccccggtctcgccctcgcccacgtgtacgggccgaccgagaccaccacctacgccacctgcttcccgctggacaccgtcgacgacgtcccgcccatcggcacccccctcgaccacatgcgggcctacgtcctcgacggctgcctgcgcccggtcccggcgggcgtctcgggcgagctgtacctcgccggtgccggtctggcgcgcggctatgtgcggcgccccggcctgaccgccgagcgattcgtcgccgacccgttcgggccgcccggcacccgtatgtaccgcaccggagacctggtgcggcggcggagcgacggcgccctggagtacgtgggccgcaccgaccaccaggtcaaggtgcgcggcttccgtatcgaacccggcgagatcgaggccgccctgatggccctcgacggtgtcgcccagaccctggtgctcgtgcgcgaggaccaccccggcgcccgccgcctcgtcggctacgtcgccgcggacggctccgtcagcggccccgacctccgcgcccggctggccgtcgacctgcccgagttcatggtgccgtcggcggtggtggtcctcgacgagctgccgctgaccccgaacggcaaggtcgaccgggccgcgctgcccgcccccgagtccaccgtcaccggcggtggccgcggcccccgggggccgcgcgaggagatcctcgccgccgccttccacacggtcctcggcaccggtacggcgggcgtcgaggactccttcttcgacctcggcggcgactccatcacggctctgcaactggtcgcccgggtccgcgaggcgggcctggtcatcagcgcccacgacgtcttccgcctccgtacggccgccgccctcgcgcaggccgcacaggaacccgcggacgagctgccgccgcccgaccgacccctgatcgagctggacgacgacgaactggccgcactcgaagcggaactcgcgctcgaggcgagcgacgccctcgccgacggcctccccacggaagcgggccgctgacatgacactcaccgcacccgacgccgccgcccggccgcgcccggcccgctccctgccgcccgggatcgaggaactgctcccgctctccccgctccaggagggcttcctgctcaacgccgacgaggccgaggcggccggcacggccgacgtgtacgccacccagatccgcctcgacctcgacggcgacctcgaaccggcccggctgcgcgcggccgccgcccgcctcctcgaacggcacagcggtctgcgcgccgcattccggcacaagggcctcaagcggccggtgcagctcgtgcaccgccaggtcccgctcgcctgggaggagttcgacgccgaagcggacggcggggacgagcgcgaggccgtgcggatcgccgccgcgcagcggacccgcggcttcgacctggcccggccgccgctgctgcgcttcgccctgctgcggctcggcccccggcgccaccggctcgtgctgaccgcccaccacatcctgtgggacggctggtcggtgcccgtgctgctccaggacctgttcacgctgtacgccgacgggccgcacaccgtgctgcccccgcccgtcccgtaccgctccttcctcgcctggcagcgtgcccaggaccagggcggtgcggagaaggcctgggccgccgccctcgacgggctcgccgagcccacccggtacgccccccaggcagccgacctgccgcccgccccgcaggacgaggtccgcgcggtgctccccgcggcggtcgccgaccggctcgacgcgcacctccgcccgctcggcgtcaccgccggcaccgtcgtgcagttcgcctggggcctgctgctcggccgcctcaccggccgcgacgacgtcgtcctcggcaccaccgtgtccggcaggccgccccagcttccgggagtggagcggatggtgggcatgctgctcaacaccctcccggtgcgggtccggctgtacgaggacgagcccgcgctcgccgcgctcgcccgcctccaggccgagcaggccgcactgttcgaccaccaccacctcggcctcactcggatccagcgggccgccgggcacggcaccctcttcgacaccaccaccgtcttccagaacttccccctcgaccacaccgccctcgccgccctcctggcccgcgcgggactcaccctcaccggccacggcatcggcgacgccacgcactatccgctgcggctggccgtcacccccgtcgacggcctggaactccggctcggccaccgcaccgacgtcgtgaccgccgccgaggccaccaccctgctcgaacgcctggtacggatcctgcggacgatcgccgccgaacccacccggcccgtgggccgcatcggcgtactctccgacgaggagcgcgcgcagctgctcggccggtggaacgacaccgcgggaccgctgcccgacgccaccctcgtcgagcgcttcgagcggcaggccgcccgcaccccgcacgcgcccgccgtcgtcttcggcggcaccatgctcacctaccgcgaactcgacgagcgggcgaaccggctggcacacctgctgatcgccgacggggcggggcccgaccggctcgtcgcggtcgccgtgccccgctcacccgacctcgtcgtcgccctctacgcggtcctgaaggcgggcgccgcctatctgcccgtggacccgggacacccggcggcccgtatcgcgcagctcgtcgaggacgggcggccggtcgccgtcctcaccaccaccggcaccgccggccggctccccgccaccggcgtgcccgtccggcacctcgacgccctcgacctgtcggcgctgcccagtacccggcccgccgccggaggccacccgtccgcgaccctcgacgacacggcgtacgtgatcttcacctcgggctcgaccggccgccccaagggcgtcgccgtcccgcaccggggcatcgtcaaccgtctgacctggatgcaggagcgctaccggctcacccccgaggaccgggtgctgcagaagaccccggccgggttcgacgtgtccgtgtgggagttcttctggccgctgcgggaaggcgccacgctcgtcatcgccccgcccgaggcccacaaggacgccgagcagctcgccgggatcgtccgggagcacggggtcaccaccgtgcacttcgtgccgtcgatgctcgccgcgttcctgcgcgagcccgccgccgcgcactgcaccggactgcggcgcgtggtgtgcagcggcgaggcgctcccgctggaccagcagctccgcttccacgaggtgctgcccggtgtcggcctgcacaacctgtacgggccgaccgaggcgtccgtcgacgtcacctcctgggagtgccggcccgagccggacgcccgctcggtaccgatcggtgcgccgatcaccaacacccgcgtgtacgtcctcgacgcgggcctgcgcccggtcccggcgggcgtcgcgggggagctgtacctggccggcactcccaggaggtg

SEQ ID NO: 833 - DNA, 2433 bp, Unknown
  Kingdom: Bacteria, Phylum: Actinobacteria, Class: Actinobacteria, Order: Streptomycetales, Family: Streptomycetaceae, Genus: Streptomyces
cgccggtcagaccggcggtggccgccgagccgatcaccgagacgaacgcgatgagcaggtactccttgacgcccatgtgcacgtggaagatctgcgccacgaagatcgcggagatggccgggtagatcgccgcgcagccgtccatcttggtcgtcgcgccgaacggcacggcgaaggaggcgtagtccttggggacgccgaggcggatcgccgactgctgggtgaccggcatggtgcccaccgaggagcgggagacgaacgccagctggatggcgggccaggcacccttgaagaattgcagcgggttgagcttgccgacggtggccagcagcagcgggtacacgccgaacaggaccagggcgcagccgacgtagatgtccacagtgaaggtggcgtagttgcccagcaggttccagccgtactgcacgatggcacggccgatgaggcccgcggagccgatcggggcgagcaggatcacccaccacagggccttctgcaggagctccaggatggactcggagagagtgaggatcggctgggccttcgggccgatcttgaggatcgcgacaccggcgacgaccgccatgaagacgatctgcaggacgttcagctcggtgaacggggtgacgacgtcggtcgggatgatccccgtgaggaagtcgagccagctgccggagtgctccggcttggcgccgtcggccgcggtgaggttcgagccggagccggggttggagaccaggccgatcgcgaggccgatgaccaccgcgatcagcgaggtgatcatgaaccagagcagggtacggccggccaggcgggccgcgttgttgaccttccgcaggttggtgatggacaccatgatcgcgaagaagaccagcggggccacggccagtttcagcagctggatgaagatgccgcccaccttgtcgagggtggtggcgagccaggacacgtcgtaggtgcgggcgacgaagccgaggaccagaccgacggcgagaccgatcaggacctgggcccagaaggggacgggtatccggaagccggacttcgcgggcttcggatcagcggtgttcgcggacacggacacactccagtaggacgcgcgggggcgggacgagcggggacgtacatacaggaagcagcgaccgtgaagaagtgtcaacggcgccgcagcatcggggagttcgcggtcaggcgcgacaagccgcggacatgcagcggcacagatcgacgtgcaggcgcgccacgagcggtacgcccgtgacggcgcggcggacgcccgcggaggcgtcggcgcggtgcgcggctgctgtcttcatgacaggaacgttaacacttgaactttgagaacctcaaagcgagcctttggcaaccatcggcacaccgccttgttgccggccccgtccgggcatggcgccgaggctggggcggggccggtggtgcgcccgtgagggctggtggcggtggcccgtcgccgtcgtgctcagcgccgcagcgcctcgaacgcgtcccgtgcgccggtcccgatggcgaggtcgatgtccggtgccagggcggccctgcggtcggagcgcgtcagggcggcgatcgccacccggtgcccggagcgggcctccaccacaccgatctcgtgcctcaggtggaggaacgtcccggtcttgccgctcacccgcagggtgtcggcgcgcagctcgctcgcgagccggtgcgtgaagacctgcgcccccatcagccgccgcagttccgcggtggcgcagggccgggagatctcgtcccgccagacgcgctgcagcagatcgacgagcgtggtggccgtacccgcgttggcgtgtgccggatccagcgtctcgatggtgtgccgcccggagtgggcgtcgcggacggccagctccagcgcgagggagaagtccttcccggccgcgccggcggcgcactcgtacatgcggttcatacggtgccggacccgcaggtgcccgcagccccaggcacgcaggcgggcgtcgacctccgccaccgggaccagcccgaagagcgcgtccgcggcggcgttgtcgctgaccgacagcatcaggtgcagcaggtcaccgacggccacggtggccgggtgccggaacgccgccagcccggtggggccgacactgctcgtggccgggtcgaccgtcaccgcacgcgcggcgtccagagcgccggccgcgatcaggtccagtaccaccagggcgagcggaaccttgacgaccgaggcgagcggcagcggcacgtcggtgtcgaacccgagctgctcaccggtgtcgatgtcgcgggcgaggaacgaaccgcgcacaccgatcgccgcccagtccgcggcgatcgcctcggccacgtcgagcagcgcgccgtcaccgacgaggtgcgcgggccggtacgcagcgctcggcagcgggtcgctcatccgtgcgc

SEQ ID NO: 834 - DNA, 2875 bp, Unknown
  Kingdom: Bacteria, Phylum: Actinobacteria, Class: Actinobacteria, Order: Streptomycetales, Family: Streptomycetaceae, Genus: Streptomyces
  misc_feature (2447)..(2531): n is a, c, g, or t
caccgaacgttccgtcagcaaacacatcggcagcatcctcgccaagctgaacctgccgccgagcgacagcggccaccgccgggtcctcgcggtgctcgcctacctgaacgcctgacctgcgtaccgcacgggtgtagcgggctacacctccggttcgggggaacggtccgatgtgccgaccgggggcacggggagaaggtggacgacgtaagagatcccacccccctgccgcccaccgggccgccgggggcgcacaccaggaggaacccctgatgaagcccgtgctctggctgctgctcctcatctccacggcggcggcggtctacgtcagcaccttcgcccactacaccggcaccacgagagtcctggccggagtcggcaccggcgtcgtattcgttggatcggcactgggactgtggctggccagcggcaagaagtgacccgtagcggcgagagcacctgaggagggggtgtccggcagcgagccggacaccccctcctcagctgtcacacggcaacaaggcgatcaaaacgatccgctgtgaacacgaagcaaccaggcccagcccgcgcagcagtacctcctggagaccctgggactggagcccgcccccgcctgggccgaggtggcggcgcggccggcgggacggcgggaggtcgcgcgcggtggacctggcggcggcgcggcagttcttcgagcgcgagggacatctgcgggtgccgcgcgaggcggtggaagtcctgccggacgggaccgaggtcaagccgggcagcgtcgtcgacaacaccgccgccgcgccactgcgttgtccggcgagcagcgcgcggcctggacggcgctcggcatgcgctggtagcggtcaggcgacgactctttcgaagctgcatctcacattttcctgcctgcaccccataacaaagggtgtcaacgggcgttgtacgtgacggcccggaccgcaaggtccgggccttgcccatgcccgccgggtcgtaggagggcttgacgggctagccggtcgatgtgccagagggggcacattcaaggcgccgcggtcagcaggttgtcccctgtcttgggctccacgcatccggggagggcgtattcaacagctgtggagagtcaggaagttgcggatcgggagtatggaacggctccggtgggcctggcagcttccttctcgctcaccgcacttgcacggctaaggccggaccctgcgaaggtgcgcacccaaagacttcccgcccctgctgctgtcctgccctgtaccaacgcagcaaaggggtgaaggaactgttcctcgccgccttggagttcgtcatgaccctcagcgtccccagcacagccaccagcatcgtcggcgccctgacaggcgtgacaggcgccccctggtggatcggggtcctcatcttgctgcccgccgtcctgcagggcgtaggcgccttcatcaccagcgtggttcctgtggtctcccgggcctggaccgatgcgatgcggcgacggcacgagaaccggatcctgcagaggatggacgaccaagccgcactggtccacctcgaacgtgtgcagggggctccggcggcggagccggcacccacggccgacggccccgccgcagaggggcaaccagcagacgacgcgaccgagtccccaccctgacaaccaccaacagaccgccagccgcgatccggccggccagcggacgtacgacccggcgggcttgccgacggtgtccgtgggccgccacgagtgtcgtggcaccatccccgcgggcgcggggagcactcttcgtgacctcatccaagacccagccctcactgggctgaccagactccagactgctactcacgcgcgttccgccccgtgtcgcggtctcgcgatgccgtaccacgacgttctccgatcgggcgtaccagcatcccgttcttccgcagactcctggcgtcgccacggcgcaacacctgttgcggggaacggctgcgtatgccggcagcgaccgtcccggcacctccacccggcaggggctctctcagtcggtcacggtcacggcgaccggcgcgtcagaggaggacgaggacggcgatcagagcgagcagggtgatcaggctggttgctgtgatcagacccaaccgtgcgggggtgtagacgtcggcgtccagttgctgtccgacggagcggtatcggaccgtgccgtaggcggtgatgaggagtccggcgaggagcaggatgccgccggagaccaccgcgtgcagtccgcggtgcggggcgaatttcgcgatggccacgcccagggccgccatgctgatgccggtgcgcagccaggcgaggtaggtgcgttcgttggccaggtggtcgcgggcgcggctgccggtgttcggtggggcccctggggggatttcggggtgcacttgtccctccaggtgctgtggccggccggccggccggtcannnnnnnnnnnnnnnnnnnnnnnnnnnnnnnnnnnnnnnnnnnnnnnnnnnnnnnnnnnnnnnnnnnnnnnnnnnnnnnnnnnnntgtccagggagccgtcggggttcggtttcgttccgctgcggtcgccgatcgcgtatcggtccagcggattgtcgacgaacagctgccggtcgttcatcatcgtcagcgaccagaagcccttggccgggggtgtctgcccggcgtcgaagtgcaggacgtaggagtgtgtgccctccagcggctttccgtccgcgtccgtggtggcgtgcgggtagagggcgtcggcatcgagattggcgccgtagccgaacttggtgatcacggcgcgtttgccgtagtcggttccgtagtcgccgaggccgcggtggatggtccatgcgctggtgtccgcgctgtgggattcc

SEQ ID NO: 835 - DNA, 3252 bp, Unknown
  Kingdom: Bacteria, Phylum: Actinobacteria, Class: Actinobacteria, Order: Streptomycetales, Family: Streptomycetaceae, Genus: Streptomyces
cgacccggacagggaggccgggtggatcgccgaggccgacggcgaacgcgtcggctgcgtcttcctggtcgcgggcagcgccccggcggtggcccggctgcgcatcctgctggtcaccccggccgcccgcggcctcggcgtcggcagccgcctcgtcgagacctgcctggccttcgcccgggaggcccgctacgagcaggtgacgctgtggaccaacgacgtcctggtctccgcgcgcaggatctaccgcgccttcggcttcgtcctcgccgacgaggagcctcaccgcagtttcgggcacgatctggtcggccagaactggaccctcgacctcacccggtccgccgtgcccccggagacggccgtgagggcgtgaggcgcgtgaggcggcggcgtcgtccgccgaggcagactggaagtccggcaaggaggacggggcgggggtgaggagggcatcgtggagttcgacgtgacggtggagatcccccagggttcccgcaacaagtacgagatggaccacgaactgcaccgcatccggctggaccggctgctgttcacctccaccaagtacccggccgactacggctacatcgaccacaccctcggccgggacggcgacccgctcgacgccctggtgatcgtcggcgagccgacgttcccgggctgcacgatcgagtgccgggccgtgggcatgttcgtgatgcgggacgagcagggcccggacgagaagatcctctgcgtgcccgcgcacgacccgcgctacgcggtcctgcaggacatcggggacgtcccggagttcgaccggctggagatcacccacttcttcgaggtgtacaaggacctggagcccggcaagagcgtcgagggctcccactgggagggccgcgaacaggcctacgccgagatcgacgcctcccgggcccgggccgccgcggccacggcgccccggacgtcctcctgaccgcacccgcacaccggccggccgtgcggcagcctgtgcgacgccagacggtagccgtacgagggcccggggtcccggacggcgctggtgaagcggtcccgcgcgcacggtaggctggccgggcggcgccggccggatgtgaccgggtgcgccgcgcggcggtggggcccgccgcacccaaccgcggcgacgacgccgccaacggtccctgcttgcgacacgcgtgcgcccgaaggagtaccgggcgctgtccgagtaggagtactgccgtatgggagaggcccgacctcaggtgctaggcgaacccgtcgaccccgacgtcgaactgcgcggccctgcccggcggcgtgggctgctcgccgggcaggggccggtcgtggccgccgtctcggtgggcggcgccgtcggggcgacggcccgctacggtgcctcgctgctgtggccgaccgccaccggaacgttcccgctgacgacgttcctcgtgaacgtgatcggctgcggcgtcatcggcgtcttcatggtggtcatcaccgacgtgtgggccgcccaccggctcgtccgcccgttcttcggcaccggggtcctgggcggcttcacgaccttctccacgtacgccgtggacatccagcggctcgtcgaacagggccgcgccgccacgggtctcgcctacctggccgccaccctgctcgcggcgctggcggccgtgtggaccacggcgaacctgacccgccgcgtgatcgagcggaggaagcgatgacccggctcaccggcaccgccctacgggtgacgatcttcatcggcgagaacgacacctggcaccacaaacccctctactccgagatcgtccaccgggcgcaccgggcgggcctggccggcgcctcggtcttccgcggcatcgagggcttcggcgcgacctcgctcatccacaccacgcggctgctgtcgctgagcgaggacctgccggtggccatcgtcatcgtggacaccgaggaccgcgtccgcgccttccttccccagctcgacgaactcgtcaccgagggcctggtgatcctcgacgactgcgaggtcatcaggtacgtgggccggcaccgggagaacgcgtgaactggctgctcgtcgtcgtcggcgccatggtcggtgcgccgctgcgctacctcaccgaccgcgcggtgcagtccaggcacgacagcgtcttcccctggggcaccttcagcgtcaacatggccggctgtctcaccctcggtctgatcaccggcgccgtcgtcgcgggcggtgcatcctccgacgtccagctgctgctgggcaccggcctgtgcggggcgctcaccacctactcgaccttctcctacgagaccctgcggctggcggaggagggcgcccgcttcttcgccgcggccaacgcggtcgccagcatcgtcggcggtctcggcgcggccttcaccggggcggccgtcgcccagtcgatctgggcgtgacggcacccaccgccgcacgcccgcaccgaccccgtcgaccccgtcgaccccgtcgaccccgtcgaccccgtcgatcgtggtaccgccggtcctacgaccgcggcgtcccaggcggggtcccggcgtgaggcggccgaacggcgcatgacgatcaccttcctcaccggagccgacaaaggctcggccacgagaccgcccgccgcctcctcgcccagggccacaccgtcatcacggggcccgcgccccggagcgcggcgccgctgccgccgcactgggcgcgcggttcgtccgcatcggcgtcaccgacgacgcctccgtcaccgccgcggcggccgacgtcgccgcccacggaggcagggcggacgtgctggtcaacaacgccggcgtccacggcccgcacggtgcggggcgggcgacgcgagtcggtgcaggcgcagggcgagttggatctccaggacacgggcgggtgtctgccagtcgtcgccgagcaggcggccgacgcgctccaggcgctgggccacggtgttgacatggacgtgcagttcgtccttggtgcggaccgggctcatgccgcaggcgaagtacgcctccagggtgcgtatgagatccgtgccgcggtgctcgtcgtactccgtgacacggccgatggtgcgtttcacgaacccggcgatgtcccgctcccccgccaggagcaggccgaggaagccgaagtcctcggcggcggcgccgtcgccggtgcgtccgagcagccgtagcgcctccaggcagcgctgcgcctccgcgtaggcggcggtggcagcgctgcctggaggcgct

SEQ ID NO: 836 - DNA, 4402 bp, Unknown
  Kingdom: Bacteria, Phylum: Actinobacteria, Class: Actinobacteria, Order: Streptomycetales, Family: Streptomycetaceae, Genus: Streptomyces
gagggccgctcgccgatcatcgacccgggcctgcagcccgccgggctgacggcgctgctcgggctgctgctggccggtgcggcggaggtcggtacgtacgcgctgctcgtaccgctggtggtactccaggcggtgacggccgccggctggttccggctgaacggcatgtggcccgcccggcagggcatcgccctcggtttcgccggcgcgctcgtctccgacgtggcggtgctcggcgcgggccgcgagcacgcgcccgccgcgatcctcggcaccctcggcgtgtgggtgctgctctccctcgtcctccagctgcgctcccacgccgacccggacgagcggatgtacggcctgatggcgaccgtggcctcggccgcgctgtcgatcctggcgaccggctacctggccggcggggcggacgcggtcgcggtgggcgcggtgtccgtcgcggtggccgtcctggcgcgtgcgctgccgctgccctcggcggcctcggtggtcgtcgcgctgctcgcggcggcgggcgcgggcatcgcggtcggcggcatgacggggatgggcgccaagggcgcgctgctcggggcgggcgcggcggtgtgtgcgctggtcggccaccgtgcggccgcctacgactacccctcccgcttcgtgcacttcacggccggcgtcgccctgccgctgtcggcggcggcgccggtggtgtgggtgctggggcgcgcgctgagctgatcgcgccgggctgtaccggcgggttgtaccggtgcgtaacagctggtcgacaaagtccgggccgcgccgtgcggcggggttacgctcgcgcaggacggccgcccggtcgtcgtgggtccgctcaggtgggggagcaccgcatgcgcgcgctgcgagtactgctgatcgtcgtcgtggttctgggcgtgctgttcgtggtggtcgaccgcgtcgccgtgcacttcgccgagggccaggtcgccgacaggctgcgcagcacggagaacctggcgagcactccggacgtgtccatcaacggcttcccgttcctcacccaggtggcgggcggtgagctggacgacgtcgaggtcggcatcaagaactacgaggcggccaccggcgacggcggcgagaagatccgcatcgacgacctcaaggccgacatgaagggcgtggagttctccggcgactacggttcggccaccgccgcacgtgccaccggcaccgcgaccatcgcctacgacgagctgctcaaggccgccaagtcgacgccgaccgacatcggcttcggcctcaaggcgcaggtggtgggcctctcggacgggggcaacggcaagatcaggctggcggtcaagatcgcgtcgttcccggtgatccacgtgctgagttcggtcgaggtcaagggcgacagggtgagtgtcacggccgacgggatgcccaagctggccggcctcacgctcgccgagaaccggatgcgggacatcaccgacttccagcaggccatcgaccggctgccgggcggcatcaagctcgactcggtgcgggcggcgaaggacggtgtcgagatcacggtgaagggctcgcacgtcaagctcgcggggtgaggtctcccggcccagggggtgaagtcggcgaacccgccgggtgaagccggggcgacgtccgatgggcgagacgaccacgtccgtaccgtagatgtgcagccgggaacgggcagccccggccgctccggccctgctcgcccagccctctggtctcacatcacggacgatgacgtctcatcatgcgacacgccggtgacatgtccgcctgtccctccctacgatcgacggcatgcagtgtcagaccagcgccctccggtcggggggccaggcggatctcacgaagcggcgggcagtggacctgtgccgcgttgccgccatgctctgtcgccccttctgagcggaagccccccgaggctccacgagacttcttgaggctccgcgtctctcagccgccctgcccgaagggcacccgtgcgccgctcgcactccgagcgcgcagccacgcactcgcacgccccgccgtaactgccccggaggagattgagtatgagccgcagtgacgtcctggtcgacgccgactgggtccaggagcacctggacgacccgagcatcgccatcgtcgaggtggacgaggacacgtccgcgtacgacaagaaccacatcaagaacgccatccggatcgactggaccgacgacctccaggacccggtccgccgtgacttcgtcgaccaggccggcttcgagaagctgctgtcggagaagggcatctcgaacgaccacacggtggtcctctacggcggcaacaacaactggttcgcctcctacgcctactggtacttcaagctctacggccacgacaacgtcaagctcctcgacggcggccgcaagaagtgggagctggacgcccgcgagctggtcgacggcgccgacgtgcccgagcgcgcgaagacggactacaaggccaagccgcaggacacctccatccgcgccttccgcgacgacgtcgtgaaggccatcggcgcgcagaacctggtcgacgtccgctcgcccgacgagttctccggcaagctgctcgccccggcccacctgccgcaggagcagtcgcagcgtccgggtcacgtcccgtccgccaagaacatcccgtggtcgaagaacgccaacgacgacggcaccttcaagtcggacgaggagctgaaggccctctacgtcgaggaggacgtcgacctcggcaaggacaccatcgcctactgccgcatcggggagcgctcggccctgacctggttcgtcctgcacgagctgctgggtgtggagaacgtcaagaactacgacggctcctggaccgagtacggctccctggtgggcgtgccgatcgagctgggctccggcaagtaagcagtcccgaccgacctatctgacctctggagaagcacatgtgtggagcgaaggccggcggccccgacgcctcgacgatcaagcccggtgagacgacgatccaggggcaggtgacccgcgacggcgagccggtgacgggctacgtccgcctgctggactcgaccggcgagttcaccgcggaggtcccgacctccgccaccggccagttccggttctacgcggcggagggcacctggaccgtccgcgcgctgattcccggcggcaccgcggaccgtacggtcgtcgcccggcagggcgggctcgcggaggtcgcgatcgcggtctgaggccgcgccgagcacgcggagggccgtacccggggttggacgccaggggtacggccctccggcatcgcctccgcctccgcacgcctccgcatgcccgcgcagcatgcctccccaggcccgcgcgcctgccgctgaaggcgccgcggaactacccttgaggtatgtacgcacggcgccgacacgcctatttcgccatgatgggaacctgcatcacgctgttcgtcctggcgtggggagtcgtgcgcatctggtcggtcccggccgctgtcgggatgtgcctgttcgccatggtcatcccgccggtcgccgccatggtggccaaccggcgcggcccggacgaccgctggtgggacgacccgtccggcgacccgaagtccgacgagtggtgggacgagctggacggcaagaagcgccactgagggcggccggggaccggtctcggcgctcgtctcagtagacgagcgcctgcgcgccgtcggccatggcctcctgcacgaatacctgcgcgcccgcgatccgcacgccctcgatcacgtccttctccgtgatgtcccggcgggccgcgcactgcgtgcacagcgtgatccggccggccgcgaggaccgagccgatcaggtcgggcagcggcgcggcgtgcggaagctcgaactccgccgcccgaccgggcagcgcgaaccaggacgactccccggtcagccacagggacacgtccacaccgctggccacggccaccgccgcgaccgtgaacgcctgcgagcaccgctcgggggagtccgccccggccgtcaccttgatcacgagcttcttcgccatgcccgaatcgtaatcaactcctttacaactgcgggtcctgccggtgggtctcctgtgcagcgcgcacacggaaggcgcgcttcttttctgtgggggcacgtcttggaagtaccggaaagaccgatttccgcgcccgagggggttttggaggttccggtggctgcgccggaagcaccaccgcgccggttcaggcgtaccgcgctgctcgtcgccgccgcggccgtgctcggcgtggtcgccggcacctgcacggggtacgtcgtccaggcgggccgcgagcccaccccgctcccgccgctctcccagccggtggtcgagcaggccgagggcgaggcggaa

SEQ ID NO: 837 - DNA, 1904 bp, Unknown
  Kingdom: Bacteria, Phylum: Actinobacteria, Class: Actinobacteria, Order: Streptomycetales, Family: Streptomycetaceae, Genus: Streptomyces
cgccgccgtacaccgtctcgccgccctcgccgggcaccggcgcagccggccgttcggcgggcggcggcaggaacaacaaggtggtgatcatcgcgtcggccgccgtcgccgtgatcgccgtcgtcggcctgatcaccgcgctcctgctgaacaacaacaacggcggcgacgacaccgccggaggcgagggcagcagcaccagcccgagcctcggctcctcctcggcccccgtcgaggggcaccgcggccccgacacgtcgaagacgatcgacctgagcgagtgcaaggagccgcggacgtcgtacaacgacccgaagctcatccagatgccgaacttccagttcaagtacatcggttcggtcaaggagtgcttccaggcggccggatggcagatgaagatcgtccgcgtggacgagaacacgtacggccagggcacggtcatgagccagttccccgcggccgacaccgacgtcgacccgaagaagatgccggtgatccagctcaacgtctcgacgggcgacccggcctcgtcctgatccgcccactcccgtcccggtcccggaccggacacggttcctgacgcgcaagggcccggcagctcggctgccgggcccttgtccgatgcgggtgcgtgcgacctaccgtccgacgcgggtacgtgcgacctaccgtccgacgcgggtacgtacggcctaccggccgatgcgggtacgtacggcctaccggccgatgcgggttcgtacggcctacggtccgatgcgggttcgtacggcctacggtccgatgcggtgcgtacggacttacaggtacggtcctccggagcggccgcccaggtgggggtcgtcgccgccctcgtggccgacgcccgcgggcagcgcgcggcgcatctgctccagctgggcgcgggcggccatctgctgcgcgaacagcgtcgtctggatcccgtggaagagcccttccagccagcccaccaactgcgcctgcgcgatgcgcagttccgcgtcgctgggggttccctcgtcggtgaacggcagggagagccgctccagctcctcgaccagctccggtgcgagaccgtcctccagctccttgaccgagctggcgtggatctccttgagccggaccctgctggcctcgtcgagaggagccgcccgcacctcttcgagcagctgcttgatcatgctgccgatccgcatgaccttggcgggctgctccacctggtccgtgaccggggtctcgcgcgagtcgtcgtccccgccgcccccgagcgccatgccgtcctggcccacgaccaggatctgcggattctccggcgaccgttcgttcctcggcatctccatacggccattctctcgtaccggtacgtctcatctccttggtgccccccgggaacggtgatccaccgtccgcgcggcgccggagtcctccgggcggcccaggcgctccaggcgggccgcgcagtggtcgagccagcgggactcggcctccacctggcagatcgaccgctccaggaccagcagccgggccacctcctcgacgggtccgggcagccgcgcgagaacctccgcccgctgccgtacgcagtcctgcagcgcctcggacacgtgccggcgctgcgtgtcgacgatctcgcgtacgtcggcacctggcgagcccagggccagcgccagcttgacggccagctcgtcgggcggctgcccggcccaggccaggggcgcgcgctcgacgggccgcgtgtaccaggaccgcagctcggcgcggcccgcctcggtcagcgcgtaggtcgcccgtccggccgcgtccacgccctcacgggcgaccaggccgtcgcgttccaggcggccgagggccgcgcagaccaggccgaggcccaggggccacgccgccgaggtacgggcctcgaa

SEQ ID NO: 838 - DNA, 4401 bp, Unknown
  Kingdom: Bacteria, Phylum: Actinobacteria, Class: Actinobacteria, Order: Streptomycetales, Family: Streptomycetaceae, Genus: Streptomyces
atgcccagggagaagccgcgggtgcggtcgtcggcgacgtccgtgagccccacctgctccagcgcgtcgtcgacgtccgccgaccgtttctcgtccccccgcagtgcggcgagcgcggtgaggttctgccgggcggtgagcgaggggtacagccccggcccgtccacgaacccggcgacaccgccgggcgcttcgaacgcccggcccaccggcgtgccgaggatctccagacttccgctgtcggtcacggccaggccgagaaggacgccgagcagggtcgtcttgccggcgccgttgggaccgaccaggccgtgaatctgtccctgcgtcacatccaggtcgacgccgtcgagcgcgacgacgtccccgaagcacttcgtgatgccgcgagcccggatggcgagctgtgagtccatgagctccttctctcggaaagtctcatgcaccctaggaagcgcacacgtccctgacagggatcacgggttgaacgctcagcgaacggaataccaaaacgggggtcaaagagtatgggtgacgcgggggttgacccacggacggtcaccgtacggctgtccggacgggccgcgttcgcgacgaacgtgccggaagtggcggtggtggccgagcccgaggtggtcgtcgtgccgcctgaccgggaacgtgagcccgggcccgagcccgagcgtctgccgaagggccgccgcacccgtgtcctgctggtcaccgtgccggtcgtgacaagcgtggcggccgtcgccttcccactgctcccgtacgcgtcgggctcgcgcggcgaccgcgatcgcgacggcacggacgacaacacctgcctcgacatcgcctcagacatcgcctgcgacatcgaagtggtcttgaatgcctgcggtccaactccgtttcttcaagccctcgttgagggaggcaagcgggatgtcgtggcttgtgtgccggccggaacatgggcaacgcggtcccgttgaggggcggccctgttgtcacgcgcccgagctgatccatgtccgggcgagttcctcgacccacaggacggccccgtcggtcgtcgtcgggggcgcgccgacgacgacgagttcggtgacgcctgccgcggcaagtcctggcaggtgctccggggtgccgtcgctcgatgcgacggcgaccgtgagctccccgagagcgcgaccgcggcgggtgcactcgtcggcgagaacggcgacgcgtcccgggatgtcggccaccggcacgtcgaagccgtaccagccgtcggcgagcgtgaccgcgcgacgcagcgcggtgtcgctgttgccgccgatcaggaccgggagccggccgccgcgcaacggcttggggttgacccggatcgcgtcgaaccgggtgaactcgccggtgtaggaggcggggtcctgggtccagagagtgcgcatggcggcgaggtactcatcggtgcggcgcccgcgtccggcgaaggggacgccgagagcggcgaactcctcggccgaccagccgatcccgacaccgaggctgaaccggccggcggacagcacatcgagtgtggcggcctgtttcgcgaccaggaccgggttgtgctcgggcagcaggagtacgccggtggcgagttcgatcctgtcggtgaccgctgccgcgaagctcagggcgagcagcgggtccagccagtccgcgtccgcgggtacggcgatccggccgtccgcggagtagggatagcgggagtcgggcgcgtccacgagcaccacgtgctcgccgcaccacagcctcgcgaagcctttcgcctccgcggccgtggccacggcccggatcacctccggacgggcaccgtcaccgataccgagcgcgtgcagccctacccgcatgatcccaccctaggcacaagagcgcggacaggagcgacgggcacgccgtctgcgaacggctgggccgccacccggcgatcgaagggtcggcccagtgggctgcctgccccgggcggccccggttccggtagaacttcggggggcgatcgtctgcgcagctgaccggggacggtcgcttgccgcccgggggtcaggcggtcagggccgcgagggtctcgtccaggtcggtggccctgggccggctgtgcgggagtttcgcgaggatcttggccatgccgcaggtgttggtgagggcggagaagaccaggccgccggcgacgcccgcggagagccagcgggccgcgctccagcgttgtccggcgatgagaccggtcaggacgagggatccagaggcgaggcggacctggcggtccatggcccagggggcgcgggtgccggccgggcggtgggtgtcgtggccgagctgtgtccaggcggtggtgccgccggtgagggtggcggcggtgatgccgtgagcggcgaggcgccggcaggcttgggcggagcgggctccggaagcgcacacgatgaggaggtcgcgtcggtccgcggcgaccttcagggcggggagggcggtatcgaggtggtcgagggggatgttgtgggcgccgggcaggtgaccggaggcgtattcgcccggggtgcgcacgtcgacgacggtcagctcgtgcaggcgggcgttggcctggtcggcggtgagggcggtggtgggggccacgggggattttcctttgctgggttggggttaccccttcgataggatacttgtgggggtatatctcgaaggagtgtgggttgtggaactggcgatggcggccgaggaattgaagacggtggtcaaccggctgcgccgggcgcagggccagatcgccggtgtgatcaagatgatcgaggaggggcgggactgcgaggacgttgtcacgcagctcgcggcggcgtcccgggctttggacaaggcgggtttcgcgatcatcgccaccggccttcagcactgcctgaccgatgcggacgtggacgcttccggtgaccgggagcagatgcgtgcccggctggaaaagctgttcctttctctggcctgagccatggtgccgcggcgcccgatgagtgctcaggcgagggcgtcgacgacccctcaggcgagggcgtcgatgacccctcaggcgagggcgtcgatgacccctcaggcgagggcgtcgatgagcatgaaggctgccacagccagcagcacgacggcgaaggtgcgttgcagcagggtgccggtcaccttggcggccaggcgtttgccgtcccaggcgccgaggatcgccgccccggtgaaggggccgaccaccgcccagtcgatgccgacggtggtggcgccgcgggtggccagggacgccagcgagttcgccgagatgaccagcaggctggtgccgacggcagcctgcatctcgaacgccagcacggtgaccagggccgggactgcgaggaagcccccaccgaccccgagcagtccggtcagcgcgcccagtcccgcgccggtgccggcggccgcggcgggccttacccggccggcttcggagccggtggcggggtggccggggcgcagcattgtgacggcggcgagtgcggcgacggccgcgaacgcggcggtcagtaccggctggggcagacgggatgcggcggctgaggccgccgcggcgggcaggagtccggccgcggcgaagagggcgccggctttccagcgcacgttgcgggcgcgggcgtgggcgtacagggcggtgagcgaggtggcggtgacgatgatcaggcttgctgtggtggcggcggccggagtgaagccgagcaggtagatcagtgcgggcaccgccaggacgctgccgcccccgccgagcgcgccgagcgcgagcccgaccacggccccggcgatcagggccggtatcagcgcgttcacgctatgacaccgccgctgccgccctgaccggtgaccggcagtcccgcacacccccaggcggtcattacgccggggacgccggtgacgtcggtgccctcgacgccgcgtccggccagtggctcggcggcctgctgggagcggtggcccgagcggcagatcgtgacgaccgccggcttgtcctgggcgcctgccgggagcgatgccccggccggcaggcgggacagcggcaggtgcagcgcgccgggcgcgcgccgggcgttccactgcggtgtttcgcgtacgtccagcagaacggcgttgccatcgctggtcttctgatggacctgctggggggtgaggcggccggggccgcggtggagaagcgaggacatcgtttgatcactttcgtgcaggtggcgcggacggcgtgtcagtcggtgccctcggggcgggtgaggggcagtcccgcgtcagcggcggcgtcgaagccgtcgtcgacggcgatcacgtcgcggccagcggcgtcgagcaaggaagcagcgatcgccgcgcgcatcccgcccgcgcagtgcacccataccgtcc

SEQ ID NO: 839 - DNA, 7919 bp, Unknown
  Kingdom: Bacteria, Phylum: Actinobacteria, Class: Actinobacteria, Order: Streptomycetales, Family: Streptomycetaceae, Genus: Streptomyces
cggccggccggccgggggcagggccgggcaccgcaggtgggccggtcaggtgcggaacgggaagccgtacgtgtggaccgccacgttctcgcggtcgcccgtgtcgccggcggcgacggccgcgcgtccgcgttcctcgtactcccgcacgaggtcgtacatgcgcttggacagctcggtcagttcctccggggtgagcttgagcagccattcggaggcgtcggaggccttcgtccacgcctcgggccagtgcgcgcgctcgtccaggaagcgccggtacatgtcggcgcgctgctcgaagaagaggcggctggcggcggtgtgtgcggcggccttctcgggggcgtcggagaagtcctcgtcgcggatgctgacgccgtcgctggcgggctgccaccagcgttccctgccgtccgtggtctgcggctcggcctcctcgatgagcccgtgctcggccagcttgcgcaggtggtagctgaccagtgagacggcttcgtcgacctgttcggcgagctgggacgcggtcgccgtgcggacgacggtcagcgcccggtacagattcatccgcagggggtgggcgatcgccttgagcgtgcccatgtccttgatccggcggtctcggtctctttcgctgtccgacatgcctccacgctagatgcgcaaggaaagttgcacaactgattttgcgcaactttccttgcggatctggcggcgaaaaagccccgaccgcccgcacggcgaccggggccttccccggaccggccgacgacccgacggccgtcggccgacctcacctcaccggatgaccagccgcccgcagcgtctccttgacctgcccgatgcgcaggtcgccgaagtggaacaccgaggccgcgagcaccgcgtccgcgcccgccgcgatcgcaggcgggaagtcggcgagccggccggcgccgccggaggcgatcaccgggacgctgacgtgcttgcggacggccgcgatcatctccaggtcgtagccgtccttcgtgccgtccgcgtccatggagttcagcaggatctcgcccgcgcccagatcggcggcccggtgcgcccactccaccgcgtcgatgccggtgccgcgacggccgccgtgcgtggtcacctcgaaggaaccggccgcggtgcggcgcgcgtccaccgacaggacgagcacctggcggccgaaccgctccgcgatctcccggatcaggtccgggcgggcgatcgccgccgtgttgacgccgaccttgtcggcgccggcccgcagcagccggtcgacgtcctcggccgtgcggacgccgccgccgaccgtgagcgggatgaacacctgctcggcggtgcggcggaccacgtcgtacgtcgtctcccggtcgcccgaggacgcggtgatgtccaggaacgtcagctcgtcggcgccctcggcgtcgtacaccttggccatctcgacggggtcgcccgcgtcgcgcaggttctggaagttgacgcccttgacgacccggccgttgtccacgtccaggcaggggatgactcggaccgccagggtcatgaatcgggctcctctgatgttcctctgaatgcttcgacttccaccgagaccaggacgcgcgggtcgacgaaaccctccacgacgagcagcgtcgacaccgggcggaccgcgtcgaacagctccttgtgggcgcggcccacgtcgtccacgtcccgggcatggctcagatacatacgcgttcggatcacggactccgcgccgagcccgaactcgccgatcgcctcgatcgcgctgctgaaggccaccttcgcctgttcgtacgggtcgccctccccgtacagcacgtcgccccggaaggcggtggtgcccgccaccaggacgcggtcccccgccgcgacggcccgcgcgaatccgaacgtctcttcccagggaactccgctctgcacgcgccgtacggcatcggacgtcatgacgacacttcctccagggcctcttcgagcgtgaacgccttcgcgtacagggccttcccgacgatggcgccctcgacaccgagcggcacgagggaggcgagcgcgcgcaggtcggcgagcgaggagacgccgccggaggcgaccaccgggcggtcggtcgccgcgcagacgttcttcagcagctccaggttggggccctgcagggtgccgtccttggcgatgtcggtgacgacgtagcgggcgcagccctccttgtccaggcgggccagcgtctcgtagaggtcgccgccgtcgcgggtccagccgcgtccgcgcagggtggtgccgcgtacgtcgaggccgacggcgatctggtcgccgtgctcggcgatgaccttggcgacccactcgggggtctccagggcggcggtgccgaggttgacgcgggtgcagccggtggcgagggcggcggcgagggtgtcgtcgtcgcggatgccgccggacagctcgaccttgatgtccatggcgcgggcgacctcggcgatcagggcgcggttgtcgccggtgccgaaggcggcgtcgaggtcgacgaggtgcagccactcggcgccggaacgctgccaggcgagggcggcctccagcggggagccgtatgaggtctcggtcccggactcgccgtggacgaggcggacggcctggccgtcgcggacgtcgacggcgggcaggagttcgagcttcgaagccatcacagggttccgatccagttgttcagcagctgcgctccggcgtcgccggacttctcggggtggaactgggtggcccacagggcgccgttctccacggcggccacgaagggcttgccgtgggtggcccaggtgaccttgggggcgtgcaccgccgcgtggtgcgtctccagccgccagtcgtggacggcgtaggagtgcacgaagtagaagcgggcgtcggcgtcgaggccggcgaacagctcggagtcggcgggtgcctcgacggtgttccagcccatgtgcgggacgacgtcggcctccagcggtgcgaccgtgccgggccactcgtccaggccctcggcctcgacgccgtgttcgatgccgcgggcgaagaggatctgcatgccgacgcagatgcccatgaccgggcggccgccggacagccggcggtcgatgatccagtcgccgcgggcctccttgaggccgcgcatgcaggcggcgaaggcgccgacgcccggcaccagcagcccgtcggcgttcatcgccttgtcgaagtcgcgggtgatctcgacgtcggcgccggtgcgggcgagcgcccgctcggcggagcggacgttgccgaagccgtagtcgaagacgacgacgctcttgcggtcgctcaactccacagcacccccagccgcatcacgcccgcgacgaggcacatcgcggcgccgatggacagcagcacgatgaggctgcggggcatcttctgtttgacgaaggagatgatgccgccgaccaggaagaggccgacgacgatcaggatggtggacagactgttcatggcggttacagcgcgcccttcgtcgagggcaggatgccggcggcgcgcgggtcgcgttcgctggcgtagcgcagggcccgggccagtgccttgaactggcactccacgatgtggtgggcgttgcgcccgtagggcacgtgcacgtgcagggcgacctgcgcctgggcgacgaaggactccaggatgtgccgggtcatggtggtgtcgtactcgccgatcatcggcgccatcttctcgggctcggtgtgcacgaggtaggggcggccggagaggtcgacggtgacctgggcgagggactcgtccagcgggaccgtgcagttgccgaagcggtagatgcccaccttgtcgccgagcgcctgcttgaaggcggcgccgagcgcgagggcggtgtcctcgatggtgtggtgcgagtcgatgtgcaggtcgccgtcggtcttcacggtcaggtcgaacagaccgtgccggccgagctggtcgagcatgtggtcgtagaagccgacgccggtggcgatgtcggtcttcccggtgccgtcgaggtcgatctcgaccaggacggaggtctccttggtggtgcgctccacgcgcccgacgcggttcatccgctctgctcctgttccttcttgagatcgcgtaccgcatcgaggaacgcgtcgttctccgccggggtcccggccgtcacccgcagccatcccggtacgccgttgtcgcggaccaggacgccccggtcgaggatctgccgccaggcggtgtgggagtcggcgaaccgcccgaactggatgaagttggcgtccgactcggtgacgtcgtagccgatcgcgcgcagttcggtgaccagccggtcccgctcggccttcagctgctcgacgtacttcagcagcgtgtcggtgtgctccagggcggccagcgcggtgacctgggtgatcgccgagaggtggtacggcagccggacgagctggacggcgtcgacgacggccgggtgcgcggcgaggtagccgaggcgcagcccggcggcgccgaacgccttggacatggtgcgggagacgaccaggtgcggccggccctccagcagcggcagcagcgagcggccgtggctgaactcgatgtacgcctcgtcgacgaccaccatggacggcttcgccgcctgcgcggcgtcgtacagcgcgaggaccgtctcgggcgcgaccgcgttgcccgtggggttgttgggggtggtgatgaagacgacgtcgggccggtgctcggcgatcgcccgctcggcggcggcgaggtcgatggtgaagtcctcgcggcgcggcccggagatccagccggtgccggtgccgcgtgcgatgagcgcgtgcatcgagtacgacggctcgaagccgatcgcggtgcggccggggccgccgaaggcctgcaggagctgctggatgacctcgttggagccgttggccgcccagacgttctccacggcgacccggtggccgccggtgcgggtcaggtacttggccagttcggtgcgcagttcgaccgcgtcccggtccgggtagcggttgaggtcgcgggcggcctcgcggacccgctcggcgatccgctcgacgagcggttcgggcagcgggtaggggttctcgttggtgttcagccgtacggggacgtccaactggggggcgccgtagggggacttgccgcgcagttcgtcccgtacgggaagatcgtcggtcctcacgtcgctcacttgctctcgggtaccttccagccgaacctggccttgatcgccgcgccgtgcgcgggcaggtcctccgcctccgccagcgtcaccacgtggtgggcgacctcggcgagggcgtcgcgcgtgtagtcgacgatgtggatgccgcgcaggaaggactgcacggacaggcccgaggagtggcaggcgcagccgccggtgggcagcacgtggttggatccggccgcgtagtcgccgagggagaccggcgcccaggggccgatgaagaccgcgccggcgttgcgcacgcggtcggcgacggcggcggcatcggccgtctggatctccaggtgttcggcgccgtaggcgtcgaccaccttcaggccctcctccaggccgtcgaccaggacgatcgcggactgccgtccggcgagggaggggcggatgcggtcctcgatgtgcttggtggccgcgacctggggctccagctccttctccacggcgtccgcgaggtcggcggagtcggtgaccaggacggcggcggccagcgggtcgtgctcggcctggctgatcaggtcggaggcgacgtgcaccgggtcggcggtggcgtcggcgaggaccgcgatctcggtcggtccggcctcggcgtcgatgccgatgcggccggtgaagtagcgcttggcggcggcgacccagatgttgccggggccggtgaccatgttcgcgggcgggcaggactcggtgccgtacgcgaacatggcgacggcggtggcgccgcccgcggcgtacacctcgtcgacgccgagcagggcgcaggcggcgaggatcgtcgggtgcggcaggccgccgaagtcggcctgggccggggaggcgagcgcgatcgactcgacgccggcctcctgggccggtacggcgttcatgatcacggaggacgggtagaccgaccggccgccgggcgcgtacagcccgacacgctcgaccgggacccacttctcggtcaccgaaccgccggggacgacctcggtggtgtgcgtggtgcggcgctgcgcgcggtggacgaggcgggcccggcggatggactcctccagggcggcgcgcacggccgggtccagctgctccagggcgtccttgatcgcccgggccggaacgcgcaccgattccagtcgtaccccgtcgaacttctcggcgaagtcgatcagtgccgcgtccccgcgatgatgcacggcctcgcagatcggacgcaccttctccagggcggccgagacgtcgaagtcggctcggggcagcaggtcacgcagggcggggccctcggggagggcgtcgccgcgcagatcgattcgggagatcacgtctccaattctctcagaccgcgcacgggcgcggttcgcccgtatcaatggctgatacagaacccgggatcgcacggttccggccttctgccacaagtcggaagatcagcttcacattccgcgttcagaccgtcacacaacgggcatcaccggttgtacaaaacgaccgaaccggcgggtagctggggaagaagggaaccaccgtgaccgaggggacccgcaggcacgccggggacctgccggacgacctgaccgaagtcgaggccgggatgtggcaggccttccgcaacggcagcgtgtacgacctgcgcagcggggacgcggcggcggacgatccgcacggcccgcgcccctggggaggcgagcggagcgtccgcgcgcgtgtggtgtgctggctgctcctcgacggaccgcccgcgctcgccgggcgtgtctcgtccctgaaactgaccgggctgcggatcacgggcacgctggacctcgccggcggcacggtggtgccctacgtggagctgcagggctgccgcttcgagagcgaggtgctgctgcccgaggcccggttcacgaccgtgcgcctggtggactgctcggtgccgcgcctggaggccgcccgcgtgcacaccgagggcgacctgcacttagcccgctgccgcttcctggcgggcatccggctcaccgacgcccggatcggcacggacctgctgctcaaccaggcggacgtgcaccacgaccgcaccggacggtccatcgccgccgacgggctgaccatcggccaggacctccaggccgaacagctgcgggcgcacggcgagatcagcatgcgcagcgcgaagataggcgcctcgctgagcctgcgcggcgcgaaggtcaccagcccgtacacgcgtttcgcgctgaacgcgccccagctgaccgtcggccgcaccctctacctgaccccggccgccctcggctcggcgctgctgagcggggtgaccccggcgcgcgggacgcggatccagcccttcgagtgccagggcgggctgcggctggacgacgggcggttcggcgaggccgtcgacctggaaggggcccggttctccttcaccgacgagcaggcgctgaccctgcgccgggtgcaggcacctgagctgcgcttcctcggggagcgtccgccgcgcggccaggtggtgctctccggtgcgcggatcgtcaccctcgtcgaccgggcggcgggctggcccggacccggcagtctgcacatgggcggcttcgtctacgagaacctcgtgccgcgcggcccgttcccgctgaccgagcgcctgggctggctggcggcggcgaccgccgagtacaaccctgagccgtacgagcggctggccgcggtgctgcgcgcggccggcgaggacgaggacgcg

SEQ ID NO: 840 - DNA, 2426 bp, Unknown
  Kingdom: Bacteria, Phylum: Actinobacteria, Class: Actinobacteria, Order: Streptomycetales, Family: Streptomycetaceae, Genus: Streptomyces
cgcccccgaggtccacgacgaagcccaggtcacggtggcggtacgggcgccgcgcgcagacaccgagcgaggcggcgacgttgatcgcggcgatccggccgtgccgccaggcgtgctgggcggtcatcggggtgaagccgccggggttgtacacgtcgggcacggccgcggcatcaccgcaggcgaacacctccggccgccccggcacctggaggtaggggtccacgacgatccggccgcgttccagatcctgcccggtgctctccaccagcggatcgggccgtacgcccacgcaccacaccagcgtccgggtgggcacgaactcgccgtcggtgagcagcaccccgtcgtgcgtcgcctccttcacggaggtgcccatgcggacgtcgacaccgcgctcccgcagcgcccggtccgcggtgcgcgagagccgctcgtccagttcgggcaggacgcgggacgcgatgtccaggagcatccagcgcggccgcatgccctggcgcagcgggtgacggcgcacctgcgcgtcggtgtacatctttccgtgcgcggcgacctcggtgcccgtgtagcccgccccgaccacgacgaaggtgcagcgggcggcgcagtcgtcgcggtcctcggccgctgccgccagctcgatctgccgggtcacgtggtcgcgcaggtagagcgcctccggcagtccgcggaagccgtgcgcgtgctcggcgacgccggggacgggcagcagcttgttgacgctgccgaccgccagcaccagccggtcgtaggcgagtgtgccggggtcgccctcggggccggtgaagcgcacggtgcgtgcgtccatgtcgacgtggccggcctcgccgaggaccaggcggacgccgggcagcccggcggagagcgagacggcgacgcggcgcggttccaggatgcccgcggccacctggggcagcagcggcaggtacaggaagtagtcggtcgggttcagcagggtgacgtcggccttgctccgtgacatccgggacagggtgcgggcggcgtggtaaccggcgaaaccggcaccgacgatcacgatgcggggtcgactcacggttcgcctccggcgctgtcgcgtgcctggtacggaactctccgcgtcccccgggccggggcacccaaacgtgaacccgcgccggggcgcggcgcccggccgccggtttccgggcccgccgccgggtactcgggaccgcgatcccgcccgcccagcccccagtcgtggaggtctcgcccatgcccgagtacggctacttcctgtcctgcgagcagtacggccccgcggacctggtcgagcaggccagaatggccgagcaggccggtttccaggccctgtggatctccgaccactaccacccgtggaacgacgcgcagggccagagcgcgttcgtgtggtcggtgatcggcgcgctgtccgaggccgtgtccctgcccgtcgagacggccgtcacctgtccgacggtgcggatgcatccggccgtggtggcgcaggccgcggcgaccagcgcggtgatgaccgagggccggttccggctcggcgtcggcagcggagaggcactcaacgagcacatcctgggcgaccgttggcctccggcgcacgtgcgcctggagatgctggaggaggcgatccaggtgatgcgccggctgttcacgggcgagatggtcgaccaccacggcacgtactacaccgtggagaacgcgcgcctgtacaccgtgcccgaagaaccggtgccgatcgacatctccgggttcggccccaaggcgacctcgctcgcggctcgggtcggcgacgggtacatcacgatgatgccggacgaggagatggtcacccagtaccgcaagggcggcggcggggccaagctcgtcagcggcgggacgaaggtctgcttcgggcacgaccgcgaggagtgcgtccgcacggtgcgcgagctgtggtacaacgagcagctgcccggcgagatgggccaggtcctgcccacgccccgccacttcgagcagctgaagccgctggtcaccgaggacatggtccgcgagaacgtggtgtgcggcgacgacgcggaccagcacgtggccacgctgaaggagttcgccgacgcgggcttcgaccgggtctacgtcaatcagatcgggtccgaccagcgcggcttcttcgacttctaccgcacgaaggtgctgccgcaactgccgtagtggaccggtcccggaccagtgaccggtccgggaccggcgggtaccgcgcagacggcgcccgccccggcgaggtgtgccggggcgggcgccgcagtggtggtgtgcgcgcggcccgctcagaactcctcgcctcgcgggcgcggcacggcaggcgggttctgcggcatcggcggcacgggcggcgtcggcgccgccggcgagtgcgcggacggcga

SEQ ID NO: 841 - DNA, 3510 bp, Unknown
  Kingdom: Bacteria, Phylum: Actinobacteria, Class: Actinobacteria, Order: Streptomycetales, Family: Streptomycetaceae, Genus: Streptomyces
ccggatcacccgtcaggtgcacgaactggcccaggagtacggcatcggccccgcgcgcgcggggccgatgccgtactcctgggccagttcgtgcacctgacgggtgatccggcgctggtaccacttgggcgcgtaggcaccctcggcgtacagccgctcgtagcgccgcaccaggtgcgggtggtgctgcccgagccaggccatgaaccattcccgggcgccgggccgcaggtgcagggtcagcggggtgacggaggtcgctcccgccgccgcgatcgcccgcaccgtcgcccgcaactgcgcggggtggtcgccgaggaacgggatcaccggcgccatcagcaccccgcagccgatgccgtgctccccgagggtgcgtacgacgtccaggcggcgctccggcgccggggtgccgggctccacggtgcgccacagctcgtggtcggtgaagcccacggagacggagatgcccacgtcggtgacctcggccgcccgcaccagcagatcgaggtcgcgcaggatcagcgtgcccttggtcaggatcgagaacgggttcgcgcgctcggtgagcgcggagatgatgcccggcatcaggcggtagcggccctccgcgcgctggtagcagtcgacgttcgtgcccatcgcgatgtgttcgccctgccagcggcgtgcggcgagctggcggcgcagcagttccggggcgttcaccttgaccacgatctgggtgtcgaaaccgacaccggtgtccaggtccaggtagctgtgggtcttgcgggcgaagcagtacacgcacgcgtgcgtgcagccacggtacggattgaccgtccattcgaacggcatgcgggaggcgccgggcacccggttgatgatcgagcgggcccggacctcgtggaaggtgatcccgcggaactccggggtgtcgaaggtgcgagtggtcaccgcgtccgcgccgaagagcgcggcgtcggcccggctgtgtccggtgttcccggtgtcttcggtgtcttcggtgtgtccggattctgcgggttccctggcgttcccggagtccgctgtgaggttgtcccagcgcatgacgcctcctcggtagcactgcccacagaatagaacagatgttcccttgatcgtgcgggtgaccgcggcgcgcccgttccgagccgttcgcgatcgtccgccgcaccgggtccgatcacttgccgcaccccgatttggggccccgggtgacggggtggttggcttgccccaaccctgagaacggatgtcctggaggaaccccatggcgcaggtcgaggccactacggagcgggtcgtcgcggcggacgcggagaaggtgttcgacgccctcgccgactacagcggcacccgcgagaggctgctgcccgagcagttcagcgagtacgaggtgcgcgagggcggcgacggcgagggcaccctcgtccactggaagctgcaggccaccagcaagcgcgtccgcgactgcctcctggaggtgagcgagcccaccgacggcgaactggtcgagaaggaccgcaactcctccatggtgaccacctggcgggtcaccccggcaggcgagggcaggtcccgcgtcgtcgtcaccaccacctggcagggtgcgggcggcatcggcggcttcttcgagaagacgttcgcacccaagggcctcggccggatctacgacgccctgctcgccaggctcgccaccgaggtcgagaagtagtccgcgccggacaactgacctcccagcggcccgcgttggccgcttcaccggttcgagtgatctccccaccgccccgctccgtgccgtaacccggcgccctgtccgtagttgtcgctttacgcgcggaaactgcgcgacagtgcgacgagggagagggccaagtgggcgggatcactctggtgcaggacgaaccggtcacggcgccaccggagacccgcgccgcgcccgccgggagcaccgaagcgctcccggccggcgccgaaccgctcagcccccgccgggtccggctggtcttcgtggggctgatgctcgcgctgctgctggccgccctggaccagatgatcgtcgccaccgcgctccccaaggtggtcggggagctgcacggcctggacaagatgtcctgggcgatcaccgcctacctgctcaccgccacggtgggactgcccgtctacggcaagctcggcgacctggtgggccgcaagggcgtcttccagttcgccatcgcggtcttcgtcatcggctccgcactggccggccgggcgcagaccatggaccagctgatcgcctaccgcgccgtgcaggggctcggcgcgggcggcctgatgatcggcgtgcaggccatcatcgccgacatcgtgccgccccggcagcgcggccggttcatggggctcatcggcgccgccttcggcctcgcctccgtagcgggccccctgctcggcgggtacttcaccgaccacctctcctggcggtggtgcttctacgtcaacgtgcccttcggcctggtcaccctggccgtcgtcagcgtcgtgctcaaactgccccggccgcgggtcaaggcccgcttcgacatcctcggcacactgctgctcggcaccgcctccacgtgcgcggtactgctgaccagctggggcggcacggaatacgcctgggggtcgcgcgtcatcctcggcctgggcgccggcgccgccgtcgcgaccgtcctcttcgtcgtcgccgaacgcttcgccgccgaacccctgatcccgctgcggctcttccgtgactccgtcttcaacatcagcggtctggtcggcctggtcgtcggcgtcgccctgttcggcgccgccagctacctgcccaccttcctgcagatggtcgacggcgcctcggccaccgagtccgggctgctcatgctgccgatgatgggcggcatcgtcgtcgcctccatcgtctccgggcagctcatcagccacaccggccgctacaagatccacccgctgctcggcagcgccctgtccgtcgtcggcatgtggctgctgtcccggctggaggtcgacacctcgcggctcgagtacagcatctggatggccgtcctcggcgccggcatcggcctggtgatgccggtcctcgtgctcgccgtgcagaactccgtgcgccccgccgacctcggcaccgcgaccagcgccaacaactacttccgccagatcggcggcagcgtcggcgcggccgtcttcggcaccctgttcgccgaccggctctccgccgccctgcgcgaccgcgttcccgcgcgcgcgggcgccgccctccccgaccccgagtcgatcaccccgcaggtggtgcacgcgctgccgccggccctgcgcgacgcctacatccaggcgtacgccgacgccatgccgcggatcttcctctacctcgtgccagtgctcgccctcggcctgatcatcgccttcttcctcaaggagaaaccgctggtgtcccacaacacccccgccgccccgaccgtcttcgagaccgagccggcgcccctg

SEQ ID NO: 842 - DNA, 9493 bp, Unknown
  Kingdom: Bacteria, Phylum: Actinobacteria, Class: Actinobacteria, Order: Streptomycetales, Family: Streptomycetaceae, Genus: Streptomyces
ctccgagctggtcaccaacgcctgcctgcacgccgagggcccggagcggctggagatcgcctgcgacaacaaggtgatccacatcgaggtctcggaccgcggctcgggccagccggccccgcgcacgccgcaccgcgccggccgccccggcggtcacggcatgttcatcgtccagcggctgtgcctcgactggggcgtggtacgcgtcccgggcgtcgcgggcaagaaggtctgggcggagctgggcgcaccggcgtaaccaaccgcacgcggccgcacgcatgcccgcgcgcagccgcacgcccgcacgcagccgcacgcaccgctgcgcccacgaaccggaagagccgccgcatcccctacggatgcggcggctcttcgcggaaccggcgggccggtgtcagcgcacgtcgcccatgagctccttgaccttcttgcggtacatccacaccgcgagaccggcgaccaccgcgagcgcggcctccagggcgacgatgcccgtcttgttgaggtcgacaccggcgatggagagcagaccggtggtggcgtcaccggcggtgacggccaggaaccagacgcccatcatctgcgaggcgtacttggcgggcgccatcttcgtggtgaccgacaggccgaccggggagagggtcagctcaccgacggtctggacgaagtagatcgccaccagccacagcgccgccgccttgtgaccgccgtcggcgatcgacagcggggccaggaagaggaagaacgaggcgccgacgagcaccaggcccatcgtgaacttcaccgcggtgctcggctccttgccgcgccgggccagtgcgatccacagccaggcgaagaccggcgcgcacgccatgatcagcacggggttgaccgactggtaccaggagaccgggaagttccagccgaggacgctgttctcggccgacttctcggcgaacagcgacagggtcgaaccgccctggtcgtagatcatccagaagaccgcggcggcgacgaagaaccagatgtacgcggtcatcttcgactgttcggtgcggtccaggtccttgtcccgcttgatccgcgcgatgaccgcgaccgggatgagcagaccggcgacggtgatcggcaccagcagccagttcagggtgtagacgccggagaagccgacgatcgcgtagaagacgacggcgacggccgcccacagggccgacttgcgcagcagggccgtcttctcctgggcggacagcggcgtcggtacgacgtcggagcgcgggttcaggtggcgcgagccgagcaggaactgggccaggccgagcgccatgccgagcgcggcgagcgcgaagccgatgtgccagttgacgttctcaccgatcgtgccgatgatcagcggcgcggcgaaggcaccgaggttgatcccgatgtagaagatcgtgaagccgccgtcgcggcgcgggtcgtcggtgcccttgtacaggtggccgaccatcgtggagatgttggccttcagcaggccggagccgatggcgacgaggccgagaccggcgaagaagctgccggaccacggcagggccagcgtcaggtgaccgagcatgatgaccgagccggcgacggcgacggtcttgcggggcccgaggacccggtcggcgaaccagccgccgggcatggcgagcaggtacacgagggacaggtagaccgagtagatcgcggtcgcgctggccgcattcatgtgcaggccgcccggagccaccaggtacagcgggagcagggccctcatgccgtagtaggagaaacgctcccacatctcggtcatgaagagagtggccaggccgcgggggtggccgaagaaggtcttctcggaaccgggggtgcccgggcggaccgagtccttcgtcaggctggacgccatggtcgttccttgctggtcgggacgcgccacggcgagccggtacgcgcccggtggggggctggccggcaccggcaggacccctcgtccaccccacgcccaggggagtttcgccccgggtcacggggtgatggacggcggccaccgggatccacgcctcgcgacgcgtcgatgcgtccggtgaggcccggccctaggtcgttcctttcgaggccggggagaaccggcccgcacgcaaaagggaccctcagcgccgaaagagcgccaaaggtccgctgcgtgctacaggcgttcaactcaccatacggcaggacagtgccggatatggaaggacttgagacacggatcacagggaacgagggaaccgcgcaggccctttcgaaggtttatccaaggatcgcaccccaggtcagcggcccggcgcggacgaggtgaaggcttcgtgcccatgccgccccacggcgcacggccacagcgccggagggcgcgcgaccacagcgccgcaagccgctcggccacggcgcggcacggctcgcgaccacagcgccggaacgcgcgcggccgtagcgccgagaagccacgtgaccatagcgccgcaaagtaagagcgccggacgtcgatcacaccgcaggccaccccagcgggtgccgcgggcggactaccatcaccccatgacccgtgtactgctcgccgaggacgacgcgtccatctcggagccgctggcccgcgcactgcgccgggaaggttacgaggtcgaggtgcgtgaggacggacccaccgcgctcgacgccggaatgcagggcggtgtcgacctggtcgtgctggacctcggcctgcccggcatggacggcctggaggtcgcccgccggctgcgtgccgagggccacaccgtgcccatcctcatcctgaccgcgcgcgccgacgaggtcgacacggtcgtcggcctggacgcgggcgccgacgactacgtcaccaagccgttccggctcgccgaactcctcgcccgcgtccgggccctgctgcggcgcggtgccgccgagccgcagcagccgcccgccacgcacggcgtgcgcatcgacgtcgagtcccaccgcgcctggatgggcgacgaggaactccagctcaccgccaaggagttcgacctgctgcgggtgctggtgcgcgacgccggccgggtcgtcacccgcgaccagttgatgcgcgaggtctgggacaccacctggtggtcgtcgaccaagaccctggacatgcacatctcctggctgcgcaagaagctcggcgacgacgcggccaacccccgctacatcgcgaccgtgcggggcgtgggtttccgcttcgagaagagctgagtccgccgtgcgggcccccgcgggcccgcgcaccgtcaggtaagaggtcatgcgccgtcgactgatccagtccacgctcgccgtggtgctcgtcgtgatcgccgtcttcggcgtctccctggtgatcgtggagacccgcacgatcagcaacagcgcgcaggagcgggtcgactccgaggcgctgcggctggccagcatcgtcgacagcaggatgctcggcgacgagaccgtcaacgcggagatcctcggcgagcaggtggccgccggccagtacgcggtgatcggcatccccgggcacccgccgatcgaggtcggcaccaagccctccggcgacgtcatccactccaccgccaagggcgagcagggcgagaccgtacggatggaggagccgcgttcctccgtcacccgcgaggtcggccggacgctgctgatcatcgggctggtcgcgctgctcgcggtggtggccgcggtgctgctcgcgatccgccaggccaaccggctcgcctccccgctgaccgacctcgccgagaccgccgaacggcttggctccggcgacccgcggccccgccacaagcgctacggcgtgcccgagctggaccgggtggccgatgtgctggacggctccgccgagcgcatcgcccggatgctgaccgccgagcgccgcctagccgccgacgcctcccaccagctgcgcaccccgctgaccgcgctgtccatgcgcctggaggagatcaccctcaccgacgacccggacacggtgaaggaggaggcgaacgtcgcgctcacccaggtcgagcggctgaccgacgtggtggaacgcctgctgaccaactcccgcgacccgcgcaccggctccgccgtctccttcgacctggacgaggtcatccagcagcagatcgccgagtggcgtcccgcctaccgcagcgcgggccgggcgatcgtcagctcgggcaagcggcacctgcaggccgtgggcacaccgggcgcggtcgcgcaggtcctggcggcgctgatcgagaactcgctcatgcacggcggcggcacggtggcgctgcgcacccgtgtgaccggcaaccaggcggtcgtcgaggtcaccgacgagggtcccggcgtccccgccgatctgggcgcccgcatcttcgagcgcacgatcagcggccgcaactccaccggcatcggcctcgccgtcgcccgcgacctggccgaggccgacggcggccgcctggaactgctccaggcccagcccccggtcttcggcctgttcctctcccgcacgcccccgctgaagcggtcggcggaggaacagccgacggtgcggtagcgcggctcgcgccgctcagcccggctcagcggaaggcgtcggtgcgggtcttcttcgtctccgcccggtgcccggcccgcgtccggcccgccggctcggccgcgtcaccggcggccggcagggcacggaagacccaggagcggtacgaccagaagcggaacagggtcgcgatgccgatgccgaggaacttgaagacgttgctctgcagcgggctgtcccagccgaaaccgtacgtcgccaggtagagcacgccgttctcgatcaccagaccgatcgcgctgaacagcaggaacagcgtcagttccttggtgcgcccgcccttgtcgcggtcccggtaggtgaagtaccggaagccgacgtagttgaagacgatcgacacgatggtggcgatgacgctcgcgcgcaccaccgggagatcggtcacgtgccgtacgaggttgaagacgagcaggttgaccagcagccccgccccgcccaccgcgccgaacttggcgacctcccgccacagccgtccgacgcgccgcagcagcgcgccctggggcgccgggggcgccgatcggtgccccgaggaaccacgtcccatgctcgtgcaggcccccgtccgggtcggtgtcggtcaacccgcccatgctatccagcgcgagcgggtggcgcccgcgcaccgggcacggcggagaaacgggtcgtacagccggcgcgcgacggagaacgggtcgcgccggccggtgggagcggggcgcgtccatcggtccggggcgcgatccgccggtccgaggcgcggaatccggccgccgtggcgtggccgataccctaggggcgtgacgttcccggtagtcggcatggtcggcggtggccagctcgctcgtatgacacacgaggcgggcatcccgctcggcatcaggttcaagcttctcagtgacaccccccaggactcggcggcccaggtcgtgagcgatgtcgtcatcggcgactaccgcgatctggagacgctgcgcgccttcgcgcggggctgcgacgtgatcaccttcgatcacgaacacgtacccaccgagcacctgcgcgccctggaggcggacggcatccccgtccgccccgggcccgacgcgctggtgcacgcgcaggacaagggggtgatgcgcgcgagactcgacgcgctcggcgtgccctgcccgcggcaccggatcgtgaccgatccggccgacgtggcggccttcgcggccgagggcgacggcttccccgtcgtcctcaagaccgtccgcggcgggtacgacggcaagggcgtgtgggtggtggactccgtcgaggaggccgccgacccgttccgcgccggcgttcccgtgctcgccgaggagaaggtcgacttcgtccgcgagctggccgccaacgtcgtacgctccccgcacggccaggccgtcgcgtacccggtggtggagtcccggcaggtgggcggcgtctgcgacaccgtgatcgcgccggcccccgacctggacgaggacctggcgctgcgggccgaggagatggccctgcgcatcgccaaggaactgggcgtcgtcggccacctcgccgtcgagctgttccagacccgcgacggccgcatactcgtcaacgaactggcgatgcgcccgcacaactccggccactggtcgatggacggcgcgatcacctcgcagttcgccaaccacgtccgcgccgtcctggacctgccgctgggcgatccgcgcccgcgcgcgccctggacggtcatggtcaacgtcctcggcggcgactacccggacatgtactccgcgtacctgcactgcatggcccgcgacccccagctcaagatccacatgtacggcaaggacgtgaagcccggccgcaaggtcggacacgtcaacacctacggcgacgacctggacgacgtgctggagcgcgcccgtcacgcagccggctacctgagaggcacgatcaccgaatgagccctgtagttggcatcgtcatggggtcggactccgactggcccgtcatggaggccgccgcgaaggcgctcgacgagttcgagatcgcctacgaggtcgacgtcgtctccgcgcaccgcatgccgcgcgagatgatcacctacggcgagcaggcggccgagcgcgggctcaaggcgatcatcgcgggcgcgggcggcgccgcccacctgcccggcatgctcgcctccgtcacgccgctgccggtgatcggcgtgccggtgccgctgaagtacctggacggcatggactcgctgctgtcgatcgtgcagatgccggccggggtgccggtcgccacggtctcggtgggcggtgcccgcaacgccggtctgctcgccgcgcgcatcctcgccgcgcacgacgaggacctgctggcccggatgcgggagttccagcaggacctgaacgaccaggccaccgagaagggcaagcggctgcgcgccaaggccgagggctcggccggcttcggcttcggcacggggaagtgagcgcggtgagccgactggaggaagcccgggaactcctgcgcgagttcccggtcgtcgacggccacaacgatcttccctgggcgctgcgcgaacaggtccgctacgacctcggtgcccgcgacatcgccgccgcccaggacgcccacctgcacaccgacatcccgcgcctgcgcgcgggcggcgtcggcgcgcagtactggtcggtgtacgtccgctcggacctgcccgacgcggtcccggcgacgctggagcagatcgactgcgtacggcagctgctcgcccgctacccggcggacctggccccggccctgaccgccgcggacatggaggcggcccgcgcgcagggccggatcgcctccctgatgggcgccgagggcggccactccatcgccgactcgctgggcacgctccgtggcctgtacgcgctcggcgtgcgctacatgacgctcacccacaacaacaacgtggcatgggcggactcggcgacggacgagcccggcgtgggcggtctgtcggccttcggccgcgaggtggtccgcgagatgaaccgcctcggcatgctggtcgacctgtcccacgtggccgcgacgaccatgcgggacgcgctggacacctcggcggcgccggtgatcttctcgcactcctccgcccgggcggtctgcgaccacccgcgcaacgtcccggacgacgtcctcgaacgcctgcccgccaacggcggtatggccatggtgacgttcgtgccgaagttcgtgctccaggccgccgtcgactggacggccgccgcggacgagaacatgcgcgcgcacggtctgcaccacctcgacaccaccgaggagggcatgaaggtccaccgggccttcgaggagtcgaacccgcgtccgatcgccaccgcggccacggtcgccgaccacctcgaccacatgcgcgaggtggcaggcgtcgaccacatcggcatcggcggcgactacgacggcacggccttcacccccgacggcctggacgatgtctccggttacccccgcctcgtcgcggaactcctcgaccgcggctggtcccgctccgacctggccaagctgacctggcagaacgcggtacgcgtcctgagcgccgccgaggacgtcgcccgcgacctccagtcgacccggggcccgtcgaacgcgacgatcggggaactggacggctgacgatcacacgcctgtgcgcatcagctccaagagcggggacgccgtcctcatgtccgccgaggactacgactcctggcaggagaccgtctatctgctgcggtccccggcgaacgcccggcggctcatggaggcggtcgcccgcgaccgctccggctcggcaggcgtcagcaggaccgtggaggagtcgcaggcgctggcgggcgacgagtgaggagcgtccacttcgacccggacggcggggaggacttcctcttctggcgctccgcggaccgcaggatggctcgtcggatcactcgtctgatcgccgagatccagcgcacgcccttcagcggcatcggcaagcccgaaccgctgaagggcgacctgtccggctactggtcccgtcggatcgacgacgagcaccggctcgtgtaccgggcggacgaccaggaagtgaagatcctcaaggcccgctaccgctacagcgactgaccgcgctcagccggcgcagaggcagaacgggtgtccggccgggtcggcgtacacgcggaagctccgtgtgcggtccgacgtgtccagaggctcggcaccgagcgcgaggacgcccttctccgccgcgtccaggtcctccacgacgagatccaggtggaactgctgcgagcggtcggccgacggccacgtcggcggtacgaaccccggcgcctcctggaacgccagcgcgagaccgcccggcaccttcaggtccacccactcgccctggtcctccacggccccgccgagcacctcggcgtagaaaccggcgagcgcgcgcgggtcgggacagtccagtacgacgacacccagcttggcgagagccatgtcttcctccagcgatgcgtgcgtgagagttacctgtagaagcgagtaaccagtaaccgttaccgcatgctctcccaaggccggtaacagcgcaacggatttgcgcggtactgtcgcttgcatgagtgacggagcgcccgcgcccggcggcctggcgctggtcgaggcgctggtcaacaccctggacctcgagacggccaccgactcgctcgacacggccgacggccgcgcccgcttcgggatcggcgaggcggacctggcgggggcgcgcgaggtgcgcgagtccctgcgggcggcgctgctcgcgcacgccggccaccccccgcaccgcccggtgacgccgctgggcgagttgctggcgcgggccccgctgctggtcgccgtcgacgaacgggacggcaccgccaccctcgcacccgccgacac

SEQ ID NO: 843 - DNA, 3635 bp, Unknown
  Kingdom: Bacteria, Phylum: Actinobacteria, Class: Actinobacteria, Order: Streptomycetales, Family: Streptomycetaceae, Genus: Streptomyces
gcaccacggcgaaggcccgggtcccgtgagggaggcccgggccttcgccgtggtgcgccgtacgcccatgatgtgcccgcgtaccgggacgcgtccgggagcggctcagccgttggccagggcctgtacccggtccagcgcgccgttgaacttgtcgtggtcgccgacggtcgggccggacgaggtgtactgccacatcgtgtagtagccccagcccgccggcagcgtccccacggtcgaggcgtaccgggcgatccacagcgggttgttggcggcgaagccgccgtagttgccggtgcactgggtccaccagctggtggccgtgtagatcacggcgtcgcggccggtacgcgccttgtaggtgttgaggaagtcggcgatccagctgaccatcgcgctcgtggacttgccgtagcaggcggcgccgtacgggttccactcgatgtcgagggcgcccggcagggtcttgccgtctttggaccagccgccgccgtggtcgacgaagtagttggcctgggtcgcgccgctggtggtgtcaggggtcgcgaagtggtacgagccgcggatcatgccgacgttgtaggagccgttgtactgctgggtgaaggaggggttcgtgtagtacgtcccctcggtcgccttcgtgtacgcccagcgcacgccgctgctccacagggtcgaccaggcgacgttgccctggtagccgctgacgtcgacgccttcggtctgggtggcggcgtccgtcgtgggcgtgccgctgcggccgtcgtgcgccgcgacgcccatgcccatgtaggcggagccgcgggcgggcgtggagccggcaccggtgtcggtgccggtgccggccgaggagggggtggtgaggaagaaggagaacgccgcgagcaggactcccgcggcggtcagccgccgcatgcgggccgttccggatctgtgcacgggcatgacgtgcctccgaagttcggtggtgctcggtggggggaaacgcgggcatggcccacggtcgcacgaggggagcgcgggcctggggagacccgccgggaagcggtagtggcgtgggcatgccattcattgcctgggtaagaagctacgcacgtagaacgactctgggaagggggcccggagtccgccgttggtctacgcctgcgaaatactgaccgagctgcggcgatggcggcggacggcggaaactttcaggaccggcgacactccgggcaggggctgaccggcaacactccaggcaggggctgacgtgcacgaagacgcaaggggcgagcaccgggaagccgcgtccgacgccgcgcggggaaatggcgtggacggggagttcctgtccctggaacgggagatgaccgtcctgctgcggcgcgcccgggccagccaggccgagatggcccgtgaggtgcacccgggtctggagtcctcggcgtacggactgctggtccggctggacgagtgcggcagccagcgcgccacggcgctcgccgcctacatcggcgtcggcaaggccaccatgtcccgccagttgcacgccctggaggagctgggcctcgtcgcccgcgagccggaccccgcggacgggcgggcctggctgatcgccctcaccgacgacggcaggcgccgggtcggccaggtgcgcgacgcccgccgggagcgttacgtcagccagctcgaccactgggaccgccgcgaggtcgccgaactggcccgcctgctgcacgagctgaacggcgtcatggagagacacgagaagtgaggcggtgggggcgcggggagcgatgcgccctcatagctggacgaacaccgcagtggcgtcgtcgtgcgtcttgctccgccccaggtacgcccgctcctcgcggtcggctctttccagcagccgtacgcggtgcaccagggcctcggcgccctccttgcgcaggagggcgaagcactggggccagtcgccctcctcgaacttctccacccagcgcgccgccccgtcgctgagcgcggccagggcgcggacctgtgtgcgcggcacggtgcccgtcaccgcccgctccgccaccgcggggtcggccgcggcggtgaagaagccgccctccttgttgcgcagggtggtgtcgacgagcgcgtccgtggccagcgcggcgcgcggcagccgggccagccggtcgtccaggaccggggtgaccaggccgtcgggcgactccagcaggagcaccgagtcggacaggaccaggtgctcgaccgacgaggcggaccaccgtacgagcaccacggttgcctgcggcgtgcgggggtgagaaaggtcacaggttatggcgtgagcctccgcggtactgcggatcgcatgcgcgagtacctcccgaagcgtcagatcccgccgcgaaacggtcagttccgtcagtgcgccgccgagcctggacgtgaaccaggggaccgaatgcagacaccccgtctcccgtggcggcgtcaccccgtcgaggacgaccaggcacccgccctgcccgtcggcgggcagggcgacggcggcgaagtcctcgttcgggtgatccggcaggcccggctccgaaacaacctcagttcgcatccggccagtctgcaccaggccttcacatggtccgccaaaggaggccaatcgccttggaattgacgcacagtcgccgatccggcgcctgatttgaggcggattggagcactccgggaagacgtggcggcgaatcctgccaaagcctgcggccgacgtccaaccggcccgccgcacggcacccgcgcacgcgccggaggaacttgcccgccaactcacctccggggttcactccttcgggtggccggtcggacgatgcgggaccactgcccaccggcactgggagggtcggagaccgatgcaggccccctgctcgcgccacacggacggcgagagcccgggggagggtggacgcaccagtcgcaccagctgacgaggcgccacccgggcccatgagtacacgagtacaggaatgcgagcaccggtgcagaagaagcggcctcggcgcacaggcaagcagacggccaccgcgaagggacccgagcggacgcccggcacaccctccgccgcgccccccgccacccccgtgggcacgggccgtccgaagcgcgtacgcaaccgcctcgtcgtctccgtcgccgtcgtcgccgccgtcgtggccggcgccggcgcgcccgccgtgatcgacgcctccggccggctgagcgactcgcaggacctggtcaccctcgccgggcagacccaggacgccctcgccctcgcccactccctcgccgacgaacgcgacgaggtcacctcctacgtcgccgccggacgccccaagtccaaggcgccctccgagcagcgcagcacccgcgtggaccgccaggtcgacgaactgcgcaccgcccccggcaccccggcctggctgcgcaccgacctcgacggcatcgccgccgtgcgccgctcggcgctcaccggccagagcaccgccctccaggcccaccaggcgtactccgccaccatcgccgaactgcaccggctcgccggacaactggccgagcagacgcccccgcgggccggctccggggcgcacgccctcgctgaactggacaccgccgtccagcaggccgccgccgcccgc

SEQ ID NO: 844 - DNA, 4263 bp, Unknown
  Kingdom: Bacteria, Phylum: Actinobacteria, Class: Actinobacteria, Order: Streptomycetales, Family: Streptomycetaceae, Genus: Streptomyces
ccgccgaccgccgaccgccgatccggcgtccaggacggcctacggctcgtggtgcccgtccggtgtccgggtcaccggttcggcgttccgggtggcggccgtcatgcctttcgggtcgagcacctggtcgccgtacaggtcctccagccaggtcgactggtagatcgtgtcgagatagcgttcgccgaggtccggggcgatggccaccgcggtcaggtcgcgcgcgtcgtgttcggcgagccacgccatggcgccgctgaccaccgtgccggtcgagccgccgaagaggaaaccgcgccgggccagccggtggcaggcgcggatcgtgtccgcctcctcgacctggatcacctcgtcgacgaaggactcgtcgagcagcggcgggcgcatgctcatgcccagaccggggatcatccggcggcccggcttgccgccgaaggccaccgaaccgaccgtgtccaccgcgacgatccgcaccggccggtgccactcacggaagtaccgcgcgcaccccatcagggtgccggtggtgcccgcgccgacgaacagcacgtccaggcgcgggaactgaccggcgatctccggcgccgtacgccggtagtgcgccccccagttgcccgggttggtgtactggctgagccacacgtaccgctcgtcggaggcgcacagcgcgcggacgtagtcgatccgggcgccgaggaatccgccgttggcgtccaggtcggcgatgacgtggacctcgctgcccagcgcctccatcagcagccgagtggacaggttgcagcgggagtcggtcacgcacaggaaccggtagcccttgctggccgcgatcatgctgagcgcgacgccgaggttgccggacgaggactcgatcagcaccgagtcctcgctcagcagcccgtcccgttccgcggcctccaccatctcgaccgctgccttcagcttgatcgagcccgcgaagttgaagccctcgcacttcaggtagagcgagcgtccgaagatcggccggaggtcgacgtagagctggccttcgttgaaggcgtggggagcggagatgacgggcacgctaacctcctgatgccgagggccgaggaccggggaacggacgttcagccgtaccgccgcagttcgtggaagaagtcgtcgacgacgtggaggttcccggcccgggccacctcggcgtggacgtagctgccgacggcgaggtcgaggaccccgaggccgaacggggagaagatcacggtccggtcgcccggcggttccacccggccggtcagcacgtcgtcgagcgtgccgtccaggaagtcccgcccgccggtgagctgttcggccaggtgcggtgaggtgttcgccttcaggcagtgctcgacgtcgtcgacgaagttcgccgagtcgagcaggatccgcgggtcgaggtcgcgcagcgacacgtgcagcaccaccggacggtggtcgaaccagccggggtcggtgacgtgcggttcgcccgcgacggtcgcgaagacgaccaggtcgctggagcggatcagctcctccgggctgtcgtgcacggtgacctgggggctcggtccggcgggaccggccgcctggcgcagatagccgcagaagccggccgcgctgtcggcggacacgtcgtacacgccgaccgagtcgaagctccagccggtaccggcgaggaaggtgtggatgtaccgggcgatcaggcccgtgccgaagaaaccgatccgggccggccgcggccgggtccgggtgagccggtccgcggccagcgcggcggacgccgccgtcctggtggcgctgatgatggaactctccaggcaggcgaacggatagccggtgtcgtggtcgttgaggatcagcaccgccgaggcgcggggcacgccggccgccacgttctccgggaaactggagatccatttgatgccgtccacgcccaccgggccgccgacggaggcgggcagcgcgatgatccgggacgtgggccggtccgggaagcgcaggaagtacgacggcgggttgaccgtctgcccgtcgccgtgcagccggtaggtggcctcgacgagttccacgatctccttctcgcggccctggagcgcctgctgcacctggccgccggagatcacggcgaaggacggcacgcgcgccgcaccggcggcggtcaagccggtggtggcgggggatgtcacggaggtcatcgccgctctccttcccgggccggggtgccgtcggccggcagccggggctcggccatcgccacgagcacgcgccgctcaccggtgaaggcctcgcggctgtgcgcggtgcggatgttgtcgacgagcatcaggtcaccggcctgccagggctcacgccgggtgtgctgttcgtaggtggcgttgatctgctggacgacgtcctcgccgatcggggtgccgtcgccgtaacgggtgttgaacggcaggccgtcctcgccgtactcgtccaccaggtactcgcgcacctccggcgccagcgtccactcgttgaggaacgcgacctggttgaaccagcagcggcggccggtgaccgggtgccgtacgacggcgctgcggcgctggcgggtgcgcagcgatccgtcgccgcgccactcgaagtcgatggcgtgcgcgcggcagtagttctcgacggtctcacggtcctcggtgccgaacgactcggccagcgaggcaccgatctcgtcgttgtagctgcgggtgagcagccagccctcgcgttcgaaccgctcggtcagttcggcgggcagcgcctggagcacctgctccgcgtccgccaccgcggtggccccgccctcggcgggcgcggtgaggcaggcgaacagcatcacggacgggacccgctgtacgtagctcagttcgtggtgcatgcacatcggctggttgtccggccaggcggtcgaggagtacagcccggagccgtaggactgccggactgcgaacgcctcccgctccgccatcggttcaccggccaacgcggtgaagacggcccggacctgctcctgctccccgaggcccaggccgcgcaccaggaccacgccgtgctcggtgacctgcgcgcgcaccgcctcgcggtactgggccgcccacccggccgcgtcggccggcggttcgacgtgcaggaccggcggccggtccggtcgcagctccacctccagcagtgacgccggggacgagaacgacatctcggtgttcctttcgtcgggcagtgtggtcgccggccggagtgctcaccggccggcgggatcaggaggacgccagcagttcggcggcgcccaggacggcccgcgcggccccgtccggccgggtgcgcgggaagtagtggccgccgtcggcgagttcgtgcaggtccacctggtcggccaggaagctccagtccttgtggtgttcgccgtacccggcggtgtgcggatcgtcggcggcgacgaccacggtcaccggcgcggccagccgcacggcgggcggagactgcagggcggcggtgaagtagcggtgcgcgcagacgcagtcgtgccggtaggccgcgccgatgtgctcggcgtggtccgcgttcagctcgcccagctcggtgtagccgctgtccgcgctcagccgggcggcgatctccgcgttgccgcgcccggtcaactccgctgccgctgcctcgcgttcggcggccgtgcccggcagctgcgcggccaggaacacccgcaccacccgcaccccgcgcccctcgagacggcgtgccgtctcgacggccagggcggccccggaggagtggccccacagcatgagcttcgtcaggccgcgccccacgacctcggccaccacccggtcggcgacctgctccagcggagcgaacggctcgtcggccgcggccaggtcatggccgggcaactcgacggcgtacaccgcgagttcgctgcccgtcagggcgctcgccatcggccggaagttgaccgcgttgccgcccgcgtacgggaagcacaccagggcgcaggcgcctgcccccttcgccgtcgacagaggctgcagcagctccggacggctcgcgcaggcaccgtcgaggagcgcggcgaggtcggcgagcaccggatgacgggtgatgtccttcagcgagacggcccggtccagggcgatggtcagcttgaccgccgacagcgaggtgccgccggcgtcgaagaagtgggtggcgcggccgatccggtcccggggcacgcccagcagttcggaccaggcgtccgccagccgccgctcggtcgcggtgctcggc

SEQ ID NO: 845 - DNA, 622 bp, Unknown
  Kingdom: Bacteria, Phylum: Actinobacteria, Class: Actinobacteria, Order: Streptomycetales, Family: Streptomycetaceae, Genus: Streptomyces
gggcggccagttcggcggcgaaggcgtcctcggcgtgcgggcgcagcgcctgcgggctctgctcgccgcccgtgttcgcgggcgcggactcgcttcggctgggtgctacggacgtcggttctacggacacagacatggctgaggccccctccagctcggccggttcggatctgccaccaaccgtgcaccacggcactgacaatgcgttccgacctgcgcaaacgccgtcgcaggggcccattgtcagtggcgggacctaccttcgatggcatgactcagcagggggcgcgctggagtgcggaccaggtgctggcactggcgcctgacgtcacgtcacgcaaagcgggaagcaaactcggcacggcgggaccgtggtccgaggcggggagttccgacgaggggacggtgtgggggctgtgcaagggaagcggaagcaagccgtatcagacggtcgtcgacatcgccgacgcggccggaccggcgtacaagtgcagttgcccgagccgtaagttcccgtgcaagcacgccctcggactgctgctgctgtgggcgggcggcgaggacgcggtggccaccgtgccctccggccaggcgccggagtgggccgggcagtggctggcgg

SEQ ID NO: 846 - DNA, 2429 bp, Unknown
  Kingdom: Bacteria, Phylum: Actinobacteria, Class: Actinobacteria, Order: Streptomycetales, Family: Streptomycetaceae, Genus: Streptomyces
ctcccccacccgaggacaccccgaggaccctccatgacgcaaccgccgctcatgcgccggatcaccgacttctccagccgcgccgacccgtacccgctctacgcggaactccgcaggacgccggtactgcacgaggaggagggcggcccgtacgtcatcagctcctactacgacatccaggccctgctgcacgatccccggatcagctcggacgcccgcaatctcagcgcgccgggcgccgacgagctgtcggagccggaggcgacggggctgccgccgagcttcatccggctcgatccgcccgagcacgaccggctgcggcggatcgccaacagttcgttcgggccgccgcaccggccgcaccggatcgacgccatgcgcgaggaactcggccggatcgtcggcgaactcctcgacgagctcggcgacgcccggcagatcgaccttgtcgaccagttcgcgtatcccttcccggtgaccgtgatctgccggctcctcggggtgccccgcgaggacgagccgcgcttccgcgcctgggtcgacccgatcgtcgccggcctcgacccggactcacgccacgaccccgaggcaccggtccagcgcgccgcacaggaggcgcgggtccagctcggcatgtacctggcggggctggtggagcagcggaccaaggagccccgcgacgacatgctgtccgatctgacggccggtcacggcccggacgggtccatgtcgatgatggaggtgctcagcacggcggtgctgctgctgatcgcgggccacgagacgacggtcaacctcatcaccaacggcatgctcaccctgctgcgccacccggagtacctgcggcggctgcgcgaggaccccgggctgtccgtcgacatcgtcgaggaacttctgcggtacgagcctccggtgcagctggtgccctcgcgcacctgcatcacggacatcgagctgcgcggggtgacgatcccgaagggctcgcggatctggctggtgctcggcgcgggcaaccgggacccggagcgcttcgaggaccccgaccggttcgacccggaccgcggggacatccagcacctcggtttcggcagcggcgtccacgtctgcttcggcgcaccgctggcccggctggagacgcagatcgcgctcaccgagctggcccggcgcctggaaaatccccggctggtcgaggatccgcccccgtaccggcagaacgcggtgctgcgcggcccacgccacctgaacatcgcgatcgacggggtgctggcctgacgagcccgagaatcctctggacaacaccgaaaaatcatacaaaatgaacgggtatccccatcgcgacttcgaggagccgcccccgcatggcgtacggagcccaccacagccccaccccgccgccgcgccccgacctggacctggctcgtgactgcgagcactgtctgggctgggggaccgtcgtcaccctcgacggtcagcacgccttgtgcgacacgtgccagctcatcccgggcgacggcgatccgccgctcggagtgccgacccaccgcccgtcccccggctgagcggcaccgctccgtgcggctgagccggcactgctccgtccgagtggtgcaacctcccgccccgtcgtagcgtcgttgcagagtttctgacgtcgtcggccgggagcggacatgggcgaacacacagtgaggaccgcggtcacactcggtgcagccgtattgctcaccgcgggtctgggaacggcctccgccgcctccgcggcgcaggcggcaccggcagggggctcgcacacgacgtaccggcagcccgtgttcgtcgactgcctgtggaagccgcagacgcgcccggacgcgttcatcctggcctgcggcgacggcaacagccgcctgtcctcgctgcactggacgaagtggaacggccgttcggcgatggccgagggcgtcaacctcgtcaacgactgcaagccgtactgcgcggccggcaagttccactcgtacccggtcgtcgtgcgtctggaccgtgccgaaccctggaagaagcacccgcaggtccagcacttcacccggctcagcctcctcttccccggccaccggccggacgggtacgggcgcgtggtcacctacgccctgtggaactgagcgtccgtgatgcactcgatcaccaagggcctgctggccggcgccgcgggaacactcgcgctggacatggtcacgtacggcgacatgctgctgcgcgggcggccgtccagcggcatcccggcacaggtcgctgaccgtctcgccggccgggcccggatcccgctcgggcacggcgaggagagggagaaccgcaccgaggcggccggggcgctcatgggatacgccaccggactggccgccggagcggcctacgggctgctgcggcacgggcgcccgccgctgcccggctgg

SEQ ID NO: 847 - DNA, 1822 bp, Unknown
  Kingdom: Bacteria, Phylum: Actinobacteria, Class: Actinobacteria, Order: Streptomycetales, Family: Streptomycetaceae, Genus: Streptomyces
ctcccacccgctgatcgtccacatcggcagcgcggagcagctcgacgactgggtcgaggaggtccccgcgacggcccgcctgctggccgcgcacttctggccggggccgctcaccctggtcctgcgacgcggtcgccgggtgcctctggaggcgaccggcggcctggagacggtcgccgtgcgcgtgcccgaccacccggtcgccggcgcgctgctggcggccttcggcggcggtgtcacggccccgtccgccaaccgcttcggctccgtcagccccacgacggcggacgacgtccgtacggaactcggcggcgccgtcgacttcgtgctggacggcggtcgctgcgaggtgggcgtcgagtcgaccatcgtggacgtcacgggagacaccccgagcgttctcaggcccggcggggtgacgcgcgaggatctcgaagcggtgctcggacagcccatcgacgtcccgtcgacgagctccgtccgggtgcccggccagcacccgtcgcactacgcgccgcgtgcccgggtcgtcctcgtcgagccggagaaggtcctcggtgaagtggagtcggcgcgcgagcaggggcaccaggtgggcgtcttccttccgccctccctcgccgacgccccggtgaaggcgcacgcgacggtggcggtccccgcttcgcctgccgcctacgcccgtgggctctacggtttcctgcgcgaactcgaccagcgggggtgcgacctcatcatcgcgtccctgcccgcggaggaggggctcggcctcgcgatcgccaaccggctccgccgcgccgcgggcccccggccggcgcagcgtgcctgacggcgtcagcgtccggacagggcacggccggggccgacagggggcctttgggggatcagacgccgaacgcggtggcgtagcggatggtgcccgccggtactggacgggtgtcgtcgagtgccagggccatcatggcctcgtcgggcacctcgaagggcgcgcggatgccgaagcgggaggccggggtgaacccgaagcgcgggtagtagccggcgtggcccagcacgacgacgaggttctcccccctggcgcgtgccgcgtcgagagcggcgcggacggcggcggatccggcgccggtgcgctgggcctggggcaggaccgcgcagggggccagggcgagggccctctcgccgccgacgtggcaccgggtgagcagcgcgtgcccgaccggaatgccgtcggcaccgccgctgagcagggagaggccgtcgatccacgccgtggggtcggcgcgcagggcgtcgacgacgtcggcctcctcggcggtcgggaaggcggcgaggttgatgccacggacggcggggatgtcgtcgggggtctcgggtcgggtggtccaggcggacatggtggttccgttcttgtggggccgatgacggtcttccgacgacggtctcggcggacatcagagcacggggaacacatgggaacatccgtttttgtcaggcatccggtcgggcatcgttcgtcgcgctgccacccacggttccggccctgcaccgcgcccggctccggctcagcggtcgagcagggccaggccgaggggggtggggctgtgcagcgcggagttgcggtgccgcaccgtgcggatcagtccggccgagcgcaggacggtggcgtgttcgctggcgctggccggagcgacgcgggcgtaccgggcgagttccttggtggagcagccggggtgctcggcgatgctctggagcacggcggcccgggtgtggcccagcagcggtgccagcgccggccgggccccggacgcggccgacggcggcg

SEQ ID NO: 848 - DNA, 3046 bp, Unknown
  Kingdom: Bacteria, Phylum: Actinobacteria, Class: Actinobacteria, Order: Streptomycetales, Family: Streptomycetaceae, Genus: Streptomyces
gccccagccgcagcccacgtcgaggacacggcgggtgttcgccgcgccggccagctcggcgaacttgtccagcttgcgctcctgggcctcgtcgagggcctcggtgaggccctcgccctcctcccagtagccgccggagtacatcatcgtcgggcccagcaggaggcggtagaagtcgttgctcacctcgtagtggtgcctgatcgcgtcgacctcggggaccgactggttcgcgaccgtcgtcattttcgtcctcaattcccgtccggatcacgtctcttggcgtgctgcctgatgtcagcgcgagacgagaaaacccctcgcgtcgcaagagatgtgcaacacgagggcaggcgccggctgttgcgcgccgattgcgcgtggacgggttgcatgcgttctcgacaaggccgagccctgcggaggacaaggccccaccgccaaggaaggacccacctcatgtctctgcccaccatcgaagaactggcgagccagctcgaggccgtgtccggcgccgagaaggtcgacccggaccacccgctgcagcacatcccggacgtggactcgctggacctgatggagtggctgtacggcttccagaacacctacccggacatcccggccgacgagtcgctcttcgccgacctggacgacaccacgaccctgcgccacgtctacgaccgcatcctggcgctcgtgccggcgcaggtctgagcggggcgcgcatgaacggcttcgacatcaccgggtgggggatgtccgtccccgagaaggtggtcaccagcgcggagctggcgacgcgtttcggcgtcgacgagcactggatcaccagccggtgcggcatcagtgaacggcgcgccgtcggtcccggccagacgacagcctccctggccgtcgaggccggtcggcgcgccctcgccaaggcggggctgagcggcggcgacatcgcccatctgattgtcgccaccgccacgcccgagcagccctcgccggcgacgtccgcgttcgtgcaccacgaactgggcatcgccggcagcgcgcacgacgtcaactccgagtgcgcgggcttcgtctacgggctcgtctccgcgatggccctcatcgccatcgacccgcggcccatcctgctcatcggttccgacacccacacgctgaccgccaaccccgccgaccgcgacctgtcgatcctggtcggggacggcgccggcgcgatcgtgctccagcccgccgccgacagcaacgtcctcgcctggaacctgggcgccgacggcagctgcaccggcagcctcaaggtcctggccggcggcagccggatgccgaccaccgaggagacggtccgccagggcctgcactacgcgcagatcaacggcaacgagatctacctcaacgccgtgcgctacacggtgcgcaccgtgcgcgagaccctcaagagcgccaaggtcgaggcggccgacgtccggcacgtcatcccgcaccaggcgaacatccgcatcatcaactcgatcctgagccacaccggactgcggccggaggcgctggtcgcgaacctgcacaagtacgggaacacggcgtccgcgtcgatcccgatcgcactgaccgaggccctggacgagggccgcatcaaggacggcgacctggtcctgctggccggcttcggcgccggcatgacctggggctccttgctcctcgaatggcgcggagggacacgatgagcagcggcaagtccgccggcacccggcccgagcaccccgtcgccctggtgacgggcgcctcgggcgggctcggccaggccctggcactcgaactggacgcgctcggctgccgggtggccgtccactacaacagcgcgaaggacgcggcgcgcgccgtgcaggacaagctgaccaacgactccgtcctggtcaccggcgacgtcggctcctacgaggcggtcggcgcgctgtacgagcagatctgcgagaagctgggcccggtggacgtgctcgtcaacaacggggccatccgccgcgaccaggtcatggcgatgcagaagccggaggactgggccgcggtcatccagaccaacctgatcggctcgttccacacggcacgggtctgcgtgccgcacatgctgcgcaagcggtggggccgggtcgtcaacgtcgtctccccctcggggctgatcgcgaccgcgggacagacggcgtactccgcctccaaggcgggcctgatcggcttcacgcggacgctggccgccgagtgcggccggcgcggggtgacggtcaacgcgctctcgcccggcttcatgatcacgggaatgacgcagacccttcccgaccacgtgaaggaatccatggaatcgaaggcacccgtgccccgattcgtgacggtggaggaagtcgcccgcagtgcgagcctgttcctggaacaggactgcatgaccggacaggtcatcagtatcgacagcggggtctccatcacctgacaggtctcgccctccccctcgggcgaaacgagaaaaggtgtccggggaatgcggccgcattccccggacaccttttccggatttcctacgcggcgggcggacgcaacgccccggacgtccccatcaccagcggatccacgatcccggacgtgctcccgtactcccgggcggggccggcctcgcgcagcagatccaggtagagcgactgggtgcgcggcgccggctctataccgagttcgtccgagagcatctcgcgcagctgctggtagacgcgcagcgcctcggcccggttgccggccgcggcgtgcgcggtcatccggcagcggtgcgcgctctcgcggaagggcgccctgcgcaccgcctcgtcggcgtagcgcagggcgtggtgcccgttgccgagggcggccgccgacacgctggccagctccagggcggtcagccgcagttcgtcgatgcgctcgcgcgtggtgttcacccagtcgccctcgtgggccggcaggaaggcgccgcgcagattggccaccgcgccggtggcgagctgctgggccaccgcgtgctccccgtcccggcaggcctgccggg

SEQ ID NO: 849 - DNA, 3693 bp, Unknown
  Kingdom: Bacteria, Phylum: Actinobacteria, Class: Actinobacteria, Order: Streptomycetales, Family: Streptomycetaceae, Genus: Streptomyces
gcgtcggcgaggcgcaccacgccggtcagcggcaggtggcggccgtccagcgcgacgcgggtgtcccccgcgtcccgggacggcgcccgcgtcgcgccgttcactgctgtgtccctgtgtgtgcggttcaggccagaccggccgacttcagccaggccttggccacgtccagcgggtccttgttctgcgactgcacctgcgtgtcgaggtccagcagggtggccgtgtccagcttggcggagagcgcgttgagcgcgtcgacgcccttctggtccagtccgctcttgtagacgagcggctggacgttctcgaacccgaagaggttcttcgggtcctgcaggacgacgaacttctccttggcgatggtcgggtccgtggtgaagacgtccgcggcctgcacggtgtccttcttcagtgccgcctgggtcagcggaccgcccgcgtccagtgccttgaaggacttgaactcgaggccgtagagcgacttcaggccgagcaggccctgctggcgcgtctggaactccggcgagccgccgatgaccatgtccttcgcggcggccttgaggtccgcgatggaggacttggcggtcaggccgtacttcttcgccgtggcggcgttgacggtgaccgagtccttgttctgcgcgggcgacggctgcagcatcgtcagcttggcatcgagcttggtgttgatcgcggccgtcgtggcggcgaccgtcttcggcgcggcgttcttgtcgaggtaggccagcagcgcgccgttgtactccggcaggacggtcacggaaccgttcttgagcaggccgtacgtggtctcgcggctgccgatgttgtgcttgtacgtgaccttgacgcccttggccttcagggcctcgccgtagatgtcggccagcaggatgctctcggcgaagttgttggagccgacgaccacactgtcaccgctcgcctcgccgcccgcgagcgggtcgctgccggacttgtcgtcggaggacgaacacccggcgaggagtgcgacggtggcggcgagggcgacggcgaccgcgccggcgtgcctcgtgctggacctggtgctcttcgcgtaagaagtcacgattctcgttccggggtgggaagtcgtggggcatggcaggagcaaaggagtacggcatgcgggacgccgcactttactgatccaatccagccgcttctcggtcagtcaagagcagtcaggtcaccgattggcttcgtttgcccggtacttgtgaaccgcaagcgattgctttgtaacgcattcttgacatgggacgagccgaacgccgcttcgaagagacggtagatttcacggcgttcgacgtcggccacagcggtgtacacgggccgctccggtgtcctcgcgcgtcatcgttgtcccgaacgtcccgggtggagcgtcccggggtggaacgtcccgggtggagacacccttcgaaggaggcccggtgtccacgaacgaggtggacgcgcccacccggcaggccccaccgccccggcccggcggcatcagggatttcgccgaccggtggcccttccggcgcaaactcaacgtcctggtcggcgtcccgctcgccgtggtcggcctgctgcttgcctatctcatcgccgatcaggtcggccaggccagggacgcggccgccgcggcccggctggtgcgtgacagcgcccaggtcgcggccctcgtcgaccgggtggaggccgagcaccagcaggccgtcctgctctccgtgcgctacgaggcccagggcatcggcgcccggccctcgaccgccgcctaccgcaaggcgcaggccgcggtcgacgcccaggtcggcgcggtacggcgggcgttcggcgaccggttgcggggcaccgaggcgcaggcgctgcgggagatcgagggcctgagcagcctgcgcgacaccgtggagcagagctatctgcccgccgacaacatcgacccggcctacacgggcgccgcgaagaacctgatcgacggcctcggcctcgaccggaacgcggcactggcggccaccttcaccggcaacctgctggactccctgctgcgcgccgacgccgcgcacagctccttcgagaccagcgtgttctcggcgacgaccggcgacaccaacgcgctcatcgagttcaccggcgcggtcggcgcccacgagctgtacacctaccaggccgaccgcttctcccggttcgccaccgtggaacaggcggaccggctctcggagatcgaacacacgcccgcgcaacgccggatcgccgaggcgtacgccgaactgcagatcgacccgagcagcctgcaggcgaacggccccgaccagatccgccgcgccttccaggacgcgctgggcgattacccctcctaccccgaccaggccgccgcccggctgaagatcgcctcctcgctcatcgacgagatcgccggcacggcccacgacgcctccaccgacgcctggtggcgggccgccgggctgctgaccgccgccctgctcggcttcctgctgtggctcggcttctcggtggccgtgcgccgctcggtggtccggccggtacaggcgctcaccggagccgcgcaggaggtctccgcggccaccgggcgcgaactcgcccgggtcgccgacgacgactccgacgacaccgggccgccgcgcctgcaggacgtgcccgtcaccgcgcgcgacgagatcggcgacctggcgacggcgttcaaccaggtgcagaccacggccgcggcgctgctggagcgccaggtgctcagccgccgcaacgtcgccgagatgttcggcaacgtcggccgccgcgtcagcaacctcaccacccggcagctcgcgctgatcgacgcggtcgagcgcggtgagaccgacccggccctgctcgaacgcctctactccatcgaccacatcgccgtacgcctgcgccgcaacgccgacagtctgatgctgctggccggcatccgcgaggccgtcctggactccggccccaccgcgctgaccaacgtggtgcgtgccgcgctcggccagatcgagggctaccagcgggtgcggttgcacgccgggaccgaggtcatggtcgcgccggacgtcatcggcgacctcacactgatggtggccgaactcctggagaacgccgtctcgttctccccggcgggcagcccggtcgaggtgaccgtgcgttcgggtgccgagggtgcctcgatcgtggtcaccgaccacggtctcggcatgagcgccgagcgcctcgccgaggagaacgcccgcctgatccgccgcgaacgcctcgacgtcgtaccgacgaaggtgctcggcctgttcgtggtgggcacgctggcccggcgctgggaggtcggggtcgccctgacccgtacgccgggcggcggtgtcacggcggaggtcaccatcccgccggccctgctgctgaccctgggcacggtggcctccggcggcgccggggcccagggagcggcggagcgcaccggacccggcggcgaggccgccggtgacctccttggcgccgccgacagctccggcgccaaggaggtcaccgggccgaggccctcggccgcggtggtgccggagcccgcctcggacggcgacgacgagcccggctcgctcccccgccgcctcccccgccgcgcaacggcccccgccgcgtccgccgcggagacggccacgggccgggacggagctgcgg

SEQ ID NO: 850 - DNA, 6923 bp, Unknown
  Kingdom: Bacteria, Phylum: Actinobacteria, Class: Actinobacteria, Order: Streptomycetales, Family: Streptomycetaceae, Genus: Streptomyces
gtgctttggtggccgtgaggtgaggcgccggtggtcgctgccttgggcttggtggtcgtgaggtgaggccccggcggtccctcccttgggcttgggtggccgcaaggcgagcggggaggccggttcctcgggcttcggtgactgtgagccgagggggaggctccttccttcgtgcttcggcggccgtacggtgaagcggcgaggaccttgcctcgcgctcctgtggctgtacggcgaaggcgccggtcccttccagggcaccggcgccttcggctgtcgcgcgggtgcgctagatgccctgccactccggcttgttggcgtaggtgtggcggaagtagtcggcgagcttcagcttggaggcggctgcctcgtcgacgacgacggtggcgtgcgggtggagctgcagcgccgaggccgggcacaccgcggcgaccggcccctcgacggtcgcggcgaccgcgtccgccttgccctcgcccgtcgccagcagcaccaggtgccgggcctccaggatcgtgccgatgccctgggtgatgacgtggtgcggaacctgctcgacgtcaccgtcgaagaagcgcgcgttgtccacgcgggtctgctcggtcagcgtcttgatgcgcgtccgcgaggcgagcgacgagcacggctcgttgaacccgatgtgcccgtcggtaccgatgccgagcagctgcaggtccacaccgccggcctccaccagcgccctgtcgtacgccgcgcaggccgcctgcacgtcctcggcggtgccgtcgggccccaggaacgcctccattccgatccccagcggctccagcacctcccggcgcaggacggagcggtaggactccgggtggtcggctcgcagccccacgtactcgtcgagctgagcgatccgcgcccgggaggtgtccgcggcgccggaccgcaccttggccgccagcgcctcgtagatgggcagcggagtcgaacccgtggcgacaccgagcagggcgtcgggcttccgccgcagcagctgcgccatggcctcggcgatgagctcgccgcccgccctggcatccggaacgatgacaacttccacgctgggcctgccgatctgaggagagccgagaaggggaccggacccggaaggaggggtcatgtggtttagaccaatctagcagaatcgggttcccgggacccgacccccgtgaagccgaaaccaccctctttcgggcctcctccggctcgcccggcaggcgtcctgccgcaagggcggcctacatcatcgaaccccccgtcgcatccacccagctccccgtcacccatcgccccgcgtccgaggcgaggaacgccaccacgtccgcgacatcggccggcgtgcccacgcggccgagcgccgatatcgacgccgcccggtcccagccgcccggtgttccgtgcagcagctcggccgtgttgtcggtgtcgacgaggccgggcgccacggagttgacggtgatgccgcgcgggcccagcagcttcgacagatcccgggtgaacacgtccagcgcggccttcgtcatcgagtaggccaccaggtccggcatgaccgcgtcgcgcgcgaggccgctggagatgttgacgacccgcccgccgtcgcgcagccgccccaggccctgccggacgatgaagaacggcgccttggtgttcaccgcgaagacctggtcgtagtcctcctcggtgatctcctccagcggccgtgagctgccgatgccggcgttgttcaccaggatgtccagtccgtccgcgtgccggtcgaactccgcccagagcgcctcggcgtcgccgggccgtcccagctccacgccgatcgtgaacgccgcgccgccggccgcctcgatcgccgcgaccgtgtccttggccgccgcctcgttggtcccgtagtgcacgccgacgcgcgccccgtcccgcgccagtcgctcggcgataccccgcccgatgcccctgctcgcccccgtgaccagcgcggtcctgcccgcgagcggccctgcggcccggtccgtgtcgcctgtcgcgcccgagtgcatgtccgtccccatgtgaagcccctcccaatttccatagctgtcgctacagaaagaccgtaccgcagtccgctgtcacttttctagtgcccgttataaaatcactccatggtggcgaagcgggaggcagaagagcaggtcagcgcaggggcggaggcggccggagagggagcgcccgccgcaaggcgccgcggccggccccgctcgttcgaccgggcgaccgccctggagaaggcggtcctcgccttctgggagcacgggtacgagggcacttccgtctcggacctcacccgcgccatgggtatcggagcacccagcctgtacgcggccttcggcgacaagcaggcgctcttcgccgaggtggtgcgggactacggcgagcggtacgggtccttcggcgcccgcgccctggccgaggagcccacggcccgcgccgccgtcgggcggatgctgcgcgaggcggcggccgagtacaccgccccgggacgtccgcacggctgcctggtcatccacgcggccacccattgcacgacccccgaagtagaggagttcctgcgcacgctgcgcaacgagaacatcgcgacgttcgagagccggatacgagcgggcgtcgccgccggggagctgcccgcggacaccgacaccggcgcgctcgcccggttcgtcggcgcggtgatccagggcatgtcccagcaggcacgcgacggggcgagccgcacggacctggaggcgctcgcggaaattgccctcactgtctggccccgtggctgagccgggcgggctaggctgctccgtgtcgaacgcctgccgtccgccttcgggtggctcggccggtcctgccggtccggccgataccgtccggccgttcgccggagaacgatgaagaaagcgcaacgaacggcttcccgctcatggacaggcgcaagtggtctagtccagaatcgagtgggatccgaacagcagcacgcacgcggcgctgacgcgcgcaagaggtgaacacgtgaacctccgtcctccccgcacaggaggacggaccgaggaaccggtgctctctgccctgactgccccggctcctcatccttcggccgaccgggaccgcacaccccacggccgatgttgctccgggctgcggtgccgggagggttgagggtccctctcaggcgccgcggcccgcgggtgtcttcggagccgggcggtcgcaagccgccccggccccccgccaccgggtatttcgaaaccgtacaaacgcccgggtacgctcgcagacgtgccctccatgaacgaactcgtacgccagcacaccgccctcgacgactccgatctcgagtggctccacctgctggtctcggagtggcagctgctctccgacctctccttcgccgacctggtgctgtgggttcccacactggacggcacccgctacgtctccgtcgcccagatgcggcccaacaccggcccgacgtcctaccaggacgacatgatcggtcacctcgtcccgcggggccgccgtccgatgctcgacgcggcgctcgacgagggacgcatcgtccgcgagggcgacccggagtggcgcgaggaggtgccggtgcgggtcgagtccatcccggtgcggcgcgaggggcgcgtcctcggggtcatcgcgcgcaacaccaacctgctgaccgtgcgcaccccgagccggctggagctgacctacctgcaaagcgcttccgacctcgcacagatgatcgcggccggttccttccccttccccgaccagcaggtcgacatggacgcctcgccgcgcgtcggggacggtctgatccggctggacgcggacggcgtggtgacatacgcctcaccgaacgcgctctccgcctaccaccgcctcggcctcgccgccgacctcgtcggccaccacctcggcgaggccaccgccgaactcgccccgtcccgcgcaccggtggacgaggcgctggtgaagctggcgagcggctgggcaccccgcgagttcgagatcgaggcccatgacggggtgatccagttccgggccattccgctcaagcccaagggcactcgcatcggttcgctggtcctgctccgtgacgtcaccgaactgcgccgccgcgaacgcgagttgatcaccaaggacgcgacgatccgggagatccaccaccgggtcaagaacaacctccagaccgtggccgcgctgctccggctccaggcccggcgtatcgattccgaccgtggccgggaggccctggaggaggcggtccgccgggtcggttcgatcgcgatcgtccatgagacgctgtctcagaacctggacgagcgggtggagttcgacgagatcgccgaccgggtgctggcgatggtcgccgagatctcgccgggcaaggtcgcgggccggcgcagcggccggttcgggatcctggacgccgaggtcgccacgccgctgtcgatggtcctgaccgaggtcctgcagaacgccctggaacacgggttccaccagggcgacacgggcaccgtcgaggtctccgcggtgcggggcggcaccacgcgcgagggccgcctgctcgtcaccgtccaggacgacggcgtggggctgcccgacggcttcgacccgcatcgctcgggcaatctggggctgcagattgtacggaccctggtcgagggcgagttgggcgggaccttcgacatggtcccggcgcccgggcggggcacgcgcgtggtgctcgacatcccggtgggggcgcccaagtagccggtgcgggggagcggttcacgcggagagcgcccgctcctcttcgccggcacgacgcagtcgtcggcacagcaaagagccccggacctttgcaggtccggggccagtcgctcgttgctgccccatcggaatgggggtaccccgtgctcggagagcttgggggagcatcggtggtactgcgcgctgcggctcgggggcgggggttgcgtacgcgccgtacgcgccgccaagctcaggctgtcagcggggtggctgtggtcaggcggaggcctgacgggcccggttgcgagcggcgcggcgcttcatcgcgcggcgctcgtcctcgctgagaccaccccagacgccggagtcctggccggactcgagcgcccactgcaggcactgctccataaccgggcagcgacggcagacggccttggcttcctcgatctgcagcagcgcaggaccggtgttgccgatggggaagaagagctcggggtcttcctcgcggcaaacggcgttgtgacgccagtccatggctgctacctctccttggtattacgtgcaagttgcttgtgaatgtgaacgctttcacgaatccctcaacaagtgaagggccgaccgtcaggtttccctggcgtggtcctgtggattgaagaggggttccggcgatctccgtggcccgctgtggtgggccgtcccgatcgccatgtagagattcgcaaacctcggcggcggatacaaccccttccggaaactttttttggattcctcggtgtcgactaggtcacagccgtacttccatggggtggatgctggtctaaacgttcgagtgaaaggactttgggcccttccactcacacaatcacacgcagtgcacggcgtacgcctgtgaacgtcacgctcgtacgcagccccaggtggtcaccgtccatctggagggggagcggcgccttcgaatgcaaggcgaagctgctcaggtcgtgcagcgagagggcatgcctgccctgcggtccgcgctccggggacgaagtgagcaactgggtgccataccgggcgaccgcggccgtggacaggcggctgagccccagcacgtcgagaccggtgtcgaacgacgccttgggcgacgtgtacatcgggcggttgcccaggtaggtccagggcgaggtgttcgacactatcgccaccaccagatcggcgatcgggtcctcgcccggctgctccagggtgatcgccccgtgccggcggttcggttcgccgaagaactggcgcagcacctggcgcacgtacagggcgtgcgtggacttcttgccgcgctcgcgctgctgctccacgcgcccgaccacgcccgcgtcgaagccgagccccgcgttgaaggtgaaccagcgttcggggaccgccgcgtcgtcggtgcccggcgtcccggacgcgaggcccaggccgaccgtgcgctcgctgccgtcacgcagggcgtccaggatggcgcccgtcgcctcgaccgcgtcgttgggcaggcccagggcacgcgcgaagacgttggtggatcctcccggcaccaccgccaggaggggcaggcgctcggggtcggggccgcggtgcagcagaccgttcacgacctcgttgaccgtgccgtcgccgccgagggccacgaccaggtcgacgtcgtcgctgtccgccgcctgccggcccaggtcgcgtgcgtggccccggtactgggtggtgaccgcgtccagtttcatctcactggcgagggcgtggatcaggacgtcgcgcgtacgtgcgcttgtggtggttgccgccggattgaccacgagaagtgcacgcatggtcagcagcgtacctactgagtagtaccgggcccaggccgaggtagggatcgggtaagaggagcgggcgtgagcctggacacggcggtccgcgccacaagggctgcctttccgtggtgcggctacccttctggggtgagcagcgagcagaacccctccaccgacaccaaggacgcctccggcccgcgcccaggacggctgacctccgcggcggcgctgtgcgcgctggaagggctcgcactgctcgccggcggcgtctggatgctggtgctgggcctcacgggcgacggcagcgaccggcagcaggccgtcaccggcgggatcaccgtgctcgtg

SEQ ID NO: 851 - DNA, 809 bp, Unknown
  Kingdom: Bacteria, Phylum: Actinobacteria, Class: Actinobacteria, Order: Streptomycetales, Family: Streptomycetaceae, Genus: Streptomyces
gtcaccgaactgcgccgccgcaacatccaggtcctcctgcgcacccgcctggagtcgtgcgccggccgcgtcgccgtcctcagcgacggccagcgcttccccacccgtacggtcgtgtggaccgccggcgtcaaaccgcaccccctcctggccgccaccgacctgcccctcgacggccgcggacgcctcaagtgcaccgccgaactgaccgtcgacggcgtcacacacgcctgggccgccggagacgccgccgccgtccccgacgtcaccgccgccgaacccggcaaggagaccgcccccaacgcccagcacgcggtgcggcaggccaaggtcctcggcgacaacatcgcccgttccctgcgcggcgagcccctccagacgtacgcgcacgcctacgtcggctcggtcgcctccctcggactgcacaagggcgtcgcccaggtctacggacgcaaactgaagggctacccggcctggttcatgcaccgcgcctaccacctcagcagggtccccaccctcaaccgcaaggccaaggtcctcgcggaatggacgctcgccggactcttcaaacgggagatcgtctccctcggctcgctggaacatccccgcgccgagttcgaactcgcggccggtggaaagcatcctctcgacccgaacatcaacccgaaagggtcatcctgaccggaccggggaactccaccggccgccccggcgtcccacggatgccggagcgcggtggccgcactgccagactggtgcgcggccggaggcggacagccgcccgcccgggccgcgcaccagtctggcag

SEQ ID NO: 852 - DNA, 9617 bp, Unknown
  Kingdom: Bacteria, Phylum: Actinobacteria, Class: Actinobacteria, Order: Streptomycetales, Family: Streptomycetaceae, Genus: Streptomyces
cttcacacgccgtacggcgtggcgcgagttgcccggtcagggggcggcggggctccgcccggccgccccaacgcgcctcgagccccgtcagttctgcgacgggagcgaggaggggctgcccgtgcccggctccagcgcgtccagcgcccggcgcagtcccgtgagcttgcgctccagatgggccgccgtggccacggccgcggcgtccgcggagtcgtcgtcgagctgcttggagagggcttccgcctgctcctccacggccgcgaggcgcgcggacagctccgcgagcagtccggccgcctccttgccctcgccgacgccgctcttgccgccgccctccagctggagccggagcagggccgcctgctccttcagctgacagttcttcatgtacaggtccacgaacaccgagaccttggcacgcagcacccacgggtcgaacggcttggagatgtagtccaccgcgcccgccgcgtagccgcggaaggtgtggtgggggccgtggttgatcgcggtgaggaagatgatcgggatgtcccgggtcctctcccgccgcttgatgtgcgcggccgtctcgaaaccgtccatgcccggcatctggacgtccagcagaatgactgcgaagtcgtccgtgagcagcgctttgagcgcttcctccccggacgatgcccgcaccagcgtctgatcgagcgcagagaggatggcctccagcgccagcagattctccggccggtcatcgaccaggaggatcttggccttctgcaccatggcccgccctcctcgccccggcttggggccgcccctgtccgcaggaaccggggcagcaccggtggatgccgccccgggggacgactcccttgcgccgcccgtccttgtgccggtcatcgtagccgtaccccgcctgtcgccacaccctgtcaccgcgatgtcactgtgcacgtagcggaaacgcggcaggagaccagaaggttccccgaatcccgcacctctacacgacatcgcgcacccagagtcaacaactccgcgcgcccgcgaaaagttcccggaaccggaaaacggatcactccggccccagcagcgcaccgagaaccgggccataacgggaccggacgggcaccgcgaacgcgctcgcacccaaccccggggcccgccgcgaacccggtaaccccgcgcccccggacaggtcgttccgctccccggcgcgccccacgaacccgtccgctccggccgccggcgcccaccgcgaaccgctcgctccgagctccgagccccggccgcacggcgaacccggtcaccccgagtttcgagcccccagggcgggggcgctgggcgtaccggcaggccccacgcgcccccgtgccgccgcctcactcctcgctcatccactgcctcatcacgcccagcagatggtcagggtcgaccggcttggtcacgtagtcggaggcgcccgactcgatcgccttctcccggtcgcccttcatcgccttcgccgtcagtgcgatgatcggcagcccggcgaactgcggcatcctgcggatcgccgtcgtcgtcgcgtacccgtccatctcgggcatcatgatgtccatcaggacgaccgccacgtcgtcgtgctgctccaggacctcgatgccctcgcgcccgttctcggcgtacagcaccgacaggccgtgctgttccaggacgctggtcagcgcgaagacgttgcggatgtcgtcgtcgacgatgagcaccttctcaccgccgaaccggacgtcccggttcacctgcgccgccccgtcaggctgcccgcccaccgcggtcggccactgctcctgccgctcctcgcgcccctgctgctcggcggcgggcagcgcccggcggcggcgccggaacagcgcggctgcgccgttctgcgtctcctggtacgacttcacctcggccggcgtctcgacctgcgcggccgtcagctcggaggcgtgcgacacgccgggcagctccgtcaggtgcggctcgccggcggcggcgaggtcgtcggcgtccaggccggtcaccggctgctggtacccgtgcggcggcaactcgcccgggtgcagcggcaggtagagcgtgaacgtggagccgcgaccgggctcgctctgggcgtagatctcaccacccagcagctgggcgatctcccgcgagatggacaacccgaggcccgttccgccgtacttgcggctggtggtgccgtcggcctgcttgaacgcctcgaagatcacgcccatcttgctggccgcgatgccgataccggtgtcggtcaccgagaacgcgatcatctcggtgtccgggtcggtcagcgagccgacctccagcaactgctcccggatcgcctgcggcacgtccccgcgcgcgggacggatgacgagttcgaccgacccggagtcggtgaacttcaccgcgttggacagcaggttgcgcagcacctggagcagccgctgctcgtcggtgtgcagcgtggcgggcagctccggcgagacccgcaccgacaggtccaggcccttctccgcggtcagcggccggaaggtggcctccacgtagtcgatcagctcgacgagcgcgatacgcgtcggggagacgtccatcttgcccgcctcgaccttcgccaggtccaggatgtcgttgatcagctggagcaggtcggatccggcgccgtggatcgtctcggcgaactccacctgcttcggggagaggttcccctcggcgttgtcggcgagcaacttggccaggatcagcagggagttcagcggcgtacgcagctcgtgcgacatgttcgccaggaactcgctgcggtagcgcatggagacggcgagctgttccgcgcgctcctccaggacctgccgggcctcctcgatctcggagttcttcgcctcgatgtcgcggttctgctgggccagcagctcggccttctcctccagttcggcgttggacgcctggagggccttctgccgctgctccagttcctcggagcgcagccgcagttgctcggtcagctcctgggactgcttcagcagctgctcggtcttggtgttgacggagatggtgttgacgctggtggcgatcatctccgcgatctggttcaggaagtccttctggatgtgcgtgaacggcgtgaaggacgccagctcgatcacgccgagcaccttgccctcgaacagcaccggcagcacgatcacctgcgcgggcggcgcctcgccgagcccggaggagatcttcagatagccgctgggcgcccgctccaccaggatggtgcgcttctcctgcgccgccgtcccgatgagtgcctcacccggccggaacgaggtcggcatggagcccatcgagtagccgtacgagccgagcatgcgcagttcgtaggcgttctccgggtcgtcggcgaagtccttgtcgtcggccagcggcatcgcgacgaagaaggcaccgtgctgggcggagaccaccggcgtcagctcgctcatgatcagcgatgccacgtcctccaggtcacgccgcccctgcatcagcgcggagatacgcgccaggttgcccttgagccagtcctgctccttgttggcgatcgtggtgtcgcgcaggttggcgatcatcttgttgatgtagtcctgcagttcctggatctcgccggaggcgtcgacgtcgatcttcaggttcaggtcgccgcgggtcacggcggtcgccacgcgcgcgatggcacgcacctgccgggtcaggttcccggccatctcgttcaccgactcggtcaggtcgcgccaggtgccgtcgacgtcccgcacgcgtgcctgcccgccgagctgcccctcggtgcccacctcgcgggccacgcgggtgacctcctcggcgaaggacgacagctggtcgaccatcgtgttgatggtcgtcttcagctccaggatctccccgcgcgcgtcgatgtcgatcttcttggtcaggtcgcccttggcgatggccgtcgtcaccatggcgatgttgcgcacctggccggtcaggttggacgccatctggttcaccgactcggtgaggtccttccaggtgccggccacgcccgggacgtacgcctggccgcccaggatgccgtccgtgcccacctcgcgggccaccttggtgacctggtcggcgaaggaactcagcgtcttcaccatggtgttgaaggtgtccgcgagctgcgcgacctcgccgcgcgcctcgatcgtcaccgtccgcgtcaggtcaccgttggcgaccgccgccgcgacctgggagatgttgcgcacctgcatggtcaggttgttggccatcaggttgacgttgtcgctgaggtccttccagatgccgacgacgcccggcacgtgcgcctggccgcccaggatgccctcggtgcccacctcgcgggccacgcgcgtgacctgctcggcgaacgacgacagctggtcgaccatcgtgttcaccgtggtgacgagttcgaggatctcgcccttggcgtcgacggtgatcttcttcgacaggtcgcccttggcgaccgccgtggtgacctcggcgatgttgcggacctggatggtcaggttgttcgccatgaagttcacggactgggtgaggtccttccaggtaccggccaccccctgcacctcggcctggccgcccaggatgccctccgtgcccacctcgcgggccacgcgcgtgacctcctgggcgaacgaggagagctggtcgaccatcgtgttcagggtgttcttcagctcctggatctccccgcgcgcgtccacggtgatcttctgggagaggtcaccgcgggccacggcggtggcgacctgcgcgatgttgcgcacctgcgaggtgaggttgcccgccatgccgttcacggagtccgtgaggtcccgccacacacccgcgacgccgggcacctgcgcctgaccgcccaggcggccctccgtgcccacctcacgggccaccttggtcacctggtcggcgaaggcggagagctggtcgaccatcgtgttgatggtgttcttcagctccaggatctccccgcgcgcgtcgacgtcgatcttctgcgacaggtcaccgcgcgccaccgccgtcgtcacctgggcgatgttcctcacctgaccggtcaggttcgacgccatcgagttgacggagtcggtgagttccttccacgtgcccgacacgccgtccacgcgcgcctgaccgccgaggcggccctcggtgcccacgtcacgggccatccgcgtcacctggtcggcgaaggacgacagctggtccaccatcgtgttgacggtgttcttcagctggagcatctcgccggagacgtccacggtgaccttctgcgacagatcgccgttggccaccgccgtcgtcacctgggcgatgttcctcacctgtccggtgaggttgcggaacgccgtgttgacggagtcggtgaggtccttccaggtgcccgccgcgcccggcacctgcgcctggccgcccagctcaccctcgacgccgatctcgcgcgccacccgcgtgacctcggcaccgaacgaggagagctggtccaccatcgtgttgacggtgttcttcagctccagcatctcgccggccacgtccacggtgaccttctgcgacaggtcaccgctggccaccgccgtcgtcaccgcggcgatgtccctcacctgtgtggtcaggttccggaacaccgtgttgacggagtccgtgaggtccttccacgtacccgccacacccggcacgttcgcctgaccgcccaggcggccctccgcaccgacctcgttggccacgcgcgtgacctcgtccgcgaagatccgcagcgtctcggtcatctggttgatcgtctcggccagccgcgcgacctcgccgcgcgccggaacggtcaccttctgcgacaggtcgccgttggccacggccgtcgtgacctgcgcgatcccgcgcacctgcgccgtcagattgccggccatcaggttcaccgagtcggtgagttccttccaggtgccgtcgacgcccggcacgtgcgcctggccgcccaggatgccgtccgtgcccacctcacgggcgacccgcgtcacctccgacgagaacgcggacagctggtcgaccatcgtgttgacggtgttcttcagctccagcatctcaccggcgacatgcacggtgaccttccgtgacagatcgcccttggccaccgccgtggtcaccagcgcgatgtcccggacctgcgccgtcagccgggacgccatcgtgttgacggagtccgtgaggtccttccaggagcccgaaagaccccggacccgcgcctgaccgcccagcttgccctccgtgccgacctcgctggccacccgcgtgacctcgtcggtgaacgtggagagctggtcgaccagattgttgacggtccgcccgaccttcaggaactcgccccgcagcggatgcccggcaccgtccgccacctgcgtccgcagctccatccgcggcgacagatcgccctcggcgaccgcggacagcacccggccgacctccgagacgggccgtacgagatcgtcgacgagcgcgttggagttctcgatcgcggccgcccaggacccctcacaggcacccgtctccagccgctccgtgagttttccctcacgccccaccatgcgccgcacccgcgccaactcgcccgtcaggtgcagattccggtccgcgacctcgttgaagaccgcggcgatctccgacatcacgccgtccccggacaccgtgagccgcttgcggaagttcccgtcccgcatccccaccagcgccgccaggagccggttcagcgcggccgtgtcgaccacggtggtcccgcctcgcggcgtgcgccgcccgctcggggactgcccggactgtccgcctttcgcgcgcgtcttcgtgccccgcgtcgctgcgccagactccactgtgtccctcccgcagggatcgaccgtcactgctgcgtcgttaccgcccgatgcgaccaggccgcacgaggggctgctgccccgcacgtgaagaccacactccgcctgcccgtaccgtcaacagaagcctgcccagtgtttcacccccaccgaaccaggccataacagttcggcagcttcgcacaccgtccgcacaccctccgggcgaaaacagtggtgaccggcatccgcacggaccgcgaaggtaagtaaccttgcatgcggctgtccagccacgccggtccgtccggcctgggcggtggcacggcaacaagcgggcatcggagggcggccgcacacatgaccaccggagtgatccccgggggacagaccccggagccgcggccgacggggccccagggtcccccgctgccggagcagcgtggcgagccgggcggccaccgagagctgcacgaagacaaccggacgaggagttctgtgatcaccgcgcgcgcggccgccaccttcgagcccctgggacgatcggtcgcgaccgcccggtccttcgtccgcgacaccctgcagggatggggcttcggcgacatcgtcgacgacgccgtggtcctcaccagcgaactggtgaccaacgccgtcgtccacgcgggaaccgccgcggacgtcctgtgcctgcgcagtgacaacggcgtacggatcgaggtcgccgaccgctaccccgagcgcgaggtcccgctgcagagcgccgcggtctccatgggcagccccgaccgcgagggcggacgcggcctccagctgtgcgcggccctcgccggccgctggggcgtggaatacacccccacacacaagaccgtctggttccagctgaccctgcccgaacgcccggtcggcacccgcaccgcaggcccctcactgcccgccgaactcctccccgtcgccgacggccgggtccgcgtcgccgtcgtccagatcgaccgcggcggcgccatcaccgcctggaacgacgacgccggggaactcttcggctacgccgccgaacaggtcaccggcaaaccgctcaccgatctcgccgcctggccgcacacgccgggcaccggcaccggcatcgccgaagccctccagctctcccgctgggaggggagctacggcatccgcggcgcccacggccgcgtcatcccggtctacgcctcccacctgcgcgtccgcgacaccggcggcgaaccgtcgacggtctgcctgctcgtacgcgaccacgagcgcgccgtcctgcagacccctctgcgcaccgcctcgaacagcgacacgaagaactcctcctcggacggcaccggcacggaccccttcgaggtcttcatcggctcccccgcccccgacgacctcgacggcctcctgcagcgcacggtggaacgcgcccgcgacatgctcgacggcgacgccgccttcctcctgctggccaccgacgacgagacggaactcgaggtccgcgcctccaccggcctgccctccgcccgccagcgcttcgcccgcgtccccgtcgaggccggccccggccgctacggctcggcccggatgcccgccgtccacgacgacctgaccgccgcccccggcgccgtacccctgctcggcggcaccggcatgcgctccgtcgtcaccgtcccgctcaaggtcgagggccgcctcaccggctccctcggcgtcgccgccgaaggagcgggcagatactccaacgaggaggcactgcgcctgcagttcgccgccgaccgcatcgccctggccgtcgaatcggcccgcctgggcgagctggagcggctgcgccgcggctcactgagcttcctcgtcgaggcctccgacctgctggccggcaccctggaccgcgaccagaccctcgccctgatggcccagatgacggtccccacgctggccacctggtgcgccgtctacacgatcgccgaccaggcctccgagccctacctgtcctacgtcctgcacgaggacgaggaactgatcgacggcatcaagtccctgctgtcgaagatcgccccgcccgacccggtaccgacgcccggagcccgcgtctggtccgcccccggcgaggccgcccaccaggcggccctgcgcacctccatgcgcagcctcagcctgggcggctcggaccaccggatcggtacgaccatcggcccgaccctcgccacggcctccgccgtcggcggcgagacggtcgtgctgcccctggtggcccgcaaccgcgtcatcggcatgctcaccctcggcaaacccaccgacgagcacttccgccaggagatcctggaactcgccgaggacctcagccgccgcgcggccctcgccctggacaacgcccgcctgtactccgagcgcacggccatcagccagtccctccagcgcagcctcctgccgccgggactcccgcaggtcgacggcgtggaggtcgacgtcatctaccgcgcggccggcgagggcaacgaggtcggcggcgacttctacgacctcttcccggccggcgacggccgctggtgcttcgcgatcggcgacgtccagggcaagggccccgaggccgccgtggtcatcgggctcgcccggccctggctgcggctgctggcccgtgagggctacggcgtcgccgacgtcctcgaccgcctcaaccagctcctcctcgacgacgccaccgaggccgccgacgccgcggcccgggccctggtcggccccgtc

SEQ ID NO: 853 - DNA, 1437 bp, Unknown
  Kingdom: Bacteria, Phylum: Actinobacteria, Class: Actinobacteria, Order: Streptomycetales, Family: Streptomycetaceae, Genus: Streptomyces
gtggacgatcatttcgtccgcaccggccgcgaggccggccgcaccggtgagggccccctgaccggctcccaccagtgtttcctgccccgcggcggacccgtgctgcccgccgtccgtcaactgggcgccggccgggctgcccacggcgcggcccgcggcgacggcggccgactgcaactggtcgacgaccggggaggagacgtcctccagcaacgcggcgggcagcatcaccagggcgcgcgtgccgccgtagtcggactcgcgcagcaccaccttgatgccgtgccgctcggacagccgggccaccacgaagtggcccaggcgggggtcctcgccgaagaccgtcatgtcgaccctgggcggctgggcgagcagttcgttggcgcgctcccgcatctccgcgggcatgccgagcccctggtcctcgacatgcacggccaggcccttcgccacccgggtcgtgctgaccgtcacctcggtgtcgggcggggagaaactcgtgccgttctcgatgagttcggccagcaggtgcgtgacgtcggcgaccgcccggccggccagcgccacccgccggtccgccggggtgttgcgcaccctgaccctggtgtagtgctccgtctccgccactgcgccgcgcatcacgtcggtgatcgccaccggccgggtcatgcggcggctcggcggggcgccgctgaggatcatcaggttctccgcgtgccgccgcacccgggtcgccaggtggtcgacgcggaagatgtccttgagcaggtcggagtcctcgtgcttgcgctccaggtcgtcgaggagcgcgatcagccggtggatcagcacctgggcgcgccggatgagctggccgacgaccttgtcggagccctgccggccctgggactggcgcagcacggagtccgcggcgacccgcgccagctggtcgaccgccgaggacagccggccgatctcgtcggtggcctgctgccggtgcggggtgaggccggccggatcgacccgctcgcccttctccagccgggccaggagttcgggaagccggaacgcggccagctgctcggtgcccgaccgcagaccggccagctgctgcgacaaccgctcgaaatcggcgagccgagtgagcgcggagcgccgggtgcgcagtgccagcaccgccgcggcggcgaccgccgccagtgtggccgcgctgcccagcagcgtgaccagcagtaactcctgggcccggtcggtggcgtgagcggacagcgcgccgagggacgtgccggagagggtctggaactcgtggacgacgccgtcggcggcggccaggccacgcgccggcgctctgcggcagcgcggtgccctggccgccgctgacggcctgctcgaccgagcccacgagaccgtactagatctcgtatgccgtcttctgcttgaaaaaaaaaaataagcaac

SEQ ID NO: 854 - DNA, 4305 bp, Unknown
  Kingdom: Bacteria, Phylum: Actinobacteria, Class: Actinobacteria, Order: Streptomycetales, Family: Streptomycetaceae, Genus: Streptomyces
ccgggcgcccctcgccgtcgtttccttcgtatccctcgggcggctcagccctccgcgtcctcccgccgcaccgacagcaggtcctccagctgctcctcgcgggcctgcgcggccacgaacagcagttcgtcgccgacctccagcgagtcctcctgcgacggcgtgagcacccgggtgccgcggatgatcgtgaccagggacgtgtcctcgggccactggacgtcaccgacctgcgtgccggccagcgccgactcctccggcagggtcagctcgaccaggttggcgtcgccgtggctgaagcgcagcaggcggaccaggtcgccgacgctcaccgcctcctcgaccagcgccgacatcagccgcggtgtggacacggcgacgtccacgccccacgcctcgttgaacagccactcgttcttcgggttgttcacccgggcgacgacgcgcggaacgccgtactccgtcttcgccagcagcgagacgaccaggttcaccttgtcgtcgcccgtcgcggcgatcaccacgttgcagcgctgcagcgccgcctcgtccagggacgtgatctcgcaggcgtcggcgagcagccactcggcctgcgggacgcgctcgaccgagatggcggtcggcgccttgtcgacgagaaggacctcgtggccgttctccagcagctcgcccgcgatcgagcgaccgaccgcgccggcaccggcaatggcgaccctcatcagtgaccgctctcctcttcggggccctcggcgaacgccgcctcgaccttgtccacgtcgtccgtccgcatcatcacgtgcacgaggtcgccctcctgcagcacggtctgcgaggtcggcagcatcgactcgccgaggcgggtcaggaacgccacccggacgccggtgtcctcctgcagcctgctgatcttgtggccgacccacttcggcgacgcgtgcacctcggcgagctggacgccgccggtggggtcgcgccacagcggctccgcacccgagggcagcagccggcgcagcatctggtcggcggtccagcggaccgtggccaccgtcgggatgccgaggcgctggtagacctcggcgcggcgcgggtcgtagatacgggccgcgacgttctgcacgccgaacatctcgcgggccacccgcgccgagatgatgttcgagttgtcgccgctggagacggccgcgaaggccccggcctcctcgatgcccgcctcacgcagggtgtcctggtcgaagccgatcccggtgacccggcgaccgccgaacccgggaccgagccggcggaaggcggtggggtcctggtcgatcacggcgaccgtgtgcccctgttgctccagggtctgggcgagagcggaacccactctcccgcagcccatgatgacgatgtgcacgaccgtccttccggtgtcaacagctactgctcagccccatcagggtctcagacagagggacaagctacacatgcgcggtgcggggcgggcacccccctgccgcataccggacggacagccgggccgaggtcctgccgacggccgggccgagggccttattccgcttccgagggacggcgccgagtgatgctgcgcacgctgcacacggtcaggaatccgaggccgagcagcgagagagcggcgccgatcagctccgcggtcgggggcatgggacctccgtgggtcggcgacggccgtgcaacgggcgcggaacaaggcggggaacgggcagggaatcggccgagtccagacatctaggcacagccacgcccccaccttcggaatccgtggcgccggccgccccggatttcactcgtgaggcagatctcgggtggcaggtgggcgagccccagttcgaaggcctacgatcctctgttgtgtccaaactgaccgacgtgcccaaacgcattctgatcgggcgcgcactgcgcagcgaccggctgggggagacccttctgccgaagcgcatcgcactccccgtcttcgcctccgacccgctgtcgtccgtggcgtacgcacccggcgaggtgctgctggtcctgtccatcgcgggcgtgtcggcctaccacttcagcccctggatcgcggtcgcggtcgtcgtgctgatgttcacggtcgtcgcctcctaccggcagaacgtgcacgcctaccccagcggcggcggcgactacgaggtggccacgaccaacctcggggccaaggcggggctgacggtggccagcgcactgctcgtcgactacgtcatgaccgtcgccgtctcgatctcctcgggcatcgagaacctcggctccgccatcccgttcgtcgtcgaacacaaggtgctctgcgcggtcgtcgtgatcgtgctgctgacactgatgaacctgcgcggtgtgaaggagtcgggcacgctgttcgcgatcccgacgtacgtcttcgtcgccggtgtcttcatcatgatcatctggggtgcgttccgcggactggccctcggcgacaccatgcgggcaccgacggccgactaccacatcaaggccgagcaccaagggctcgcgggcttcgcgctcgtcttcctgctgctgcgcgccttctcctccggctgtgccgcgctcaccggcgtcgaggccatctccaacggcgtcccggccttccgcaagcccaagtcgaagaacgcggccaccacgctggccgcgatgggcctgctcgccgtgaccatgttctgcggcatcatcggcctcgccatgacgaccaaggtccacatggccgagaacccggccgccgacctcctgcacaacggcatcccgctcggctccggatacgtgcagaacccggtgatctcccaggtcgccgaggccgtcttcggcaagggcagcttcctgttcgtggtcctggccgcggccaccgccctggtcctcttcctcgccgccaacacggcgtacaacggcttcccgctcctcggctcgatcctcgcccaggaccgctacctgccccgccagctgcacacccgcggcgaccgcctcgccttctccaacggcatcgtcctgctcgcgggcgcggcgaccctgctggtcgtcgtctacggcgccgactccacccggctgatccagctgtacatcgtcggtgtgttcgtctccttcacgctcagccagatcggcatggtgcggcactggaaccgccacctggccaccgaacgcgaccaggccaagcggcgacacatgatccgctcgcgcgccatcaacgccttcggcgccttcctcaccggcctggtgctggtcgtcgtcctgctcaccaagttcacgcacggcgcctgggtcgccctgctcggcatgtgcatcttcttcgcgacgatgacggcgatccgcaagcactacgaccgggtcgccgaggagatcgccgcgcccgaggaaccggccgacgacctcgtgcgcccctcccggatccactccgtggtcctcatctccaagatccaccggcccaccctgcgcgccctggcctacgccaagctgatgcgctcggacagcctggaggcgctcaccgtcaacgtcgacccggccgagacgaaggtgctgcgcgcggagtgggagcggcgcggcatcgacgtaccgctgaaggtgctggactcgccgtaccgcgaagtgacccgcccggtcatcgagtacgtcaagagcctgcgcaaggagtccccgcgcgacgcggtctcggtgatcatccccgagtacgtcgtcggccactggtacgagcacctgctgcacaaccagagcgcgctgcgcctgaagggccggctgctgttcacgccgggcgtcatggtcacctcggtgccctaccagctcgcctcctccgaggcggcgaagctgcgcgcccgcaggcgccaggagtggagcgcgcccggcgcggtgcggcgcggtcctgcgcaggtgcgcaaggagccgaaggagccgtcggcgcccaagggctgagctggcgtagcggcctggtggtgaacggccggacggcacccacgtagactggtgggctgttgtccggccgtttccccgttctcgatctggagccaccccgccatgcacgcagaaccgaagaactcgcaggtgggaccggagacggactcgctggtgggcgaggagtacgaggtcgagatcggcccggtcgcccacggcggccactgcatcgcgcgcaccgcagagggccaggtcctcttcgtccggcacgcgctgcccggtgagcgggtcgtggcccgcgtgacggagggcgaggagggtgcccgcttcctgcgcgcggacgcggtacggatcctccaggcgtccaaggaccgcgtcgaggccccctgcccctacgcc

SEQ ID NO: 855 - DNA, 2683 bp, Unknown
  Kingdom: Bacteria, Phylum: Actinobacteria, Class: Actinobacteria, Order: Streptomycetales, Family: Streptomycetaceae, Genus: Streptomyces
gccggcacaccggtgggggtgcccggcgtacaggcgccggacacccccaccggtgtgccggctcagccgtgcgtcttggccaggagttcgaggacctcggccgtggtgcccgtctcgccgagccgcgggaagatccgctgcacgctgccgcggtgggcctccgcgtccatgtccgccatggcgtccgtcgccagggtgacgtggtagccgtgctcgtacgcggcgcgcgcggtggactccacgccgatgctggtggcgatgccggtcagcacgatctgcgtcacgccgcggcggcgcagctgcacgtcgaggtccgtgccgtggaaggcgccccagttgtgcttggtgaccgtgatgtcgccggggtgaccggccagctcgggcacgatgacgtcccagccctcgggacggctgccgccggaacggaccgcctccgtacggccgggcgcggcgtccgcgaagtcggcggcgaaggacacccggaccaggacgacgggcaggtcccgggcgcggaacgcctcggccagctgaacgctgcgcgcgaccacttcgggtcccgtgtgcggcacggtcggagcggcggcgatgcccgcctggaggtcgatcaccacgagcgcggtgcgggggtctagggcggtgagtgccatgggggtacgggcctttcagggctttcggggggtgagtcgggcgagtgaccggtccggcacgctgctcaccaggagcagcaccgatccggcgaccatgaacagggccaggccgtgcagcccgcccgtgtcggcgcggtgcgggaagtaccccgcggtggccgcggaggcgcccagcgcgccgaggtacatgaaggtgcgcagcagcccggcggccgaggcgatccgggcgggatcggcctgccggtagagcgcgttctggttggcgaggccgatcagcccctggggtatgcccatcaccacgccggccagcagcagcagccacagcgggctgcgggagccgatcagcagcaggacggcgcaggcggcgacctggacggcggcgccgacgacgagtttcacgcgtacggcctcgcggcgtccggtcagggtggagacgacgagcgcggtgcccgacagcggcagcagcaccagtccggcggaggaggcactgagcccgcgcccttcttccagccactgcgtgtagccgtacatgaaggcgtacgtggtggtgtagccgagcaactggcggacgtacgtggtcagcacaggcacgttgccgcccaggacccgcaggtcgacgaagggctgtccggtccgcagctcgcgcaccgcgaaggcggcaccggccgcgacggcgagcaccggcaggtaccagcggccggcgcccggctccatcaggaacagcatcagggccacgagcgtgccggcgaacaggaccatgcccggcaggtcgatgtcccgccgcgaacgcccggcgtgcttctgcggtggcccactcgtcgtctctgcctggtctgtctctcgcggctgccgcgcttcccggggcagccgcagggcgccgaggaccagacaggccgcggacagcggcacgttgacggtgaacacggcacgccagccgccggcgccgatgagcagaccgccgagggccgggccgaccacggccaccgtctggttggcgacggcgagcgcggtcaggacgcccgccggactgtcccgcccggtgcgctcggcctcgcgccgggtgagctgcatggacgccggatacgccgcggaggtgccgaagccgagcagtacccgcgccccgacgagcgcgccgagcgacggcgcgagcgcccccagcagacccgcgacgccgaccatggcggtaccggtgaggtagagacggcgggggccgtacatgtccaccagccggccgatgaccggctggccgacggcggtcgccaggtagagcgccgagaccagccagacggtctgcgccgggggcgcgccgaaggcggtgccgatcgggacgagggccaccgcgatcatcgacgagttgaccgggttcagtaccgaacccaggatcatgggggcgatcagccggcggtcgaaggcgtccggggccgcaggcccggccgcgcggccgccgcccggccggccgacgagcctggccttcacgaccgcgtcagccgttccatcaaggtgaacgcctcgatgagggtctgccgttcgtcctcgctgaaccggtcctccagagcgcgggtcagccactcctcgcggctgacccggtcgccctcgatgcgctcgcggccgctctccgtgagggtgacgagctggcggcggccgtcgtcggggtcgggacggcgccggatgagcccgcgctgctccagtgcggcgagcgtcgtggccatcgactgcggccgtaccccctcggcggaggcgagcgcactcgccgtggccgcgccgtgcttgccgaccagggtgagcgccgacacctgggacggtgtgaggtcctcgtcctgcgcgacctcccggatccgccgccgcaggcggctgaacaccacccgcagatcgcgcgccgcccggacggaggaggcggagaggccctcgggcgcttcgctgcactgctgatccatgcggtcaccgtagatccgtcaggtgaaactgtccagtctggactgaacagtttggctgagcagctccagctgtggaccggccgagcggccggtcggccgaac

SEQ ID NO: 856 - DNA, 3334 bp, Unknown
  Kingdom: Bacteria, Phylum: Actinobacteria, Class: Actinobacteria, Order: Streptomycetales, Family: Streptomycetaceae, Genus: Streptomyces
  misc_feature (2865)..(2883): n is a, c, g, or t
cgtagccgcggccctgttcgccggccgcgatgttcagccgccacaggcccgagcggatcacgctgccgtccatgcgccagtcgatgtcgaagaaggccatcaggaagcccacggcccgtccgccgtcggtgatcagccgcggccaggcgatgcccggatggacgtaggcctcggcgagggacttcacgaccggtgcgaccgcgtgctcctggtcggggcggacccggatgccgagcgcggcgtcgaggttctcggcggtgatctcctcgaaccggggcgaggacgtggaggcggcagcggcggcggggccggtacgggggccggtgtcagggttggtcaccggcgcaccgtagttgcgcgcgcgccgctcggccaccggattacggccggtccccggccggggaccggcccaggtccggtggcggctccggagacgcggctcagcccaggtgccggtagcggccccggaagtacatcagcgggccgccctccgcgctcggaaggcgggccgtcaggacgcggccgacgaccagggtgtggtcgcccgccgccacccgctgctcggtgcgcagttccagggtggccagggcgccgcccaccagcggggcgccggagacctcgccacgggtgcaggggatgtccgcgaagagcaggcggtcgctgatccggcccttcatggcgaagcgcccggcgatctgccgctggctgtcggccagcacggacaccgcccacagcggctgctcggcgagcaggtcgtccatgcgggagtccgtgcgcaggctgaccagggccagcggcgggtcgagggagaccgacaggaacgccgtcgcggtcatccccacgtcctcgccgcgcggcgccagcggatcctccgggtcgagcggcggctcctgcgcggtcaccaggaccacacccgcggccagccgggacatcgcggcacggaactcgtcgtcggtcaccccctcagcatgcccgggggaggcggggagcagggcggcggaggacggagcaggggaagtgttcagcacacatcaacgctaatgaccgccccgcgccgcccgcatcggcccttggcccgaacccggacctaggaccacggccccaccgcccacgccccggcatccccctcaccacgaccccgctcgctcatcggaaccagcgattccagcccggtccggcggtctctcgtgcatcatggccgcacagcacaagtctgtgttcagtgaacacttcggaaaaaagcagaaactcctctcaattgttcatgttcagttgtgacttgagtcacaagagacgtgaattgttgaccctgtgtaccgagtgggcttcgcgctgtgattcagtggcgtagaccgcacggcgcgatacgccgaagagaaccctttgattcactgcgaggtctcggggggagggcgagcatggagaccgagtcggagccctacgtccgtcttgcgaccctgcggcaactgcaccaggtcatggccgacatgaacaccgcgcgaagcctggcggacacgctccagaccgtggccgacggcgtcgtgaccggcctcggctacgaactggcctgcgtcaacctcgtacgcggcgacggcgacctcgtcgtcgccgccttctccggcaaccccgccgccgaggccctcatcaccggccgcgtcggctcccgtgactcctgggagcgccggctggccatgggcgagacctggggcgacctggtcttcatcccgcacaccgagggctgggtcctcgacgacgacgacgtcccgcagtggtacaccgacgggcccgctccccgcttcgaggacgagtggcacccctccgaccgcctcttcgccccgatgtacgcgcccggcgcgcccgccggctccccgggcgagctgctcggcgtgctctccgtggaccgcccccgcaacggccgccgccccggcgcctggggccgcgaggccctgcaggtgtacgcgttccaggcggccatcgccatcagcaacgcccggctgcgcgccaacatgcagcgcgccctggtccgcctggagcgcgaccagcaggccctgcgcgccagcgaggagagcttccggcaggccttcgagtacgcgccctccggcatggccatcgccgagatgggcggcgaccagcacggccggatcctgcgcaccaacgacgccctgtgccgcctgctgggccgccccgcctccgcgatgcgccgctactccttctccgacctcgtccaccccgaggacataggcaccctgctgcgcacctccgccgagggcggccgggccgagctgaggctgggccgccgcgacggcagctacgtctgggtgtccctgcgcaactccgtcgtcgccgacgccgccgacggcccccgcttcctgctcacccacgtcgaggacatagaggagcgcaagcgccgcgagctgcacctcgcccaccgcgcctcccacgactccctcaccggcctgccgaactccgccgaactgcgctcccgcctcgcctcccgcctgtgccggcgcccgcagtcgccgcacgccggggacatcgcctcgctggacgcggcctacggccatcccgcccacgccgccgtcgacgccggtcacgaccacggcttcgacttcggctccggcccgcagccctacgacgcgtacggcgcctacgaccaccacgtgcacaccgtcgcccccgaggacggccgggacgacggcaccaaggggctcgccgtcctcttctgcgacctcgacggcttcaagtcgatcaacgaccggttcgggcacaacgcgggcgacgccgtcctcatcgaggtggcccggcgcctgtccaacggcgtgcgcgacggcgacaccgtggcccggctcggcggcgacgagttcnnnnnnnnnnnnnnnnnnncattgcgggatgacggcggacgaagtgctgaagtccgcggacgagcggatgtacgtcgagaaacgatctcgtcccaaacagcacaggcgcgccgggtaaagcgctggtcagcggcggggtgcgaggtgagtcacccgttcggccccgagggagcgggtaggctcggtccaatctcacgacgtactgcacccgacccgcactgttgaggagaccaagggatgacgcccggcgacaacggcccgagcacgcccgaggacgacgacccgttcggctatctgtacgccgacgggcaggccaacggagcccagccgccctccggcggttacggctaccccggctcggtcaaccgggtccgcgccgtcggccagcgtcagtacggccagcagacgcagcagacgccacaggcccccacggcggcctacgggcaggtcccgcagcagggcggctacgg

SEQ ID NO: 857 - DNA, 4524 bp, Unknown
  Kingdom: Bacteria, Phylum: Actinobacteria, Class: Actinobacteria, Order: Streptomycetales, Family: Streptomycetaceae, Genus: Streptomyces
cgcccctcaccgggcccgctgcctcaccaggccatctggtcgagcagcacggaggcgtccggctgcctggtgccgcccaggctctgctccgcccagatcaccttgccgttcgccacgtaacgcgtgccccaccggtccgcgaactgcgagaccaggtacagcccccggcccccttcgtcggtcgtggcggcgcggcgcagccgcggagaggtgttgctgccgtccgacacctcgcagaccagggtggagcccagcatgatcctgacccgcaccgggggagcgccgtagcggatcgcgttggtgagcagctcgctgaggatcagttccgtggcgaacgcggactcctccagctcccagtcggacagccgccggctcacctccgtgcgtacccgggagaccgcgctgacgtcgaacgggacgtcccagaccgcgacccgggacgggtcgagcagccgggtgcgggccaccagcagcgccacgtcgtcgctggggtgctccggcagcatcgtctccatcacggcccggcaggtgtcctcgggcgtctggtccgggtgcgcgaccgccgcggcgagcatcgccatcccctcgtcgatgtcgcgccgccggtcctcgaccagaccgtcggtgaacaggacgaggcggctgccctcgggcagcaccagttcgcccgtctcgaacgggtgcccgcccacgcccagcggcggcgacagcggcaggtcggggaaggacacccggccggcgggatccaccacggcgggcgtgacgtgaccggcgcgcgagaaggtgcagtggccgcccaccgggtcgtagatgacgtagaggcaggtggcgccggtgaccagggacccctcgccgtccgtcgcctccgccggggtgtcgagccgggccaccatctcgtcgaggtggccgagcagttcgtccggtggcaggtccagcgaggagaagttgagcaccgccgtccgcagccgtcccatggtcaccgccgcgtgcaggccgtggcccaccacgtcgccgaccaccagcgccgtgcggaagcccggcagggggatgacgtcgaaccagtcgccgcccacccccgactgcgccggtcggtagcgccaggccacctccagcgcgtcctgctccggcaggtcccggggcagcagactgcgctgcagcgtgacggccatcgcgtgctcgcgcgagtacctgcgggcgttgtcgatcgcgaccgccgcccgggcccccagctcctcggcgaccgcgacgtcctcctcctcgaagcgcggcgagccggcgccccgccacaggttgaccatgcccagcaccactccgcgcgccctgagcggcaccgcgatcagcgagtggatgcccgcggccagcacctggcgggcaccctccggatcctgggcccgccagtccccggcggtccgcaggtccggcaccagcaccgccttgccgcggcgcagcgccgccaccatcggcgtgtcggccaccacgaactggatgagatcacccaccggttgcagcggattgcgtgtcccgcgcagcgccgtgcggcgcatccggtgcatggcgccggtgggctcctcgccgtgcagtacggcgtccaggagttccacggtgaccacgtccgccagccggtccaccgccacgtcggccagttcctccgcggtacgccgcacgtccagcgtggtgccgatgcgcaccccggcctcgtacagcagcgtcaggcgctcccgcgccacctccgcgcgtcccgacagggcccgcagctcggtggtgtcgcggaaactggccaccaggcccggcgggtccgcgtacggggcggtacgccgggtgttcaccgcgaggagccggtccccggccgggcacacgtcgtcggagacgatctcgcccgccaccaggatccgggtcagctccggcgcgagccccagctgggtgacgtggcgctggtcggcgtccgccggcaggtcgagcaggcggcgcgcctcgtcgttggccagcaggagccggccgtcggcgccgacgatcagcacgccctcgcgcaccgcgtgcagcaccgcgtcgtggtgctcgtacatccgggtcatctcggccggtcccagaccgtgggtctgccggcgcagccgcctgctgaccagcgccgtgcccgccgtggcgagcgtgagggccagcgcggccgaaccgagcaccatgggcacctgctggtccaccaggtgcgtcaggttctcgacctggataccggcggtgaccacacccaccacccggcggctcgagtccatcacgggcaccacggcgcgcacggcgtcggccggtttgccgtggaaggtgtcggtgaaggtctccccggcgatggctcggctgacgtccatggccttggtgccgatgagccgcggctgtgtgtcggcgagccgcaccccgtggacgtcgagggcggagatgaagtcgatgcccgcgccggcctgcgcctgtatgaccggggtctggagcagcttggtcgggtccggggacttgaacgcgagggccgttccgggggcgtgggcgaaggactcggccgcggccagggaacgtttgcgggcgtcgttctcgccgtcgtagcgtccctgcaggaccagggcggtggccgccgccgcgaccagcaccaggaccacgatgacctggagcagcaggacctgcccggccagcgtgccggggccccggggcgacggcgggcggcgtccgggggagcggcgcggtcccgggcgaggggagggatcagcggaccgccgggcgtcaggcggcgctgccgccttcgaccgggaccggcgggaacgtccgatcatgctcccagttctagcactgcgctcgcccgccgggcgaccggtatgcccacttcactcaggtttcggtgggctgcgccgatcggggaatgcggccggtgtcgcgactgttgacgcacccggctggcatgtctggatcaatccggggatgcggccgaaaggaggaacacagatcacatggcacgcaccaccgtgcgccccgtcgtccggctgaagtccaccgccggaaccggcgtcacctacgtcacccgcaagaaccgtctcaacgaccccgaccggctcgtcctgcgcaagtacgacccggtcgccgcccggcacgtcctgttccgcgaggaacgctgagccggcggccctggcggacggagtcgaccgcgcggccccggtggccgcgcggtcacgcgtgggacagctgctgctccgcccagatcgtcttgccgcagcccgagtaacgggtgccccagcgctgggcgacctgggcgaccaggaagaggccgcgtccgccctcgtccgtgctctgcgcccgcttcaggtgcggtgaggtgctggcgccgtcggagacctcgcagatcagggtccgctcatggatgaggcgcaggccgatcggaccgcaggcgtgccggatggcgttcgtgagcagctcgctgacgatcagctccgtgctgaaggccgcctcgcccaggccccagcgggacaactgctcggccacgtcgttgcgcgccacccgcaccgccgccggatcggcgggcacctcccagtaggccacccggtcggagcggagcacatgggtgcgcgcgatcaggaacgccacgtcgtcgcgcgggcggtccggcagcagcgtgcggaccatgatgtcgcagatctcctccagcggccggtccggatgggccagcgtgaagcacagccgctccatgccgacgtcgacgtcccggtccgacgcctcgatcagcccgtccgtgtagagggcgatgacgctgccctcctccaccggcacctcggcgcactcgaacggcagcccgcccagcccgagcggcggccccgccgggatgtccgggaactcgaccggctcgttcagatgcgcgatcgccggactgggatgcccggcacgggccacgacgatcttgcgggcgatggggtcgtagacggcgtacacacaggtcgcgccgaccgccgggagcccctcgtcggccgcgtccgactcctcggacagccgcacgaccaggtcgtccagacgcgccagcagttcgtcgggggccaggtccagatcggccagggtctgtacggcggcccgcagccggcccatgctggccgcggcgtgcagcccgtgaccgaccacgtcgccgaccacgagcgccaccctggcaccggagagcgggatgacgtcgtaccagtcaccgcccacgcccgactccgcgtcggccggcagataccggtgggccacctcgacggcgctgtgctcgggcagggcggccggcagcaggctggtctggagggtgagcgccgcctcgtgctcctgggcgtagcgccgcgcgttgtccacgcagacggcggcccgcgccaccagctccgtcaccaggagcaggtcgtcctcgtcgaaggggtccgggctcttccaccgcatcagcgtgacgacgcccatggtcacgccgcgcgcccgcagcgggacgaccagatgggtgtgcacgccgagccggatcagcttgtgccagcgtccggggtcgtcggc

SEQ ID NO: 858 - DNA, 6282 bp, Unknown
  Kingdom: Bacteria, Phylum: Actinobacteria, Class: Actinobacteria, Order: Streptomycetales, Family: Streptomycetaceae, Genus: Streptomyces
agcgcggccagggcgggcgcggccgggtgcgcgctcagcgtccgtacgtaccggcgcacgcccgtgaccagcagcgtcagcccggcgagcgcggccagacgcagcacgacgaagacggaccagccgctcacccgggcgacccagccgagcagcagcatccacggcgagtagtaggggctcggggtgtccgcgtcgaccagcgggttgccggggtgcagcaggctgtggcgcaggcgttcgatggtggccgcgtgcatgccgaggtcaccggcccacggcagcctgacgatcaccaggagcagcagcacgatcaggagcgctgcggccgtccgggcggcggcggaacgtttcgcgcggaccggcggccggggcgccgccctcccggcggggcgcacccgtggcggcgcggcgcgcatcatcgtgccggaattcccggcggcaggcccttcaccgtatttccggccggacggtccccggcgaggtgcacagtcacgcgcgccagtttatccgaatgatctcgaataacaggaaaaggtaaatttaccgtgcgtcgtttcctaaacaactgcgagaaatgagcatgagggcgccccgggccttttacggcccggggcgccctcgtcggctgtgccgcgcgttacgcccgcggcgccttacgcgtgaggcgccttacgcatgcgtcgcgtcacgcgtgcgttcccagcagcgtcctcatcgtccgcatggcgaccgagaggttggccaggtcgaacgcgtccgaaccgcggatctcctccagggtgatgcgggcccgggagaggatcgccgcgttcttcgactcccaccccttgaagcgctgctccggcgtggacgtgccgttgccgacggcgaggacgtccgcggtcagggccgcgtgcgccgcgtacaggtcctcacggatcgccgcacgcgccatggactgccagcggtcggcgcgcggcagttcgatgatgcggtccatcagctgcgtgatggcgagccggtcggcgaggtcgtagtacacctcggcgacgtccagcgggtccttgcccatgcggtcggccaccgagacgatgtcgagcgccgggaaggcggaggagaacccggccacacgggtggccagttcgtccgggacaccggccgcgcacagctcgtcgtagacctgctggtaccactccaggtccgcgcccttgatcagcttgggcatctgggtccacacctgctcgacccgctcggagaagaactccaccgtctcgccgagctgcagcggctgcggccggttgttcagcagccagcgcgtgccgcgctcgaccaggcgtcgcgagtgcagccggatccgggtctggacatcggcctcgaccttgttgtccagggcctccaccgcgtcccacaccggcgccgagcggaagatcgcgcgggccacggtctgcgcccggacgatctcctccagcgaggctccggtctcctcccgcagccggtgcaggtacgtcgtaccgccggtgttgaccgtgtcgttgaccaggacggtcgtcgtgatctcgcggttcagcgggtggctgtcgatctgctccgcgaactgctcgcgcagcggcgtcgggaagtaggcgtgcagcagcccgcgcaggtacgggtcgtccggcagcgaggtacgcagcagctcctcggcgaccgtgatcttcgtgtacgccagcaggacggccgtctccgggccggtcaggccgttccccgcgttcagccgctcgcggatctggcggtcggtgggcaggaactccagcgcccggtccaggtggccctcgcgcaccaggtgcttcatgaagcgctgctgggcgtggaccatgtccttggactgggccagagcgttggcgatcgccgtgttctgcgcgtagttgttgcgcagcaccagcgcgccgacctcgtcggtcatctgggcgagcagcttgttgcgctgcttgacggtcatgtcgccgtcggtgaccagcccgttgagcaggaccttgatgttcacctcgtggtcggaggtgtccacgcccgcgctgttgtcgatggcgtcggtgttgacccggccaccggtctgcgcgaactcgatccggcccagctgggtgcagcccaggttgccgccctcgccgacgacgcggaccctgaggtccttgccgtcgacgcggatggcgtcgttggccttgtcgccgacgtcggcgttggactcggtggacgccttgacgtaggtgccgatgccgccgttccacagcaggtccaccggggccttgaggatggcccgcatcaggtcggccggggtcagcttggtgacgccggactcgatgcccagggcctcgcggatgtgcgcgttgagcgggatcgacttcaggttgcgcgggaagatcccgccgccggccgacagcagctcggtgttgtagtcggcccagctggagcgcggcaggtcgaacaggcggcgccgctcggcgtagccggtggccgcgtccggggtcgggtcgatgaagatgtgccggtggtcgaaggcggcgaccaggcggatgtgctcgctcagcagcatgccgttgccgaacacgtcaccggacatgtcgccgatgccgacgaccgtgaagtcctgcgactgggtgtcgacgtccagctcgcggaagtgccgcttgaccgactcccaggcaccgcgggcggtgatgcccatgcccttgtggtcgtagcccgcggagccgccggaggcgaaggcgtcgccgagccagaagtcgtaggactcggcgacctcgttggcgatgtccgagaacgtcgccgtgcccttgtcggccgcgaccaccaggtaggtgtcgtcgccgtcgtggcgcaccacgtcccgcggcggtacgacctcgcccgcgaccatgttgtcggtgatgtcgagcagcgccgagatgaacgtcttgtagctggcgatgccctcggccagccaggcgtcccggtccacggccgggtcgggcagctgcttggcgacgaagccgcccttggcgccgaccggcacgatgacggtgttcttcaccatctgcgccttgaccaggccgaggatctcggtgcggaagtcctcacgccggtcggaccagcgcagaccgcctcgggcgaccttgccgaagcgcaggtgcacgccctccacgcgcggcgagtacacccagatctcgtaggccgggcgcggcgccggcaggtcggggatggcctgcgggtcgaacttcatggagacgtagtcgtgcggccggccggccgcggcctgctggaagaagttggtgcgcagggtggccttgatgaccgtcaggaaggacctgaggatgcggtcctcgtccagggaggccacctggtccagggccgcgtcggcctcctccagcagcgcgtcgaccagctcgagtccggcctgctgccgctccggcgccatccgcgcctcgaacagggagacgagcaggcgagtggtgtggacgttgttgcggagggtgtcctccatgtagtcctggctgaaggtggagcccgcctggcgcaggtacttggcgtaggcgcgcagcaccatcgcctggcgccagctcagcccggcgctcagcaccagcgcgttgaacccgtcgttctccgccttgccggtccaggcggcggcgaaggcgtcctggaaccgctcgcgggcgtcgtcggcgaggtagtcaccgctgccggcgaccgccttgggcatgcgcaggccgaagtcgtagatccacgccgtcgtacggtcggcgcagcgcagctcgtagggccgctcgtcggtgacctccacgccgaggcggctgagcaccggcaggacctgcgagagggagaccgagccgcccttctggtagatcttgaaacggcgctcctcgggggcggcgcccaccggctcgtacaggctcagcgcgaacgtcttgtcctcgtcgagctgctccaggttgaccaggtcggcgaccgcggcgcgcggggtgtggtcggccttgtagccctcggggaacgcggcgccgtagcggcgcagcagctcggcggcgcgctcctcgcccagctcggcggtgagcgcctcggagaaggcgtcggcccaggaacgggcggcctccaccagacgggcctcgatgcgctccttgtcggcgtcggacagctcgggcagctcggtgccctgcggcacgcggacgacgaagtgcagccgggagaggatcgactcggtgttccaggccgtgaagtcgacgctggtgccgcccagctcctccttcaggatgtcgatgatccgcaggcgcacgcccgtggtgtagcggtcgcgcggcaggtagacgagggccgagtagtagcggccgtactcgtcctggcgcaggtacaggcgcagccggcggcgctcctgcaggtacagcaccgaggtggcgatcgcctgcagctcggcgaccggcgtctggaacagctcgtcgcgcgggtacgtctccaggatctgcgtcagatcgcgcccgtcgtggctgttgggcgagaagccggcgaggtccaggacctgctccaccttgcggcggatcaccggcacccggcgcaccgactcggtgtacgcggcggacgagaacagacccaggaagcggcgctccccgatcacctcgcccttctcgttgaacttcttgacgccgatgtagtccaggtaggacgggcggtgcacggtggcccggctgttggccttggtcagcacgagcagcttgtgctcgcgggccttggcacgggcgtcggcgggcagccgctcgaaggacgggctgaccgggtgggcctcctcgcccgcgtgctgcgggtccgagcgcagtatgcccagaccggtgccgggcacggcggccagggagtcgtcgccgtgcagctggtactcgcggtaaccgaggaaggtgaagtggtcggcggagagccagcgcagcagctcgcgggcctcctcgacctgcggcccgggcaggtcggcggggaccggctcgtcgggcaggccctcggcgatgcgggtggccgcctcgcgcatcttctcccagtcctcgacggcctcacggacgtcggagagcacgcgcagcaggtcggcggtgatctgcttgaggtcggaccggtcggtctcgcggtcgatctccacgtggatccaggactcgacgtgcgcgtcgtgcggcagcgcctcaccggccggtccggccggcagcacgtccaggagcttgccggtcaggtcgcggcggactacgaactgcgggtggacgacgacgtggatgccgcggctctggcgggtcagctcgttggtgaccgagtccacgaggaagggcatgtcgtcggtgacgacctcgacgacggagtggctgcacgtccagccgttctcctcgacggtcggggtgtgcacccgcacgttggccgtgccctgcgggcggctctcggccagccggtagtgcgagaaggcggctccgaagacgtcgaccgggtcacggtcggcgaggtcctccggggcggtgtgcaggtagtaccgctggaggaaggcgagtacggcgtcccggtccggggagccctcgccccccatcccggccgggaggtgtcctcccgccggactgttctcagctacccgaacggccctttcgagcaactcggccttggcttcgtccagcttggtctgcattgtcctctgactcctgtcgcgcgccgttgcgtgacgttgaaggaagtacggtctctgcccatccggcgtgatgtcccggtccggggtgtccggcccttaccgacgctatgccgtgaggtgagatgagcggggggttatcggccatcttcgacgcatccgagcggtgtgacactgctctcggtggcgccgccgggaaccggcccggcgtcctggaggccctgggggtggtcctggcgaccccgtcccgcccgggaggaccagcgaccgccgcccggtcacggatgtcgtccgtgcacaccgggcgcagagcggaggcgagagcgcccccgcgaactatcgcgctgatcacgccaccaggctatcgctcttcccgggtcccccgtcatgagccgtatgtgtacaaaaccaggggtggaactttgacgttctgcacagcggcggggaggggaaggagtggcatggggggtgtgagggcgctgtggggcgtcgcgcggcgtggtgcggggcgcggcgtggtgcctgtgcggtctgtggtgccggtgcggcaggtgtgcctggggcgaccccttgtgccggcgcggcgtgtggcgccccttgcggcaggtgtgcccagcgcgacccgttgtgccgggcgcggcgtgtggcgccgaggcggcccatgg

SEQ ID NO: 859 - DNA, 2663 bp, Unknown
  Kingdom: Bacteria, Phylum: Actinobacteria, Class: Actinobacteria, Order: Streptomycetales, Family: Streptomycetaceae, Genus: Streptomyces
cgaggtggcgggtgcgggccggcctcgccgcgcccgcccgcacccgccacctcgtgcccgccggcgagccgggacgcagcctgcggctggagatcgaggggaggggcggcggcgagtggctgatcccgctcgactcaccgggcgcggtgggctccgcggagcaccaggtggcccatgtggcgctggacggcgtggagttctgccggctggcggccgggcacgtcgctccgcgcgaggcggcggccggccaggtcggcgacgtcgacgcgatcagcgacgtgctgcacgcggcggcctccctgagccggatgtgacggccgggagaaaggtcttgacaggtctcaggcgaagaccaccgtgcgccggccgttcaacaggatgcggtgctcggcgtgccacttcaccgcgcgggcgagggcctggcactccacgtcccggccgatcgcgacgagctggtccgggttgacgccgtggccgacccgctcgacctcctgctcgatgatcggcccctcgtcgaggtcggcggtgacgtagtgcgccgtcgcgccgatcagcttcacgccccgggcgtgcgcctggtggtacggcttggcgcccttgaagctcggcaggaaggagtggtggatgttgatgatccggccgctgagctgcttgcacaggtcgtcggagaggacctgcatgtagcgggcgaggacgaccagttcgacgttctcctcgcgcacgatctccaggagccgcgcctcggcctcggccttggtgtcccgggtcaccgggatgtgatggaacgggatgttgtacgaccccaccagctcggcgaaatccgtatggttggacaccaccgcggcgatctcgaccggcagcgcgccggtccgtgcgcggaagagcaggtcgttcaggcagtgcccgaacttgctcaccatcagcacgatccgcatcttcgtctcggcgcggtgcagctgccagtccatgccgaaggagtcgccgaccgcggcgaagctggcgcgcagcttgtccacggtcaccggggactcggcggagaagtggacccgcatgaagaacagtcccgtgtcctggtcgccgaactgctggctgtccacgatgttgcagccggtcatgaagaggtagctcgacacggcgtgcacgatgccctttttgtccgggcaggaaagggtcaggaggtactggtcggcgggggccgtcgcggatcggggggactgctcagtcatgcaggacaggttcccatacggccgccccgccgcggacgcccgtccgcaggacgggacggcgccgcacccggcgatcccacggccgggcgccgcgagccgcacggcccggacaccgtgtgacgcacgacccggacgccgcgtgacgcacaccgcggagaccgcgtggcgcgcaggccgcacgaccccgtacagcccgacgccgcgtgacgcgcgagtgccgcccccgctacgccgcgcgggtcatgatgctcagggcatccaggctgcgcggcggggtgtccgggtcgtcgccgtcgccggtcgccaggcgcaggtgggcgtcgcgcgccgcccgcaccgcctccggccagccatggtgttcgaggtaggcggccaccggcgcgtccgggccgacctggtgcatgatccgcagcacccgcagcacggccgtgtcgacgagcgccgcctcctgcgagtcccggaagatcgtgccgacgtacttctcggcggaccagttgtccagccaggtgtcctcgaccaggcggtagacggcgtcggtcacgtcgccgtacccctcgacgcccgccagccagacgtcccgctggaacaccgggtcggagagcatgtgcagcgcggagcgcacgttgctgcgccagcgccaccacggcatgtcgttgagtggcatgccgcccatggtggaggagcgacggccgcgacgggaagagttctccgaaccttgcacggtcatcgatcgtacgttctcctcacgggcgtccccgccgccccccgcaattcaccttcgcgtcacccattgtcgaccatgggtcactccggcgttggcggtgtgccggaatcgtgcgtgaacatgaccggcaggcgacacaggcacaacgcactcctccccgctcccgcgcgggccgccgggccgaggaggcacctgctgaccgcgggcgcgctggcggcgtgcgcgtcgctcgccgccggatgcggtgtcgtccccggtgccacggggggctcgggggacggcaccgtcaccgtgatgacctgggcaccggacggcacggcggcgaccaacaaacccggcatgcccgccatggcccgcgcctacgcccgctgggtcaacgcggcgggcggcatcgccgggcacaagctcaaggtcgtgacctgcaacgacagcaacgacagcgtggccgcggcgaagtgcgcgcggctcgccgtcaaggaggacgtcgccgccgtcgtcggctcgtacagccagtacagcgactccttcttcccgccgctggagagcgcgggcatcccctacatcggcgggtacggcgtcaccaccgccgagttcacccgcgccctgtcctaccccgtcaacggcgggcagcccaccctgctggtcggcctcggccgggtactcgccccgcgctgcggcccggtcgccctcgtgcggcccgacagcatcgcggg

SEQ ID NO: 860 - DNA, 4611 bp, Unknown
  Kingdom: Bacteria, Phylum: Actinobacteria, Class: Actinobacteria, Order: Streptomycetales, Family: Streptomycetaceae, Genus: Streptomyces
ccccctttcgcaccctttatgtcccgatatacccacctcccctacgtccaggagcgatccatgcgaacccagagccgacggcggccaccgcgagcgacactcgccctggccgccgcagggacgctgctcgccccgctgctctccggctgctgggtcggggcgggcggagccggttccggcggcgactccatcaacgtgctgatggtcaacaacccgcagatgacggagttgcagaagctcaccgccgcgcacttcaccaaggagaccggcatcaaggtgaacttcaccgtgctgccggagaacgacgtccgcgacaagatcagccaggacttcgccaaccaggccggccagtacgacgtcgccaccctgtccaactacgagatcccgatctacgcccgcaacggctggctgcacgcgatggactcctacgtcgcccactaccgcgccttcgaccaggaggacgtcctcgcgccgatgcgccagtccctcaccgccgacgacggcaagctctacggcgaaccgttctacggcgagtcgtccttcctcatgtaccgcaaggacgtgttcgcggccaagggcctgaccatgcccgcccaccccacctggcagcagatcgccggcctcgcggcgaaggccgacggcgcccggcccgggatgaagggcatctgcctgcgcggactgcccggctggggcgagctgatggccccgctcaccacggtcgtcaacaccttcggcggcacctggttcgacaagggctggaaggcgcacctggactcgcccgagttcaccgaggcgacgaagttctatgtcgacctggtccggcagcacggcgagtcgggcgccgcgcagtccggcttcgccgagtgcctgaacaacatgacccagggcaaggtcgccatgtggtacgacgccaccagcgcggccggctccctggaggccaagggctcccccgtcaagggcaaggtcggctacgcccccgcgccggtggagaagaccaagtcgtccggctggctctacacctgggcctggggcatccagaacgcctcccgcaaccccgacaaggcctggaagttcgtctcctgggcgtccggcaaggagtacgagcagctggtgggcaagacgtacggctggtcgaacgtcccggccggcaagcgcgcctcgacctacgagaaccccgcctaccgccaagaggccgccgctttccaggagatgacgaagaacgccatcgagaacgcccgcccgaacgaccccggcgtgcagccgcgccccgcgccgggcatccagttcgtcgacatccccgagttcaccgacctcggcaccaaggtctcccaggagatcagcgcggccgtcgccggacgccagtccgtcgagtcggccctgaagaagtcccagcagctcgccgagaagatcgccaaggagtacgagggacgatgaccgccacgaccacggcccccgtggccgccaccgagccgctcgcaccccggcagccctcccccaggctgcgcgcctgggccacccgcgccccgctgctgcccgccctcgtcttcatgatcgccgtgacccagctcccgttcgtggccacgctggtgatctccttcttcgactggaacgcgctctacccgaaggcccgccgcttcaccggcctggacaactaccagcaggtgctcaccgacgcggacctgcgccactcggtgtggacgacggtcctgctgacggtggcggtggtgctggccagcctggtcctgggcctggccctcgccctcctcctggaccgccgcttccccggccggggcgccgtacgcaccctgctgatcgccccgttcctcgtcgtacccgtcgccgccgccctgctgtggaagcacgtgctctacaaccccgagtacggcctgctcaacggcctgctgcactacgtcggcggaccccagccggactggatctcgaacaccccgctgctcgcggtcgaggcctcgctggtgtggcagtggacgccgttcatgatgctgatcctcctggccgggctgcagagccgcgaccagcagcagatcgaggcagcccgggtggacggggccggcgactggcagatcttcgtccatctcacgctgccacacctgcgccgctacctcgaactcggcgcgctgctcggctcgatctacatcgtccagaacttcgacgcggtcttcaccctcacctccgggggcctgggcaccgccaacctgccctacaccgtctaccagagcttctaccaggcccacgagaacggcctggcctccgccgccggtgtcctggtcgtcatcggctccatcgtcatcgcgaccttcgccctgcgcgtggtctcgtccctgttccgcgaggaggcgtcccgcgcatgaacgtcctcaagcgcaacggtctcggcctggtcgcctggctggccggcatcgtcttcttcctgcccatcgcctggatggcgctgacgtccttccactcggaggcggacgcggcgaccaacccgccctccttcgccgcctccctcaccctggacggctaccgcgacttcttcggcagcggcggcggccccagcccctggcccgcgctggccaactcggcggtcgcctcggtggtgtcgacgctgttcgtcctggtcctggccctcccggcggcgtacgcgctgtcgatccggccggtgaagaagtggacggacgtgctgttcttcttcctgtccaccaagatgctgccggcggtggcgggactgctgccgatctacctgttcgccaagaacgccgggatgctcgacaacatctggctgctcgtcatcctctacacctccatgaacctgccgatcgcggtgtggatgatgcagtccttcctcgccgaggtgccggtcgcggtgatcgaggcggcccgcgtcgacggcgcgcgcctgccgacgatcctggcccgggtggtcgcccccatcgccgtccccgggatcgcggcgacggcgctgatctgcttcatcttcagctggaacgaactgctcttcgcacgggtgctcaccggcgtggtcgccgagaccgcccccgtcttcctgaccggcttcatcaccagccagggcctgttcctggcgaaggtgtgcgccgcgtcgctcgtcatctccctgccggtgctcgccgcggggttcgccgcccaggacaaactggtccagggcctgtcgcttggagccgtgaaatgaaggccgccgtcatcgagtccgtgggccgtgccgtcgtcaccgaggtccccgacccgacgcccgggccgcgcgaggtcgtcgtggaggtcgccgcctgcggcctgtgcgggaccgacctgcacatcctgcagggggagttcgcgcccaagctgccgatcgtgccgggccacgagttcgccgggcgcgtcgtcgcggtcggcacccaggtcaccgaggtcgcggcgggcgaccgggtggcggtggacccgtccctgtactgctacgagtgccgccgctgccgcaccgggcacaacaacctgtgcgagcgctgggcggcgatcggcgtgacgacggcgggcggcgcggcccagtacgcggtggcgccggtcgccaactgcgtcaagctccccgagcacgtccgcaccgaggacgcggccctgatcgagccgctgtcctgcgcggtgcgcggctacgacgtcctgcagtcccggctcggcgcgcacgtcctgatctacggctccgggacgatgggcctgatgatgctggagctggccaagcggaccggcgcggcgagcgtggacgtggtcgacctgaacccggcccgcctggagacggcccgcggtctcggtgtctcggcctcggccgcgaacgcggacgagctggaccggcccgagggctgggacctggtcatcgacgcgacgggcaacgcggcggccatccaggacggcctcaacagggtcgccaaggcgggcacgttcctccagttcggcgtggcggactacgccacgcgcgtggagatcgacccgtaccgcatctacaaccaggagatcaccatcacgggctccatggcggtcctgcacagctacgaacgcgcggccgagctgttcgcgaacggcgtgctcgacccggacgtcttcatcagcgaccgcctcccgctggagagctacccgcaggcgctggagcagttcgcggcgggggtgggccgcaagatcgtggtggtgccgtaggcaccgtgatgcagcctctccgggggtgccccctgctcgaagagcctgggggaagtccgaggacgaggccgaaggccgacagggggtctggggcggagccccagggacgcgaagggaaggggcggcgagggcggaaccccttggggccgctgcggtccgcacccgccgccacccgaatgccctcttcccgctgagtaagggaacggcaaagtcccctcgctcgttcacccggcatgacagctatgacccccggctcgaacatccccctctccgccgcccgcgtcacggtcgacgtgaccgctcccgtgcggctggacgtttcgggcctgctgctcaccgccgacggcaaggtgcgctcggacgacgacttcatcttctacaaccagccctccggcccgggcgtgacgtaccgctcgggccggagggctggttgta

SEQ ID NO: 861 - DNA, 4244 bp, Unknown
  Kingdom: Bacteria, Phylum: Actinobacteria, Class: Actinobacteria, Order: Streptomycetales, Family: Streptomycetaceae, Genus: Streptomyces
  misc_feature (4001)..(4002): n is a, c, g, or t
gcgccacggcgctcagcagcacgggttcgtcggcgctcaggacccgctccaccgacgtccgcgccccggccgacagcagggggagcggaccctcgaggcgccgcgcccgccgagggtgcgcgggacaccgtacggcgacccgttccaggatcccggtgcgctcggagcacagcgccaccgcagcccagtcgcccagtcccggcaccagcagccgcagcaggcggcgcatccgcccggaggcgtccagcgcggacatcagcaccgaggagacgtccgccagcaggttcagccgggccgtgagagcctccagagcagccgcgtgcgcggccatccgctcctcggccgcacggtgcggaccgaagtcgtcgaagaccaccaccagccccgccggccggcccgccaccgtcagggacgtcgtcgtccagatgatcggcaccgtcgacccgtcggcccgcaggaagtactcctcgctgccctcctcgacggaccggccgtcggccagcggagtgcgcatcgtgcactcctcacgcggcaccgtggtgccgtcggcgcggcggtgcagcaggtcgtgcgcgtcctggccgagcatctccgcttccgaccggcccagcagccgctcgccccacgggttgacgaaggtgatacgtccggcggtgtcgagggtgaagacgccggtccccaggtcgcacaggaccgcccgcgggaagtcgggccccagggccgcgtcctccgcgctcatggcgcctgcccctttctcgccccggaccgccgtccggcgtgctgccaccgtagatcaccgctttcgccgggctgtgctggaaaccgggccgtgctggagagcaccgggcggtgtgcccgacacaacgggtacccaaaaaccgcccgtactgccacatagaggtgcatacggtaccgggcttgccagggggcggcgccgccaggatccggcaggtacagtgcggagatcagccgaaaccccagcgtgaggtcccgcacgtgttgacccagaccacctcacgggtgctcgaaccgagcgacctggacgcggcgctcgccgtcctcgaccgcgagccggtcgcgaacgccttcgtgacctcccgcgtgcagatcgcgggcctggacccgtggcggctcggcggcgagatgtggggctggtacgagggcggcatgctcacgtccctgtgctacgcgggcgcgaacctcgtcccgatctgcgccaccccgcgcgccgtgcgcgccttcgcggaccgcgcccggcgggccggccgccgctgctcctccatcgtcggcccctccgggcccaccacccagctgtggggactcctcgaacccagctggggcccggcccgggaggtccgcgcccgccagccgctcatgatcaccgaccgcatgcccgccgacatcgccgccgacccctacgtccgccgcgtccgcaaggacgagatggagacgatcatgccggcgtgcgtggccatgttcaccgaggaggtcggcgtctcaccgctggccggcgacggcggcctgctctaccaggcccgggtcgccgaactcgtgggctccggccgctccttcgcccgcctcgacgagcacggcaaggtgatgttcaaggcggagatcggcgccgcgaccgaccgtgcctgccagatccagggcgtctgggtcgcccccgagtaccggggccgcggcctcgccgcccccgccatggcggcggtactgcgctacgcactggccgacatagcccccgtggtcagcctctacgtcaacgacttcaacacggcggcccggcgcacgtacctgcgggtgggattcaaggaggtcggcgcgttcacgagcgtgctgttctagcgcactcgggcgtgctgttccggtgcactggtgtgcggccgggggtcctgggcccgctgcggcggccgtcgtatccgtgcggttctgaggctggtgcgggccgggtagtctccccggcatggcgcactttcccggtcacggccccggccgccgccccgacgacatcgtgatcggccccctcgacctgtcggcccgcgtcgacgaggcgctcgccgtccaggccgtcgccttcgggctcggcgccgaggaggtcgccgtgcgccgccagatcgtcctgcgccacatgaccagccccggcgcccgcgccctgggcgccaccaccgccggcggacggctggccgggttcgtctacggcatgcccaacgaccgcacccactggtggtccaccgtcgtcgagccctacctgcgcgcccgcggccacgaggagtggctggacgactccttcgtcatcaccgaactgcacgtccacccgggccaccagaaccgcggcatcggccgcgccctgatcaccaccatcaccgacagcgccgccgagccccgctccatcctctccgcgatcgacaccgacagccccgcccgcggcctctaccactccctcgggtacgtcgacctggcccggcaggtcctcttccccagcgccccgaagccgtacgccgtgatgggcgccccgctgcccctgcgccgccgcccgtcccacggccgctgaggcgattaccgccgccgccgtccgcccggctaacctcctagccatcaccgatttccggcaggagtacgagaacgatggcgaacgcaccggtccagcgcatgtcccagttgatggccaagacgctgcgcgacgacccggccgacgccgaggtcctcagccacaagctgctggtccgcgccggctacgtccgccgcaccgccgcgggcgtctggagctggctgccgctgggcaagaaggtcctcgcgaacgtcgagcggatcgtccgtgaggagatggacgccatcggcgcccaggaggtgctgctgcccgcactgctgcccagggagccgtacgaggccaccggccgctgggacgagtacggcgccgagctgttccgcctccaggaccgcaagggcggcgactacctgctcggccccacccacgaggagatcttcaccctgctggtgaaggaccaggcgtcctcctacaaggacctgccggtcatcctctaccagatccagagcaagtaccgcgacgaggcccggccgcgcgcgggcatcctgcgcgggcgtgagttcctgatgaaggactcctactccttcgacaccgccgacgagggcctcgccgagtcctatggtctgcaccgccaggcctaccagcgcatcttcgagcgcctcggcctcgactaccgcatctgcgccgccaccgccggcgcgatgggcggctcccgctccgaggagttcctggccccggccgaggccggcgaggacaccttcgccgactgcccgaactgcgacttcgccgccaacacggaggcgatcacgtacgagctgcagccggtggacggctccggtgtgcccgcgctggaggagatcccgacgccggacacccccaccatcgagaccctcgccgcctccctcggcgtccccgcctccgccacgctgaagaacctcctcgtgaaggtggacggcgagatcgtcgccgtcggtgtccccggggaccgcgaggtcgacctgggcaaggtcgaggcgcacttcgccccggccgccgtcgaactggtcaccgccgaggacttcaccggccgccccgacctggtacgcggctacgtcggcccgcagggcctgggcgagaaggtcacctacatcgccgacccgcgcgtggcgcccggcaccgcctggatcaccggcgccaacaaggagcacacgcacgcgaagaacgtcgtcgcgggccgtgacttcgaggtcgacgcgtacgtcgacgtcgtcgtcgtccaggagggcgacccctgcccgaagtgcggcaccggcctgaagctggaccgcgccatcgagatcggccacatcttccagctcggccgcaagtacaccgacgccctcaagctcgacgtcctcggccagaacggcaagccggtccgcgtcaccatgggctcctacggcatcggcgtctcccgcgccgtcgcggccctcgccgnncgagcacggcctggtctggcccgccgaggtcgccccggccgacgtgcatgtggtcgccgcgggcaaggccctgcagaccgagctggccctcgacgtctccgggaagctggccgccgccggtctccgcgtcctcgtcgacgaccgcgccggcgtctccccgggcgtgaagttcacggacgccgaactgatcggtgtccccaagatcctcgtcgccggccgccgctccgccgacggcgtcgtcg

SEQ ID NO: 862 - DNA, 2878 bp, Unknown
  Kingdom: Bacteria, Phylum: Actinobacteria, Class: Actinobacteria, Order: Streptomycetales, Family: Streptomycetaceae, Genus: Streptomyces
cccctgccgggaggagcgcacccgcacccctgccgggaggagcgcacccgcacccctgccaggtggcgcggagcgcccccgtgccgggcggcgctcagcccgccgcgcgcagcaccgccgccacgatcgggccggccgcgtcgccgccgtggccgccctcctgggtcatggccgctgccgcgacatcgtcccggtacccggtgaaccagctgttggacttggcctgcccgtccacctcggcggagccggtcttcgcgccgatgctgccgctcagcccggacatcgcgacggccgcggtgccggtcgtggcggtgcggtgcatcatctgccgcagctgcgcgaccgtgccggccggcagccccttggccgtcgccagttcgcggtcgtccagaccgggggagacgaggacgggctgccggaagctgcccgtcatcgcggtcgccgtcaccgaggccatgttcagcgggctcatctgcacctggccctggccgatcaggttggcggcggtgtccggaccgccggacgccgggaccgagccgtcgaaggacgggatgccggtcttccagttgtcccggcccagtccgaaacggtcctgcgcctccttggtgagggagtccaccttgacctcgtcggcgtacttcacgaacgccgtgttgcacgaacgcgcgaaactctcggagagggtggcctgttcgttcggcttcatgccttccaggttgtggaacgtctggctctgccagaccgccttgtcggggcagggcgcggggccggaagccttggtgatgccgttgtcgatgagcgtcgcggcactgatgatcttcatggtggagcccggcgcgagccggccgaggaacgccgcgttgaaggcgtcctcgcggtggttggcgaccgccagcacctcaccggtggatgccttgacggccaccacggacgactcggagaacttgtccaccgccttctcggccgcggcctgcgcgctcgcgctgagcgtcgtgcgcagcttgcccggacggcccttggcgagcgtgacgagcggcgtctcggcggtctcggagtccgcatgatggatgctcagctcgacggacggggtgccgcccgccttgtcgccgtacttgtcgcgcagttcgtccaggatcgggccgagcgaggggtacttgtccttcgtgaggacggtgccgtggcggtcgacggcgtcgatcggcggggccgccgagtcgccggtgacgagcgtgtcgcccttcttcaactgcgggtgcacgacggccggctgccagtcgaccagcgcccggtggctggtcgcgccgcgcaccacggtcagccggctgctgtaggcgagcggcgcggacttgccgccgtaggacacggtggcccggaccgagaagggcacggtggtgccggaggcggcgcccggcgatatccgcacgccggtgatgtgcgcctcgtgcccgtaggaggacagcacctgctccgcgtcctgagggaagttcgtgtacgacgcggccttcgcggcgtcgcccttctcccaggccgcgaagaactgcgacgtcgtgtccttgacctcgtcccggctcggcggcccggtcctggcgggcgtggcggcgccggtggtcgagtccccctccagcgcggagaagaagttgtacccgccgtacaccgctccgccgaccagcacgacgacgacaccactcacgatcgtggccttggtgcccttgcgcatcagcgcgctcctccccgtactctcccctgtgcgccttcgcccgcgcgggtttcttgaacgcgttcaaaggcggtgcgtgtctcgcactgtaggtgaaagcggggcgccggcggcggctgttgccggatggtgtccgaagagagatcagccgatccgtgtcagacccacgtatccagccacattcgggcccgccagtcgtcgatcgggatcgccgtgcccgtgtacaggggccagaagtagatgaagttccaggcgacgaggaggaccaggactcccgcgccggtggcgccggcgacgcggcgggtgtccgaggcgccgggcggtccgagcagggcgccggccagcatggtgacggccaggcagaggaacggcacgaagacgacggcgtagaagaagaagatcgtgcgctcctggtacaggaaccagggcaggtagcccgccgcgacgccgcaggcgatcgcgcccgcgcgccagtcgcggcggaagaaccagcgccacagcacgtacacgagcgcggcgcacgccgcccaccacagcaccggcgtgccgagcgcgaggacctcgcgggcgcacttgtcaccggcgtcggccgggcagcccgcggtgccgggcgagggggactcgtagaagtacgagaccggacggccgtcgacgagccagctccacgggttggactggtaggtgtgcggcgaggacaggccgacgtggaacttgtagacctccgactcgtagtgccacaggctgcgccaccagtccgggaagagccacgaccaggagctgccgcggccgtccgtggccgcccagttgcggaagtagccgccggtgccgtcggtgggcgagaagatccagccggcccacgaccagatgtaggtgatgacggccaccgggaccgtggcgacgaaggcccagcccaggtcgtggcggagcaccgccacgtacgggcgccgggcaccggccgtgcggcgggcgccgacgtcccacagcaccgtcatcacacagaacgcgaccaggatgtacaggccgttccacttggtgccgatcgccaggcccatcatcagaccggccgcccagcgccaggggcgcaggcccaggcccagggtgtccgccgtgtgggcgtcgggccggacgcggccgtccgggccgacgcccacacggcggaca

SEQ ID NO: 863 - DNA, 1299 bp, Unknown
  Kingdom: Bacteria, Phylum: Actinobacteria, Class: Actinobacteria, Order: Streptomycetales, Family: Streptomycetaceae, Genus: Streptomyces
cctcggcggggtcgggctcggtccccggggcggggacgtagaaggcgacgccgacctcgccgaggcggggatcgggggcgccgacgaccgcgacgtcggcgatctgggcgtggccgcgcaggacgttctccacctcggccgggtaggcgttgaatccgccgacgatgtacacgtccttgaggcggtcggtgagggacaggtagccgcgttcgtcgagcacgccgatgtcaccggtgtgcagccagccgtccgcgtcgatcgccttggcggtcgcctcggggtcgtccaggtagccggacatcacgttgtagccgcgcaccaccacctcgccgggctcgccgggcggcaggggcgcgccgccggtgtccacgacccgcacctcggtgccgggcagggccggtccggcggtcgtcgccacggtccgggcgtcctcgtccggcgggcacacgcacaccaccccggtggactcggtgaggccgtaggcgttgaacacggcctggacgtccagctcggcgcgcatccgctcgatcagtccggggccgacgccgctgcctccgacgccggccaggcgcagtgccgtcaggtcgtagtgggcgcgccggggatggtcgagcaggctgtggaagacggtgggcgtgcccatcaggacactgatccgctcctcggccacccggggcaggatccgctccaggtcgaagacctcctcggggaccatggtgacgcccttcagcaggcaggcgacgatgcccgccttgtagccgaagacgtggaagaacgggttgacgagcaggtagcggtccccggtgcgcagggtgaccgcccgggaccactccctgaagacccgcagggtgcggccgtgcgtggtcagcacgcctttggagcggccggtggtgccggaggtgaagaggatgtcggacaggtcgccggggcggacggcggcgctgcgggcggcacgttcggactccggcaccagcgcgcccgccgcgaggtagtcgtcccagccgatcgtgccttccgcgggctccccgcgcagcaccacggtgccgctcagctgcccgaggtcctcgcccgcgtcgcgcagcatcgccacgtagtcgatgccgaggaaaccgcgctcggtgaggagcagccgggccccgctgcggcggatgatgtcggcggcctcggccgccttgtagcgggtgttgagggggaccaggaccgcgccgacggacaccgccccgagcacggcggtgatccactggcgggtgttgggcgcccagacggccacccggtcgccgggacgcaggccctgggcga

SEQ ID NO: 864 - DNA, 4057 bp, Unknown
  Kingdom: Bacteria, Phylum: Actinobacteria, Class: Actinobacteria, Order: Streptomycetales, Family: Streptomycetaceae, Genus: Streptomyces
tgcctcgacctcggccccggggacggtctcgctcgacgcccggaacaccccgccctcggcgctgacgcgcataccggcgccgacgaaccggagcactcccgcccgcgacagcgcgagcatctgccgcagccggggaccgggcggtccggaggcgagggagctgaagaagccgtgccaccagggtccgatgccgccgagccgcaccaactgcccgtacacggacagcagtccgaggaagagaccgaggtcggcgctgtggtcggggtcgtgccgccggcgcaggtcggcctcgatgtgtccgcgcagcgcctcctggaagtcctcggacgtggcgtgtcgtacgccgtgcagcgggcggtcgagggcggcgaggtcgagccggtcggccgggtcgggcacggcggcggcgaccagggcccggcgctcgtcgggtcccgcgcccgcgtacgcctgctcgaagtccgcccaggccatggcggtccgctcggggtgggcggtgaacagccggtggtagtgggcgaacccgagttccttctcgaccagcggccacagatcgcgccggaagtcgagtccgccggggcgggccgccagctcccgggtctcggccgggccgaggaagcggggcagcggcgggcgctcgccggtgaggtcgtagccgatcttggagtggtacggcactccgcgccgcgagccgacgtgcagcaccggttcccgccccgagggcacgtaggtgtcgccgtcgtaccggccgccgcggccctcggtgagcagcaccatcaggtcgacgaaggcgagtccgaagccgcggacgatgaccgggtcgccggcccgcagggcggacaggtcgctgtcggcggtgaagtccggcggcaggtggaccaggccgtggtcgcgggcgtaggcggccaggcgggtctgctcgtcgtcgggttcggcgtccaggtggccgagggcgagcaccacgaggtcggcgagcagggggcgcgggcggccctccagccatacctgctggcggccctcgcacggcccgccgagcctgagcgcgcgccgccggtggtggtggacggtgacgcgctcgggcagcgcggccaccgcctcgtcgtacacccggcgcaggtaggagccctggaggcggcggtcggtgaaggtgcggccgggcaggcccgcccactggtgcagggtggggccctcgcgcaccggccccgccatgtcgaccgtgtcgtcggtgaacatggtgacgtcctcggcgtgcgagttcatccacagcagcggtgactgcgcggcacgccagatgcgtccggcgccgggcggatacgggtcgacgaggtggatgtcgaggccctcaccggcgtacagctcgggcgcgttggcggcgatgcgttcgagcagtccggtcccccgcgggccggccccgacgacgacgagtgacgacctcatcgggtgtgctccgtgccgcgcgcgtagtgcttctccacgtagtgctggccgacgctcagcaccgaggtgacggcggtgtaccagagggtggcgaccatcagcagcgggatgacctggtacgtccggtggtagatcaactgggcggagtacagcaggtcctggacggcgatgacgctgacgatggaggtgcccttgagggtgccgatcagcatgttcccggccgggggcacgatggagcgcatggcctgcggcaggacgatccgccgccagcgccgccactggctcaggccgagtgcctgcgccgcctcgatctggccgcggtcgacggagaggatgccgccgcgcaccacctcggcggcgtaggcggcctcgtgcagggtgaggccgacgatggcgacggtgaccggtccgaacaggtcgacggtcttcacgccgaggatctgcgggtagagcgccccgatgttgaaccagagcagcagctgcacgaggatcggtatcgaccggaacagccagacgtagccgcggctcaccgcgcgcagcaccgggttggcggagagccggaagacggcgagcagggtaccgagggcgaagccgagcgccatgacgacggcggtcagccacagggtgagccagagtccgcgcaggaccgagccggaggtgaagtagccggcgacgacgtcccattggaacgccttgttgcgcacgacggaggtcagcgcgagaccgagcagggcgaggacggcgacggcggcggtccactggccggtccggcggcgcggcacgatgcgcagggcgtcggccggtccggaggtgccggggctgccggggtcggcgggggctttggcgagggtgccggaagacatgcgaagactccgtgacgtaggtcgaacacgggtgatgccttcacacgggagcgccgcggggcgctgacggccgagcccctcagcaggaccgtcagcacgagagtacgggccgctttcccttcgctgtcaagggcgtccagcatatgagccgctcgtctcaaggcagttgacgggaatccggatgcctgttccacttggcccatgcatccgcagcagtggctggtcacgcgctcccacatcgacttcggtcgagtgtggtcctgttcttgttgagctgagccgaccccctgcgcgccccgctgcctgcgggcgccttcggtcttctcccgttcctcctttcgggtacttcgcgaccactcgcgcacttcacgtcgtgcgcgccgttcgctcccgtctttccgcctttcgccgcctttcccccctttcgcgtcttcgcgtcttcgcgtcttcgcgccttcggctctttcgcgtcctcgtcatcgccttcgcacgcgcacccctcccctcgcgccgcctgacacccctttccttccaggagaccgcacaccatgcgtacgctctcgcgcgcccgtaaacggcatttcatccccttcgccctgatcagttcggcggcgttgctgctcaccgcgtgcggcaccggtccgggcggcaccggagccggagggtccgtcgtgggcgccgccaaggccgccgccgagatcccgaccgcggacgtcgtctccggcatccgcaaggacccggccgccgcccgtctgctgccgtccggggcagggagcctgacgatcgcctacgccgtcggcgggaccccgcccggcacctcctacctcggcgacggcaagaccctcgccggccaggacgtcgacttcgcgaacgcggtcgcccgcgtgctcggcatccggctgaagacgcagcaggccgggttcgaggcgatcctgcccgccctcgacagcggcaagtacgacctcggcgcgggcaacttcggcgtgaccgacgagcggcgccgcaccatcgacttcgtcacctacatcaacgacggccagggcttcgccacccgcaaggacagcaagctcggcaaggtcaccgacctcgcccagctgtgcggcctgaacatcgcgaccggcgccgggaccaccttcgaggccacccttgagcagaacgcgcaccgctgcgcggacgcgggcgagaaggcctacaaggtgcagacgtacagcgagtccggcgcgctgtggtcctcgctccagcagggccgcagcgacgtggtgatgtccacgatcaacggcctgcggtacgcggtcgcccagcagccgggcctgaagttcctcaacgagttccaccgcctcgacgtcggcttcgccttcaagaagggcaccacgctggcaccggcgttccaggcggcggtcgacaagctgatctccgacgggacgtacgcgaagatcctcgacaagtggggcacgacggcgtcggcgatcaaggcatcgcggatctcaccgccggagctgaagaactgaccggccgtcacgacggggccggagccctcggctcagccgcagcccgagcagcactcacagcattcgcagcactcacagcactcgcacgcctcgcagcagtcgcagtcgcagtcgctgcaccagccctcgcgccgctgccgtgaccacgggccctcgaactcgtcggcgcagcacaccttgcaggtgcagcacaggccgacggcggccgcgcaccccgcccagaagccccgcttgtcggggcgcggcggc

SEQ ID NO: 865 - DNA, 1754 bp, Unknown
  Kingdom: Bacteria, Phylum: Actinobacteria, Class: Actinobacteria, Order: Streptomycetales, Family: Streptomycetaceae, Genus: Streptomyces
ggcagtgcggcgagcgcgctgtccatcgcctcgtgcgccgcgaacaggcacggcgtgctgtagatcgcgacgtccacgcccagctcggacagctcgctcagcgacagccgcggcgacttgccgccggcgatctggttgaacagcagcggcttgccgccgaccacctcgcgcacccgcctgatccagtccacgctgcggatcccgtcgacgaggatgacatccgcgtcggtggcggcgagggccccggcccggtgcaggatgtccgcctcgtcggtggcgtccgtacgggccacgacgaccaggtcctgccgggtggccagcaccttctccagtttggcgaggtactcctccagcggcagcacctgcttgccgtcggcgtgcccgcagcggcggggccgcttctggtcctccaggatcaccccggaggcgccgatgcgttccagcccctccaccacgtggcaggcgacctcggggtcgacgtagccgtcgtcgatgtccaccagcaggtggtgcgccgggaaggcgccccgcagccgctggacgaacgccaccatgtccggccaggcgatgaaaccgatgtccggcagtccgtagtaggacgcggcgaagccgaagccggagacgaacatgccgtcgtagtgttcggccgcgatcgacgccgagtacatgtcgtagacaccgataagcggggtggttcccggcccggcgatctgctcgcgcagcttcttgccgtaggtcaacgtgactcctctgatggggggtcgggcgcgcacggcgccctcaggggcggccggtgccgacggtcgacggcacgcggccctttgccgagacaaaaggatccctagaccctgcggagatcgggacttgagacgtcctttactcactcggtcggcggaacgccttcaccggagaaacgtcactgatcggcgtgtcggggcgccgtgttgatgcggcccgtccgatttcttcaagacccccggccggggccgtgcctaccgtcgccgcatgactccacgattcgccgtcgtcggcctggtcgcctccgacctggccgcctcgctcgccttctaccgccgcctcggtctggtcttccccgagggcgccgagcaacagccgcacgtcgaggccgagttgcccggcggcctgaccctcgcgctggacaccgaggacaccgtccgctccttccaccccggctggcggcccccggccgcgggcggccgggtcgcgctcgccttccgctgcgacacgcccgccgacgtcgacgccgtctacgaggacctggtcggcgccggccaccacggggagctgaagccctgggacgcgttctgggggatgcggtacgcggtggtgcacgatcccgacggcaacggtgtcgacctgttcgcgccgctacccgcgaacgccgagtagctcacccagcggcatgccggcgaactcgcgtacgtcacgggagagatgggcctggtcggcgtagccggcccggaccgcggtctgcgcgaacggcaccccgctccgggccagcgcgagggcccgctgcagccgcagcacacgcgccagcgtcttggggccgtagccgaacgcggccagggagcagcggtgcaaccggcgggcgccgagcccgagttcgtcggcggtcgcggcgaccggccggccggcgtccagggccgtgaccaggcgccgcagcagcgggtcgggcggcccggaccggtccgcccgttccagggccgcccgttcgagggcggcggcacgggacc

SEQ ID NO: 866 - DNA, 1397 bp, Unknown
  Kingdom: Bacteria, Phylum: Actinobacteria, Class: Actinobacteria, Order: Streptomycetales, Family: Streptomycetaceae, Genus: Streptomyces
gcccgcggcccggacggcggtggacgaccagcaggtgttcgccgtgctggagatccccgccggccgcgggcccgtcgtcctcgacgtgtccggcgcctcgggcgcgacggtcgcacaggtcctggaggaagccgtggagaaggtgggccggtccaccggcgtccccgtcaccgtccgcgacctcaacccgctccagcacggcgacccgcgcggcctcgcgatcttctacatctcgctcgccgccgtgatcatcggcttcgtcggcgccatccagctcagtgtccatgcccgcgacctgaacccgctggagcgcatcgccttcaccgtcgcctacgcgctgctcggcggcttcgtgatcgccgcggtggtggactggatgctcggcgcgctcgatctgccgttcgtcgagtcctggctgatcctcgcgctgaccatgttcgtctccggcatggtcttcaccatgttcaacaccctcttcggacgctgggccatgatcccgacgtggggactgatggtgctgctcggcaacccctcctccggcggcgcggtctcctggcccctgctgccctcaccgctcggccagatcggccgctggctgccgcccggcgcctcggtcaacgcccagcacaccgccgtctacttcgccggacaccagcacgccttccccttcctcgtcctcgcggcctgggccgtcgtctcctgcgccgtcttctggggctggcgccaccgccaccccggcggccgccaggccacccccgcacacgcggccccctgacggaccggccgcccggtgcgccgcttacctgacgggtcatcgaccgcgggccgccgccggtgcgatgatcgacgccgtacgcagcacagcccgcacggccgaccgaccggaggacgtcatgcccgcctacgccatcgcccacctgcgcgacgccgccccgcacccggagatcgccgagtacatcgagcgcatcaccgccaccttcgccccgtacggcggccgcttcctggtgcacgccacgcagcacgaggtgaaggagggcgcctggccgggacacgtcgtggtcatcgggttccccggcatcgacgaggcacgggcctggtgggactcacccgcctaccaggagatcgcccccctgcgctcacgccacatcgagggcgacatcatcctggtcccgggcgtccccgaggactacgacccggccggcaccgcgcgggcgatgcgcgaggcctcggcggcggggcgggggtagccggccgcggtcgccttccgcgcgtacgcggcaacgcgctccggtcgccgggggcgtcaccgggctggtgcccactgcccggtcggaccgttcggcccggtgagcgcgtccccttccgggaacccggccgccggtccggtcgggctccgt

SEQ ID NO: 867 - DNA, 3774 bp, Unknown
  Kingdom: Bacteria, Phylum: Actinobacteria, Class: Actinobacteria, Order: Streptomycetales, Family: Streptomycetaceae, Genus: Streptomyces
gtcgcctgggccgccgcccgtgccgcaagccgcgacttgccgaccccgccggcgcccgtcaccgtgaccagccgagccgcgtccagcgcccgcgcgagcgcgccgagttcggccgtgcggcccacgaacgcgtcgagttcggccggcgtgccggcggccgtgccgcactccgggagcggcgggtccggcgtcggatcaggcatggcgtctcgcatggaacacggagcgtactgaaacgtaatcactccgtacaatcgcccgggaggactccccgcgtgcgcgcggtaatccggtacggagccccacccgtggcgcgataggctcggtgcacgactttttcgatgttctcgatgttcaggcacgtttcagggagcgggtgcgcacagtgtccggtggtgaggtggccgggatcctggtggccgtgttctgggcgatcctggtcgccttcctcgccgtcgcgctggcgaggctggcccagacgctcagggcgaccaccaagctcgtggcggacgtgacggaccaggcggttccgctgctggccgacgcctcgcaggcggtgcggtccgcgcagacccagatcgaccgggtcgacgcgatcgcctccgacgtccaggaggtcacgtcgaacgcgtcggcgctgtcgaccacggtggcgtccaccttcggcggcccgctggtcaaggtcgccgccttcggctacggcgtgcgccgcgcgctcggcggccgcaaggaggacgtgcccgccaaggcgtcgaggcgtacggtgatcgtgggccgcaccgtcccggccgcgcggcgggggaagcggaacaaccgggagaagtaaggactagcgatgttccgccgttcgttctggttcagcacaggtgtcgccgccggtgtgtgggccaccaccaaggtcaaccgcaagctcaggcagctgacccccgagagcgtcgccgcgaccgcggcgaacaaggccctggagaccggtcaccggatcaaggaccgcgcggtgggcttcgcgctcgacgtccgcgacaacatggcgcggcgggaggccgaactcggcgaggcgctcggcatcaacgcccccgtcgaccgcgaactcccggcgccccggcggctcgccgccatcgagaaccacaacagcccgaagtacgtcgagggctcgacgtacccgacgtactcgtacaaccggaatgaggaccactgatggagtcggctgagatccgccgccgctggctgagcttcttcgaggagcgcgggcacaccgtcgtcccttcggcgtcgctcatcgcggacgacccgactctgctcctcgtcccggccggcatggtgcccttcaagccctacttcctgggcgaggtcaagccgccgttccagcgcgccaccagcgtgcagaagtgcgtgcgcacgcccgacatcgaagaggtcggcaagaccacccggcacggcacgttcttccagatgtgcggcaacttctccttcggcgactacttcaaggaaggcgccatcacgtacgcctgggagctgctcaccacgccccaggacaagggcggttacggcctcgaccccgagcgcctgtggatcaccgtctacaaggacgacgacgaggccgagcgcatctggcacgaggtcgtcggcgtgccgcgcgagcgcatccagcgcctgggcatgaaggacaactactggtccatgggcgttcccggcccgtgcggcccctgctccgagatcaactacgaccgcggccccgagttcggcgccgagggcggccccgccgtcaacgacgagcggtacgtggagatctggaacctcgtcttcatgcagtacgagcgcggcgagggcatcggcaaggacaacttcgagatcctcggggacctgcccagccagaacatcgacacgggcctcggtctcgagcggctcgccatgattctgcagggcgtgcagaacatgtacgagatcgacacctccatggccgtcatcaagaaggccaccgagctgaccggcgtggcctacggcgacgcccacgcctcggacgtgtccctgcgcgtcgtcaccgaccacatgcgcacctccgtgatgctcatcggtgacggcgtgaccccgggcaacgagggccgcggctacgtgctgcgccgcatcatgcgccgcgccatccgcaacatgcgcctgctcggtgccacagggccggtcgtcaaggacctgatcgacgtcgtcatcggcatgatgggccagcagtacccggagctggtcaccgaccgcgagcgcatcgagaaggtcgccctcgccgaggagaacgccttcctgaagacgctgaaggccggcaccaacatcctggacaccgccgtcaccgagaccaagcagtccggcggcaccgtcctcgccggcgacaaggcgttcctgctccacgacacctggggcttcccgatcgacctcaccctggagatggccgccgagcagggcctgtccgtggacgaggacggcttccgccgcctgatgaaggagcagcgggagcgcgccaaggccgacgcccaggccaagaagaccggccacgccgacatgggcgcctaccgcgagatcgccgaccgggccggtgagaccgacttcatcggctacaccgacaccgtgggcgagtccacgatcgtcggcatcctcgtcgacggcgcctcctccccggccgccaccgagggcgacgaggtcgagatcgtcctggaccgcaccccgttctacgccgagggcggcggccagatcggcgacaccggccgcatcaaggtggacaccggtgccgtcatcgaggtccgcgactgccagaagccggtgccgggcgtctacgtccacaagggcgtcgtccaggtcggcgaggtcaccgtcggtgccaaggcccaggcctccatcgacgtccgccgccgcaaggccatcgcccgcgcccactcggccacccacctgacccaccaggcgctgcgcgacgcgctgggcccgacggccgcccaggccggttcggagaaccagcccggccgcttccgcttcgacttcggctccccgtccgccgtcccgacggccgtgatgaccgacgtcgagcagaagatcaacgaggtgctcgcccgcgatctcgacgtgcacgccgaggtcatgggcatcgacgacgccaagaagcagggcgccatcgccgagttcggcgagaagtacggcgagcgggtccgtgtcgtcaccatcggcgacttctccaaggagctgtgcggcggcacccacgtgcacaacaccgcccagctcggcctggtcaagctgctcggcgagtcgtcgatcggctccggcgtgcgccgtatcgaggccctggtcggcgtcgacgcctacaacttcctggcccgcgagcacacggtcgtcgcccagctccaggagctgatcaagggccgctcggaggaactgccggagaaggtctccgccatgctcggcaagctgaaggacgccgagaaggagatcgagaagttccgcgccgagaaggtgctccaggccgccgccgggctcgccgagtccgccaaggacgtccgcggagtcgccgtggtgaccggccaggtcccggacggcacgaccccggacgacctgcgcaagctcgtcctcgacgtgcgcgggcgcatccagggcggccgcgccgccgtggtcgccctgttcacggtcaacaacggcaagccgctcacggtcatcgccaccaacgaggccgcccgcgagcgcggcctgaaggccggtgacctggtccgtaccgccgccaagaccctcggcggcggcgggggcggcaag

SEQ ID NO: 868 - DNA, 928 bp, Unknown
  Kingdom: Bacteria, Phylum: Actinobacteria, Class: Actinobacteria, Order: Streptomycetales, Family: Streptomycetaceae, Genus: Streptomyces
cctcgtggtcgcgggtgcccacgccaacgagcccacgggcggctcggccctcctcgcgctggcccagcgcgtgctggacgaacggcagttgcgtgccgggacctcctggcacttcctgctgtgcgcggacccggacggggcgagcctgcacgtgacgccggccccgcgcagcctgctcgactaccacctcggcttcttccggccggccgggtccgagcagccggagtggtcgccggccgtgctgccgcccgaccggctgccgcccgagacccgggcgctgaccggcgtcatcgacgcgctgcggccctacctccaggtgaccctgcacggcaccgagctgggcggcagctgggtgcagctcacccgggacgtgcccgggttggcggaacctttcgccaagtcggcggccgagctgcacatcccggtggagacgggggcctgcgacgcggcgggctggcccgtggccgggcccggcgtacgggtgatgccggcgcccggctcggcgctggcgttcccgagcctgccggacgacgcacggctgagcacctggtaccacgcccaccgctacggcggcatgacggcggtcgtggaggtcccgatgtgggcgagcgacctggtcgacgatcccgccccgcaccccgacccgcaggcggcgatacgccggctggcggcccggctgctgcgggacgggcgggaggtggagctggtgctcgccgacgcgctgccccggctgcggggcaccgggggtccgctgctgcgcgcggcgcgctggtacctcggcctggtgccgggtctggcggcggactgggtgcagaccccgcccgccgacacgacgatggcctacgtcggcagcgtcgacgcgttcggccgccggctgccgctgcgggccgcggctatgctgctgcgggtgctgcggaagtacgacgac

SEQ ID NO: 869 - DNA, 2989 bp, Unknown
  Kingdom: Bacteria, Phylum: Actinobacteria, Class: Actinobacteria, Order: Streptomycetales, Family: Streptomycetaceae, Genus: Streptomyces
gggaaccgtgcggagcgcggcaggagtcgtcccgccgcgctccgcacggttcccggagacgtcccaagcgctggggttccactggacgtcggtcgtgtgcttcgcggcgtcgtgcgtcgggtgtgctccgctgcccggccagccgccgcaggccagtgcggcggacggtatgccgacggcgccgacagcgacggcggcgatggctgcccgccggtagtgctgatgcttgcgatgcttgcccatgcgtgacctcactcggtagtcgccgagcgcccttcatccgggcggctcttcgggagcccgcccctgaactgcggcgatgcctgtgggtcgtcatcttgcggcgacggcgagcggggacgcaaaggaccttgctactacgctgcctcgtagatcggcatggtccttgcggaggcgcaggggaacatgctgatcactcgttccggccgggagcggacgcctggctgcgcgtcagaaggccctcatgggccggtgaaggaacgaaagcgctgagcggtggtcagccgccgtgaccgtcgcgcagtgagcccgccccaagccggacaagtccctcatgtcaccagagcggcggctactatcggaggaccatagtagcggaatgagctgtgactgatgtcacggagcggtggcggaccgcagacgtacggggagcgtctggtgcccgttgctgatgagcgagcgcagtggcggcaactggtccgcggatacggtgagttcgatgccggggaaccggtcgaagagcatccgcagggcggtggtgacctccatgcgcgcgagcggggcgccgaggcagaagtgcacgccgtatccgaaggccatgtggtccttcaccggacgggtgacatcgaagcggtcggcgctcggaccgtgccagtcggagtgacggttcgcggcggcgtacgaggcgaggatggcgtcgccctgcgggacgacctgtccgtcgggcagggtgatgtccttcagcgcgtagcgcagcggaagatgcttgacggcgggttcgtgtcgcagcgtctcctcgacgacgtccggccagtccgcctgtccgtcgcgcaggagggcgagctgcccggggtcggtgagcagggcggtcacggcctggtcgatgacgttgacggtggtctcgtacccggcggagatcatcagcagcagagtgtcgcgcagttcggagtcggacaggccgcccccgtcgccctcctcgtcgcgggcggcgaccaggagagaggtcatgtcgtcgccgggctcggcccgcttgagggcgatcagccggcccagggcctcgtggacggcggtggtgttcgcggcggcctgctcggtggtgagcgtggtgtcgaagacaccgtcgaccatggcacggaaaccgtcgcgctggtcttcgggcacgcccatgagcctgctgatcacggcgatcgggagcgggcgcgcgagacgggcgcgcaggtcgacctcgtccccgacgggcagagcggcgagtgtgtcgagcagtgcggtgaccgtggtctccacggtggggcgcagcgcttcgacgcggcgggcactgaaggcgggcgcgatcatgcggcgcagcctgcggtggtcggagccgtaggcggtgaacatgttgtccgtcgagacccagagggcgagcggccaggtcgtgatggtctcggcgaaggccggccagtgcctggcggcgtccttggagacgtcggggctggtcagcaggagcttgagggcgaccgggtcggtgacggcccacgccgtcaccccgaggatgtccacgcgggcggcggacccctgggcgcgtaacgcccgggtctccgcgtggtggtcggcgccggtggggtcgaggacgatccaaggctgctcgttcacgcgtgtctcccttgcctgcgggcggcctgcgctgcatgggccgtctcgtaggttagggcttccgcacgccctgcgggagttccgcgtcggtatcgtcacgcgtgcacaggatcagccgcttcccgtgcaggcggccctcgtccatgcgccggtgcgcctcggcggcggcccgcagcggcagcacctcgggcgagcgcgggcgaagagccccggccgcgagcaaccggttgatggccgcggcggcctcggcgagttcggcggacgtggcgtgcgagatcacgaagccgatgaccgagcagtccttcatgtacagcggcccggcgggcagttcgggccgggtacgggcccccgccagcaggacgatccggccacggcgggcgagcagtccgaccgtgttcgtcaggtcgttcacgccggcggtgtcgaggtagaggtcgacgccgcgcgggcaggcgtcccggatccgctcgaacagagccgggtcgcggtagtcgatgacctccgccgcgcccagtgcgcggcagtgcccggcgtccttctcaccggcggtggcgacgacgtgcgcgccggcccgcgccgcgagcaccaccagcgcgccgccgacgttgccggcggcacccgcgacgacgacggtctcgcccgggcgaagccggccgtgggtgaacagtgccaggtaggcggtggccgccggatggacgacggcgaccgcggtgagcggctccacaccgtccggcagggggtacagccggtcggcggccaccacggcgcgttccgccgcggcgccctgccgtccttcgtggcccaggctgttgctccacacccggtcgcccacggcgaaaccgccggcgcccgggccggcctgggccaccgtgcccaccaggtcacggccgatcacgaaggggaagccgaccggggtgcggaacaggcccgagcggacgaaggtgtccaccgggttgaccgtggtggccaggacgtcgaccaacacgtcggtcggccccggccgcggcgagggcagttcaccgtaccgaatcacgtccggcgggccgagctgttcgatgtaggcggcgcgcatgcggccgatcatgacactctcggccgccgcgcgcggcgcaggaga

SEQ ID NO: 870 - DNA, 2281 bp, Unknown
  Kingdom: Bacteria, Phylum: Actinobacteria, Class: Actinobacteria, Order: Streptomycetales, Family: Streptomycetaceae, Genus: Streptomyces
cctccaggccgtccatgccgggcagcatgaggtccaggaccaccaggtccggcggccgggcggcggcccgtgccacggcggccggaccgtcggcggccaggtcgaccgcgaagcccgcccggtccagatacccggcgacgacctcggacacggtggggtcgtcgtccacgacgagtacgcgtttcacaccagcgagtctcgcaccggcaccgcttccccggagggggcggcggcggacgtcagcgatccgtaagccggcggatcaccggcggatcgatcgatcacctcgtccggtccccctgaccagtgccgctccgcctccccgcgtcccgcgtggtctaagtgggccgggggtgcgacgctggtgggacaggtgtccgaggaggggccgagtcgaccggggagcgccgatgggacgggacgtcccggcgatggtcttcacccgcgaggaccgccgccggtaccggagcaagatgcaggactgtctcgacgcgttcgcgcagatgctgcgcgagtcacggttcgagtccgagcggccccaggtggggctggagatcgagctgaacctcgtcgacgaccgggccgagccgacgatgcgcaacgtcgacgtcctggaggcgatcgcggatccggcgtggtccaccgagctgggccggttcaacctggagaccaacatcccgccccgggcgctgacggcgggcggccccgacgcgtgggagagcgagatccgggccgcgctgaaccacgcggaccggcgcgcccggtcggtgggcgcgcatctgatcatgatcggcatcctcccgacgctgcggcaggaggacgtgggccaggcggcgctctcggagaacccgcgctaccggttgctcaacgaccaggtcttcgcggcccggggcgaggacctgcacatcgaggtggacggcgtcgaccggctgcgcacgtacgcggacacgatcactccggaggcggcctgtaccagcacgcagttccacctccaggtgtcgccggaggagttcgccggctactggaacgcggcacaggcggtggccggggtgcaggtcgcgctggcggccaactcgccgttcctgttcggcagggagctgtggcacgagaccaggatcccgctgttcgagcaggccaccgacacccgtccgaaggagatcaaggtgcagggggtgcggccccgggtgtggttcggggagcggtggatcaacagcgtgttcgacctcttcgaggagaacctccgctacttcccggcgctgctgccgctctgcgacgagcaggaccccgccgagacgctggaccgcggcgacatccccgagctggccgagctgaccctgcacaacggcaccatctaccgctggaaccgcccggtctacgccgtcgcccaggacaagccgcacctgcgggtggagaaccgtgtgctgcccgccggcccgaccgtcgccgacaccctcgccaacggggccttctactacgggatcatccgggccctggtggaggaggaccggccggtgtggtcgcggatgtccttctcggccgccgaggacaacctccacacggccgcgcggcacggcatcgacagccggctgtactggccgggcacgggcgaggtcccggtgcccgaactggtcctgcgccggctgctgccgatggcgcacaagggcctggagctctccgggatggacgaggcctggcgcgagccgctgctcggcatcatcgagcagcggtgcgtcaccggccgcaacggcgcggtctggcagaaggagatgttccaccacctcgacgccgcgggccgcgccggccgccacgagtccctgcgccgcatgacgcagttgtacatcgagtacatgcacctcaacgcgccggtgcacacctggccggtggactgacagagccggcccgcccggcccaggcggagccggcccgccgggcccgggcacttcgcgcgtgccccggccgcattcaccctgcggtggcacgcgggattgaacgattcaattcctggtcaacttccctttgccagaagccttgacgaccgccatggccacacctaccgtctcccgcggcgatgttaaacgattcaattgcaattcaattcccgaccctgcccgagtcgtcgtcgacccatcgaagggagcacggaacgttgcctgcacagcgcgtcccgtccggtccgtcccgccgtcaggtggtccgcacggcgtccgccgccgcggccgtcaccgcactgtcctccaccgccgcccacgcggcacccgcaggacctgccgcccccgccgcc

SEQ ID NO: 871 - DNA, 4512 bp, Unknown
  Kingdom: Bacteria, Phylum: Actinobacteria, Class: Actinobacteria, Order: Streptomycetales, Family: Streptomycetaceae, Genus: Streptomyces
gcgctcggccgcctcggcgacggcgtcggggtgccggactctgaccgaggtgaggtcggggatgcggacgctcaaggcagggctccgttcaggaggcgcacggcggggctccgttcaggcggtcgtcggcaggcgtggccgccggacccagcgggtagagatccgctccgtcggggagggggcggatcccgggtcgccgtctcccaggtgtagacgcgcggcagcacagtgtcaatattttgtacggacataaggacgtaccgacgtacaaacctgcgcctgcaatgatgtcttgacaaagtattgacagcgggcaccgcagaggattggatcccgtcccagcgcaccagccatgaaccggcgacgacccggagaacccgccgggggccggccttccctccgtcgcacagtgaggtgcaggaaagatggaccgctcctcccgcccccgcagactcgcccccgtcgtggccctcaccgccgccgcggccctgaccctcgccggctgctccagcagctcgggcgggaagaaggccgcggagggcggaggagacgcctccgcgggcaaggccaccacgccccggatgaccgtcgccctggtcacgcaccaggcacctggcgacacgttctgggacatcgtccgcaagggcgccgaggccgccgccgccaaggacaacatcaagctcgtctactccgccgaccccaacgccggcaaccaggccaacctggtgcagaacgcgatcgaccagaaggccgacggcatcgccgtcaccctcgccaaacccgacgcgctcaaggccgtcctcggcaaggccgtcggcgccggcatacccgtggtcggcctcaactccggtctcagcgactggaagaagctcgggctgctggagttcttcgggcaggacgagaccgtggcgggcgaggcgttcggcaccaagctggacgaggtcggcgccaagaacgtcgtctgcgtgatccacgagcagggcaacgtcggcctgacccagcgctgcgacggcgtgaagaagacgttcaagggcaccaccgagacgctgtacgtcaacggcaccgacatgccgtccgtcaaagcgaccatcaccgcgaaactcaagcagaacagcggcatcgaccacgtcgtcaccctcggcgcgcccttcgccctgaccgccgtgcaggccgtggccgacgcgggcggcaaggcgaagatcgccaccttcgacctgaacaaggacctggccggcgccgtcaagaagggcgacatccagttcgccgtcgaccagcagccctacctccagggctacctcgccgtcgactccctgtggctctacaagaacaacggcaactacagcggcggaggcgtccagcccgtgctgaccggcccggccttcgtcgacaggtccaacgtcgacaaggtcgccgagttcgccgccaagggcacccggtgagcggcccagggcacccggtgagcggcatgagccggcagcccgcaccggcgccggtcgtcccaccgggcccggacggcacgcggaccgacggcaggaccgcacggcgcccgccggtactgcggctgctggcccggcccgaggtcggtgtcctcctcggcgccgtcgccgtcctcgtcttcttcctcgtcgcggcgccctcggtccgccagggcggctccatggcgaccgtcctctaccagtcgtcgaccatcggcatcatggccctgcccgtggccctgctgatgatcggcggcgagttcgacctctccgccggtgtcgccgtgatcacctcggcactgaccgcgagcatgctcagctaccagctgacgacgaacgtgtggacgggcgtgatcgtcgccctggcactctcactgggcatcggcgcgctcaacggctggatgctggtgcgcacccgcctgccgagcttcctggtcaccctgggcaccttcctcatcctccagggcgtcaacctcgccgtcaccaaactggtcaccggcaacgtcgccaccgacgacatcagcgacatggacggcttcggccaggccaaggcactcttcgcctcctccttcgacgtcggcggcgtgcaggtgaagaccaccgtcgtgtggtggctggtcttcgccgcgctcgccacctgggtgctgctgcgcaccaagtacggcaactgggtcttcgcggtcggcggcgagcaggagagcgcccgcgccgtcggggtaccggtgaccttcaccaagatcacgctgttcatgctggtcggtttcggcgcctggttcgtcggcatgcaccagctgttctccttcaacaccgtgcagtccggcgagggcgtcggcaacgagctgatctacatcgccgcggccgtcatcggcggctgcctcctcaccggcggccacggctcggcgatcggccccgtcttcggcgccttcatgttcgggatggtgaaccagggcatcgtctacgccggctggaaccccgactggttcaaggccttcctcggtgtgatgctgctcggcgccgtcctcatcaatctgtgggtccggcgcacggcgacccggaggtgatgagatgaatccggaggtgacgacatgaagagcgacaggaccggcacgggagccgaaacgcagggcgccgtacacggtgccgtgccgcgggacaccccgcccgacggcgagcggcccctcgtcgaactgcggggcgccgggaagtcctacggcaacatccgggcgctgcacggtgtcgacctcgcggtgcacgccggacgggtgacctgcgtcctgggtgacaacggtgccggaaagtccaccctcatcaagatcgtctccgggctccaccagcacaccgagggcgagttcctcgtcgacggcaccccggtgcggttctccaccccgcgcgaagccctggacaagggcatcgccaccgtctaccaggacctggccaccgtcccgctcatgccggtgtggcgcaacttcttcctcggctccgaactgacccgcggcccctggcccgtgcgccgcctcgacatcgcgcgcatgaagaagaccgcggacgaggaactgcgcgggatgggcatcgtcctggacgacctggagcagcccatcggcaccctctccggcggccagcgccagtgcgtggccatcgcccgcgccgtccacttcggcgcccgcgtcctcatcctcgacgagcccaccgccgccctcggcgtcaaacagtccggagcggtgctgaagtacatcgccgccgcccgcgaccgcggcctcggcgtcatcttcatcacccacaacccgcaccacgcctacctggtcggcgaccacttcagcgtgctgcgcctgggcaccctcgaactgtccgcgccccgcagcgggatcggcctggaggagctgaccctgcacatggcgggcggcgccgaactcgccgcactcaggcacgaactgtcccaggtgcgcggcgtcgacgtcgaggaactgcccgaggaacaggacctgacccggcaggaccccgcggcccttgcaccgggcgtctccgcaccggatgcctccgcaccggcgacccccgaagggaactcctgacatgacacccgtgctcgaccgcatccgggtcggctcggcccccgactcctggggcgtgtggttccccgacgatccccggcagaccccctggaaccgcttcctggacgaggtggcggaggccggctacccctggatcgaactgggcccctacggctacctgccgaccgacccggcccggctcaccgacgaactggcccggcgcggcctgaaggtctcggcgggcaccgtcttcaccggactgcaccgcggcccgtccgaatgggcgtccacctgggaacacgtgggccgggtcgccgagctggcccgggccgtgggcgcggggcacctcgtcgtcatcccgtccttctggcgggacgacaggacggccgagatcctggaaccgccggagctgaccggcgagcagtggggtcacctgacccggggcatggaacggctcggccgcgaggtcaaggagacctacggcctcgacatcgtcgtccacccgcacgccgacacccacatcgacaccgaggcacacgtcgcacgcttcctcgactcgaccgactccggcctggtcaacctctgcctggacaccgggcactacgcctactgcggcggggacagcgtcaggctgatcgagacctacggcgagcggatcggctacctgcacctcaagcaggtcgaccccgagatcctcgccgaagtggtgtcgggcgggctgccgttcgggccggccgtgcggcgcggcgtgatgtgcgaaccgccgtccggggtgcccgagctggaacccgtactggccgcagcgcaggaactgggcgtcgacctgttcgccatcgtcgagcaggacatgtacccctgcgcaccggacgcgccgctgcccatcgccgtacgcacccgccgcttcctgaggtcctgcggggcctgacccccgcgggcctgcctggcccggctgcgcggccgcccgtgcgccttgtcctcgcgtcccgctccct

SEQ ID NO: 872 - DNA, 3595 bp, Unknown
  Kingdom: Bacteria, Phylum: Actinobacteria, Class: Actinobacteria, Order: Streptomycetales, Family: Streptomycetaceae, Genus: Streptomyces
gtcccgcgcgtgtcccgcgcggcggcagggcgtgcgggcggggcggcggacactcccacatgtgtctacgcggaccggcgaaccgcagacacagtgtcgggcgcggtccgggcgcgttgctggtgggatggtctggtgacggcgaccgcaccccgaaccggcggccccggcccccttccgggccgcccaccggttccggtcccggcacacgagccccacgaacggcacgtctcgacccgacgccgccctctgcgaaggagtaacccggaatgacgaagatcgtcaaccactggatcggcggcaagtccgtcgaaggcgcctcggggtcgtacgggccggtcacggacccggcgaccggcgcggtcaccacgaaggtggcgttcgcgtccgtggaggaggtggacgcggccgtcgccgccgccaaggacgcgtaccgcacctggggccagtcctcgctggcccagcgcaccacgatcctgttccgcttccgcgcgctgctggacgcgcaccgcgacgagatcgccgagctgatcaccgccgagcacggcaaggtgcactccgacgcgctcggcgaggtcgcgcgcggcctggagatcgtcgacctggcctgcggcatcaacgtgcagctcaagggcgagctgtccacccaggtcgccacccgggtggacgtgtcctcgatccgccagccgctgggtgtggtcgcgggcatcacgccgttcaacttcccggcgatggtcccgatgtggatgttcccgatcgccatcgcctgcggcaacaccttcgtgctgaagccgagcgagaaggacccctcggcctcgctgaagatcgccgaactgctgtccgaggccgggctgcccgacggcgtgttcaacgtcgtccagggcgacaaggtggccgtcgaccgccttctggagcacccggacgtccaggcggtctccttcgtcggctccaccccgatcgcccgctacatccacaccacggccgctgccaacggcaagcgcgtgcaggcgctgggcggggccaagaaccacatgctggtgctgccggacgccgacctggacgcggcggcggacgcggcggtctcggcggcgtacggctcggccggcgagcgctgcatggccatctcggccgtcgtcgcggtcggctcgatcgccgacgagctggtcgacaagatccgcgagcgcgccgagaagatcaagatcggtccgggcaccgacccgtcctccgagatgggcccgctgatcaccgccgcccaccgcgacaaggtcgcctcctacgtcaagggcgccgcggacgagggctgcgaggtcgtcctggacggcaccggctacagcgtggagggctacgaggacggccactggatcggcctgtcgctgctcgaccgggtgccgacgaccgcgaaggcgtaccaggacgagatcttcggcccggtgctgtgcgtgctgcgcgcggacacctacgaggagggcctggccctgatcaacgcctcgccgttcggcaacggcaccgcgatcttcacccgggacggcggcgccgcccgccgcttccagctggaggtcgaggccggcatggtcggcgtgaacgtgccgatcccggtgccggtgggctaccactccttcggcggctggaaggactcgctcttcggcgaccaccacatctacggcaacgacggcacccacttctacacccgcggcaaggtcgtcacgacccgctggcccgacccggccgacgcgcccgcgggcgtcgacctcgggttcccgcgcaaccactgagcgtgacgcaaagccccctcgcggccgtccggtatccggacggccgcgactttttttgcgacagggcctgcgattcccgtgtgcgcgggaggaaacggatggcggaggcggatcgactccagcgccttggaaagcaaggtcaccatttgttgaggcttgatgaatgcgctgttgcagcgatgaaacctatgaaaccgagccgccgcccgcccagtcccgggtgcggattccgaaggtgaacagccattgacgtgacggttttcgtcgggattccatgctggcgccgggagcggacgaacatgacgtgaacgtacgaccgaagccgccggaggcgatagcgctcccgagaccctctcacctgctgcacgaaccgatcggaaccgccgcatgaccgacacgctccgccctgtcgacaccgccgccccaacggcggccggcagccccaccgaggcgacggacaacccccagcagctcaagcgttccatcggcgtcgtcggcggcaccctcctcaccctctcgtgcgtcaccccggcctccacgctcttcgtggtcgtgcccgacctgttcgggacgctcggcaccgccaccgcgctgaccatcgccatcggctcgctgctctgcatcgccgtggcgttctgctactccgagctgggcaccctcatccccagcgcgggcggcgagtacgccatggtctccacgatggccggacggctcgcgggctggctggtgttcgtgctgtccctgctggtcgtcatgatcgtgccgcccgtgatcgccatgggcaccgcggactacctcgccccgatcgtgcacctcgacccggcgatgaccggcgccggcgtgatgctgctcgccaccctcgccggcctgctcgacctgcgcgccaacgcctggatcaccggcatcttcctggtcctggaggtcatcgccgccggcgtggtcgccctgctgggcttcgcgcacagccaccgcggagtcggcagcctggtctccatgcaggtggccggctcgggcggccacaccagcaccgtgacggccatgatggtcatctccgggctcgccatcgccctcttcgccacccagggcttctcgaccgccgtctacctctccgaggaactcgagcacccgcgccgcaacgtcgcccgcacggtgctcgccaccctggccatctcctccgtgatcatcctcgtgccggtcgtcgccatcaccctgggcgcctccgacctcaaggagctgaccggcggcgacctcagcgcgatggtgaccgcctggtccaactccgccgtcggcaccttcgtcagcctctgcgtcgccctcgcgatcatcaacgccggcatcgtcatggtcatccagaactcccgcgtgctgttcgcctccgcccgcgacaaggcctggcccgcgcccgtcaacaacgtcttctccaggctgggccggttcggctccccctgggtcgccacgctcgccgtcggcgtccccggcgccgccctgtgcttcgtcaacctggacaccctctacggcgtcaccggcgtctcggtgaccggcatgtacatcctcgtcgcggtcgccgccctgctgtgccgccgcgcctcccacaagcacacccccgcatggcgcatgccgctgtggccggccatgccgatcctgctgatcgtggtgctggtgtacatcctcacccagcaggaggtcagctacctgctgtggaccggcggcatcatggccgtggccaccctgtactgggccttctacctccgcccgcgccgcgacacccgctggctggtgtcgatccccgaggacgcccaggcctgagcccccgggccgcacgg

SEQ ID NO: 873 - DNA, 2498 bp, Unknown
  Kingdom: Bacteria, Phylum: Actinobacteria, Class: Actinobacteria, Order: Streptomycetales, Family: Streptomycetaceae, Genus: Streptomyces
agggcccacagcgcgagcctgccgccgagccgcgggtccgcgtcgatcgcggcgcgcaccttctcgacggcgaaaccggcgtgcccggtgtcgtcgaggacggccagcaccagctcgcgggtgtcggagtccagccgggcggcgacctcccggtagaagtcgctggcgatcgagtcaccgacgtacgccttgacgagcccttccagccagtccgagggcgccgtctgccggtggaagccgtcgagcgcggcgacgaaggggtccatcgctgcggtgggctccgcgccgatctccgtgaggcggtcgcgcagccgctcgaagtggtggaactcggccgaggccatcttcgccagctcggccttgtccgcgagggtcggcgccagtttggcgtcctccgcgagccgttcgaacgccgccagttcgccgtacgcgagcgcgccgagcaggtccacgacggcggcacggtactgcgggtcggcggcggccgtcgcccagtcctgggcggcgatcccggtgcgttcggcgggggcgtcggaggcctggtcgggcttgtcagagctggtcatgaagcgcacaatagcccgcctgccgggctccggagggacctgaccgaacagtgtgacgacggctacgtgaccaaatcggccatcgcgtgtgcgggattccggggtatggtggtattgcgcctgctgggcacgccggatttcccgacgcactccgacaggccgcacgcatgaggatgcccggtcggtggcccgatcggctccgacccgacagccctccctgaccgtacggcactgcgcgtacgacgatcggagggacaccctcagcggtacgagcgctggacctgccccgagggcaggcccgcagagcgtcggcagaggtcccgtgccaatacggccggcctgagcggttctcccgtacggccgccgacgtccccggcacggtccgacacgacccccgcgctcgcctcgcaccgcacacacagaagaggcagcaccctgactacgacgttccgagagctcggaatccttcccgagaccgccgaggccctggaggccgtcggcatcatcaaccccttccccatccaggagatgacgctccccgtggccctgtcgggcacggacgtcatcggccaggccaagaccggcaccggcaagacgctgggcttcggcctcccgctcctcgagcgcgtcaccgtccccgccgacgtcgaggccggacgcgccgcccccgaggccctcaccgaggccccgcaggcactcgtcgtcgttcccacgcgcgagctgtgcgtccaggtcaccaacgacctgctgaccgccggcaaggtgcgcaacgtgcgggtcctcgcgatctacggcggccgggcctacgagccccaggtcgaggccctgaagaagggcgtcgacgtggtcgtcggcaccccgggccgcctgctggacctggccggccagaagaagctgaacctcaagcacgtcaaggcgctcgtcctcgacgaggccgacgagatgctcgacctgggcttcctgcccgacgtcgagaagatcatcggcatgctgccggccaagcggcagacgatgctgttctcggcgaccatgccgggcgcggtcatcggtctggcccgccggtacatgtcccggcccacgcacatccgcgccaccgcgccggacgacgagggcgtgacggtcgcgaacatcaagcagttcgtctaccgcgcgcacaacatggacaagccggagatggtcgcccgcatactgcaggccgagggccgcgggctggcgatgatcttctgccggaccaagcgcacggccgccgacatcgccgagcagctccagcggcgcggcttcgcctccggcgcggtccacggcgacctcggccagggcgcccgcgagcaggcgctgcgcgccttccgcaacggcaaggtcgacgtcctcgtctgcaccgacgtcgccgcgcgcggcatcgacgtcgagggcgtcacccacgtcatcaactaccagtcccccgaggacgagaagacgtacctgcaccgggtcggccgtaccggccgcgcgggcgccaagggtacggcgatcacgctcgtcgactgggacgacatcccgcgctggcagctgatcaacaaggcgctggagctggacttcaacgacccggcggagacgtactcgagctccccgcaccttttctcggagctgggcatccccgagggcaccaagggcaccctgccgcgctcggagcgcacccgcgccgggctggacgcggagaagctggaggacctcggcgagaccggtggtcgcggtgcccgcgggcgcggcggccggggcggtcgtcccgaggagcgctcggccgaccgtgagcgtgacgtcgagcgcgagcgtgaccgtgagcgtccggcacgcaccccgcgccgccgccggcgtacgcgcggtggtgcgccgctggactcggccgcgccggccgccggtacgtccgccgaggccgcgccggtcgagccggccgcc

SEQ ID NO: 874 - DNA, 2892 bp, Unknown
  Kingdom: Bacteria, Phylum: Actinobacteria, Class: Actinobacteria, Order: Streptomycetales, Family: Streptomycetaceae, Genus: Streptomyces
ctcggccgtgtgatgcagtcgatcaccaagccgtggcagatgtacccggtgggcctcctctccggcctcggcttcgacaccgcgaccgaggtggcgctgctggtgctggcgggctccggcgccgcctcggtggcggtgtcgaagccgaggccgaagaggaagcccagcgggtacatctggccgggccgggagaccgacttggtgaggcggcccaggatgcggttcatgaacccccgcgagtccaggtgggcttccagctcccgctcgtcgtacgtgcccgcgcgcatcgcccggaacaccttcatgatgccgacgagggcgaccaggttgagggcggcgatgaggtagaggaaggtgcccgagacggtggtgccgacgatgccgagcgtctggtgcgtaggggagtcgtcgctcatcagggtgcccgcgaggtgggcgccgcccgccaccagcgcggccatcgccaccaccacgctggagtgaccgagcgcgaaccagaagcccaccgacaccggccgcttgccgtcggccatcagcttgcgggtggtgttgtcgatggcggcgatgtggtcggcgtcgaaggcgtgccgcatgccgagggtgtacgcggtgatgccgaggccgatgccgaaggccttggtgccgacctggtagtgctcggggacgacgagcaggaacaggatgccgaaggcgacgacgtgcagggcggctatcaccgccatcagccccgcggtcttgagggtgtcctcacggcgccagcggaaggacgcctgagggggccccgtgggggcggacgtcggcgtcgggacaggcttgggcagggtcatccggtatcacgctccagcacctcgtggatcacttcgtgagctgccgtggccggtctcctggcttaggggtcgtgcattccgcctccctgccttcccggtcgtgcgaccagtggcccggcggatgccggacggaaggggaactccccgatcacagtggcgagggccgcgtcggcttcgcaccgacttcccgagcaccacggcccgcccacggtagtgggacgcaccgtcgactgcatagctgcatacctgcgcaggtacggaagatcacatcgatgcctgcgaggatgggggcatgcatctcgtccctgccgaccgcgcgggccgccggaccatcgacggtcaccgggtgtgcgacgccatcgcggcgatcggggagcccggccacgtccgcgcgtgggcggagcgcttctcgctgctggccgaccccaagcggctcgccctgctgctggccctgcaccgcaccggcccgctggccgtctccgacctcgccgtcgccaccggcatgaacgacccggcggtctcccaggccctgcgcctgctgcgcgcggcgggcaccgtggagggcgagaaggagggccgcgtggtgcgctaccggctggtggacgaggacgtacggcacctcctggagcactgcgcggcggacacggactgacgccgatgacggggcgatgacgcgcgccccgccgaccgccccctgtgccccggtacaaccccacgtgttcgcttttccggtgttctggacagattctctgtgtcgaccgccgtacgaagaggagaccgcgtgaccgaccgcaccggcgacgcgccgcccgacctgtcctcccgcagtcccgactggtggcggcaggccgtcgtctaccaggtctatccccgcagcttcgccgacgccgacggcgacggactcggcgacctgaggggcatcacccagcgactgacgcacctcgccgccctcggcgtggacgccgtctggctcagcccgttctacccctccgaactggccgacggcggttacgacgtcgccgaccaccgggacgtcgacccgcgcctgggcaccctcgacgacttcgacgcgatggtcgccgaggcgcaccgcctcggcctgaaggtgatcgccgacatcgtccccaaccactcctcgcaccggcacccctggttccaggaggcgctgcgggccggtccgggctcggccgcccgcgaccggtacgtcttccgggacggccgcggcgagcacggcgaactgccgcccaccgactggcagtccgtcttcggcggcagcgcctggcagcgggtgcccgacgggcagtggtacctgcacctgttcgcacccgagcagcccgacttcgactggcgcaacgaggaggtccgcgccgacttccgcaccaccctgcggttctggtccgaccggggcgtggacggcttccgcatcgacgtggcgcacgccctggtcaaggacctcgacgaaccgctgcgcgacgtcggggacatcggcgtcaccggcgaggtggcgctgccgcacgtcgaaccgggcagccacccgtactgggaccgcgacgaggtgcacgagatctaccgcgactggcgcaagatcttcgacgcctactccccgccccgcacggccgtcgccgaggcctgggtgcccgatgtccggcgcgcgctgtacgcccgcccggacgaactggggcaggccttcaacttcgagtacctgcagaccgggtgggacgcggacgagctgcgccgcaccatctccgcgtccctggccaccgcacaggccgcgggcgcctccgccacctgggtgctgtccaaccacgacgtcgtccggcacgcctgccggctgatgctgccgccgggcacggacgagaacgcctggctgctgtccggcggcagcatcagccggcaggcgtgccggacgacgtcgtggttggacagcacccaggtggcggaggcgcccgcggcctgtgcggtggccagggacgcggagatggtgcggcgcagctcgtccgcgtcccacccggtctgcaggtactcgcagttgaaggcctgccccatttcgtccgggcgggcgtac

SEQ ID NO: 875 - DNA, 1578 bp, Unknown
  Kingdom: Bacteria, Phylum: Actinobacteria, Class: Actinobacteria, Order: Streptomycetales, Family: Streptomycetaceae, Genus: Streptomyces
gctccggggggcgctcgccagggcgcgcacggcgtggagtgcgctccgtgcgctcccgctgcccgccggggcgcccgcgcggtggtgccgtccgtcgctgtgcagcaggacccctggcgcgaaggggcgcagcacgagcgcgtccagccccgggctgcggcccagttgggggtacgacgtgagcagcagctgcccgatccggtcgagccggaagccgtcgatcttctccgtcgacatgcggccgcctgggcaaggggcggcctccaggactgcggtcgttactcctgcgctggtcagccgatgtgcggcggagagcccggcgaccccggctcccaccaccacgacatccacctggtacgcgggctcaagcacgtgcccctcctcgaggttgcgcgaccggtgaagcggtgatgcccgcgaccggcttgaggaatacccgagttcggcacgaggttaggcgcgcggccggtcaggaacagtcgcgcatcgacagggcacggtcgcatgacggtcgcatacggtcgcaagccttcaagaccgcaacgagaggcatcaccagccactcacctcagatcacccgcggtccgcccgcccggctgtcacagcgccgctcgtacggcgtcctcgacgtcggggaaggcgaacgagaatcccgactccaaaagccgccgcgggaccacccgggcgctggccagcacgtcagccgccatctctccgagcaccgtccgcagcaccggcgccggtaccgggaacggtgtcggccggtgcaggacccggcccatcgccgccgtgacctcacggttcgtccgcgggtgcggagcggtcaggttgaccggccccgacaggctgtccgtgtcgatgagatggcgcagcgccgccacctcgtcgtgcagcgcgatgaacgaccagtactgccgcccgtcgcccagccgcccgccgagcccggcccggaacagcgggaacagccggccccacgcgccgccctcgcgggccaccaccagaccggtccgcgcgaacaccgtccgcacgcccgcctcccgcgccggagccgcggcctcctcccactccacgcacagcgagggcaggaaaccgtcaccgggcggcgcgtcctcgtcgacggcccgctcgcccgtgtcgccgtagaagccgatcgcactgccgccgacgaacacccgtggcggtgtgccgagggcggcgacggcctcggcgagcgccgccgtgcccagcaccctgctgtcccgcatcgtcctcttgtacgcgtccgtccagcggtggtcgcccacccccgcacccgccaggttgaccaccgcgtcacacccgatgaggcccgacgtgtccacgtactgcctctcggggtcccagcggacctcgtccgcaccgcgggccggccggcgcaccaggcgcaccacctcgtgcccgtccgcgaccagggaccgcaccagggcgctgccgatcagaccggacgcgccggccaccgcgatgcgtgaacgttccatgtgctcatcctgccccgccacgcccctcctgccccgcccgtcacgcgaatcccccacgacagcgtcccggcgccccctacag

SEQ ID NO: 876 - DNA, 4460 bp, Unknown
  Kingdom: Bacteria, Phylum: Actinobacteria, Class: Actinobacteria, Order: Streptomycetales, Family: Streptomycetaceae, Genus: Streptomyces
gtacgaagcgatgtcggcgcccctcggggcgccggtgtccgaagcggtgccggtgcaccggagggcccccgccgtccgagccgcgtacggcgtcgccgcaccgggcgtcggtggcagccgggcccgcgggcggcggcggtttccggccagggcgccgccgcccggcagggacggccgcgcggtcctcccgcgggacccgcaacccgcgccccacatgcgccggacccggcgttcacacgccgtttgcctcgaatcgataacggctttggaagaggtctttttctgacatctacgcgcgttacgatgccgaggccgacgccgccagggcgtctcggctcgagcaccgaaacggtgctcacatcaagcgccgacacggcgctcaggtcaggtgaaggagccttcccgtgcgccgggttgccaagctttccgctgcgtgtatcgcctccgcagcactcgcactgactgccaccgcctgtggcagcacctcctccgacagcagcacctcgtcctcgtcgtccggtggcggcggcaagggcgtcaagatcggtctcgcctacgacgtcggcggccgtggtgaccggtccttcaacgactccgccgcgcgcggtgccgacaaggccgagaaggagttcggcggttccgtcaaggaactgaccgccaagacctccgacaccgaggccgaccgcgagcagcgcctgtcggacctggcggacgcgggctacaacccgatcgtcgccgtcggttacgcctacgcgccctccatgacgaaggtcgccgcgaagtacccgaagaccaccttcggcatcgtcgactcggtcgtgaacggcaagaacgtcgacagcatcaccttcaccgaggagcagggctcgtacctggccggtgtcgcggcggcgctgaagaccaagaaggaccacgtcggcttcatcggcggtgtcgacgtcccgctgatcaagaagttcgaggcgggcttcgtccagggcgtcaaggagaccaacccgaagatcaaggtcgacacccagtacctgtcccacggctcggacacctccggcttcgccagccccgacaagggcaaggaggccgcgcagggcatgctcgacaagggcgccgacgtcatctacacggcggccggctcctccggcaacggcgcgatcgaggccgtcagcggcgtcaagggcgcctgggccatcggcgtggactccgaccagtacaacgtcccgggcctggccaagtacaagaactcgatcctgacctcggtcgtcaagaacgtcgacgtcggtgtctacgacctcatcaagtccgtgcacgacggcaagccggtgagcggcaacaacgtctactcgctcgccaaggaaggcgtctcgctgtccaccagcggcggtttcctcaccgacatccagcccaagctggacgccgcgaagaagaagatcgtcgacggccagaccaaggtcaagaccactccgtgacctgacgggtctcagacagccgtcggacctgggctcggcgcggggatgccgaagcgggcacccccgcgccgagccataacaatgtgtcaactctacgcgtgtagcaccgagttgccgcgctagcgtcgccgacgcctgccctcccctacgcagcccctttccccgaggagagtgcgccatcaacgcgtccagccctcccgctgccgtcgaactgcgcggcatcaccaagcgtttccccggcgtcgtcgccaaccgcgacatcgacatcacggtccgcacgggcaccgtccacgccctgtgcggcgagaacggcgccggcaagtccaccctgatgaagatcctctacggcatgcagcagccggacgagggcaccatcacggtcaacggtgaacaggtcgtcctcagcaatcccggtgacgccatcgcccgcggcatcggcatggtccaccagcacttcatgctcgccgacaacctcaccgtcctggagaacgtcgtcctcggcgcggagaagctgcacggcatcggcggcagggcccgcgcccggatcaaggagatctccgacgcgtacggcctgaacgtccgcccggacgtgctcgtggaggaactgggcgtcgccgaccgccagcgcgtggagatcctcaaggtcctctaccgcggcgccaagacgctcatcctggacgagccgaccgccgtgctcgtgccgcaggaggtcgacgcgctcttcgacaacctgcgcgagctgaaggccgagggcctcaccgtcatcttcatctcccacaagctgggcgaggtgctctccgtcgccgacgacatcaccgtcatccggcgcggcaccaccgtcggcacggtcgagccgggcgcgaccacgccccgccagctcgccgagctgatggtcggcagcgaactgcccacaccggagaccgaggagtccaccgtcacggacgtccccatgctcaccgtggacggcctgcgcctgacgcagaccgacctggacggtgtcgagcgggtcatcctggacgacgtctccttcacgatccgcaagggcgaggtcctgggcatcgcgggtgtcgagggcaacggccagtccgaactggtcgaggcgatcatgggcatccgcaagcccgacaccggcgccatcacgctcgacgacgccgacatcgcccacacctcgacccggagccgccgccaggccggcatcggctacatccccgaggaccgccaccgccacggcctgctcctggaagcaccgctgtgggagaaccgcatcctcggccacgtcgccgagaagccgaactcgcgcggcgccctcctcgacatcaaggccgcccgcgccgacacccagcggatcgtccaggcctacgacgtccgcacccccggcatcgaggtcaccgcggcctccctgtccggcggcaaccagcagaagctgatcgtcggccgcgagatgagccaccacccgaagttcctcatcgccgcccaccccacccgcggcgtggacgtcggcgcccaggcgcagatctgggaccagatccgcgaggcccgccgcgagggcctggccgtcctgctgatctcggcggacctggacgaactgatcgggctctccgacaccctgcgggtgatgtaccgcggtcgcctggtcgccgacgccgaccccgccacggtcacccccgaggcgctgggctccgccatgacgggtgcgtccgccggccacctggagcagacagaggacgacgagcgatgaacaagctgacctcacgcatcgacaaggagcggctgctcctcgggatcgccgcaccgctgctggcggtcgtcgccgcactcgtcgtcaccacgctggtgatcctcgcgaccggcaagaaccccggtgccgcgttcagtgacatgatcacctacggctcggccagcgacagccaggtctacatcctgaacaaggcgacgacgtactacctggcgggcgtcgcggtggccatcggcttccggatgaacctgttcaacatcggtgtcgacggccagtaccggctcgccgcgttcgtggccgccgtcctcggcggcgcgctgagcgcacccggctggatcgccatacccctggtcatcctctgcgccatggcgaccggcgccctgtgggcggccatcgccggcatcctgaaggtgacccggggcgtcagcgaggtcatcgcgaccatcatgctgaactccatcgccaccgcgatcatcgcctacctgctccagcccggaaagctcggcgaactccagcagggcggcacgctcgtctccaccaagccgctgccgacgtcctcgtacttcttcggcttcgacaccggcgcggccggtgaactgtggggcttcatcgtcatcgccgcgctcgtcggcgtggcctactggttcgtgctcggccgcacccggttcggcttcgacctgcgcaccgtcggccagtccgagagcgcggccgccgcgagcggtgtgtcggtgaagaagatggtcgccaccagcatgatcatctcgggtgcggtggccggtctgatcggcatgccgaccctgctcaacgacagccaccagttcagcaacgacttcccggcgggtatcggcttcaccggcatcgccatcgcgctgctcggccgcaaccacccgatcggcatcgccctcggcgccctgctgtggggcttcctggagcgcaccacgaaccacctggagttccagggctacgacaaggagatcctcggcgtgatccagggcgtcatcgtcctgtgcgtcgtgatcgcctacgaggtcgtccgccgctacggcctcaagcgccagcagcagcgggtcggcgccgaactcgccgcccaggccatcgctccgaagacgaagcaggaggtggcgggatgactgccacgatgactgacgcgccgccgcccgtggcgcccaaggcggacgccggctcccggcggtcgggccgctcgttcggccagatcctcatgctcgtcgccggcgccctgctgctcgtggccgccgtccggg

SEQ ID NO: 877 - DNA, 1943 bp, Unknown
  Kingdom: Bacteria, Phylum: Actinobacteria, Class: Actinobacteria, Order: Streptomycetales, Family: Streptomycetaceae, Genus: Streptomyces
ccctcggcggccatggcctccaggacggcccggtacatcgcggcgagtcggtcggcggcgtccctggcgaggaccttggtgctggtcttcagggtgagaccgccgccggacgtggcgacctccagggcgaactcggtggtgcccgagccgagcccggccgccaggtccagctgctcaccgtccaggttgtggaagtcctggtagttgaagatcacgtcgacgaggcgcccggcggcgttcgcggtccgctggatctccgggaacgggaagcggcggtgcggccacatcgcgacctcgcggtcgaagacctggcgcaccagctcccgccaggtgcgggcggtgcgcacgtgcgggaacggcagcgtgttgacgtacatgccgtacacgcggtcggagcccaggacctcgggacgggtgtcgcagacgagccccgtgtggaaggcgggctcgtcggtgagctggccgagcaccttgaggtgggcggcgagcagcacgctcttgacggacaccccggcgcgtgtggcgaaggcgcgcagcggcgcctccaggtccgagagcggcacggtgaccgcgaagtcctccgccgcggcggtgcggtccgcccagtcggcgggcagcgcgaacggcgcgtgccgccccaccacgtcctgccagtacgcgcggtcctccggcgagccgagcgcggccagttcggcggcgacggtgtcggcgaagcggacctcgggcgcctggtgggcgcccggctcacggccctgcgcgtacgcccggtagcaggcgagcagttccatcagcatggcgtgctgcgaccagccctcggtgatcatgtgggactgggtgagccccagccaccagccgtcgtccgcgacgtgggcggtgacccgcagctgcggggcggacgccacatcgagcagcgcggcccgttcggcggcctgatgggcccgcagcgcgctgcgcaccccggcggcgtcgagcccgctcaggtcgtacaccgtgacgggtgccaccgccgtggcgtgcaccagttgcagcggccgggaggcggtggacaggtcgaacgacgtgcgcagcacctcgtgccgggcgaccaccgtggcgaccgcggcgcgcagcgcgtccgcgtcgaacggccggtcgtcgcgcaccttgtagtccgccgtcgagtggtaggcggcctcggcgcccgccgtcatctcgacgagcatcccggtctgcacctgtgtcagcgggtaggcgtcgacgacggccgccggcagcagcgcccggtcgtccgcgtcgatcatcgcgaacggcttgaccgcgcggaacgcctcggcgggcgcggtgcggccgctcaccagttcggcgacggcggcgacggtgcgccgctcgaagacgtcgcggacggtgacgtcgagcccggccgcacgcatcgcgccgaccagcgcgaccgcgcggatcgagtcgccgccgaggtcgaagaacgcgtcctcgacgccgaccgtgtcccggccgagcgcgtcggcccagatcagcgcgagctgctgctcgacgggggtgcgcggggcgacgtgggagccggtgtcgagggctgccgcgtccggcgcgggcagcgcccgcttgtcgagcttgccgttggtggtcagcgggatcgcgtcgagcgtcacgaacaccgcggggaccatgtactcgggcagcccgcgtccgaggctgtcgcgcagcgcgcggggcgcggcgagcccgccctcggcgggcaccacgtaggcgacgagctgcttgtcgccgggggtgtcctcgcgtacgacgacgacggcctgggcgatggacggctcggcggcgagcgcggcggcgatctcgccgagttcgatgcggtagccgcggatcttgacctggtcgtcgacgcggcccaggacctccagggagccgtcggccagccgtctggcgacgtcgccgctgcggtacatgcg

SEQ ID NO: 878 - DNA, 2801 bp, Unknown
  Kingdom: Bacteria, Phylum: Actinobacteria, Class: Actinobacteria, Order: Streptomycetales, Family: Streptomycetaceae, Genus: Streptomyces
atcctggggcgggcgctgctgggattcggctgagccgccgtccggccgggctgacggtcccgggtgggccgccgcgcggccgagcggatggttcgggtggcccgccgcgcggacggacggccggttcgagcgggccgtcacccaaccgcgataggtccgaccaggccgccgtgacctgcggtgatgccgccacggaggtgactgtcagtggtggggtgcagactggccggtgtctgggacgaaggcgtcctggacccacttgtcgcggaggtgatcggcatgaccgaggtactgctcgccgtgggcacccgcaagggcctgttcatcgggcggcggcgcggtggcgcctgggagttcgacgacagtccccacttcaatgcacaggccgtgtattcggtcgccatcgacaccaggggcaccgtcccacggctgctggccggcggcgacagcgcgcactgggggccgtccgtgttccactccgacgacctgggccacagctggaccgaaccggcccggcccgcggtgaagttccccaaggacacgggcgcgtcgctggaacgggtctggcagctccacccggccgcggcggaaccggacgtggtgtacgcgggcacggaaccggccgcgctctaccgctccgaggaccgcggcgagagcttcgaactggtccgtccgctgtgggagcaccccacccgctccaagtgggtgccgggcggcggcggcgagggcctgcacacggtggtcacggaccggcgcgatccgaaggccgtcacggtggccgtgtccaccgccggggtgttccgcacggccgacggcggcgcgagctggacgccgtccaactccggtgtgtccgccgtgttcctgcccgatcccgaccccgagttcggccagtgcgtccacaaggtcgcccaggactgcgtcgatcccgaccggctctacctgcagaaccactggggcgtgtaccgcagcgacgacaagggcgcgcactggacggacatcggcgagggcctgccctcgacgttcggcttcgcggcggccacccatccgcaccgcggcgacacggcgtacgtcttcccgatcaacgccgacgcggaccgggtccccgccggccaccgctgccgggtgttccgcacgaccgacgccgggcggagctgggagccgctctcggccggcctgccgcaggaggaccactacggcaccgtgctgcgtgacgccctgtgcaccgacgccgccgacccggcgggcgtgtacttcggcaaccgcaacggcgaggtgtacgcctcggcggacgacggcgacagctggcagcagctggcctcgcacctgcccgacgtgctgtgtgtccgggcggcggtggtcgactgacgcgggaggatccatgccccggcccgagcgcgcggcgagggtgcgctggctaccctgcggtcatgcgtatgcgggtgacgccacgtcaacggttgtacctcgactcgctgatcgcggccgggcttctgggtgtgacgctgggcttcgccgccgggtacaggccaccgggctggcccgtcttcgacgcccgcgccgtcgtcctgacgtgtctgatccacctgcccctggtggtgcgccgggtggttccgtggccggtgctgtgggccacgtgtgccgggctcaccgtgtacaccgcgctcggttaccagccgtccgtcaacctgtggtccccgatgctggcgttcttcacggtcgccgccgcccgaccggcccgggaaaccgcgcgggcggccgtgccggtcgcggccgcgtggctgtacaacgggctggcctcgcacgcgatgtcggtcctggtggccgtgggacagaccctcgtggtcctgctgctcgcctggggcttcggcacgaacctgcgccgtctggagcggcagaacaccgagctggaccggctcaccgcacgcctgcgcgcacaggagggagcccgcgcccggcacgcggtgaccgaggaacgcctgcggatcgcccgcgaactgcacgacgtggtcgcccaccatctctcggtcgtgtcggtgcagagcggtctggcccggtacgtcttcgacagcgacgcggagaaggcacgggcggcgctgcgcaccatcgaggacaccgcacgcgagacgctggaggagatgcgcggcctgctccaggtcctgcgcgtaagcccggacggcaccgacgccgtgtccggaccgtccacggggcccgacaccggtctggcccggctggacgaactcgccgcccggatgggcgcggcggggctcgtcgtcgagaccgccgtcaccggcacgccccggccgctgccgtcgggggcggacctgtgcgcgtaccgcatcgtccaggaggcactgaccaacgcgctgaaacacgccggcgcgcacgcccgggtccgggtggcgctggcgtacgacaccgatgcgctggcggtgaccgtgaccgacgacggaggtcatcggccggacggctcccgtacggccgccgaagcgacgcgggtgacagcgtcccgcgtggcgcccgaggccgtcaccggggccgggagcgaagccggaaaagatctcgaagccgacgccgggaaccgtgccggaaccggcgccgcgagcatggtcacggccgtccccggacagggcctttcgctgtccggggacggccgtgaccatgctcgcggcgccggttccggcacggttcccggcgtcggcttcgagatcttttccggcttcgctcccggccccggtgacggcctcgggcgccacgcgggacgctgtcacccgcgtcgcttcggcggccgtacgggagccgtc

SEQ ID NO: 879 - DNA, 799 bp, Unknown
  Kingdom: Bacteria, Phylum: Actinobacteria, Class: Actinobacteria, Order: Streptomycetales, Family: Streptomycetaceae, Genus: Streptomyces
ctctgagccgcccacagctctcagccgtgctcagggctgagcggggcgcacggggtgcgggtcagtccgtgtcggctgcctggagggttctcgtcacgtcgacgaagcccttggtggccgacaccagacggcctcggcgcaccacctggagggtcacgtcggcgttggccaggcgggcgaagccggtggaggcgaaggggcccgacaggggccaccgcagccgtggggtcaggccgcccgtgtcgacggccagcccggagtcgagggtgcgccgtacggcgtcggcgtccaccggtccggagccgatcttctccagggcggcgcgcaggacggtgtaggcgatccacgtggtctgcaccccggcgtccgtggggtccacgcggttgtcgccgaaggcctgcgcgttgatcaccttcttcatcgcgtcccagcgcggatcgtccgcgaccgggtaccagccggtgatggacgccccttcgtagggtcctgagggcccgccgctcgcgtcgatcacggtctggtccacgctgccgagcacggcggcggtgcgtaccgccggatagttctgccgggcccggcggaaggagtccatgaagatgttggtgcgctcgcccagggccgggacgacacagcccttcctccccggcacggcggacgcctgcaccagcgccttggccgcctcgccggagtacccggtggcgtcgtcggcggccagttggtcgtgcgccgcgccgtgcccgcccgccttcaggccggtgtcgagcagcccgggcagttcatcgcccgcgatgctgtcggg

SEQ ID NO: 880 - DNA, 661 bp, Unknown
  Kingdom: Bacteria, Phylum: Actinobacteria, Class: Actinobacteria, Order: Streptomycetales, Family: Streptomycetaceae, Genus: Streptomyces
gacggcgcctacaccgccgtctgagcaaggccgagcacgcagaagacacgaacaaggctcagacgcggagaaggctcagcagcggagaaggctcgccgccgcccgcgcgcagaaggaaggacttcccatgaaggcactgcagtaccgcaccatcggcgccccgccggaggtggtcaccgtccccgaccccgaacccgggcccggacaggtcctgctgaaggtcaccgccgccggagtctgccactccgacatcgccgtgatgagctggcccgccgaggcgttcccctacccgctgccgctcaccctcggccacgaaggcgtgggcaccgtcgccgcgctgggtgccggcgtgagcggactggcggagggcgagcaggtcgccgtgtacgggccctggggctgcggcacctgcgccaagtgcgccgagggcaaggagaactactgcctgcgcgccgacgccctcggcatccgcccgccggggctcggcgctccgggcgcgatggccgagtacctgctcgtcgacgacccgcggcacctggttccgctcggtggcctcgacccggtcgcagccgttccgctgaccgacgcgggcctgacgccgtaccacgcgatcaagcgcgcgctgccccgcctcgtaccgggctccaccgccgtggtcatc

SEQ ID NO: 881 - DNA, 749 bp, Unknown
  Kingdom: Bacteria, Phylum: Actinobacteria, Class: Actinobacteria, Order: Streptomycetales, Family: Streptomycetaceae, Genus: Streptomyces
  misc_feature (300)..(301): n is a, c, g, or t
tcgggttggcccgcaggtcgagcgaggcgtcggccgtgaggatcacggcctccagcagcgagtcgatgtgcagaccctgcttggcggagatgtcgacgaacatggtgtcgccgccgtactcctcggccaccaggccgtactcggtcagctgaccgcgcaccttggtcgggtccgcgccctcgacgtcgatcttgttgaccgcgaccacgatcggcacgtcggccgccttggcgtggttgagcgcctcgaccgtctgcggcatgacgccgtcgttggccgcgacgaccaggatcgcgatgnncctcgtcctcgccgaactccaggtcgaaggactcgagcagctcgcggtcctcctcctcggggctgacgatctggacgttgtagttcatctcgtcggccaggagctgcagcgtctcgtcggagacggactgcgtggccgtgaccatctcgcccaggttcatcatgaccgcgacgagcgacgccgggttggcgttgatcttctcggcgaagtcggtgagcgacgcgccgcgggagagacggatcgtctcgccgttgccgcgcggcagcatcacgccgccgacgctcggggcctgcatggcctcgtactcctggcgccgctgccgcttcgacttgcggccacgacgcgccggaccaccgggacggccgaaggcaccctgcgtgccgccacggccaccgggaccgcccggacgaccgccgaagccgggacggccaccgccgccgccgaagcc

SEQ ID NO: 882 - DNA, 3567 bp, Unknown
  Kingdom: Bacteria, Phylum: Actinobacteria, Class: Actinobacteria, Order: Streptomycetales, Family: Streptomycetaceae, Genus: Streptomyces
acgccgccctgcgccgcaccgccgacccggtcgacggtgcggcgcagggcggcgtaggagtccaagcgggtgcgcagcgcggcgaaggtgaagggcttgacgaggtagtgcagcgcgcccagtcgcatcgcctgctgcacggtcgccacgtcgccggccgccgtgatcatgatgacgtcggtgcccagaccctgttcgcgcatgcggtggacgagttccagaccggtgcggtcgggcaggtagtggtcgagcaggaccaggtcgatgcctccgcgttgtacggcggtcagtgcctgggcagcactgtgcgcgcgggaggtcacccggaatccgggaacctttcccacgtacttcgcgttgatctcggcgacacggaagtcgtcgtcgaccaccaggacgtcaatcatcgggcctctttccctcaaggcctggcgagcgttaagcccgtgtttcggctccgttgttgtagcgcgagcaaaacgagcacaacaggtgcttgcgagcaaaagaacggcttgcgaacagaagactgctgctgtggcgggggccacacctaccgtcccgggtcatgagcgcagacaccagccccgcgatcgagctgcggggcgcgagcaagacgttcaggaccccctcggggggcctgcacaccgctgtgagggatctcgacctcaccgttcggcgcggcgagttcgtcgccgtggtgggacccaccggctgcggcaagtcgaccacgttgacgctggtcagcggattggaggagcccaccgagggcgacgtgctggtggccggcgagccggtgaccggtgtcggcggcaaggtcggcttcgtcttccagcaggacgccaccttcccctggcggacggtgctgtccaacgtgatggcgggcccgcgtttccgcggcgtgccgaaggcggaggcgaaggagaaggcgcgggcgtggctggcccgggtcgggctcgccgccttcgaggaccgttacccgcaccagctctccggtggtcagcgcaagcgcgtcgccctcgccgcgaccttcgtcaacgaccccgagatcctgctcatggacgagccgttctcggcgctcgacgtccagacccgggcgctgatgtcggacgagctgctggagctgtgggagggcaccggctcctcggtcgtcttcgtcacccacgacctggaggaggccatcgcgctggccgacaaggtcgtcgtgatgacagccggtcccgccaccgtcaagcaggtcttcgacatcggcctgccccggccgcgcaaggtcgagcaggtgcgcctgcagagcgagttcatcgacatctaccgcgagatctgggagtccctgggcgaagaggtccgcatcacccgtgaaagaggtgccgcccatgtcgcctgaggttctcagcacgccggtcgccgagacggccaagacgcccgaccgggcgcactcccgggcgcgtgccgcccgcaagcggaaggcgatcgtcaccgcggcccgcatcctgctcctggtggccgtgctcggtctgtgggaggcgctctcccgggccgaggtcatcgatccgttcaacttctcgatgccatccaagatctgggaccagatgtggacctggatcacccacggcaccgcgctcggctcgctgggcgagcagatctggtacacgctctacgaggcgctgatcggctgggtgttcggtgtggtggccggtgtgatcctcggcatcgcgctgggtcgcatccacttcctggccgacgtcctgggcccgtacatcaaggtgctcaactcgctccccaggatcgtgctcgccccgatcttcgtgatctggttcgggctcgggccgatgtccaagatcgcctccgccgtcgtcctcgtcttcttcccggtgttcttcaacgccttccagggcgcccgcgaggtcgaccgcaacctggtggccaacgcgcgcatcctcggcgccagcgaccgcagggtcaccttccaggtggtcatcccgtccgccacctcctggatcttcaccagcctccacgtcagcttcggcttcgcgctcatcggcgccatcgtcggcgagtacatcggcgccaccaacggcatcggcctgctcgtcgcgcagtcgcagggcaccttcaacgcggccggcgtgtacgccgcgatggtcatcctcgccgcggtcgccctcgtcgccgaggggctgctcaccttcgccgagcgccgcatcttccgctggaagcccgccgactccggtcactgagccgcccccggcacgcccccgtgccctcctgcccgtgccccgcaccttcctcccgtaccgctcacccctaggacgtgaaccgccatgcgcaagaccgtcagactcgcggcgtccgccgccgccggcctgctcgccctgtcctccctcaccgcctgcgccaacgacgcggccggctcggccgacagcggcagcggcggcgggggcggcggcaagggcgaacacgtcaagatcatggtcggtggcctggacaaggtcatctacatgcccgccatgctcacccagcgcctcggctacttctccgccgagggcctgaacgtggaactgctcagcgagcccgccggtgtccaggccgagaccgcgctcgtctccggccaggtccagggcgccgtcggcttctacgaccacaccctcgacctccaggtcaagggcaagcacatcgagtccgtggtgcagctctcgcacgctcccggtgaggtggaggtggtctccaccaaggccgccggcgacatcaagtcccccaaggacttcaagggcaagaagctcggcgtcaccggcctcggttcgtcgaccgacttcctcaccaagtacctcgcggtcaagaacggggtgaaggtcagcgacttcaccccggtcgccgtcggtgccggaccgacgttcatctccgcgctccagcagggctccatcgacggcggtatgaccaccgacccgaccgtcgcgaccatcctggacaagaaggccggcaacgtcctcgtcgacatgcggaccccggagggctcccaggaggcgctcggcggtccctacccgtcgtcgagcctctacatgcagacggactgggtcgacagccacaaggacaccgtccagaagctggccaacgcgttcgtcaagacgctcaagtggatgtccacccacagcgcgtccgagatcgccgacaagatgcccgccgactactcgcagggcaacaagctcctgtacgcggcggccatcaagagcacgctgccgatgttcaccacggacggtgtcatgccggcgaacggtcccgagaccgtggagaaggtcctcaaggcgttcaacccgaccatcaagaacgccaaggtggacctcagcaagacgttcaccacggagttcgtcaagaaggccaccggctgagccgacatccgtacgccgggggacacggtctcccgcggcgtacaccacgggacgcggtctccctccgctccatgagccgtgtcctgaggcatcagtcgcgggccgcccacacgtaacggtgttccgggcggcccgcgtcgccgtatctgagggtcagccgggcccgcccggaacaccgttacgt

SEQ ID NO: 883 - DNA, 3222 bp, Unknown
  Kingdom: Bacteria, Phylum: Actinobacteria, Class: Actinobacteria, Order: Streptomycetales, Family: Streptomycetaceae, Genus: Streptomyces
caccgtcggccgcgccgccctcttcgccacgctccgccacagcctcgccccggtcctggagcccctcctgcaggccatcgacgcgatcgccaagtcggcgggcgaactgagcgagctgggcggcggcaaggtcaacggctgcgacgtgttcgtcgccttctcggtggccggcggcaccggcgccgggatcttcctggactatctgcacctcatcaaccacgccttccggctgcgcagcttcgacggggtgaagatctacccgctggtcgtcatgccgtcgtcgttctccgccgccaccggtggcggacgcgaggccgaactcaacgcggcccgcgccctcgtcgacctgttccgcctggtggaccagcagaacgcgccggtcgaacgccccgacatcggcgacctcgaccacgaggccaagttcggcatccgctaccccggcatcaccccggtccggctgcgcaccggcatcctgcccacggccttcctgttcagcccgaccgccgggatccgcgccgacgacctgcgccgctccatcgtctccctcgtgatgtcgctggtcggcacagaactgggcgacggccgcccgcagggccggaagatggccaccgacgacgactaccagaccttcgccgccagcttcatcaaccgcggagtggcccgcagttccgtctcgcccaccggcatcggcaggcggggcgtgtccaccagcctggtggcgtccatgaccgccccgatggaccagctggccgacctggtggccggacggatgctgcgcgaggccgtcagggacctggtggaacggccgcgcaccgaactgcgcgagggcgccgtcccgatgatccgccagctgttcgcggactcccacctcgaagagctgtgggaacgacggcagttgacggtgcccgaacccgaaccgctgccgcgcggcggccggaacatagagcaggcgctcggccagcgcgtcgccgacatgcaggcactcctgtccgacctgcgcgccgaggcggggcggcaggccgccgtgatggccgaccggttcgccccgcgccccgccatcgacaaactcctgcagagcaccgaccccttcctcgtcgaacgcgtcgtccggggcgtcccggacagcgaggaacagatcgcccggatcggcttcctcggcatgctggacagccgcgcccgcgccccgcagcgcccgccgggcgtcacggagcagccgccaaagatcccccggatcaagggccagctggccggcctggcaccggcccgctggggggacgacgacgtccaggcggccctccaggagcagaacacctggtaccagtggcgctgccgctccatctggcacgaggcctggcgcgaacagcagcagcactggcagtcccaggccgacatggccggcatcgacctcgaccgcctggtgcgggccttcctgcgccacagcgaccaggaacgcaaggcctccgagcaaaagggccgcgaactctacgaggaccgcaccggcatctcctacctgctgccaccgcagcgcaccctcaaccacttctacgaggacgtggtcgcccggctgctgcgccgggagaacctgcgcgagcaggaccacgtctccgcgctgctgctcaagctcatcgacggcgactcctggcgccaggtccacacgctcagccgccgcgacccggagggcgcggtcgcccgcatcaagagccagctggagggccgtatcacccggctcttcgccgagagcggcacccatctggaggagcgtccgctgctgccggccatgggcaccctgctggccgccgccgcgggcgacgcggacgcccgcgagcaggtcagcaaggacgcgctcgacgtgttcagccgcaagctggccggactgctgccggtgggcttcaccccggagggcaccggcccgctgcgggtcctggtcacccacccccgcgtgcaggccgtggacgaggtgcaggagttcctcggcaagacgctgcgcctgccctcggacgcgaagaactccgtcgagtaccggggcgtggagagcgactccgtcaccgtcgtcctcttccgcagcgagatgagcctcacccaggtgcccgaggcccgcaaggtgctgcgccagtgggcccgggcgaaggagaacgagcaggcccacgacgtgctgcggtggcgtcagcggctgggcttcagggacacctggatggtgagcaccgaggacgaccggcagaccatcctgcaccggctgctgtgctgcctgtggaacggccaggtcgacgtgctcgaaggcgacgacgcctccccgcagcgcgtcaggctgcggctcttccccgaccggagcccggacgtacccggcgtacggctgcggctcggcgacttccccggcggcgtgtcgagctgggcggagctgctgcggtcctacgaacgctggacggtcctcgacgacgaggcgaccgtggaggactactgctacgagctgatggcggcccagccgctcggtctcgcccgcacgggcagcgaaccgcacccgctcttcgtggagctggtcgagaagatcgccccgcgccagctggagctgctggcggaccgccgtgagcggggcggtcaccgcgtcgagggctgggtgcgcccgctgtgggagttctgggcggagacccttccggccgctctggacaaggagttcggcgaccagcgcgccgtccagccgaccctgcgcaccctgctggagcacgcccgcggcggcacgccggcccgcccccgcgaccgcgaggacgcgcccgcgtccaggcgcccggcccccgaggacgacgacttcggcacgacccccatcactccccgcgccccgcgcgatgccggtgacgcgcgcgatgcccgcgacccgcgtgagagcggggaagcctggggcggccgtcacgaggaccggtacgaggaccggtacgaggaccggcatgaggaccggcatgaggaccggtacgacggcgtgcggtacggcggcgagcgcggcgagcggcgaggggaggaccgcgaccgcgaccgtgaccgtgatcgcgaccgcgatcgcgcttacgagggtgatcgtgaccgtgaccgggagtggggccgtgaccgccgctccgagcggcgtgacggtgaccgggggcgctccggcgggggcttctccttcgacaagcccgacgccgaggaccctcacgcggacgcccgccacgccgacgaccgccgtgaggacccgcgccg

SEQ ID NO: 884 - DNA, 8990 bp, Unknown
  Kingdom: Bacteria, Phylum: Actinobacteria, Class: Actinobacteria, Order: Streptomycetales, Family: Streptomycetaceae, Genus: Streptomyces
ggcggcggcctgggccgacagcgtcgtcttcctgagccggggcaggatcgtcgacgagctcgcggctccctccacggcagccgtcctggccgtttgggacacgttgtgaggcgtggcatcgccgccggagtggcggcggcactggtgtgcgcggccatgctgacgggcgcgttcggggtcctgctggagtccgcactgcgggcgcacggatcggccgaccgctatgagcgcgccgtggccgtcgtcgccgcgagccagcgcgtcgagaccgtccgggacgaccagaccgatgtcaggccactggtggaacgggcccgggtactggtatcggtggcggaccggctacgcacggtgccgggagtcaccaaggtggtcgcggacgtttctctgccggtgatcaccgccgacgggaccatgaccaccggccgcggctgggacgcgaccgcgctcaccggtgtcgagttgcgcgccggccgggctccagtggcggaacacgaagtcgcggtggactccggcagcgacaaggccgttggcgacaccgtccgtctgcaggccggtgacggggcgccggagccctaccgggtcaccggtctggtggtcgaccggtccgtcgcgagccacgacgtctggttcggccagcgcacggcacaggccctcagcggccaccccgaacgcgcggacgcgctggttgtgctcggcacgaaggagacatccgcccagtcgttgcgggcagccgcccccggtctcgtcgtcgcgaccggcgcgggccgtggcgacgtcgagaacccggaggtggcggcggcccgactcgacctgatcggcgtgtgcgcgtcgatcggcggtgtcgccctcctggtggtgctgctggtcgtgaccggtctcctggacacgtccgtacgggaccggacccgcgaactcgctgtcctgcgcgccatcggtgccaccccccggcagatccgccgggtgatcgtccgcgagacactcaagttcgcggtaccggcgtcgctcctgggcggtctgctgtcgctcgggctcggcaccctgctgcaccgcttcatggccgagcaggggatcctgccacaggggctcgggctcgctctgggaccctttcccgtcatcggtgccctggcgctcgcggtcctcaccgcagtcggttccgcctggctcgcggcacgacgcgtctccgggatccggccgaccaaagcactgagcgagacctccgccgaaccgacccggctaccgcgctggcgcatggtcaccggcctggtgttcctggccgtcggtctcggctcggccaccaccgcgttcgcgttcggcgggcaggtggcgaccgcggccatgggcggactcgtactctccctcatctgggccgcggctctgctgggcccctggatagcccgagcgggcatcgtcgtcctcggcccgatcatgcgtctgctgtccccggtctcggggcgactcgccaccgacacggccaccgccgcggccgtgcgactcgcatcggtcatcacgccgatcgcgctcgcgctctccttcggcgccagccagctgttcgtgcagaccaccgcggtcaacgccacccggacacaggcggctgcggggctgcacgcggaccacgttctcgtctcggacgggccgggcgtgccccgggccatgtaccaggaaatgaagaagacggccgggccggacaccgtgaccgcggtgaaacgcaccgtcgtggtgatgcagatcgcggaccagctccagtccctgcccacccaaggcgtgcagggtgcactgtccaatctggacccgggcgtgaaggcgggctcgatgaaggacctgcgcggcaagaacacggtcgcgctcagttcaagcgtcgcaagcccgggcgatgtcggttcgaccgtgtctctctggctcggcgacgggacccggatccaccccgaggtggtagccgtgtacgaccggggtcaaggcttcggggacgtcctgctgcctcacgatgtggtcgcaggccacgtcaccgacgcgggccacgacgactacctcctggtgaagggagaagccgacctgcgaccagtgctcgaccgcttccccgggacccgtgccacgtccgccggacagtacagtgcggccctcaccgaaaaggcacgccaggagggcgtacccggactcatcgcggtcgcggcgatcgccctgttcaccctgatcggcgtggtgaccaccctggccgtcgccaccgcgtcccgccgtcgtgaactggcgctgctccggctcatcggcgcaacccgcggccaggttctgaccatgctgcgcctggagacctgcctcgtcctcggtacgggggccgtcgtcggctccctggtcgcggcggtgacgctgctgaccttcggcggcgcggtgaccggtctgtccgcgctgtcggtgtccccctcggtctgcgcggccgtactcggcacggtgttcctctcgggcacggcggccgtcatgctgcccgcccgccggctgctgcgccgccgcaggtcccctcgcatcacgtagcggaaccaggtcccgcctctctcatgcttcccgccctcgggcggggcacgggcggaaagtcgttccttcatgcgccgcgaccaccccagggccaggccgagccaccggcaggcccgtcgcaccacgaccacctctccctgacccactgacgttgttccccaatatcgacaggagttgttccatgcacgcacgcgtatcgccgaggttccgccctactctttcgcgaggtggccggcgtaaggccttgctggccgtgaccgtgctcaccggagccgtcatgaccaccggtgcgctgttcccgtccgcggcctccgccgccaagccggacaccgttcaaagcagcctgaaccgcctggtggccgacgaccagatgcctgccgcgctggcgagcgtcacggaccgcgagggccgtatgcgtaactacaccgcgggtgtcggtgacctcaggaccggggcgaaggtacccaaggacgggcaggtgcgggcggccagcaacaccaaggccttcacggccgtggtcgcgctgcagctggtcgccgagaagaagctcgccctggacgcccccgtcgacacctacctgcccggcctgctgcgcggcgaaggcatcgacggacgccacatcaccatccgccaactcctccagcacaccagcggcctgcccgaatacgtggacaagcccgcgatcctcgaggatccgcagaggtactacgagccgcgcgagctcctcgacagcgcactcgcgcagaaggcccacttctccccgggcgcgaagtgggagtacagcaacaccaactacctggtcgcgggcctgatcatccagaaggtcaccggccgcccgctgggcgaggagatcaaccggcgcatcatcgaccgcatcggactgcgccacacctactttcccacccccggagacatgaccatccacgagccccaccccaagggctaccaccgggacacagccgactcgccctggcgcgatgccaccgaactcgacccgtcctggggctgggctgcgggtgcggtgatctccaccaacagcgacctcaaccgcttctacaccgccctcctcggcggcaagctcctgcccccggcccagctcgcccagatgcgcaccaccgttcccgcagagtccctcggccggggtgtccgttatggactcggcctgagcagcacgccgctgtcatgcggcggcgtctactggggccatggcggcaccattcccggatacttcaccttgggaggcgtcacgaaggacggccgtgcggtcaacatcgcactgaccgccttgccgggcgacagcgccaccggacagcacgcgcagaccgccgtcgacacggcgctgtgccgctgacagcctcactgacccgaccggaaagctgccgctcccgcaccgcggccgcagacgcccgatgagggtgggggcgggcccccggccgccaccggcgcttgacggtatcggtcgccgctccccctcgcgggaacggcgaccgatacccccgcgggcccgtgcccacgagcgtcgccaggccaccgtcaccgagggcgcgcaccggctccctttttgcttgctctccactgtcacgacaggagttgttccatgcacgcacgcgtatcgccgaggttccgccctactctttcgcgaggtggccggcgtaaggccttgctggccgtgaccgtgctcaccggagccgtcatgaccaccggcgcactgttcccgtccgcggcctccgctgccggaccggaccccgttcaaagcagcctgaacagcctggtggccgacgaccagatgcctgccgcgctggcgagcgtcacggaccgcgagggccgggtgcgtcactacaccgcgggtgtcggtgacctcaggaccggggcgaaggtacccaaggacgggcaggtgcgggcgggcagcaacaccaaggccttcacggccgtggtcgcgctgcagctggtcgccgagaagaagctcgccctggacgcccccgtcgacacctacctgcccggcctgctgcgcggcgaaggcatcgacggacgccacatcaccatccgccaactcctccagcacatcagcggtttgcccgaatacctggagtctcccgtcttcgcggacttcccggccgtccggtaccggtacttcgaaccacgcgacctgattgacggcgccctcgcgcagaaggcccacttctccccgggcgcgaagtgggagtacagcaacaccaactacctggtcgcgggcctgatcatccagaaggtcaccggccgtcccgtaggcgaggagatcaagcggcgcatcatcgaccgcatcggactgcgccacacctactttcccacccccggagagacgaccatccgtgagccccaccccaagggctacgaacgggaaacggacgacggacccctgatcgactacaccaccatggacatgtccatggcctggtctgcgggtgctctggtttccaccaacagcgacctcaaccgcttctacaccgccctcctcggcggcagactccttcccccggcccagctcgcccagatgcgtaccaccgtccccgcagaggcacgcggccccggcgtccgctacggactgggcctgaccagcacgccgctgtcatgcggcggcgtctactggggtcacggcggaaccgccctggggtaccggacacgaggaggcgtcacagaggacggccgtgccgccgacgtcgcggtgaccaccaccccgacgggtgcggcctcccagcgggtggaggccgccgtcgacacggcgctgtgccgctgatccaggcagagacaggcgggaagacggcccgcggggtcgccgacgcgttccggcggccccgaccccggccccgttccgtggaaattttcaggtgctgaccagtacgccgggcggacgccggcacgccagatgtacgccccccggacctggcggggagccctgggggattgagccgcgccgctctgtccgcgcccggatcccaggccccggcagcagcgaccggaccacggcccactccgcgcccgtcatgtccgagggctaccgccggacacgctccgggcgatcggccgcatccccgaaccggtgagtgacacaatcacacgccggagcagctgagttgaattccaccggcacgagcacacaactgcggcaacagggtcttctggatcacggtcggcttcgccccctcgaagccaccaaaagcccctaatccgttgctgaggacgctcccaagggacagtcgttcttgggatgttcgagtgccgggccgtgacatctagtggctgccgggcgagcaacaacgcctcgcttcagaccgcgtacacggtcccggtactcacccgtggtggcggtcgcacagcgcttgagctcccgcgcagaccggagcccgtggggtgcgctggtgccacgaatggctaggacccatcgtcagagtcgacgacgagcagctgaacgcgcgagctgtctggctcctcgcaggacactccgagcgctggtctggtccagtctcgtgctccaagcggcggccatcttcggtcgatcgcactactaccgcactgctttttcgtccgtcacgacgacggcggcccgcttgcccgctgcctacggttcacccactcgtaggcgtggcggcggaaggggcggagctgatgagcagcagagcggacttcggggcccgaagggtggcgcacattcgccggttgctgggggcggtggttgccgcgtcggtgggggtgtcgctggcggcgtgcggtggggcgtccgccggggccggtggtgatggcaaggccgacggtagcgcgacggtcactatcggcatcgcctccaaccccgggacgctgagcccgacggcggcgctggccgggactgcggtcctgatgatcgggtacgcgtacgaccggctgatccacatcgccgacgacggcaagctcatctcgggggtggccgagaagtggaccgcgaactcgacctccgcgacgttcaccatccgggccggcgtcacctgccaggacggcacgccgctcaccgccgccgatgtcgcggccgagtacaactacatcgccgacccgaagaacgcctcgccgctgctcggtgtcgtggtcccggcgaccgcgaaggccacggccgacaccgccgcgcgtaccgtgtccgtcaccacgcaggttccggcgccgttcatcgtcgagatgacccagctgctgccgttggtgtgccagaagaacctggccgatccggcggcgctggccaaggccaccaatgccagcggcccctaccagctgacccaggccgtccccggcgaccactacacgtacaccaagcgtgctggttacaactggggcccaggcggcgccactgacgccgatatgccggccaccgtgatcttcaaggtggtggcgaatccgtcgacggcggcgaacatgctgctgtccggccagttgaacatcgcggcgatcaacggccccgacactcagcgcctggacagcgcccgcgtcggcaagaagagcgccctgacgccgttcggcttcatgaccttcaacgagaccgccgggcacgacaccgccgaccccgcggtccgcagggcgctggtcgaggtgctggaccggaagcagatcggctcggtggccaccggtggcaccgggcagccggccacgtcgatcggcgaagtggccccgaccccgtgcaccggcgacagcgtcaccggcaaccttccggcgcacgacccggttcaggccgccgccgacttgaccgcggccggctggacgaagggaggcgggggctggaccaaggacggcaagcggctgaccgtcacccagcttcactcttcgcagcttggcccggacgcggccgcctcctatgagctggccgccaagcagtggaccgacttcggggtgaaggtccaggacaaggccgtggactcgaccacgacggtgaccaccctggcttccggcggctatgacgtgtcctggatcccggtcagcgttccgctgccggaccagctcgctcggttctacgacggcccgaccccgccgaacggcaccaacttcggcgcgatcgcgaaccccgactacaccagggtgagcaagcaggctatggcggtggccggcaagaaaggctgcccgctgtggcaacaggctgacgcctcgctggtcaagcgggttgatgtggtgccgatcgtcgacagcttggtcggctggtacggcaagggcgtcagctacgacgtcgacggctccggtcccatcccgagcagcctgcgagcgggcagctgatggcccgggtccagatcgcgaacgccggggcggacaccggcgagcccgccgctccgggtggcggcgccgaccgaacggccccgggcggcgcggtcccggcactccgccgcgccgtcgccgtgctgaccggcgatacctggcccggcttcctggtccggcgcaccggccggctgctggtctcgctggccgtggtggtgaccgcgtccttcgcgatgatccacctgatccccggcgacccggtccgcaccgccctcgggctctccgccgacccggctcaggtcgcggcccgccgccacgacctggggctggaccggccgctgcccgagcagtacggcgacttcctgacgaacctgttccacggtcggctcggcgactcgatcatctcccagatgccggtctcgcaggtcatctccgaccggctcccctcgacgctgcagctggtgatccccgctgtggtgctcatcctgctggtcggcatcccgatcggcatgctggcggccgtcctcaccagggacggccgccgccggcggggcgagctggccttcgccgcgaccaccggggtcctggccgcgctaccggagttcctgctggcggtcgggctggtcgcggtgttcgcggtgtggtggcaggtgttcccggtggccgggcagtcagatctgtcctcgtacgtgctgcccgtcctgtccctgaccgtggtgccgacggcatcgctgtcccgggtggtccgggtcgaggctctccgcgtcctgacggaggactacatgcgcacggcgcgagccaagcgtctcccggcccggctcgtctacctgcggcacgcgctgccgaacctgctgacctcgtcgctgaccatcggcggcctgctgttcacctcactgctggccggcacggtgctggtggagaacgtgttcgcctggccgggtctgggctcgacgatcgtgcaggccatcacgaccagggactatccgctggtgcagggcgtggtgttggtctatggagccgccgcgctgctgatcacgttcgcggtggacatgacggtcgccgcgatcgacccgcgctcgacggtacgggggacctgatggccgcgaccacagtggctgcgaccacggcgcgggacgacgtccgagccgacccgccggcgtccttcgcccgccggctgcgccagagcctgcgcaccccgctcggcgccgcggcgctggccgccgcgctgg

SEQ ID NO: 885 - DNA, 2229 bp, Unknown
  Kingdom: Bacteria, Phylum: Actinobacteria, Class: Actinobacteria, Order: Streptomycetales, Family: Streptomycetaceae, Genus: Streptomyces
cttcgctccgccccgcggacgttccgcggcacgcgggcggccgggccggacggtgctgcccgcagaagaagtccgacgaccccgccgaaccggggtcctccttcccgaacttctgcactctgcggagagaactcgtgtcgcatgcttctgcaggcctgcccgtcgggcgtggcctcctctacctgatcgtcgccggtgtcgcctggggcaccgccggtgccgccgcctccctggtctaccgcgccagtgacatggggccggtcgcggacacggcggcgaagtaggcggtctggaacacggcgagcccgagcccggtggcaccggcccgcagcagtgcggcgccgcgtggcaccggcgctctggcgctgcctcgcgggcgcagcaggcggacggcgagcagcagcacgacgcccgcgaggcagcgccagaaggacagcgcggccggccccatgtcactggcgcggtagaccagggaggcggcggcaccggcggtgccccaggcgacaccggcgacgatcaggtagaggaggccacgcccgacgggcaggcctgcagaagcatgcgacacgagttctctccgcagagtgcagaagttcgggaaggaggaccccggttcggcggggtcgtcggacttcttctgcgggcagcaccgtccggcccggccgcccgcgtgccgcggaacgtccgcggggcggagcgaagcaccgggctcgccgaaggaggcccgcctcaggcggccggcggcgagatgacgagtgcgcgcgtgtgcatgatcggcagcctagacggtggttccgcgcgccgacaactcccggtcggccccgccgcccgcgaccggatccgccgccgctttggcgggcgccgaggactgcgcgatgaaggcacccaggaggacgacggcgccgccggcgacctgcggcgcggagaggtgctcgccgagcagcacccaggccagcacggtcgcgatgaccgcctccaggcaggccaccacgcccgccacctgcggcgagagccggcgcaccgagagcaccccggtgacgtacgccaggacggtggcgaccagcacgatccagaccagcaggacggcggccgggacggcggtgccgttcatgtccgcgctgtgcgcgagcaccgtccagtccatgccccagggccgggccacggcggtgagtacgacggccccgatgagaagcccgtacgcgatgacgccgagcgggtccggtgcctcctcgccggcgtcgccgccctggtcggacaggacgaagtagccgacctgacagcaggcggcccccagggcgagcagcagcccgagggcgtcgaagccgagtccggaccagacctcgacgacgcaggcgaggccgccggcggcgaggaccacgccgagcgcggcggcccgggtgaccgggcgccgctgtacgaagcggacccagccgagcaccagggccggggccaggtactcgatgagcagggcgaccccgaccggtattcgggagagcgcggcgaagtagcacgcctggacgcccgccacggcgagcaggccgaacccggcgagcagcagggggcggcggcgcagcagcgcgcggtggcgtacggcgagcggcagcatgaccagcgccgcgccggtgacgcgcagccagacgacgtgcagcgggtccaggcccgcctcgatcagcggcttggccgcgacaccggagccgccgaaggcgaccgcggagacgagtgcgagcccgagcgcggcgcctttgccggactgcccctgactgatcccagacgtaaccaccggcacatgatgacaggcggcgacatgagcgtcaccctcgttggcacctgtctcaccggctggacggcgaggcgggcggacgccgcgcacggagagctccgcaccaggaaggccgtgccggacaccagggtcggcgggcggtgccggacggcagcttcagtgagcggtgccggacgggcaggaggtcagcgtgcggtgccgccgcgccctgcccacgcctccctgcccacgcctccctgcgtacacccccctgcgtacgcctccctgcgcactcctcgcctgctactccttcgccgcgtactcctccgcccgttcccggcgctcgccgcccgcttgactcccgtccccgatccgggcggccagctcccgtgcgtcgatccccgcccggccgagcacctcgaccgcccgcgccccggggtcggcgatgaccgccgcgaggaggtcgacac

SEQ ID NO: 886 - DNA, 6175 bp, Unknown
  Kingdom: Bacteria, Phylum: Actinobacteria, Class: Actinobacteria, Order: Streptomycetales, Family: Streptomycetaceae, Genus: Streptomyces
cccgcgaccgccgtcgcggggggcgccgcttcgggtgccgacggcaccacggcggccggtgcggccgcgtggtccaacgtggctttcccgtccctcgtggacatcgccggtgccaccgcgacaggccttctgacctgggacaagatgtcccgcacctactcctggacgcgaacctcggacggctcctccaccaagctgtccggtatcgggaacatgctcgccaccggatcgggtgacctcgtggccctccagcagcccggcaaggcccagctcagggacatgtccaccggacagaacgtgctggaggccgacctcgcgtcgctccccggccaccagtacgcgggagccgcgggcaacgcactcttcctcgtcctgggcaacgcggccagaggcaactccctcgagatgcgtaccggggcgggcggcacgaccgcggtgaccgggctcccgcccgacgcccgggacatcaccgtcaaggcgggcacccccgcccaggccctggtcaccttcagcaccggtacttcggccaagcactggggcttcctcgacctcgccaccggcacggtgaccgaaacctacgacgtccccacggccgccgtgcacggggacgtcgcggtgtccgggacacacctcgcctgggtcgagtacgacgatccgcaccgtccggcgatcgccgtccgcacccgcggtaccgacacgatccggaggttctccgtgggcgcgccgtacacgcgcggcatcaaggtcggtctggtgggagactggctgacgtacggcgaaggccaggacatcggaaccggctcccctgacccgctgaacgcgtggaccgcgtacaacctggcggacgggagcacgcgcaagctgctcgaccacgtggtctcggccgccaccgcgcccgacggcacacagtacgtccgcggcggcaccgtcgcccagggcgagggtgtctaccgcgtcgccccgggtacgaacggagtcccggccgcgcgcatggtggcgagcaccggcgagccgaccagactcactctggtcggccacaacatccccgccgtgatcgatctggaccgcaaccgcggcagggtgaagatgagttggcggttgtcccgcaagaacgcggaggtgacggtcacccttcgacacgtccggacagggaagaccgatcgcacctacctctactacccggatacgccgggcttcgagttccagtgggtgggcgacctcgacagccctcatgccagcgggggcaacggtgactacacgtgggagctcagcgcgcggccgaccaacggcatcggcccgaccctgaccgcctccggcaagttcaaggtcgtccgcaagcccgctccgcacgactacaacgacaacggctccccggacgtcctcgcgcgggactcctccggccggctgtggcgctccgactcctactgcgatccgaatgattacgtcggcgaccagttgagggagcctgagcacaagctggtcggcggcggctggaacacctacaaccagatcgaggccgccgggaacatcggcggctcgacggccggggacctcgtcgcccgcgatgccggcggcgtcctctgggagtacctcggcaagggcgacgggagcttcgccgcccgcacccggatcggcgccggctggggcgtctacaacaagatcaccggcggtggagacctcgacaacgacggcaaggccgacctcctcgccaccgacaccagcggtgccctgtggtggtacaagggcaccggcaaggcggccgcgccctacgcgtcacgcgtcaaggtcggttccgccggctggaacacctacaaccagatcaccgccgtgggcaacatcgccggaggcaccgcaggagacctcgtcgcccgcgacacccacggtgtcctgtggctctacctcggcaggggcgacggcactttcgccgcccgcaccaggatcggcggcggctggggagcctacggtcagatcgtcggcatcggcgacggtgaccgggacggacgccccgacctgttcacgtacggtcccggaagcgagacctacttctacccgggcaccggcgactcgcacgctcccttccgggcgcgccggctcaccggcctgttcttcgcggaaccgggttacaactccgtcgtgtgatcgcgagggtggccgggcgtggagtggcaccccgcccggccgcgcccggggactgtcagtgggggcgcttagtctttcgtcgtggtcgcggtgcagcgggccggtccgaactgccggggttccgcggtgccttgcggccatcagggcgagcacgacgggcgagacgagcgaggggcgggacaccatggggtgggtggcggcgggcgacgactacgaaatcgccctcgaccaagggcgggtggtggcgcgggccctgtccgatccgccctcggcagcgcggtcgcagaccctgccggcggagctacgggaccgtcccgaggtgatcgagctggagcggctcgcccagtggctggaccggcacgcggcggactgcgtggcgcaggtcgacacctgggtggtgtcgtccttgccggtgccgaccgttctgctggcccgggtgtggcccgacgaggcatggcggtcggcgctgcgtgacctcgtcgtggtcggcggagaacccgaccaggtcggcttcctgcgggacgccgacgcctccggccacctgcggctggtggccccggacggcgggaccgtcgtcgtccgcgcccccaccgtgaccatgccgcaccccgtcctcctccccggcctggagaccctgcgcgcacgcgccggcgaactgggcgtcgtccagggcgtcgagcagctccaccgtgccgtgtggcacaagcctgacgggctcgaccccgatgcccgtacggtcaccgagttcgcgggcgcagagtacagctcctggttccgcctctccgcccgtgccaccgccctcggttacaaggtcgccgggcagtacgccaccgaccggatacgggaggcgggccgggtcgtcaccgcgtcggtcgcgatcggcgacccctacaccgaggagcgggcctggaccggcggcctggcctgggccactcctcacgacgaccggatgccgctggccgatgtcggcccggtggcctggtccgagggcatgcgcatggccgccgccctgcacgccgggggccgtagcgcgcccgtggacgacgacgcggcgtgaacggcgcggcgccacggcggcgccacgcacgtagcccaccgcacgcacggcacgtacagcacgcacggcacgtacagcacgctcggcacacacagcaacgtacagcacgcacggaaggcgcgtacccatgaacggctcagtcaccgaggacggagcgacggcgcaggcggcagcggaggcgcaggtggaggagctgctgcgggccggtgccgtactgccacccggggccaccaccgcgggcgcccgcgccgtaccgatgctcacccaggcctaccgtcatcccgccctggacgaccggatcgtcgtacgcctggtcgccgcggagcccgccgaggaccccggcagcggcttcctcggcctggaacccgaaggcgaggcggtcgaggtcggtctcgggcggccccgtgccctcggctttccggaatgggtgctggtgcaccaccccgcggacgggcacctggcgatgtccgtgaccgaggagatggaccggatcgcgcggaccgcgcggtccaggccgaagaaggcgcgcgccgcctacgaggccatcggcgaacgcctcgccggagcggtaccgcacttcctgccgaccttctacgagcaggcgggccgggtgttcctcgccgccgacgagacgacgtacgcgtccctgatgttcgtcaacgcccgcaaggccgagacggcgtacgcgctgccgttcgacgaggagcgcatggacgcggtcttcctggagttctccctggccgaggccgtgccgacgaagatgctctccagctacgccaagggcctgtcgtcccgggtcccgccacagacggcgttccggcacctgcgccggctcttcgtccggctcgcggaacacgggctggctccgtcgagtccgggcgcgggcgacctgcgtcggctggcgaaggagacggcgggcaaggacgccctcgccgaggagatcgcccatctgcgcgagatgctcgtgcagcccggcacgcagaaggcgccgcccggctggtggaaggcacaccggcgggcgttgctggagctgacccgcaaggagcccgcattccgcggggtcctgctggggctgatgccctcggggtgggagagggaggaactgccccagtggctggacttgctggaaacgtccggtgccaccgccggcctgtgcgacaccgcgctgcccgccgacgtgcgcccgcccgacggcacctccgggtgggtccgcagactgctgccgctggtggggtcgcacccaccggcggaggtgcatcccctcatcgagcgcatggccggcgcactgcgcaccgaactccgccccggaccgggcggcgatccgagcccccagccgggcgtagagcagcgccccgagccgggcgtagagcagcgccccgagccgggcgtagagcagcgccctgagccgggcgtagagcagcgccctgagccgggcgtagagcagcgccccgagccgggcgtagagccgagcggcgatccgggccccgcacccgacgtccgcgcggaccctttgccggctgtccatgacgtgaatcttctcgaccagttgctggccctcggcataccggtggcggaccccccgccccggcactccctctccctggaccggtgggccgtcgacgagaaccggcgcgatctccgcgcgctggaggccgacccccgcttccgggaggcgttccggcgcagttgccccggccaccgagggaagcacgacgtacggaccctcacggcgttggcccaatcccccggcggacgcccgatgctcgccgaatggacgggcgaggtcgcccgcaagtatctgcccgtggaactcgccgggttcgccgccccgtacgaccggccgctcgacccgctcgactggctgccgggcgaaattctggcgctcgccgagggggcggtgcgggaggcactgagcaccggtctcgcccccgcgctcacccgcgccctgcggtcgggcatcatcgacgaactgggctggcccgcctgggaggaagccgtcgcggcagccggtgcgccgtacccggccggccacatccacgtcagcgacgcctggccccacctcgtcgtcctggccggcacacaggcccgcgtgatcgacgcgcagggcaccgtgcacacgcacgaactgcgcctgccgcccgaggtgacggacgagcgctcggtctggggcctgcgagccgtcggctgccgctacgtcgacggggagctgttcgtctggtggagcccgccctggccggccgacaagcagggctactgggagcgcagcgccccggcgccgttcccggccgaccccgaagccgtccgctgcgactcgatgcgggagtacggccggcacatggcctccgtcgcccttccgcttcccgggggcggcgtcaccaccggggcgggggtgctgcgcccgggggacacggccgtccccgagcaacggcacgtgatcagcgacgggacgtcctactgggtgcgggcgggcgagtggcacgcgtacgacccgttcacgggcacgcgcggtgaaccgggcatgccggactggttcgccgagggcctgcgcgacgcaccgccgcacagcaccctcgcgaggaacagccggctgctgcccgccccgtacgccgagcccggcccgctgtgcgcgccggtcggcggattgatcggctggcgggtggtggaactgcctgacggctccctgcgcggcgaggacctggccggacgctcggtcgtcgtgcggcagacgggatcccaccggatgacccgggaactgtggcacgcgctggagttccccggctccgaccggccgctggcggtggtccaggacggcgcccccatcagcctgttcgacgccgacggcacgctgatggcccagttcccggagggcacccccgcctcggcggagcagaaccgcagggcaggcttttccgcgggcaccgcgctgctgccgcccctgcgctactggcaccagctgcagccgcgcgatccgcagggctc

SEQ ID NO: 887 - DNA, 3184 bp, Unknown
  Kingdom: Bacteria, Phylum: Actinobacteria, Class: Actinobacteria, Order: Streptomycetales, Family: Streptomycetaceae, Genus: Streptomyces
tcgggcgcggggcgtgacctggccgttccggcatctcgggcgcccaccggcccggggcgcggcccggccggcgggctcgcccagcggagtgtgaatcacgatcggctccgccgggttcacgacgatggtcttggcaaggcggccggggaggcttacgttcgtgcctctaggtctgttctacgggcgtagaggctctgacgtacgtcgaaggagcagctcatggccaacgtcgtccgtgccgccctggtccaggccacctggaccggcgacaccgagtccatggtcgccaagcacgaggagcacgcccgcgaggcggcccggcgcggcgcccggatcatcgggttccaggaagtcttcaacgcgccgtacttctgccaggtgcaggaggcggagcactaccgctgggccgagccggtcccggacggcccgaccgtgcgccggatgcgggagctggcccgcgagaccggcatggtcgtcatcgccccggtcttcgagatcgagcagtccggcttctattacaacaccgccgccgtgatcgacgccgacggcagctacctcggcaagtaccgcaagcaccacatcccgcaggtcaagggcttctgggagaagtactacttcaagcccggcaacctcggctggccggtcttcgacaccgccgtgggccgggtcggcgtctacatctgctacgaccgccacttcccggagggctggcgccagctcggcctgggcggcgcccagctcgtctacaacccctccgccacccaccggggcctgtcctcccacctctggcagctggaacagccggccgcggccgtcgccaacgagtacttcgtcgccgcgatcaaccgcgtgggccgcgaggagtacggcgacaacgacttctacgggacgtcgtacttcgtcgacccgcgcgggcagttcgtcggcgatgtcgccggtgacgccgaagaggaactggtcgtccgcgatctcgacctcgacctcatcgaagaggtgcggcagcagtgggccttctaccgcgaccgccgccccgacgcctacgaagggctggtgcagccgtgaacgacctgtacgaccgccaccgtgccgtcctgcccgactggctcgccctctactacgaggacccgctggagatcacccacggcgagggccgccacgtctgggacgccgagggccgccgctacctggacttcttcggcggcatcctcaccaccatgaccgcgcacgcgctgcccgaggtcaccaaggcggtgagcgagcaggccgcccggatcctccactcctccaccctctacctcaaccggccgatggtcgaactggccgagcgcatcgcccagttgagcggcatcccggacgcccgtgtcttcttcaccacctccggcaccgaggccaacgacaccgcgctgctgctggcgacgacgtaccggcgcagcaacacggtcctggccatgcgcaacagctaccacggccgctccttcagcgcgatcggcatcaccggcaaccgttcctggtcgcccagctccctctccccgctgcagacgctgtacgtccacggcggcgtccgcacccgcgggcccttcgcgcacctgagcgacgccgagttcatcgcggcctgcgtcgacgacctcaaggacctcctcggccacacccgtccgcccgccgcgctcatcgccgaacccatccagggcgtcggcggcttcacctccccgcccgacggcctctacgccgccttccgggacgtcctgaaggaacacggcatcctgtggatcgccgacgaggtgcagaccggctggggccgcaccggcgaccacttctggggctggcaggcgcacgggcgcagcgggccgccggacatcgtcaccttcgccaagggcatcggcaacggcatgtccatcggcggggtcgtcgcccgcgccgagatcatgaactgcctggacgccaacagcatctccacgttcggcggcacccagatcaccatggccgcgggcctcgccaacctcaaccatctcgtcgaacacgacctccagggcaacgcacggcgggtcggcggactgctcatcgagcggctgcgggccgtcgccgcggggctgcccggcgtacgggaagtacgcggccgcgggctcatgatcggtgtcgaactggcccggcccggcaccgacgaggccgacccgcgggccgccgccgccgtgctggaggcggcccgggaaggcggcctcctcatcggcaagggcggcggccacgacaccagcgccctgcgcatcgccccaccgctgtccctgaccgtggcggaggccgaggagggcgccgcgatcctggcggacgcgctgcgcgcggcgtactgacgcggcgtaccgaggagcaccgacaccaagaaccggtcgagcaagggggcgcagcccatgaccaccacctcggacggacccccgaccgcccgcagccgtccggaaccggccgcgtggaaggcgccggactccgtcctgtccgtccgccaggtactcaccctggagcgcgtgctcgccggggagcccgaggtggtggccggtgcgggccagctcgaccggcccgtgcgctgggtgcacgtcgccgaggcggcggacgtcggcgtgatgctcagcggcggcgagatggtgctcaccaccggggtgctcctcgccggggacgaaaacaagcaggccgaatacatccgctccctgtaccgcgcggaggccgcggccgtggtcctgggcctggggcgggcgttccccgcgccgcccgaggtgatgcgccgcgccgccgaacggtgcgggctgccgctggtcgtcctgcaccggcccttcccgttcgccgaactgaccgaggaggtccagtcccgcctggtgcgccagaagttcgcctcggtcagcctctcggagaccgtacgcaccgcgctgaccgccctcatcaccgcgggcgccccgctgcaggccctgctcgacgagatcgcccggcacagcgcctgccccgtcgtcgtcaccaacctcgcccaccgcgtcctcgccaccgcgggggagcgctccgccgtggacgacgtgctgcgcgactgggaacgcatcgcccggcaggcaggggggcaccgcccaggccgttcaggcacggggggaggcagcgacggcgacggctggatccgcgccgaactcggcggacgcggcgagcagtggggccggat

SEQ ID NO: 888 - DNA, 5371 bp, Unknown
  Kingdom: Bacteria, Phylum: Actinobacteria, Class: Actinobacteria, Order: Streptomycetales, Family: Streptomycetaceae, Genus: Streptomyces
cggtcgggtggaactgcacgaactccaggtcggagacctccgcgcccgcgcgcagggcgagcgccacgccgtcgccggtggacaccgacgggttggtcgtggcggagaagacctggcccatgccgccggtcgcgaggaccacggcgggcgcgtgcacggcgcccacgccgtcgtgctggccctcgcccatgacgtgcagggtcaccccggcggtgcggccctccgagtcggtgagcaggtccaggacgagcgcgttctcgacggtgcgcaccccgcgcgcgcggaccgcctcgacgagcgcccgggagacctcggcaccggtcgcgtcaccgcccgcgtgcgcgatgcggcggcggtggtgcccgccctcgcgggtgagctggatgccgccctcggcgtcggtgtcgaaccgcgcaccggtggagatcagccgccgtacggcgccgggaccgtcggtgacgaggatccgtacggcctcctcgtcgcacaggccgaccccggccaccagcgtgtcgtccaggtgctgctccggtgtgtcgccctcgccgagggccgcggcgatgccgccctgggcccagcgggtggagccgtcgtcgaggcgggccttggtgacgacgacggtggtcagacccgcggcctcgcagcgcagggcggcggtcaggccggcgatgccggagccgacgaccacgacgtccgcggcgatggaccacccgggcgcgggcgcgtgcagtcgtatgcctgtgctggtcacgatgcggctccaagggggtccggggccccggggttcccggggtcaccgaaggtgaggggcaggttgtcgatcagccgggtcgccccgacccgggcggcgacggcgagcacggcctcgccggtgaagtcgtccccgatctcggtgaagtcggacgggtcgacgagggccaggtagtccagttcgagcggcgggtccaggcgggcggcctcgtcgaggaccagccgggccgccgcgacctcgcccagcgccgccgggtccagctcgcggaactcctgccactcggtcaggtgcaggaccgcgtcggcgccccggaccgcctccagcgccgagccggcgtacccgagtgtcgggaagaggcggcgcgcgttgtccatgcccttggggtcgtagacggtcacctggccgccctggaggtggatctgaccggccacgttgagcgcgggcgagtcgcgcacgtcgtccgagtcgggcttgaacgtggcgcccagcaccgcgatccgcctgccgaggaacggcccgccgcccagcgcctgccgggtcagctcgaccatccggccgcgctggcgcatgttgatcgagtcgatctcgcgcaggaacgtcagcgcctggtcggcgcccagctcaccggcgcgcgccatgaaggcgcggatgtccttgggcaggcagccgccgccgaagccgatcccggcgcgcaggaacttccggccgatccggtcgtcgtacccgatggcctccgccagcttggcgacatcgccgtccgcggcctcgcacacctccgccatggcgttgatgaaggagatcttggtggccaggaaggagttcgcggaggtcttcaccagctcggcggtggggaagtcggtgaccacgaagggggagccctcggcgaccggcgtggcgtacacctcgcgcagcagcttctcggcccgctcgccgcgcacgccgaccacgatccggtccgggtgcagcgtgtcccggacggcgaagccctcgcgcaggaactcggggttccaggccagctcggcgtcctcgcccgcgggcgcgagctgggcgagcgtccgggccagccggtccgcggagcccacgggcaccgtggacttgccgacgacgagggcgggcccggtcaggtggggcgcgagcgaggtgatcgcggagtcgacgtaggacatgtcgcaggcgtactcgccgtgcttctgcggggtgttcacgcagaggaagtggacatcgccgaaggcgcccacctcggcccagtcctgggtgaagcgcagccgcccggtggaaccctccagaccggccacgtgccggcgcagcaggtcctccaggccgggctcgtacatggggacctcgccccgccgcagcatctcgatcttctcggggacgacatccaggccgagcacctcgaagcccatctcggccatggccgcggcgtgggtcgcgccgagatagccggtgccgatcacggtgatcttcaggctcatggatgctccaggagggatgatggcaatgcgctgcccgagcatatcgggggcatgcgcgaagccctcgccgggcaatgtcccactcgtcacgtcccacccgtcacccgttgtcgccaagctcacgtaccgctcacgtgagcaggcccctaaaattcgagttacttaacggtaattagcatcaccgctcgtctgcacccgtcatcaccacacccgtcatcacctgtatcagtggtcgtctttggagcgtgagagaccttggccggatcggctgacttcgacctgtaccgcccgtccgaggagcacgacatgctccgcgacgccgtccgctcgctggccgaggcgaagatcgcgccgtacgccgcccaggtggacgaggaggcccgcttcccgcaggaggccctcgacgccctggtcgcgaacgacctgcacgccgtgcacgtccccgagagctacggcggcgcgggcgcggacgccctcgcgaccgtcatcgtgatcgaggaggtggcccgcgtctgcgcgtcctcctccctgatccccgcggtgaacaagctgggctcgctcccggtgatcctctccggctccgaggagctgaagaagaagtacctgggcccgctcgccaagggccgggggatgttctcgtactgcctctcggagccggacgccggctcggacgcggccggcatgaagaccaaggccgtccgtgacggggacacttacgtcctcaacggcgtcaagcgctggatcaccaacgcgggcgtctccgagttctacacggtgatggccgtcaccgacccggagaagcgctccaagggcatctccgccttcgtcgtcgagaagtccgacccgggcgtctccttcggcgctccggagaagaagctcggcatcaagggctcgccgacccgcgaggtctacctcgacaacgtgcgcatccccgccgaccgcatgatcggcgccgagggaaccggcttcgccaccgcgatgaagacgctcgaccacacccgcatcaccatcgccgcccaggccctcggcatcgcccagggcgccctcgactacgccaagggctacgtcaaggagcgcaagcagttcggcaagccgatcgccgacttccagggcatccagttcatgctcgccgacatggccatgaaggtctccgccgcccgcgccctgacctaccaggccgccgccgcctccgagcgcgtcgacgccgacctcacctaccagggcgccgccgccaagtgcttcgcctcggacatcgcgatggaggtcaccacggacgccgtccagctcctcggcggctacggctacacccgcgactacccggtggagcgcatgatgcgcgacgcgaagatcacccagatctacgagggtacgaaccaggtccagcggatcgtgatggcccgcaacctgccgtaaaccaaggggagttgccgtatccgtacggctgctcggccttctggctcccgacgccttccggcgtcctccgtcgccctccgtccgcccgggacggagggcgacggctttgtcaccgcggctgtctccgtggcggcgccggtcccgccgtcacccggacgggcgtagcggagtcagtgcctgcgccggatggcggaccgcggtggctgggcgtacgacggaagggcacggggcccgccccgcggcccctgaggcctccaggagaagccatgacccacacccagcccggagccatgaccgccatgagcaaggagatgcaggactgcgtcgacgcctgcatgacctgccacaacatctgcgaggaggccatgagctcctgcatgcagatgggcggccaggcgcagatgcagatcatgcgcgcgctcatggactgctccgagacgacccgtatgtgcgcggacatgatgatgcgccgctcgcccatgtcgtccgagatgtgcgcgatgtgcgccaaggcctgtgacatgtgcgccgaggcgtgcatgtccatgcccgacgaccagatgatgatgcgctgtgccgaggcgtgtcgccgctgcgcggagatgtgccggtcgatggcgggcgcccggatgtgatccgccccccgctgccggcgccgtccagctgccccaggacagccggttgccccagccggtcgggtcagtcgctggagacggtcaccttctcgtcgttcttcagctcgtccaccagggtcttgaccttcgacttgtcccagaccaggttgccgccgaccgagccggagacgggcatgttcatggaggtgccctcgccgccgctgacgcccttcatggcccagaacatggaggccaggtcccacaggctcatgtccttgtcgacgatgagggagtccaggcccgcgcccatggtcgggtagaacttgaacgggttgaggaccgtcgtcggggtggcgacctcgtgcgcgagcgcggagaggaacttctgctggttcttcgtgcgctggaggtcggaggcggcgaaggcgtgccgggtgcggacgaaggccagcgcctgctcgccgttcagcttctgcttgccggccttgaagtccgcgccggaccacttgtccttgaagggcttgtcgatggtcatctcgacgccgccgaccgagtccacgatgttggcgaagccggcgaagcctatctccacgtagtggtcgatgtgcagaccggtgttgtactcgatggtgcgcaccagcagggtcgggccgtcgtaggcgtaggccgcgttgagcttgttctgcccgagggggcccttgatcttgccggactccgagccgcggaactgcgggatcgtgacgttggagtcgcgcggcagggagatcagcgtgtccccgttgtccccgacgtgcaggatcatcatggagtcggtgcgcttgccctcggcggagccggtgtgcagcttcttcttgtccgccgccgagagcccgtcgcggctgtcggagccgacgatcaggtagttcgtgcccttgccggactccggccggtcgatgaccttggacaggtccacctcgcggttgagcttggagtcggcccagaagtaggtgcccaccgacgtgaccaccagcagcgtgaccagggtgatcgcggtccacttgatgcgccggcgccagttcggcgccggccgcggcccgcgggtgccgcccgcccccggaccggccggcgccgaactggcg

SEQ ID NO: 889 - DNA, 1636 bp, Unknown
  Kingdom: Bacteria, Phylum: Actinobacteria, Class: Actinobacteria, Order: Streptomycetales, Family: Streptomycetaceae, Genus: Streptomyces
gctcagcgaccgctacgcccgcgtcgtcggcgccgccgcggtcctcggcctctgggaggcccaggacggcagcgaccccttcctcgccgcccccgcctgggccgtcctcgccctcacccggaccggcgaacgcctgaacatcccggtgcccccgctgcccgacggcgtccaggaccaggtgctcgaagaactcctgcgccgccaccgggacaaccgcagcctcgacctcgacgccctcgcgtacggcggcggcgacgggcagaagggcacgccatgacatccgcgaccgcggcgccgtccggatccgagcggatcagcacgcccgtccacgtcgccggcccggacgcgccctggcatccggtgcgcgaagccatggaccgcttcggcaacgccgtcgtccacaccacctggggcgaatggctcggggcagccgtgaccgccccggcgctgcgcacgctcctcggccgcgactggcagcgctacaagcgcaccaaggaccccacgatccgctaccggttcgtcgcctcccggctcgccaccaagtacacggccgccgccgccctgcacaccgaaccggccgaactcgacctcgcctaccggatcggcggacggccctacctgcgcggcctcgaccagatcgacgtgagcctcacccacaccgacgacgtgatcgccgtcggcatcagccgcaacgggcgcatcggcgtcgacgtcgagcccgccggccggcacatgtcgtacgagctgctgcagggccatgtcctgacacccgccgaacgcaccgagctggaacacgtgcccgagggcgagcgcacggcacggctgctgcgcctgtggaccctcaaagaggcgtacaccaaggcgctcgggcaggggctgcggctgaacttcaccgagttcggcttcgccgccgacggcggtgaactgctcgcccccgacggccggcccgccgcccacggcgagtgggcgttcgccacccacgacgccctgggccggtacgtgctcagcatcgcctgccacgacgccggactggccgcctcgcccgacaccgccgcccgcaccatgctcgacgagggcttcatgggcgcggtcaccgagcagctgggctgacggccgtgccggcgccgcactcgattccgcgtcgaaccccgctggagaaacccgcggccgttcccgctgcccggctagggtgcgaaacggtcgcctcctgtgcgccaccctgcgcgaccgcggcgccccaccaccagaccagcgccgtgtcagcgccatatcagggccgcgtgggcgggcctcgcatactcgttccgcactcgccgagagacgagagaggggagggagggggttttcccgcatgcgtgacacggccctaccggccgccggtgtccgcctgcgcgtgccccgcacgacgatgaccaccgaccactcctcgcacgccgcgtccgccgggcccgcctccgacggaccgatgaccgtcgtcgtgaacccgccggagcgggccgcagcctccgacgcggaccgcggcccggccgcggcgcccgtactcgaactgtgcggcccgctcgacgcgcaccgcatcgacgccgccctcgaccggctcgccaccggacccggccgggcctggcagccgagcctgcgc

SEQ ID NO: 890 - DNA, 1653 bp, Unknown
  Kingdom: Bacteria, Phylum: Actinobacteria, Class: Actinobacteria, Order: Streptomycetales, Family: Streptomycetaceae, Genus: Streptomyces
ctggaggccgtcccggccgtcagccgtctgccggtgcacccgcagacggccgacggccgggacggcctccagcaccgcgagccgggtgagttcatggcggaactcgctcacctgtccgtcggtgcgcacgactccgcaggccacggcctcctccagcgccctctccgcgtccggcaggatgccggtcagcagcggcagggagacccggggccccagcacggccaggacgtcgacgaccgtgcgcgtcgcggccgacaggctggccaggcgtccggcgacggcctcgcgcaccgtggccgggatcgtctcggcgggggcggcgaggatctccgtcacgatgaacgggttgccggcggagacgtggtacagctcctcggcgtcgacggcgtgtcccgccgcgagccgggccacggcccggcggctcagaggtgccaagtcgtggcggtgcacccacggatagcgggcgagagtaccgaggagcgcggtcacatggtgggtgcggccgatctcgtcgtcgcggtaggtggccaccacgagcgcgggaacgcccggcagacgccgggccaggtaccgcagcaggtccatcgtcgcctcgtcggcccagtggacgtcttccacgaccagcagactggggcagacgctcaggtcggcgaggaggcagtcgaagacctcgtcggaacggcacgtgccggccagcgccccggtcagcgcggtgcgcacggctcggcccaggcgtggggcgaagtccatcacggggcctagcgggcggggcgtggccagggggtcacaggcgccgaccaggacgcggatgtggggatccgccacctgggccagacggtggacgagcgtggtcttgccgatgccggcctcgccgcgcacaagggccagacccccagggccgcttaccgcctcctgcaggtgaccggcgaggtcctggagcacagcctctcgctctagcaggtccatcaccagccagtttctctccggggccggagccgcgcaaaagatccggaccgatcaaggcaggccgacctggggggtggcgccaggggatgccgggatgaaaggtggggcgtgccgggctggaacttggggtgttcacccgatgtggccccggctgtggcatggaacgctgggcaaagtgttccagaacccgggtcccctcgtccgcggctcgaatcggtctgtgcagagcatgccgtccgaaaccgccttcgaaatgcctctggcagtgaatccaatccagcccgggaatgaaaggcaactcgagttgccgtcgcctttcgggctgttccgcccgacggcgggatccgcactcatcggaaagaaacgccatgatcaagcacatcgcaaagcgtacggcgctgctcaccgcgtcggctgccctggccgcgggaggcgtcgccttcgccccctccgccgccttcgcctccccggagcccgcaagcacccacgcctcggtgccgttcgacaacggccaccacggacacggtaagaagaacggcgcgaacaacaacaacaataacaacaacaacggcaggggtgcgaacaacaacaacaacaacaacaacggcggcaggggcgggaacaacaacaacaataacaacaacaacaacggcggcaggggtgggaacaacaacaataacaacaaca

SEQ ID NO: 891 - DNA, 7034 bp, Unknown
  Kingdom: Bacteria, Phylum: Actinobacteria, Class: Actinobacteria, Order: Streptomycetales, Family: Streptomycetaceae, Genus: Streptomyces
ggcgcccgccaccacggcggcgtcgacgagttcgcagccgccgtggtggcgggcgcccgggtagccctcggcgtacttgttcgcgagcggcgagccgagcgcggccagcaccgcgggtgaggtgaagttctccgccgcgatcagctgcagcgtcgtcgactgccgcgccagctcccccagcacgatgtcggccacttccgggtcctgccgccgcaggacatcggcctcgagggcggggatgaccgacatggtgcgctccgggcggtcgacggtgacgtacgtccaatgtaggcccgccccgggaggggcgcgcggtcgttacgccgtcacgggcacgcccgggaaacccgggatgcccgtggcccgcgcacgccgtcaggcccgcgccgcgacccccgtcagtgcggtcaccaccggatcgagcgcctcgtgtatctcgtcgccgatcgagcggaagaacggcagcggggcgccgtaggggtcgtagacctcgtccgcttccacgctcggggccaggagccacccgcgtagagcggcggcggcacggaccagggcgcgggcgcgttcgaccacgccgtcctccaggggcggcagcgtggccgggtcgatcgccttcaccaggcgggtgaactccttgagcgtgaaggtgcgcaggcccgccgagtgccccatcgagatgacctgggcgcggtggtcgcgggtcgcggtgaggaccaggtcggcgcggatcacgtgctcgtccagcagctcgcggccggtgaagccggtggcgtccgcgccgaagtcggcgaggaccgtctccgcgttggtctccatgggcgcgccctcgtggccccacgtgcccgcgctctccacgatcagaccgccgccggccgggtcgccgagccggtccgccacgaagtgccgggtcagccgctcggtgatgggcgagcggcacacgttgccggtgctgacgtggaggatgcggaaggttgcacggggctgcccgggctgcccggacagcccgggctgcgtcgggatcgtcgggaccaccggctcgtccttcccgcctatgccacgcatgggggtcccccctgcgggagccgggtcgtgggcccgcgggtgtcaggcgccgtcaattcgccacctcgaggtcgggtacgaccttgcgcagctcctcggccgacagcgcgcccgcgcgcagcagcaccggcacgtcgcggctgacgtcgacgatggacgacggcacgttgccgggggtcgggccgccgtcgaggtagacggagacggagtcgccgagcatctcctgcgcggcgtcgcaggtctccggcgcgggatggccggtgaggttggccgaggagacggccatcgggccgaactcgttgagcagttcgatggcgaccgggtgcagcggcatgcgcacggcgaccgtgccgcgggtgtcgcccaggtcccactggagggacggctggtgcctggcgatgagcgtgagggcgcccggccagaaggcgtccaccagctcccaggccatctccgagaagtccgtgaccagcccgtgcagcgtgttcggggagccgatgaggacgggcgtgggcatggtgcgcccgcggcccttcgcggcgagcaggtcggcgacggcctccgaggagaacgcgtcggcgccgatgccgtacacggtgtcggtcggcagcaccacgagttcgccccggcggacggcggacgcggcctcgcgcagacccgtcgcgcggtcggtcgcgtcgttggtgtcgtatcgccgtgccattgtcagcgggcctcctcgtacacgtactgctggtctgaagtcctggtggtgggctgcgccgggctcatggcagcgccttgcgggcggtggcgaaccgcggccggttgttcaggtcgggatggtcggccgcgtcggcccagccccgctcctcggtgaagatccacggcacctggccgccctgggtgtcggcgtgctcgatgacgacgacgccgccggggcgcagcagccggtgtgcggtgcgttcgatgccgcggatcaggtcgaggccgtcctcgccggagaacagcgccagctcggggtcgtagtcgcgggcctccggagcgacgtactcccactcggtcagcgggatgtacggcgggttggagacgacgaggtcgacctggccgtcgaggtcggggaaggcggtcagggcgtcgccctggcgcaggtcgaccctggatccctccacgttcttacgggtccacgtcagcgcgtcctcgctcagttccacggcgtgcacgcgtgagcgcggcacctcctgggcgagggcgagcgcgatggcgccggagccggtgcacaggtcgacgatgcagggctcgaccacgtccatggcacgcaccgcgtctatggcccagccgacgaccgactcggtctcggggcgcggcacgaagacgccggggccgacctgcagctccaggtagcggaagtaggcccgcccggtgatgtgctgcagcggctcgcgctgctcgcgccgggcgatgacctcccagtaccgggcgtcgaagtcggcgtccttgacggagtgcagctggccgcgcttgacgccgtggacgaacgcggccagttcctcggcgtcggtgcgcggcgagggcacaccggcgtcggccagccgctgggtcgcctgcgccacctccgcgagcagcacgctgcgggggcctgggggtcgccccccggattcttgctgcacgctggtcctccgtgctcggtactggtgcgcaggtgccgtgcctgccggcgccggacatgcgtcctgtctacgtgccttacgcgctcttggtgccgtacgcggtccgcgtgccttacgcggccgcgagcttggcggccgagtccgcgtcgacgcaggcctggatcacggcggcgagttcgccgtccaggacctggtccaggttgtaggccttgaagccgacccggtggtcggagatgcggttctccgggaagttgtaggtgcggatcttctcggagcggtcgacggtgcggacctggctgcgccgggcgtccgcggcctccctctccgcctcctcctgcgccgccgcgagcagcctggagcgcaggatacgcatcgcctgctccttgttctgcagctggctcttctcgttctggcaggaggcgacgactccggtgggcaggtgcgtgatgcgcaccgcggagtcggtggtgttgacggactggccgccgggcccggaggaccggtagacgtcgatgcgcaggtcgttcgggttgatctcgacgtcgacctcctcggcctccggggtcacgaggacacccgccgccgaggtgtggatacggccctgggactcggtggccggaacgcgctgcacgcggtgcacgccgccctcgtacttcagccgcgcccacacgccctggccgggctcgatctgcccgcgggccttcaccgcgacctggacgtccttgtagccgcccagctcggactcggtggcgtcgatgatctcggtcttccagccgacgcgctcggcgtagcgcaggtacatgcgcagcaggtcgccggcgaagagcgccgactcgtcgccgcccgcgcccgccttgatctccaggatgacgtccttgtcgtcgctggggtcgcgcggcacgagcagcaggcgcagcttctcggtcagctcctcgcgctgcttgtccagctccttgacctcggcggcgaagtcggggtcgtcggcggccagttcacgcgcggtgccgatgtcgtcgccggtctgcttccaggagcggtacgtggcgacgatcggggtcagctcggcgtaccgcttgttgagcttgcgggcgttcgcctggtcggcgtggaccgacgggtcggcgagcttcttctccaggtcggcgtgctcgacgacgagctcctcgacggcctcgaacatcttgggctcctgctgctgcttgggaaggtgaagggcgggcgaccaaaaacgccggtcccgggcgcaccccggtgggggcgcggccgtggaccggcgaaatggggctcgctacttcttggagccggcagccttgccgaagcgggcctcgaagcgggccacacggccaccggtgtcgaggatcttctgcttgcccgtgtagaacgggtggcactcggagcagacctcggcccggatggtgccggactcgatggtgctgcgggtggtgaacgacgcgccgcaggtgcagctgacctgcgtctcgacgtactcggggtggatctcgcgcttcaaggtgtctcctaggttcgggagggcgccgggtcgccgccgcggggtgcgggagcgtgaaccggggccgacgtaccagtctgccaggactgccgccatctcccaaaaccggggggccgggccgggtattccccccgggggcgcggcggagccgcacatcggctaggagccgctcacgactcccttggccttaccggtcgccgtgccctccgtggccgtcctcgggatcggccggtcgctcttcagggccgtccagacctgctgggccttggtctgttcgatgatcacgcggttggggttggccgggtcgtaccggaccggcatggtgaccatgttcatgtgggaggagctgatgcccttgaggccgtcggcgaaggagatcagggagttcaccgagcccagctccgagtcggtggtgacggccttggtggcggtgtcggcgaggtcgtagagcttcttggggctggtgaagaccccgacgtgcttgacctggtcgatcagtgccttgacgaaggcctgctggagctggatgcggccgaggtcggagccgtcgccgacgccgtgccgggtgcggaccaggccgagcgcctgctccccgtcgagggtgtgggtgcccgcggtgaggttcaggtggctgttcgggtcgtggatggcccgggtggtggtgacctggacgccgccgaggtcgtcgatgagcttctggaagccgctgaagtcgacctccaggtagtggtccatacgcaggccggtgagcgattccacggtcttcacggcgcaggcggcgccgccggtgccgtacgactcgttgaacatcgcgtcgtgcgcggccgggtgcgcggcgcccttggtgtcggtgcactcggggcggtccacgagggtgtcgcggggtatggagaccacgctggccttcttgtggccctcgtacacgtgcacgatcatcgccgtgtcggagcgggcgctgccgtcgtcggtgccgccgcccagcttcttgttgctgccggcgcgggtgtccgagccgaggaccaggatgttctcggagccgttgtcggccttgccgggccggtccgtgccgagggcctggttgatgtcgacggtcttcaggttgccgttgagcttgaagtacaggtagccggcaccggtgccgcccagcaccacgatccccgcggcggtccaggccgtgaccagcagcgccttgtgccgccccgtggggggcttgcggcggcggcccccggcgcccctgcggcgggtgctgtcggtgcggctcttccccggtatgccggggtccggcgttctctgggcggacatgtgctcctcagctctcgttccggtcggttaccccttgatgcctgggtcaggcccggcccggtcgaagccgtaccgcaccatcgtcgctcttcccggtcagacgaggtaaccggggcaaaggttgcacagaggcggtacggggtgctgtggcgaagctctcgccggcccccgccggccctctccgggcgccgcggagcgggcgagggggccccggccggggggggtgcgtgcacggcgaagggccgccccctgacgggagcggcccttcgctgccggaccgtgcggatcagtcgccgttgccgggggccggcgtcgtcttctggatctgcatcaggaactcgacgttcgacttggtctgcttcatcttgtcgaggagcagctcgatcgcctgctgctggtcgagcgcgtgcagcacccggcgcagcttccagacgatggccagctcctcggagttcagcaggatctcctccttgcgggtgccggacgcgtccacgtccaccgccgggaagatgcgcttgtcggcgagcttccggtcgagcttcagctccatgttgccggtgcccttgaactcctcgaagatcacctcgtccatgcgggacccggtgtccaccagggcggtggcgaggatggtcagcgagccgccgtcctcgatgttgcgggccgcaccgaagaagcgcttcggcgggtacagggcggtcgagtcgacaccaccggacaggatgcggccggaggccggggcggccaggttgtacgcgcggcccagacgggtgatcgagtccagcaggacgaccacgtcgtgacccagctcgacgaggcgcttggcgcgctcgatggccagctcggcgaccgtggtgtggtcctcggccgggcggtcgaaggtcgaggaaatgacctcgcccttgaccgaccgctgcatgtcggtgacctcttcgggacgctcgtcgacgaggacgaccatcaggtggcactcggggttgttgtgcgtgatggcgttggcgatcgcctgcatgatcatggtcttgccggtcttcggcggggccacgatcagaccgcgctggcccttgccgatcggcgacacgaggtcgatgatccgggtcgtcagcacgcccgcctcggtctccaggcggagccggtcctgcgggtacagcggcgtcagcttgttgaactccggccgcccgcggccgtgttcgggcgccatgccgttgacggagtccaggcgcaccagcgcgttgaacttctcgcggcgctcgccctccttgggctggcgcacggcaccggtgacgtggtcgcccttgcgcaggccgttcttgcggacctgggcgagggagacgtagacgtcgttcgggccgggcaggtagccggaggtccggatgaaggcgtagttgtcgaggatgtccaggatgcccgcgaccgggatcaggacgtcgtcctcggcgatctgcggctcctgcacgtcgtcgcggccacggcggccacggcggtcgcggtagcggccgccgtggccgccgtggccg

SEQ ID NO: 892 - DNA, 2550 bp, Unknown
  Kingdom: Bacteria, Phylum: Actinobacteria, Class: Actinobacteria, Order: Streptomycetales, Family: Streptomycetaceae, Genus: Streptomyces
atccgggccaagcttcccgggtgagcgccacgccggtggacatcgccggtgaccatgccggtggccgtggtggccgtgccggtgcctgccggtggccgtgccgctgagcggcattcgtcggtgccgtgccccggtgggctgagccgacatgtgcggatgcgggctctccgagtcggagagcccgcatccgcatgtcacgtgtcatcccgtcgtcccccggcaggcgtcagggcttgagggtgtccttgcccttctccttggcctgacgtgcgtcgcccttggccttctcggtccggccctcggcggtcatccgctcgttgcccaccgcgcggccgaccgtctctttggccttgcccttcatctgttccttcttgcccttggccttctggtcaccagccactgtcactcactcccagcggtcgagatcggtgtcaccgcgtcgggtgtccggtgcggagcgcggcaaacctcgcgcgcggcgcgcacgcgcgagcacgagcacgcggagacgcgcgggcccgtgcccgcctccggcggctgggtacccggggccgagcagtccggaagttccggaaggagcgttgccatgacggagtccctgacggtcgacgcccgcgagcacggtctcgcgggcgacgggtccaccaatgaccagccggcgttccagcgtctggtggacgcgctcggcgcggcctgtgccgccgacggccgcccgcgtgtgctgcacgtgccggccgggcggtacctgatccgcgaccggcccacgctctggcgcagcggcgtctccctcgtcggcgagggccgcggtgccacctgcttcgtgctgggcaatcccggcgaccgtacgacgcccgtgccgttggcctggttcaccacccagcagcacggagccggtcgggacaaccacctcgcggacgtcaccttcgcccacttcgagatcgacggctcgggagtgacgaccgagcagtacgacccgctggccaaggggctcggtctgcagtacgtgctgcgcgggcgcttcagcgacctgtacatccacgacacggcggccaccgggttcggctgcgacttcctccaggacacggtcgtggagggcgtgctggccgagcggtgcggacggcaggacagcggcgagcagatgggcggggcgggcctcgggatcggcgtcggcggctggggcccggtcgaacggctgaccgtcaccgcctgcaccgcgaccggcaacggcaccaacgggatcttcctcgaactgcagaacgaggactgggtgccgccctcgggcatccgcatcaccgcctgccatgccgaggacaaccgcttcggcatctccgactggggggccgacgggctcctcgtcacctcctcgaccatgctcggcaaccaccaggccgggttcgacgtgtcctcgcagggcacctcgggcaccggcggccggggcggcatcgtcacgggctgcgtcatcgacggcaacgtccgcgacggtgtggcgctgggcaacaccccggggccgtacgccttccgcggcaaccggatcagccgcaacgggcggtacggctactgggagcacaacctcgccggcggggacgaggaagcggcggcggacatcgttctggaggccaacgacatccgggacaacggagtcgacggcgtgtgcgtcggcgccgccatgcgggactccgccatcctgagcaaccggatccgcaacaacggccggcggtgcgccggggccgtggagagtacgggcagcggcgtgcgcttctccgagctgtcgctgacggacgggaacgccgactggcgcgccgacgggcacctcggaaaggaggtctcggtgggtgaccagagcgccctggtcatcggtaacacccggaccgagctgcacctcgcgccgctgcggcccggcgctgacaccgcctggccgaaaggcgttcccggcgccggctccggctaccggctgcccgcggcacccggcgtgcggaccgggctgacggtcgacgcggccgtgctccggccgcagatgcagggcaaccggatcggcgacgaccagccggtccgaacccagacccacggcatgcggatcaccggcgacggcagctggacggacggccgcgtcctcgacaacgacctgagcggcaacgcccacgaggacacccgcttcgacacccggccggcgggcggccggtggcgggacgacgacgcgtgacggcgtacggcccacacgtgactgcgcacgacatacgtgactggcctgcacgtgactgcgcacgacctacgtgacgggtgcggctcaggtgacggcatgcgcgccgcgtctcaccccctgctcgcgtccccgcaggtgtcccgtcccgttttccgccccgtaccgccgtccgggtgagcgggctcgtcgtccgggtgagggcggaccgggccgccggagggtccgggcgaccggcgcggggggcgctcatggtggtcgcggcgccagtcgaggaccgccaccgtcagggacgccagcatggccacgagcgcgaagcccaccgagagtgacacggccgcgcggtagttccc

SEQ ID NO: 893 - DNA, 7481 bp, Unknown
  Kingdom: Bacteria, Phylum: Actinobacteria, Class: Actinobacteria, Order: Streptomycetales, Family: Streptomycetaceae, Genus: Streptomyces
tggacgggatctcgctcgtggccggggtgcgcggcacccagcccggcgtacggaccgtcgtcctcgccgcgaaggacgacccgcggcgggccgcgctcgccctgcaggccggcgcctgcggctgggtcgccaaggactgctcactgtcgcggctgctcaccgtcatccgcggggtgctgcgcgacgagacgcacctgccgcccgcgctgctcaccggcgtgctgcgggagctgaccgccgcccgcaagcaccgcaccgagagcgaacgcctggtggagtcgctgaccccgcgcgagcgggaggtgctgcgctgcatggtcgccgggctcggccgcaaggcggtcgccgagcggctctacctgtccccgcacaccgtccgcacccacatgcagaacgtgctgggcaagctcggtgtgcactccaccctggccgccgtggcactggcccgccgggccggagtggggcccgcggagctgggatcagccggggatgttgtcgaacggggcggtcaactggcgtagcagaccggcgagttcggagcgctgggcggtggacagttcggcgaggatcgcccgctcctggtccagcaggccggacagggactggtccgcgcggtcgcggccctcgtccgtgagccggaccagtacgccccgccggtcgctggggtcgggcaggcgctcgaccaggcccttcttcgccagccggtcgatgcggttggtcatcgtgcccgaggtgaccagggtctgggtgagcagttgtcccggggagagctggtacggcgcgcccgcgcggcgcagcgcggtcagcacgtcgaactcccacggctccaggctgtgctcggagaacgccagccggcgggcgcggtccaggtgccgggcgagcctgctcacgcggctcagcacctcgagtggttccacgtcgaggtccgggcgctcccggcgccacgctgcgaccagccgatcgacctcgtcctccatacgagcagtgtagtggttgtgtcgacgtgaagtctcttgatatcgactatcttgacatcgagagaacgaacggaacatgctggttgcgcggatcacggacccgaccacggacccgatcacaggctcgctcaccggacttcaaggaggccgccatgcccgccgaccacgcccacgacatccacgctcccgccggcgcgggcagcctcacgtgggaccccgcgcagtacctgcgtcacgcgggccaccgggcccgccccttcaccgacctgctcgcccgggtccccgacctgcccgccgactccccccgcatcgccgacctcggctgcggtcccggcaacgtcaccgcgctcctcgccggccgctggcccaccgcccgcatcaccggctacgacaactcgcccgagatgctcgacaaggcagcggtggagcacgcggggcccacgccgggcgggggccggctcgacttcgtccctgccgacgcccgcacctggacgcccgacgagcccttcgacctgatcgtcagcaacgccaccctccagtgggtgccgggccacaccggccgcttcgccgactggatcgcggcgctggagcccggcggcaccttcgccttccaggtccccggcaacttctccgcccccagccaccggctgatgcgcaccctcgcccgctcggcccgctggcgcgaccgcctcggtgacgtcctgcggcacgaggacgccgccggcgagcccggggcgtacctggaacagctgaccggcctcggctgcacggcggacgtgtgggagacgacgtacgtccatctgctgcacggcgaggacccggtcctggactgggtgaagggcaccggactgcggcccgtcctcaccgcgctcgccgacgaccccgacgcccgggacgccttcctcgccgagtaccgggccgccctgcgcgaggcctacccggccggcccgcacggcaccccgttccccttccgccgcgtcttcgccgtcgccaccaaggaggcgtgagccgtgctcaccgcgatcgaccacgtccagctcgccgccccgcccggctccgaggacgcgctgcgggcgtactacgccggtgtcctcggcatgacggagatccccaagccctctgccctggccgcccgcggcggctgctggttccaggccggcaccgtccagctccacctgggcatcgaagcggacttcaggcccgccaagaaggcccacccgggcctgcgggtgaccggcatcgaggcctacgccgcccggctcgccgaccgcggcgctccggtcacctgggacgacaacctccccggccaccgccgcttctattccgaggacccggcgggcaaccgactggagttcctggagccggtcaggccgtccggccgaggtgcgtgaccagaatgtggatcgcttcgtcgtcgttgacgcagaggacgcggtggcgcccacacgcggtcgccggatggtgacgccgtaggccgtggaaccggcgggtcgcggagactcggcgagcgcgtccacggcctcatacacggcggcgaggccagtgggatcttccttcaggaaacggacggcctggtcggcggcagcgggttccgagactcgcggccgtgtgccgcccggcgcaccaggtcgccgagctgggagcgggcagcgctggtgatctcagctcttccggtgccctatcagccgaggcttcggctccaggccgtccaggccgtgccaggccaggttcaccaggtgggcggcgacctccgccttcttcgggcggcgtacgtccagccaccactggccggtcagcgcgaccatgcccaccagggcctgcgcgtagagcggggccagcttcgggtcgaagccccgggacttgaactcgcggcccaggatgtcctccacctgggtggcgatgtccgagatcagggacgcgaaggaacccgtggactgcgggatgggggagtcgcggacgaggatgcggaagccgtccgtgtactcctcgatgtagtccagcagggcgaaggccgcctgctcgcacagctcacgcgggtggccggccgtcagcgagctggtcaccatgtccagcagccgccgcatctcgcggtccaccaccaccgcgtacagcccctccttgccgccgaagtgctcgtacaccaccggtttggacaccccggccttcgccgcgatctcctccaccgacgtgccctcgaagcccttcgccgcgaacagggtgcgaccgatctccagcagctgctggcggcgctcggcaccggtcatccgggtgcgacgcgcacgccgcggcttgtcattgctgggggtgctggagtcggtcgccacggcgtcaatcatgccgcctcggcggtttccttccggcgccgggagccgccttcaccggtgttgcgccgggaatcgatacgcgagcgtgacggccagcgcacgtcgtacgcccagcccagctgctcgaaccagcggatgatccgcgcggaggagtccagctggccgcgctccacaccgtgccgggcggaggtcgggtcggcgtggtgcaggttgtgccaggactcgccgcacgacaggatcgccagccaccacacgttgcccgagcggtcccgcgacttgaacggccgcttgcccaccgcgtggcagatcgagttgatcgaccaggtgacgtggtgcagcagagccacccggacgagtgaaccccagaagaacccggtgaacgcgccccaccacgacatcgtcgccagaccgccgatcagcggcggcagccccagcgagacgatcgtccacagcacgaactggcgcgagaccgcccgcatcgccgggtccttgaccagatccggcgcgtacttctcctgcggggtctgctcctcgtcgaacatccagcccacatgggcccaccacaggcccttcatcagcgccgggaccgtctccccgtaccgccacggcgaatgcgggtcgccctcgtggtcggagaacttgtggtgcctgcggtgatcggccacccagcgcaccagcgggccctccaccgccatcgacccggcgatggccagcgcgatcttcaacggccgcttcgccttgaaggagccgtgcgtgaagtgccggtggaagccgatcgtgatgccgtggcagccgaggaagtagaagaagaccagcagaccgaggtccagccagctcaccccccacccccacgccagcggcacggccgccagcagcgcgaggaacgggacggtgatgaacagcagcagcgtgatctgctcgatcgaacgcttctgctcgcctcccagggtggcggaggacagcgcgccgacggccgcgtccggggcgtcgtcgatcacatcggaggagcttgaggtcatgggcgtcccctgtggggtcgagggtcgagacaggtgccgggggcttcgcaaccgttcagctccctacggttccgtaacctacggcgacgtaagtatggcagtgcgtcgccgcgcggcaagagcccctggcctgcgcgtcccacccggcacctagacttggtcccggtcggacagcgcggtccgctgaagaagattccttcccggatgcccggcccgtatgcggcacccgccgcgcggcacccgtccgggttccctctcagaagagcttccacactgcaaggagccgcacctgtgagcagtgccgacgaccagacgacgaccagcagcgagctgcgcgccgacatccgccgactgggtgacctcctgggggagaccctggtgaggcaggaaggtcccgaactcctcgacctcgtcgagaaggtgcgccgcctcacccgtgaggacggcgaggccgccgccgagctgctgcgcggcaccgaactggagaccgcggccaagctggtccgcgccttctccacctacttccacctcgccaacgtcaccgaacaggtccaccgcggccgtgaactgcgcgcccgccgcgccgccgagggcggcctgctggcccgtaccgccgaccagctcaaggacgccgaccccgagcacctgcgccagaccgtccagcacctcaacgtgcggccggtgttcaccgcgcaccccaccgaggccgcccgccgttcggtcctcaacaagctccgccgcatcggcgccctcctggagaccccggtcgtcgagtccgaccgccgccgcctggacacccgcctcgccgagaacatcgacctcgtctggcagaccgacgaactgcgcgtggtccgccccgaacccaccgacgaggcgcgcaacgccatctactacctggacgaactgcacgccggcgccgtcggcgacgtcctggaggacctcaccgccgaactggagcgcgtcggcgtcaagctccccgacgagacccgccccctcagcttcggcacctggatcggcggcgaccgcgacggcaaccccaacgtcacccccgccgtcacctgggacgtgctgatcctccagcacgagcacggcatcaacgacgccctcgacaccatcgacgagctgcgcgccttcctgtccaactccatccgctacagcggcgccaccgaggaactgctccagtccctccaggcggacctggacaacctgcccgagatcagcccccgctacaagcggctcaacgccgaggagccctaccggctcaaggccacctgcatccggcagaagctcgtcaacaccaagcagcgcctggccaagggcaccccgcacgtcgcgggccgcgactacctcggcaccgccgaactcctcgccgacctccgcctcatccaggactccctgcgcgaacaccgcggctccctcttcgccgacggccgcctcggccgcaccatccgcaccctggccgccttcggcctccagctcgccaccatggacgtccgcgaacacgccgacgcccaccaccacgccctcggccagctcttcgaccggctcggcgaggagtcctggcgctacgccgacatgccccgcgagtaccgcaccaagctgctcgccaaggaactccgctccagaaggccgctcgccccggccccggcccccgtcgacgaggccggcgccaagaccctcggcgtgttcgagacggtcaagcgcgccctggacgtcttcggacccgaggtcgtcgagtcgtacatcatctccatgtgccagggcgccgacgacgtgttcgccgccgccgtcctcgcccgcgaggccggcctgctcgacctgcacgccggctgggccaagatcggcatcgtgccgctcctggagaccaccgacgagctgaaggccgccgacaccatcctggaggacatgctctccgacccgtcctaccggcgcctggtcgcgctgcgcggcgacgtccaggaggtcatgctcggctactccgactcctccaagttcggcggcatcaccaccagccagtgggagatccaccgcgcccagcgccggctgcgcgacgtcgcccaccgctacggcgtgcggctgcgcctcttccacggccgcggcggcaccgtcggccgcggcggcggccccacccacgacgccatcctcgcccagccctggggcaccctggagggcgagatcaaggtcaccgagcagggcgaggtcatctccgacaagtacctcatcccctccctggcccgggagaacctggagctgacggtcgccgccagcctccaggcgtccgccctgcacaccgcaccccgccagtccggcgaggccctcgcccgctgggacgcggccatggacgtcgtctccgacgccgcccacgccgcctaccgcaggctcgtcgaggaccccgacctgcccgcgtacttcttcgcctccacccccgtcgaccagctcgccgacctgcacatcggctcccggccctcccgccggcccgactccggcgccggactcgacggcctgcgcgccatcccgtgggtcttcggctggacccagtcccggcagatcgtccccggctggttcggcgtcggctccggcctgaaggcgctgcgcgaggcgggcgtacggcaggagggcgagaccgtcctggaggagatgcacgaacgctggcacttcttccgcaacttcatctccaacgtcgagatgacgctcgccaagaccgacctgcgcatcgcccagcactacgtcgacaccctcgtccccgacgagctgaagcacgtcttcgacgtcatcaaggccgagcacgaactcacggtcgccgaggtcctgcgcatcaccggcgagcgtgaactcctcgacgcccagcccgtcctgaagcagaccttcaccatccgcgacgcctacctcgacccgatctcctacctccaggtcgccctgctcaagcggcagcgcgacgcggcggcagcggaccaggacgccgacccgctgctctcgcgggccctgctcctgacggtcaacggcgtggcggccggcctgcgcaacaccggctgaccggcacccacgcggcggcgcccccggttcacgcgaaccgggggcgccgccgtacgcctcacaacgcgacgaacgcggccgtcagcagcgcgatccccgcccccgccagcacccacgccgcccgcacc

SEQ ID NO: 894 - DNA, 702 bp, Unknown
  Kingdom: Bacteria, Phylum: Actinobacteria, Class: Actinobacteria, Order: Streptomycetales, Family: Streptomycetaceae, Genus: Streptomyces
  misc_feature (463)..(552): n is a, c, g, or t
cggcaacccggtcatcggcgtacgggccttcggcgcggacaccgacctcgtggcccggcacacggccgcctacgtcgagggcatgcaggccgccggcgtcgccgcctgcaccaagcacttccccggccacggcgacaccaacgtcgactcgcaccacgcgatcccgcgcatcgacgtcgacgaggacacgctgtacaagcgggaactggtgccgttccgggcggccatcgaggccggtacgcgggccgtgatgagcgcgcacatcctggtgcccgcgctggaccccgagcggccgggaacgctctcgcgccgcatcctcaccgagctgctgcgcggtgaactgggctacgacggactgatcgtgaccgacggcatcgagatgcaggcgatctcacggacctacggtctggaacacggggtcgtgctggccatcgaggcgggcgccgacgcgatctgcgtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgtccgctccggcgaactgcccgaggaacggctggcggacgccgccgcccgggttcgcgaactggcccggtggacgaagcgggcgcgcagcggcgcgggtgtcccggccgacccggaagtgggactcgccgccgcccgccgcgctc

SEQ ID NO: 895 - DNA, 1630 bp, Unknown
  Kingdom: Bacteria, Phylum: Actinobacteria, Class: Actinobacteria, Order: Streptomycetales, Family: Streptomycetaceae, Genus: Streptomyces
gcggcggggcgggccgggccgggcggtgccgggcggtgtcagggctcgcggtgttcgtgggccgcgcggtccagttccgccgcctccgcctcggccagccgctgctcggcggccacgtcgatcgagcgggtgagccaccagtacagcagcgcggagacgggcaacccgatgaacagggcgatgtccgcgccgcccagcgccttcgcggcgggcccgacgaaaagggtgccgacggagaagaacggcaccatggccgcgaacccggcgagataggagacgatgccccgccagccccaacgtccgtaaatgccatgggggttgaagatctcggccaccgcgtagtggccgcggcgcacgatgtagtagtccatgaggttcaccgcggtccacgggatgaacaggtacaggaccagcagcaggaagtcgttgaagttccgcaggaagtgcgaggtcgcggcgagcgcgccgaacagggagagcgccgcggtcaggccgagggtcagcaggcgcacgccgagcgtcgggcgcaccttgcggaacgagtcgatggcgctgatcagcgtcagcgacccgccgtacatgttcagcgcggtcacggacaccaggccgagcgccgcgaacagcagcaccacggcaccgaagcccgtgaacacggtgtcgcccgccgcgtcgatcgaccggatcgtgtcgaagtcccggcccgcccaggcggccagcagcgagcccagcaccatcagccagatgccgccgagcgcggagccgaagtaggtccagtagaaggtcttgcggacggtgacgtcgggcgggaggtagcgggagtagtcggagacgtagatggcccagctgatctggtaaccggcgaccacgccgaactgggccaggaacggcgtccacttgaagccgcccaggtcgaaggagccccccggatagtgcaggttgaccaggacacccacggtgaagaccccgaagacgaccaggaaggtgtacgtcaggaagcgttcggccttgtggatgatgtcgtaaccgaccagcgcgaccacgagcccgatcacggtgaccacgagcacccagagcttgacgccgccgtgcagcgtggcgtgcagggcctgcccggcgaggatcgtgttgaagacgttgaaccccgcgtactgcacataggcgaagagccacaccagcagggcgccgacgtagccgaactggggccgcgactggatcatctgcgggagccccagctgcgggccctgggccgagtggaacgccatgaagaaggtgccgacgacggtgcccacgacgatggcgagcagcgaccagacgaggttgccgccgctggtgatgctgatcaggcccacggccagggtggcgatctgcgcgttcgacatgaaccacaggggtcccagatgccacagcttgccgtgccgctcgtccaggggcacgtagtcgatggaccgggtctccagacccgtcacccgcggctcagccgatgtgctcacggcacctcccgcaaccgaaccatccctgtggtcacggtcgccccccggagcacgccggtcaagcggggaggggccggggcagccggtcgggctgagcggacaagggcgccggcccctccccgcttgaccggcgtgctccg

SEQ ID NO: 896 - DNA, 5628 bp, Unknown
  Kingdom: Bacteria, Phylum: Actinobacteria, Class: Actinobacteria, Order: Streptomycetales, Family: Streptomycetaceae, Genus: Streptomyces
gtacggaggccggggtaagtacgggccgtaccggaccgcccccgagagccgcgcacccgccgggtaggcccgccgcccgcccccgtcgaatccgctcggaccaacccggaccaaccccccaatgaggtcgtacggttcatgaactcccgtcagcgccgcggcgtgatactcctggtcctgtccgtcatctgcgccctcggcgcgttcgcgggcgtgctctccgtcatcagcgacgtcaagtcgaaggtcggccccgaggtcacggcgtaccagctgaaggccgacgtgaagccgtacaccccgctgaccgcgagccagttcgagaagatccggatgcccaagcggtggctgtcgccgaacgccgtcaccgacctcggtcaggtccagggcaagatcgcggtcaccacgctgcgccagggttccctgctgcagagcgacatgatcgtgaaccagcccgccctgcggcccgggcagcaggaggtcgccatcatgatcgacgcggccaccggtgtggcgggcaagatcacgccgggctccacggtcaacgtctacgccaccttccccggccggcgccagggcgaccccgcccagtccaagatcatcgtgaccaacgccagggtcctggacgtcggccggatcaccgccctcgacccgggcgccgacaaccgcgaccggcagcccaccgaggccgtccccatcaccttcgcgctctccaccatcgacgcccagcgcatcacctacgccgagtccttcgcccagcgggtgcggctcgcgctggtcgcgccgggcggcgacaccgacgtcccggccaaggaccggacctacgaactcgcgaacgacaagtgagaggcccgcagccatgcccaccaggatcctcccggcagtcggcgacatggacgcggtccggtccctcacgacactgctcagccagctccccgacgcggaaccggtgccccccgtcgccgactcgacccagctcgtcgacaccctggcccgcctggccgccgagtccgtcgacgaactgcccgagatcgtggtcgtacacgaacgcgtcggccccgtcccggccctggagctgatccgcgaggtcgccctgcgcttcccggcggtgggcgtcatcctcatcacctccgacgcgagccccggcctgttctccgccgccatggactccggtgcgcgcggactggtgtccctgccgctcagctacgaggaactggccagccgggtccaggccgtggcccagtggtcggtgggcgtccggcggcacctcggccacggcggcgacgtggtccccggcgtcggcggacgcctggtgacggtgagcggcgccaagggcggcgtcggcgcgaccctgaccgccatccagctcgccctcgccgccaaggcctccgggcagagcacggccctggtcgacatggacctgcagaccggcgacgtcgcctcctacctcgacgtccagttccgccgctcggtcgtcgacctcgccgccatcaccgacatctccccgcgcgtcctcgccgacgccgtcttccggcacgacaccggcctcgccctgctgctcgcccccggcgagggcgaacgcggcgaggaggtcaccgaccgggccgcccgccagatcgtcagcgccctgcggtcgcgctacgaggtcgtcgtcctggactgcggcgcgcagctcggcggcgcgggcgcggcggccgtggagatggccgacaccgccctgctcctcaccaccccggacgtcgtcgcggtgcgcgccgccaaacggaccgtgcggatgtgggaccggctgcagatccgcaaggccgaggagacgaccgtcgtcgtcaaccgccacacccgcgccacggagatccagcccgcgctcatcggcaagatcaccggcaccgcggtggccggcacggcggtccccgcgaacttcaaggaactccaggccctggtcgacgccggccgcatccacgagctggacgccaggagcacggtcaagcaggccctgtggggcctggccgccgaactcggcctggtcaagagcccggtgaccgcccacaagggccacggccggatgcgtggcgaccggggcgcggtcagcttccggcggcgcagggaggccgggggatgaggcggggggcgggacttgcggagcggttacggtccgacagcggccaggtcgccgtcgagttcctgggcatggcgccgacgatcatcatcacgctggtgctgctgtggcagtgcgtgctgctgggctacacgtacacgctggccgggaatgcggcggacgaggccgtacgggcggcgacggcggccaccggggacatgcagggagcctgcgaacgcgccgggctcgaagacctgccgagcgcgtggcggggcggtgcccggatcgagtgcgggggccggggctccggttacgtcacggccaccgtgcacctggatgtccccgtcctgctgcccggcctgatcggcttcccggtcccggtgaccggccacgccggtgccgtggaggaggtgaaggactgagatgcctcaggagcgacgtaccggcgggccccacgggcgacgtacttgcgtgcctcgcgggcgacgtaccggcgtgccccacgagctgcccgacgagcgaggccgccggtcccgcgatcacggccaggtcgccatcgagtacctggggttcgtcccgatcctgctgctggtcggcctggcggccatccagatcggactcgtcgccttctgcgccctccaggccggtacggcggcacgggcgggtgcgcgcgcggcctcgctcgggcacgacgcgcagcaggcgtgcacggcggcggtcagcggcggactctccggacgcacgacctgcgatcccgcgcccggaggcgacacggtcaccgtcaccgccaccgtccgcatcccgtcgatcatcccgctgtggaacccggtcggcaccgtccgcaagaccgccaccatgccgctcgacgacccccgctcgaccagtgaccgaggacgaggagccccgcccccatgagcctgcgcgcacgcatcaactcgcccgaggagcacggcagtcgcggcgaggacggccacctcgtcgcctcctaccgggcgaaactcctggaggagatcgacctcgcggagatgagcgcgctcgcgccggcggagcggcgggtacgccttgagcgtgtgctcgggcacatcatcagccgggagggcccggtcctgtcgaccgtggagcgctcacagctgatccgccgggtggtcgacgaggccctcggactcggcatcctcgaacccctgctcgaagacgcgtccatcaccgagatcatggtcaacggccccgacgcgatcttcgtcgaacgcggcggacgggtcgaacagctcccgctccgcttcgcctcccacgaccagctgatgcagaccatcgaacgcatcgtctccacggtcaaccgccgcgtcgacgagacgaacccgatggtcgacgcccggctgccgtcgggcgaacgcgtcaacgtgatcatcccgccgctgtcgctgaccggccccaccctcaccatccgccgcttcccgcgctccttcaccctccaggagctgatcggcttcggctcgctcgacgagcacatgctctacctgctggccgcgctggtgcaggccaggttcaacatcatcgtgtccggcgccaccggcaccggcaagaccacgctcctcaacgccctctccgggctgatccccgagagcgaccgcatcatcaccatcgaggactccgccgaactccagctccagcaggcccacgtcgtacgcctcgaagcacgcccgccgaacgtggagggccggggccggatcagcatccgcgacctcgtgcgcaactcgctgcgcatgcgccccgaccgcatcgtcgtgggcgaggtccgaggcggtgagtcgctggacatgctccaggcgatgtcgaccggccacgacggctcgctggccaccgtgcacgccaacagcgccgaggacgccctcatgcgcctgcagaccctcgcctccatgtcggacgtcgagatccccttcccggcgctgcacgaccagatcaacagcgccgtcgacgtcatcgtccagctcacccgcttcgcggacggcgcccgccgcgtcaccgagatcgcgctcctggacagccacggcggtgagccgtaccggctggcgaccgtggcccgcttcgccgcccgtcccatgaccgccgacggccgcatccacggcgcctacgagcaccacccgctgccccgccgcaccgccgaccgcctctacatggcgagccagcccgtcccgcaggccttcggcatcgcccactccgcagaccaactggccacccgggaagccaggtaggagccatcatggacctgagcaccctcgtcaccctcaccaccggaaccgcgctgctgacctgcgtcctggccgtcctcgggctgcacgcctacacctcgggccgggcccggcgcgcggaactcgtcgaccggctcgccctgaccagcggcaccacgtccggccgcaggcgccgcttccgctccctggaccgccggctgcgccgcaccgcactgggccgcagactcgaactgcggctcgccgccaccggcctcgacatcaccccgggcgagttcaccgcctgcatgctcgccgtggtcgccgcgctgtggctgatcggccaggcggcgctggccccgttcttcggcccgctcgcaggcctcctcggcgtctgggcggcggtgcagttcctcaactggcagcgggccagacgcatcgagaagttcatcaaccagcttcccgaactcgcccgcatcctcgccaacgccacccaggccggcctcgccctgcgcaccgccatcggcatggccgccgaggaactggaggccccggccggcgaggaactgggcaacgtggcccaccagctcgcgctgggcgcgtcgatggacgacgccctcggcgaactggccgaccggctgccctcgcgcgaactcgtcgtcctggtcaccaccctggtgctgtccaaccgggccggcgggcaggtggtgagcgccctgcgcaacctcaccgagaccctggaggagcgcaaggagacccgccgcgagatccgcacccagctctcccaggtcaacatgacctcgtacgccgtgcccgtgctcggcgtcggcgcgctcttcctgatgaacggcgtcaaggccggcgccctggaccgcatgacgggctcaccgctcggccaggccgccgtgatcaccgccttcgcgctgtacgccgtcggcttcttcctcatccgccggatgtcccgcatcgacgtctgacggcagagtcaggggagcagaggagaggatcgacgatggcatggctgctcgcactcgtgatgggcctcggggtctggggcgccttcgccggcatccgcatgtaccgcgcggacgcccggctccccagcgacctcgcgctcgccctggaggtcggctccacccgcaccggcgcggtgggctcgctcatcgaccgcatgggcatgcgctacgcccccgccgtactgcgtctgatgggccccaagctggtcgccaggtaccgccgcaagatcgacctggccggcaaccccggcggcctgaccatcgaccgctacgcggcccgccgggcggtgtacggctt

SEQ ID NO: 897 - DNA, 931 bp, Unknown
  Kingdom: Bacteria, Phylum: Actinobacteria, Class: Actinobacteria, Order: Streptomycetales, Family: Streptomycetaceae, Genus: Streptomyces
cccccaccctcgaccccctctcctccctggccaaaggctgtgccgacgccgcctcctggaccgtcaaggagctgagcaaggccgtgaaggagaccgccaccgtcgacttcaccaacccgaagttcctccagcagtacgccatcgtcttcgcggcctccgccatcctcacgctcctgctgtggctgctggccgtcgccaagcgggccgtgcgcggcgtgccgctgtccaccgcgctctcggaagccgtcggtttcctctggctgaccgtgctcgcctccgccttcaccccgctgatcctctacacggtcgtctccgcgaccgacagcgtcagcgacgtcctcgccaaggccaccggcgatcagaccggcacgttcttcggcacgttcgccggcgcgctggacaagggcacgagcatcggcggcggcccgatcatgctgatcctggtgtcgctggtctcgatcctcgccgccggcgtgctctacctggagctgttcctgcgcgcgatcctgctctacgtcggcgccctgctcggcgtcgtcgtctactccgggctcgtcgacaagaacctgtggggccacgtccgccgctgggcgggcatcatgatctccgtgatcctggtcaagccggtgatcgtcatcgtgctcggcctcgccagcgcgctctcctcggacgacggccccgacgcgctcgccgccgtcgtctccgggctcgccatcatcctgctcgcgatcttcgccagcgcgatgatctaccgcttcgtgcccggcttcggcgacgagatcgccgccggccgcaacaaccgcatcatgcagggcgccgaaggcaaggccgcggccgtcatcagctccccggcgaccctggtcgcccagggcatcaagacccacagcacccgcgccgacagcaacggcggggcgggtgctgtgggtcttga

SEQ ID NO: 898 - DNA, 1893 bp, Unknown
  Kingdom: Bacteria, Phylum: Actinobacteria, Class: Actinobacteria, Order: Streptomycetales, Family: Streptomycetaceae, Genus: Streptomyces
gttccggccgcgctggggccggtcggggccctggccgccgccgcggccggaaccgcgctcgcgggcccagcgggccagctgggccacccgcttgaccacgaactgggtgtcgaggatgccgaggagcccggcgagctggacggcgacctcgtgctgggcgccgctgttcttgatccgggcgacgaccggcgcggcctcgtccagcgcggcggcgcggccggccggggtgtccaggtcgtagcgggcgacgatctggcgcagcgcgaactcgaagagcggggtgcgcggctgcaccaggtcggtgacggcctcgtcgcccttggccaggcgcagctcgcaggggtccatgccgtcgggggcgacggcgatgtacgtctcggcggcgaacttctggtcgtcctcgaaggcgcgcagcgcggccttctggccggccgcgtcgccgtcgaaggtgaagatgacccgtgcgctgccgttgtccatgagcagccggcgcaggatcttgatgtggtcgccgccgaaggcggtgccgcaggtcgcgatggcggtggtgacaccggcgaggtggcaggccatgacgtcggtgtagccctcgaccacgaccgcccgggagaccttcgcgatctccttcttcgccaggtcgatgccgtacaggacctgggacttcttgtagatcggcgtctcgggcgtgttcaggtacttcgggccggtgtccgcctcgtagagcttgcgggcgccgaagcccaccacctcgccgccgatgtcgcggatcggccacatcagccggccgcggaagcggtcgatggggccgcggcggccctcctgggcgaggccggacaggagcagttccttgtcggtgaagcccttgccgcgcaggaagcggatgaggtggtcccagccctgcgggctgtagccgacgccgaagtggagcgcggcggcctggtcgaagccgcgctcggcgaggaagacgcggccggtctcggcctcggcgctgctcgcgagctgttcggcgtaccagtcggcggccagtttgtgcgcctcgaccaggcggatgcgctcgccgcgctggtgggcggggttgtagccgccctcctcgtagcgcagggtgatgccggcctgggcggccaggcgctcgaccgcctcggagaaggtgaggtggtcgaccttcatcacgaacgtgatggtgtcgccgccctcctggcagccgaagcagtggaagagtcccttgctcgggctgacctggaaggacggcgacttctcgtcgtggaacgggcacaggcccttgaggttgccgccgcccgcgcctcgcagctggaggtactcggacaccacggcgtcgatcgggaccgcgtcccgtaccgccttcacgtcctcgtcgttgatccgtcctgccacgcgtgaattctacgggggcggtcggacatccccgtgcctcaggaggcgagggtgtccagcggcacgtgcgggtcggccagcgcctccgtgtccacctgcgccttcgtgcggatcaggtgctggatcgggtccgtgacgtcccacacgttgacgttcatcccggccaggacgcggccctccttcacccagaacgcgatgaactcgcgcttgcccgcgtcgccgcggatcaccacctggtcgtacgagcccggcggcgcccagccgctgtactccatcccgaggtcgtactggtcggagaagaagtagggcacgcggtcgtagctgatgtcctggccgagcatcgcgcgggccgcggccgggccgccgttgagggcgttggcccagtgctcgacgcgcagccgggtcccgaagagggcgtgcgggaaggcggccacgtcaccggcggcgaagatgtcggggtcggcggtgcgcagccgttcgtcgacgacgatgccgccgccg

SEQ ID NO: 899 - DNA, 2059 bp, Unknown
  Kingdom: Bacteria, Phylum: Actinobacteria, Class: Actinobacteria, Order: Streptomycetales, Family: Streptomycetaceae, Genus: Streptomyces
agcttgtcgtttaacgttcggctgcttcggcatcggaggccaccgatgtccggaggatgcgtagccatcgttggcagacttcatgggtgacgggttcgaacagctcgggggtcgagatttcgacgaggaactgggtcagcaggtcctggtgcccttcatcaacgtgcacctggtcctcgaagtgcacggcctgtgcccagtccacgagctggccggggctggcgagcccagtggtgaccctttctgcggcagcaacggcgtggccacgacggaacgtgacagccgataccggttcgccgtgccgggcatttctaatgagtccagagagctcaccgttccaccgcacgaggtcttcaaggggtcggcttccgttcgcgtccatgttgcccatcctgcttgaccgcatggtcatcgggcagtgacagtcgccggtcagctcggaacgggagtgacacggcggggtttcgtgccgactttgtggtgggcgggtcggctgaacgcttcgccggtggcaaggactctgcccacgtcgtgacgggtggctgggcggcgattcttcgagcccggtggcctgcctggcccgggccgggacggtttcggtgcgccggctggagacccggtcttcgcgtgcaggtttctgaaccctctgcggacgcgggcgggtgtcagtctgttcggctccgtcggcttctcccagggccgccgcaggtccgtggccagtggacgggcgagccggagctgggcataggcggcgatcaccagccaggtccaccggtcggccgcctcggagctgcgaagacggggcttggtccatccgagtgtctgcttgaacaggcggaacgtgtgctccaggtcgaagcggcggaggaaggactgccagcagcggttcacgtcgtccgaggtggcgccggtgcccgaccaccacagccagaccggcttgttgaccccgccgctgggcagcttctccacgatcagccggatgacggtgccctcgatgatgggcagcgggccgtcgtggtcgagccatgcggcccggcgggtgagccgcgggtgcagtcggtcccacgcctgcgcggtcgccttcccataaagccgggtgtccgtggtcgtcacggcctgttccgtgccccaggtgctggggtccccaaagacgaactcgccgccgtgcttgggcggtcggccgcctttggggtcgtagactcgcggcggcgttggccagcgcatgacgcgatcggagcggagccggccgaggatctcgacgggcaggccgttcagcaggtgggcgatgcgcggggcgtcgtatccggcgtccagcacgaccaggacctccgggtcgcccggcttccactggccggcggcgacgagccgctcgacgacctcgcggatctggacggtggtgaccgcggcgacatcgccaccgggctccaggcggaccgcgtccagcaccgccgtccaggacgtgcggccggtctccagggccgccaccaccgagtacggccagccgggcaccatctggtgtttcccctcgccacggccgaacgtgtggcaaaatgcccggtcagcacaggtattggcatctggtcgcagccacggtgagacatccacggccagcacaagtcggccgtccgcagccctcggcagtggcatgccggccaaggcgcgacgcagccgtgcgacatcgatccgcccctggttgagcccgccgtacagagctccgtgcccacggcggtgttcgggcgcgagcgcaagatcgaccagcgtccgtacgggcccgtccgtgcacaacagcgcgtcgcataactcgaacaacgcgtcgccccgcgcggtcagacacgcgtacaactccgaccggaagtgtgacacttccgcgaacgcatcccgcaggacgccctgacgtaccagactcacgaccacggccttcgcgctgttcctatgcctctgtgacggagcacaggatcagacagaggccgcctacgtgtccgctgaactgcgaaaacgccgatcaagttcgagtcgcgttcgacgccggaccataaatgacaaggtgagtgcctgtttc

SEQ ID NO: 900 - DNA, 5042 bp, Unknown
  Kingdom: Bacteria, Phylum: Actinobacteria, Class: Actinobacteria, Order: Streptomycetales, Family: Streptomycetaceae, Genus: Streptomyces
ccgtcggggcatggctgagggcggtgctgcggccggtgcgcgccggcgtggtgtcggccaaccggtacttgtggtacttgcgcgatccggtgcgcttccccgacggtcgcctcggtctctacgaccgtctcctgccgcctccgggcacctcccccggcgtggtggtgctgccgctgctgggccccgaggcgaaggtcgtgctgatcgagcactaccggcacgccacgcgggagcggcactgggaggcggtgcgcggcttcggggacccgggcgccacgggtgaggagaacgtgcggcgggagctgcgggaggagatcgccgcgagccccaccgaggtgatcccgctcggcgtgctccacccggacaccggactgctcgcccacaaggtggagttgtacgccgcccgcgtggacggcgtcggcgctccggagcgcggtgaggcgatccggcgggtcctgaccgtgtccgtgaccgaggcggagaccatggtggccgacgggcggatcaccgacagcttcaccatcgccgcgctctaccgggcgcggctggccgggttgttggacaaggcgccggggcacggcgacgacgcgacctgacgacggtacctgacgacgtgtcggtgggccgggcgggcgggagcggcatccctcgtccgccgctcgttttggccccacacccttctgatcaataagatccgccgatgatcacaagacaacggctggcggcaggagtctgtgctctgctcgccgccctgacggccgggatggcctttcccgccggtgcggtcgccgatgagccggacggcacggccgcgccgaaggtcgaactcgtcctggacgtcagcggttccatgcgcacgcgggacatagacggcgggtcgcggatggccgcggccaagcaggcgttcaacgaggtgctcgacgccactcccgaggaggtccagctcggcatccggaccctcggcgccaactaccgtggcgatgaccgcaagacgggctgcaaggacaccgcgcagctctacccggtcggcccgctgaaccgcaccgaggccaagacggcggtggccacgctcgcgccgaccggctggaccccgatcggtcccgcgctgcagaaggcggcggccgacctcaagggcggtgacggcacccgccgcatcgtcctgatcagcgacggcgaggacacctgccagccgctggacccgtgcgaggtggcgcgcgagatcgcggcccagggcatcggcctgaccatcgacaccctcggtctggtgccggacgccaagacccgcgaccagctcagctgcatcgcggacgcgaccggcggcacgtacacctccgtacggcacaaggaagaactctccgaccgcgtcggccagttggtcgaccgggccgccgatccggtggtgacgccggtcgccaccgagggcgcggccgactgcgccaaggcgccggcgctgaagtccggcctgtacaccgaccgtgaggagttcgggcagcagcgctggtaccgggtggacgtgaacccgggccaggagctgcgggcggcggtcagcgtcgccgacgaccgtaccgtgcgcccggactacggcgtactgctgcgggcggtgaccctgcacggccgggagatcgtgcgcggtgaggcggccggcaccggccgcacggacgtcgtctccaccggtctgcgctacccgaaggcgaagagcgacgacgacaacgccccggcggagacggtgtgcctgcaggtcaccaactccttcgcggcggcggacggcgtcaagaccacgccgggtctgccgctggagctgaccgtcgacgtcgtggacggcccgggcaaggcgagtgacgtggcggcgttcggactgggccgcggctggtggctgctcggtgtcctggtgctggtcggcttcctcgccggactggtctggggctggctgtcgcgctggcgcgtggcgatctggaggaccaactgatgcgtctcacccgtgtgttcagcgccgcgctgctcttgctggggctggcggcggcccccgcggcggccgacacctcaccctcgccgagcccttccggcgacagcaaggccccgtcccaggcgggcacgtcgttccgtacggcgacggagatcgagcaggggcagcaggccaccgcgagcggttccaccggtgactacctgtactggtcgttcccggcggacgccgggcagcggcccaccgtccacgccacggtgaagctgccggaccagcacaccacgcagacctggcagatcgacgtgtacgacggtctgcggcgccgccagtcctgccagtacggcgcccagacgcgcaccgccgagtccggcacgtcctccgtggagctggcctgcgtcctgcgcacggtccgcgcatggtcggagccgtgggccaacgacccgctgcccggcacgtactacgtccggctcacggtggtcggcctgaactccggcgacctgggtctgccggtgagcgccgaggtgaaggtggactccaagcacatcggcggcgcggcggcggtggacggttcgctggcgaagccgctggtgccgggtatcgcggtcaagtcgcaggaagaaggcggcggttcgggcagcggtgatggttcggcgagcaagaagccggccgtactgtcgagcatcgagcccgacgacggctggtcctcgggctggtggtccgaccggtgggtgtggaccgggatcggcgcggtgctggccgcgctggcgggcatcggcgggtacgcgctgacccgtggctccggacggccgtcacgggtgccgccgggcgcctgaccacccgtcagccagtgactcgagaaaggcccgtccctccccgggggcgggcctttcttcggtcacgtctcgcgcagggtcttggtgagcggaccgtcgccggtgaccgtcacacggccgtcccgcaccgcgtccgcgaggtccagctcgccgcgcgcgatcgccgtgcaggccggggagtcgagggtgagccgggcgtcgggttcgcggggagcgggcccgtcaccgtacgggccctcctgctcaccgccggcgtacagatggaagacgccttcctccagcagcacctcgacgagaccgtccccctccagcgcgcgcagcagcggcagcgcgaaccagtgcgcgcgtacggcgtcggtgggccgcggctcgcccagttcggcctgtccccactcgcccagcgcctgcagcacgggcagcaagtcgcgtccgcgcgaggtgagttcgtagacgtggacggcgccgggcgggggcagccggcgccggctcgccaggccgtcccgttccatgtccctgagccgcgaggcgaggacgtcggtgctcactcccggcagatcggcgtgcagatccgtgtagcggcggggaccggccagcagttcccgcacgatcagcagggtccagcggtcgccgacggcgtcgagcgcgcgggcggcggaacagtactggtcgtagcttcggcgaggtgacatgcgacgcagtctagacaagttgttggactttccaagctcacacttggtaaaaccaagcatcaccacgaaccggaggggcgcatggagttccggcagtcgagcaagctcaacgaggtctgttacgagatccgcggcccggtgatcgagcacgccaacgcgctggaggaggcgggccacagcgtgctgcgcctgaacaccggcaacccggcgctcttcggcttcgaggcgccggaggagatcgtccaggacatgatccggatgctcccgcaggcgcatggctacacggactcgcgcggtgtcctctccgcccgccgggcggtcgcccagcgttaccaggagcggggcctggaggtcggcgtcgacgacgtcttcctcggcaacggcgtctcggaactgatctccatggccgtccaggccctgctggaggacggcgacgaggtcctgatccccgcgccggactaccccctctggacggccgtgacgacgctggccggcggcaaggcggtccactacctgtgcgacgagcaggccgactggtacccggacctggacgacatggcgtcgaagatcaccgaccgcacgaaggcggtggtgatcatcaacccgaacaacccgacaggcgccgtctacccgaaggaggtcctggaaggcatcctcgacctcgcccgcaggcacggcctgatggtgttcgccgacgagatctacgaccagatcctctacgacgacgccgtgcaccactcgacggccgcgctcgcgcccgacctggtggtcctgacgttctgcggcctgtcgaagacctaccgcgtggcgggcttccgctccggctggctggtcgtgaccggcccccggcagcacgcgaaggactacctggagggcctgaccatgctggcctccatgcgcctgtgccccaacgcgcccgcgcagtacgccatccaggccgcgctcggcggccgccagtccatccgcgaactgaccgtgcccggcggcaggttgcacgagcagcgcaacatcgcctgggagaagctcaacgagatccccggcgtctcctgcgtcagacccaagggcgcgctgtacgccttcgcgcgcctcgacccggccgtccacaagatccacgacgacgagaagttcgtcctggacctcctcctgcgcgaaaagatccagatcgtccagggcaccggcttcaactggcccacccccgaccacttccgcatcctcacgctcccgcacgcggacgtcctggacacggcgatcagcaggatcggccggttcctgggcgggtaccggcagtaggtcccgagacctgctcagcaggacggacccgcggccggccaaggagtacgacagagcaggcagcggaaccgtgcggcgctacggtctcgggaccgggcggaagggggcggcaggaaccaccgcgcctcaggtggcccggcgcctgccaagaccggatcctgacagcccgctctcccgcaggggagttgactgagcgccctgcggcgggccggtgggaaatggggtgcgccccgaggcgacggccccgcctgcgtcgaggtcgcccacgcc

SEQ ID NO: 901 - DNA, 2307 bp, Unknown
  Kingdom: Bacteria, Phylum: Actinobacteria, Class: Actinobacteria, Order: Streptomycetales, Family: Streptomycetaceae, Genus: Streptomyces
gccacccgggcggccgacccgcctccggtcgcgcgcgacggcctggaggacgtcgcccggcgcgccggactgcgtccggacggctccggacgcgtcgcatgcccgttcgggtacgccgatctggacagcgcggtgcgcggcatgctcgccacggggctgttcgacgcgacgatcgaggccgtcgggcccgaccaggtcgacaaggagctgaccgaggccctgcacgcccaccagcggcgcgacggcacggtgtggatgcccaacgtgttccgctacctgatcgcacggacgccgtgacacgcacgccgcggcacggacgccgtagcccggatgccatgagacgcacgccgtagcacggatgccgtagcacggctgccttgagacgcacgccgtggaacggacgccgtaggaccgggccgcctcactccacctccgactccaggtccttcttcaggcgggtgatgccggcgacccggtaggcgtcggcctcctccagcgtctcgttctccagcagggcttcggccagcgcgtccagctgcgggcggtggtcgcgcagtttgcggcaggcctcgtcgtagcactcgtcgacgatgcgccgcatctcggtgtcgatggcgtccagggtctgcggcgcggcggagagcccgtaggcctgctgggcgtcgttgggcagggcggacaggcggcccaggtgctcgctcatcccccagcgggccaccatcccgcgcgcgatgttggtgacctgctccaggtcgctctccgaaccggtcgtgatgacgtcgtagacgacgtgctcggccgccatgccgccgagcgcgccgatgatccggccgcgcaggtactcctccgtgtacgcgtacttgtccgattccggcgtggacagggtcacgccgagcgcacgcccgcgcgggacgatggtgatcttgcggaccgggtcggcgccgggctggagcatgccgagcagggcgtggccgctctcgtggtaggcggtgcgccggcgttcctcctcgggcatcacgagggcgcgctcggcgccgagctggaccttctccagcgcctcggagaagtcggcctgcgtcacctcgcgctggcgccgcttgaccgcgagcagggcggcctcgttggcgaggttggccagttccgcgccggtcatgcccggagtcgtacgggccacccgggtcaggtccacaccggcggcgagcgggatctcccgggtgtggatgcgcaggatggcctcccggccgccgcggtcgggaggcgcgacgctcaccacccggtcgaaccggccggggcgggtgagggccgggtccaggacgtcggcgcggttggtcgcggccagcacgatcacgccctcggaaccggagaagccgtccatctcggtcaggatctggttcagggtctgttcgcgctcgtcgtggccgcccatcgacgcaccgccgccgcgtgcccggccgatggtgtcgatctcgtcgatgaagacgatcgagggggccaccttgcgcgcctccgcgaacagctcccgcacccgggaggcgccgacacccacgatcatctcgatgaactcggaggcggaggcggagaagaagggcacacccgcctcaccggcgacggcccgcgcgagcagggtcttgccggtgccgggcggcccggtgagcagcacgccgcggggcatcttggcgcccatccggcggtagtcgtcggggtgtttgaggaagtcgacgacgtcgtccagttcgcccttgacctcgtcgatgccggccacgtcggcgaaggtcgtgcgctgggtacccggctgcagctcgaccgggcgcggcggcgtcttgcggcccagcaggccgccgggaccgccgaggcccgagccgatccggcgcgcgaagaagatccacagtgcggcgatgaccacgatcggcgccagcgacagcagcaggttggacaggaacccgcgctcctggacgacgggctgcgcggtcacggtcacgtggtggctggtgaggctctgccagagccggtcgccggcgaaggaggggcgctgggtcttgaacttggtgtacgtgccgtggccgctcggcctggtctgggcactcttgagctggccctggatcgcgtcgcccttggcgtagatcttgctgacgtgacccgcgtcgacctgcctgctgaactccgtgtacgagatggtcggctcgttgccggtgctgtagtagctcagcccgccgtacgccaggaagaagacgatcaccgcggtgacgagcagcccccaccaccggccgcgcgtgcgcctgccgccgggccgccggggcggctcgtccg

SEQ ID NO: 902 - DNA, 2116 bp, Unknown
  Kingdom: Bacteria, Phylum: Actinobacteria, Class: Actinobacteria, Order: Streptomycetales, Family: Streptomycetaceae, Genus: Streptomyces
ggcggctcgtccggcgtgccctcggtgcgccacggctggtcaggggccttgcgtggtggcgcggcattgctcatatctggacgttacggcactcggcgggcaccggcacgcgctgagggcgcccccgggagaccgggggcgccctcagcggcgtacgaccgccgcggcggggccgcggtggccgtcagcccatgaacttcttgaactcgtccggcagctcgaagtcctggccgccctgctgcggcaggccgagggcgccgccgccctgggccgcggcggcgcggcgcgcggcctcctcctgctcctgctgcttgcgcttcatcgggttgcccgagcgctgcttgcccttggccttcttgggctgcttcttgctgcggccggggccgccgcccatgcccgggatccccggcataccgggcatgccgccgccctgggccatgcgggacatcatcttgcgggcctcgaagaaccgctccaccaggttcttcacggcgctgacctcgacaccggaacccttggcgatacgggcgcggcgcgagccgttgatgatcgtcgggtcctggcgctcgcccggggtcatcgacttgatgatcgcggcggtgcggtcgacgtcacgctcgtcgaggttgttgatctggtccttgatctgccccatgccgggcagcatcccgagcagcttgctgatgctgcccatcttcctgacctgctccatctgggacaggaagtcgtcaagggtgaagtcctggcccttcttcgacgccagcttggaggccattttctcggcctcttcctggctgaacgtcttctccgcctgctcgatcagggtgagcaggtcacccatgtcgaggatgcgggaggccatccggtccgggtggaaggcgtcgaagtcgtcgagcttctcaccgttggacgcgaacatgatcggcttgccggtgacctgccggatcgacagggccgcaccaccgcgggcgtcaccgtcgagcttggagagcaccacgccgtcgaagccgacgccgtcgcggaaggcctccgcggtgttcacggcgtcctggccgatcatcgcgtcgacgacgaagaggatctcgtcgggccgcaccgcgtcccggatgtccgcggcctgctgcatcatgtcggcgtcgatgccgaggcggccggcggtgtccacgatcacgatgtcgtggaccttggccttcgcgaagtcgatggagtcctgggcgaccttgaccgggtcgcccacgccgttgcccggctccggggcgtagaccgcgacgccggcgcgctcggcgacgacgctgagctggttgacggcgttcggccgctggaggtcgcaggcgaccagcagcggcgagtggccctgctccttgagccaccggccgagcttgcccgcgagagtcgtcttaccggcaccctgcagaccggccagcatgatgaccgtcggcggctgcttggcgaagcggaggcggcgggtctcgccgccgaggatggtgaccagctcgtcgttgacgatcttcaggacctgctgggccgggttgagggcccgggagacctcggcgccgagggaacgctccttgacgttcttgatgaacgcccggacgaccgggagggccacgtccgcttcgaggagggcgatgcggatctcgcgcgcggtggcgtcgatgtccgcttcgctcaagcgccccttgccgcgcaggttcttgaaggtcgctgagaggcgatcggagagagtatcgaacacggcggcgtcggtcctcggagtcgggagcagtctgagcgccttccagggtatccggccgcgcaagacaatcgcccccacccgtgaggtttcagcgggcggccccgtcgggttcagcgggcggggacgggaccccgcagcgcctcctccaccgtccggaccgcgcaggccgcctcctccggcgggagcgggtcgcctgccgggccggtgacgtagaacgcgtccaccgcattggagcccagcgtgctcacgtgcatgctccgcacgcgcacctcggccccctccagcgcccgcccgatgcggaacagcaggcccggggcgtcctgggcgcggacctcgatcaccgtggcgtgccgggaggcggcgggggcgagggtcacgcgg

SEQ ID NO: 903 - DNA, 4285 bp, Unknown
  Kingdom: Bacteria, Phylum: Actinobacteria, Class: Actinobacteria, Order: Streptomycetales, Family: Streptomycetaceae, Genus: Streptomyces
gtctcccggcggggtggcgggagcggcggccgtcgggtccgcggtcgcgaccgggcggcgcgtgctgccggacgggccggccgcaccggacacctccgccggtgcgccgggggcgggagcgggcatcgagcggtacctgcgcgcgccgaggaaccggtagagcaccgccggtacgaccaggcccacgatccacgagatgtccgcgccgcccagcgggccgacgaaggggccggtgtagaagctggtggacaggaacgggaactgggcggcgattccgatgccgtagacgagcagggcctcccagcgccagccgccgtagcggccgtgcgggtcggacagcgcgggcaggtcgtagcgttccttggagatgaggtagtagtccaccaggttgatggccgaccacggggtgaagaacgtcagcaggaagagcaggaagtcggcgaaggagtccaggaaggagttccgtccggcgagcgcgacggccgtgcccgcgaccatgatggccgcgatgtaggccgtacggccgcgctgcgacaggacccgctggccgcggaaaccgctcacgctggtcacgatggacatgaacccgccgtaggtgttgagcacgttgacggtgagcttgcccagcgcgatgacgaagaagaggaaggaggcgatcacgcccgtgccgcccaggctcacgacatagccgacctggtcgtcgaggaaggccgtgcccgcggtcgccgcgaccaggacgccgaaggccatggaccactgcgcgcccagcacggtgccggcgagcgtccagccgaaggtcgcccggggcgaggtcgtccgcggcaggtaacgcgagtagtccgccacgtacgggccgaaggccagctgccaggacgccgacagggacatcgccagcaggaacatcggcagcgcgaagtggtgctggtgggcgacgtgcccgaggtcgatccggctcaggagcctgccgcccaggtagaggaagctgagcgcgcacaccacgctggccacccggcccagcgcgtggatgacgcggtagccgacggtcgccatcaccgcggtgaccagggcgaagaggatgatgccgggcaccgggccgagatgggtcagtttgccgacggcctggccggcgagcaccgacccactggcgaagaagccgacgtacatcaccacgacgagggccagcggcacgaccgctccgcgcaccccgaactgggctcgcgaggagatcatctgcggcaggccgagccggggcccctgggccgagtgcagggccatgaccgcgccgccgagcaggttgcccgccagcaggccgatcagcgaccagatcacgtcgccgccgaggaccacggcgaggccgccggtgacgacggtggtgatctggaggttggcccccagccagagggtgaactgcgagaacgccgtcccgtggcgctcctcgtccggaacgacgtcgatggaacgtcgttccacaattgcctgggccatgtaatgctccgtcctggtaggcgctggacgatgccgcttggccgggcgagcgctcggaccggctgcatatgactatgcagactatggggtgatgaatggattgccaatagtctgcaggcagatcggtcgagtcggtgaccgcggcggccggctgaccggcgcggcgatcgtcaccccgctcgtccgccggaggcctggtcggccccccgggagcgggggcggatgcggacgcggacgcggacgcggtgatgcgggcgaccgcctccgcggtcagcgccctgtcgtgcggtgcggtgtccagcgcgggatggatggacaggccctcgatgagcgcgtcgaactggcggaccatcacggggtcgaagtgccgccccagggcccggcggttcccctccgtccaggcgcgggtcagctcccggtaggcgggctgccgggcggcgagggtgtacagctcgtgggcgagcaccacctcccgccggtcaccctccgagacccggtgcaccaggtcggtgaccgccgccctggccccgtcggcggtgccggccgcgccgaggtgctcctcgaagagggcgaccgccctggcggtgaagccggtgaacgcctcgcgcacccagttcgtccatgttctggaagtggtacgtcatcgacccgagggggacgccggcacgggccgcgaccttgcggtgcgaggtgccggcgactccctcctcggcgatgaggtcgagcgcggcggcgacgatgcgctcgcgccgcccggagtcggcctgtccggtcgccacggggcctcctagagtgcgcggatcacccgggcggggttgccgacggcgaccacgccggccgggacgtccttggtgaccacggcaccggcgccgacgacgctgtcgtcgccgatggtcactccgggcagcacgatcacgccgccgccgagccagacgttgtcgccgatcatgatcgggcgggccgcctccagcttgtctcggcgcggctgcggctccagggggtggacgggggtgagcaactggacgttcggcccgatctggcagtcctcgccgatcgtgatgggcgcgacgtcgagggcggtgaggttgtggttgacgaaggtccgcgcgccgacggtgatgtggctgccgtagtcgacgcagagcggcggccggacgtgggcgccggggccgaggccgccgagcagttcctcgatgatcgggcgggccgcctcgatgtcctcggcgtaggcggcccggtacgccgccgtcaggcgtacggcgcgctgtgcctggcgggccagctccgggtcgtcggcgatgtagaggtcgcccgcgagcatccgctcgcggttcgtacgggggtcgtcggcgaagcagtccatgcggacgaccgtacgttcgtacgcacaaggccggcgggcgcgttcgtggggacgctcacgccgccggcccgcgggtcagtcgccgccgcaggacgcgcgcactttcagctcggggagcagttcgacccggtggaccgggagggacgcgccatggcgcagccgccgcaggaggaggtcgacagccgcggcgccgacggccctcttgggcggggccacggcggtcagcggcggtgcgccgagggccgcgaagacgtcgtcgtagctgatcagcgcgagatcctcggggacggacaggccccgtgcccgcagcagcgccgggagctggatggcgtcctggtcgttgtgcacgagcgcggcccgcacgcccttctccacgccctcggcgagcctccggctcacctcctggggagccgtggcggggtcgtcgatgtcgatcaccggctgcggtgtcagctccagcgactcgcacgcctcggcgtagccgctgcgcaccttcagcgcggtccaggtgtcgcgccgggcggcgaggacgaccgtctcgtggcccagctcggccaggtggcgcagggcgagcagcactccgtggtggtggtcggagctgaccgagtccagttccgcggcgggcgtgccggcggcggcacggcgttccaccagcacggtcggtacgggcagttcgtggagccagcgccggtcctgcgggtcgttcgtggacatccagttgggcgtgagcatgagcccttcggcgcccgatctgagcagttgttccgcctgaccccggtccgcgcccgggtcgtaggaggagatgccgagcaccagatgcgctccggcgtcggcggcggcggcacgggccccggcgatcacttcgtcgaagtactgactgaccgtgtggctcaccgtggggacgatcaggcccagggtgcgggcatcgaccggcacgccgaagcgctcctccggaatggacaccgagccgtgcgcgcggcgcagcaggccggcttcggcgagggccgcggcatcacggcgcacggtgaccgccggcaggtccagacgggccgcgaggtccgtcacccggaccgtgccgagcttgcgcacgatctcgaggatccgcgtccggcgctcgtccgccgcgatcgacatggcggtccctttctccgtggtccgactgccctcgcagaatatcattcgatccacgattgatctactgctcagcctgagcccctaatcattcattagatcgatttctgatcgatattcgatcgcctggtccattcgtattgactcggtcaggtgacgctcctagcttctgggcccccgaccaacgcaggagaagccccttcatgagccacttcatgagcaccttcacgagcgttctcacgagcaggagatccttcggtacgggtctcgcggcggccacgttgaccgccgcgagacccgtaccga

SEQ ID NO: 904 - DNA, 1596 bp, Unknown
  Kingdom: Bacteria, Phylum: Actinobacteria, Class: Actinobacteria, Order: Streptomycetales, Family: Streptomycetaceae, Genus: Streptomyces
cccggcccaccgatgcgagagggacacagaaaccatgacgacaacacccgaaaccctcctcgacgacctgcgaccgcgcatccgcagggccgagcggatgctcatcggcgacgactgggtcgaggcgagcaccggcgagaccctggcggtgcacgatccgtcgaccggcgaggtcgtcgcgcatgctccggccgggggcaccgtggacgtggaccgcgcggtgtccgcggcgcgtgcggcgctgaacggtccgtggcgcgtgatcacgccgcaggagcggggcaggctgctgtggcggctggccgaactcgtcgaggcccacgccggggaactggccgccctggaggcactggacgtcgggatgcccgtcaacgaggcgcgcttcgtcgacgtcccgttctcggtggacatcctgcgctactacgccggctggcccacgaagatcaccggtgacacgatcccggtgtccttcccggcgaacttcggcgggccgtaccacgcctacacgcgccgcgagcccgtcggcgtggtgggcgcgatcgtcccgtggaacctgccgctgatgatggtggtcaagaagctcgcaccggccctggcgacgggaaacaccatcgtcgtcaagcccgccgagcagactccgctctccatcgcacggctcggcgagctcgtcctggaggcgggcatccccgaaggcgtgttcaactacgtctgcggctacggtgagaccgccggtgcggcgctggtcgagcacccgggcgtcaacaagatcaccttcacggggtcggtggccaccggaaaggcgatcgcgcgggccgcgaccggtacgctcaagcgggtctccctggagctgggtgggaagtcgcccaacgtggtcttcggcgacgcggacctggacgcggcgatcgcgtcgtccgcggtggcggtcttcgcctgtcaaggggagagctgcgtcgccggctcccgcctgtacgcccagcgcggcgtcttcgacgacgtcgtcgcgggccttgccgaccgggcccggaacacaaggctcggacccggactcgaccccgccaccgagatggggccgatgatctccgccgagcaccgggagaaggtcctcggctacatcgatctcggacgggccgaaggcgtcgacatcgtggccggtggcgcggcctggggcgagcagggttacttcgtccggcccaccgtgctgacgaacgtggacccggcctcccgcatcgcgcgtgaggagatcttcgggccggtgctgtcggtgttccccttcgacaccgaggaggaggtcctgcgactggccaacgacaccgacttcgggctgggcgccggtgtgtggaccagggacgtgagccgtgcgcacaggttcgcggccgcactcgaatccggccaggtctgggtgaactgctatcaggccgtcgacgcagccctgccgttcggcgggtacaagcagtccgggtggggacgggagacctgcaaggagaacctggacgagtacctggaactgaagaccgtcgtggtctcgctctgaggtgccggccgtaccgccgacgacgccgacgacgcagtcgtctgtggacactgccggcgcctcag

SEQ ID NO: 905 - DNA, 2980 bp, Unknown
  Kingdom: Bacteria, Phylum: Actinobacteria, Class: Actinobacteria, Order: Streptomycetales, Family: Streptomycetaceae, Genus: Streptomyces
ctatcacgcaccaactcgtaaagctgcccgcagatgcccatacgttggaaattgcagacagcttcagaggcatgcatgcggctggcccgcacacagacgccgtgggattcccacgtcgcctggcaggcgcggaagcaatcacggcttcttgtcatacggcgcctgtttccgcaggtcagcgcttgtttccccgcggcttcaagggcgcgttcggcagctctggcgcgggcagcggagcgccgtcgtagccctgcacctcgccgaaacgggttctctttatccagtcctcgcgagcctgtacgatctcgtcgtacgaccgtccgatgaagttccaccacatgacgatctcttcgcggaacggcggtccgcccagcagcaccagtctcgctgcccggtgggcgctgttcgtcagggtgagggcggtacggcccggcgccgcgtagccgaggtcggccggcctcaggacggtgccgccgagaaggatctcacccgtgtcgacgagtacaccgtgctcgaactcggggtcgacgtcgagggtgacagtggcgccgggggccacggacacctccgcccccaggagcggggtgaaggtgggcaccggcgaggagtcggcggcgagcgttccgaggaagacgcgggcctcgccgccgtccagcggcaccgcggcagggacgtagtgctggaagtccctggctgtgtcacggtgttgtgcgggcagggcgacccagagctgtacgccgtgcagggtcgtggtggtgggcgtggacacctcggagtggctgatgccgtggccgctcgtcatcaggttcagctcaccgggccggacgagcgcgagggtaccgaggctgtcccggtgctcgatctcgccgctgaagagccagctggccgtctggaggccgatgtgggggtgcggggcgacgttcatgccgccggtcgccgccacgtcgtccgggccgtagtggtcggcgaagcaccaggcgccgatcatcgtccgggcccgctggggcagcgtgcgccgcacacgcatcgcgcgggggccgcccagcggtacgtcgcgcggggcgaggacctcgatgtccgcgggcgccgctccgtcggcatcgacgccgacaccggagtcggcaccggcacccgtcccggcaccggctccggcactgatgccgcaggtgagcgcggcgggccgtgcttcggtgttgctcaccggtcggctccttcccgtccataaagttcgattttcaacattcacgggacagcatacgtgttccgtgattcagcgcccaggtgtgccccgggcgacccgcaactggggggcgtcgccgaacacccagccggcgccgcggatgtagagaatcacaggcagggtgcccgaggccccggcgagccggacgatgcgggcacggacgtgctcgaccccggtcactccgggactgccgccgcagtagtcacggcacgcgacaacacggcacggcgccggcggaaccgcgccggatttacaccggcttcctcggaccgccgtcgcctgatgtcaccgatcaccatcccctcaggcgtgtggagccttacggcccatcagtgacatcgagcgtggtcacagcctccgccgcgccaccgccccacgtccggttcagacgaccaggacccggcgcccgcgcgtgtgaccggcctggctgtcgatgtgcgccgccgcggcatcggcgagcgggtacgacttctcgaccgggatgtggagcttcccccgcgtgatgaggccgacggcctcggcgagcgcttccggcacgctgccggccacgccggagaaccggaccccgagctgcggcgcgtcgagatcggcgatggagaccaccttgcgcggatccccggtcagagcgacgagttcgcggatcacgcccgagcccgccaggtcgagcgccgcgtcgacccggccgagccgccgcacccgctcgacccagccctcgccgtacgtcgtggcgagggcgcccaggccgcgcagatagtcctggttcgcggccccggccgtgccgatcaccgtgatgccgcggtcacgggcgatctgcagcacagccgatcccactcccccggacgccccgctgaccagcaacgtctgcccgggccgcacaccgacctcgcgcaggatgcgcagcgcggtctccaccacggagggatagccggccgcctcctcgaacgtcaggccctcgggcatccgggcccaggccgacagcacggcgaactcggcgtaggtgtcggccccttcgccgaacacgtggtcgccgacctcgatcccttcgactccctcgcccacctcgtccaccaccccggaggcgtccaggccgactccggagggcagctcgatcggatgggccttgaggatctggccttcacggatcctccagtcgacggggttcacacccgccgcccgcacggcgatgcgtatccggccggggcccgcgtggggctcctcggcgtcttcgagtcgcaggacatcgggaccgccgaactcggcgaagctcactctcttcatgcggcagaccgtagcactaacggttagggttttgaaaccgttacgattttggatttgctagcatcccgtcatgacagtgccgcccggacgccgtgagcgaaaaaaggccgcgacccgccagaagatcgccgacaccgccctgcggctcttcctggaacgcgggtacgacgaggtgggcatccgtgacgtggccgccgaggccgacgtcgccgtcaccacgctcttctcccacttcgcctcgaaagaggccctggtgttcgagcaggaccagaacttcgagcagcgcctcacccaggcggtcacggaccgcgcaccgcacgagccgctcatggccgcgctccgcgccgagatccaggctctggtgcgccattgcacagcggacggcgccgcccccctctggcgcatgatcgacgcgtcgcccgccctgcggcagtacgagcagtcgatgcggctgcgccacgc

SEQ ID NO: 906 - DNA, 3532 bp, Unknown
  Kingdom: Bacteria, Phylum: Actinobacteria, Class: Actinobacteria, Order: Streptomycetales, Family: Streptomycetaceae, Genus: Streptomyces
ggctgctggccggggagaccgcggaggcggtggaggcgctgcgcggggcggcagcccggcaccgcgacaacgaggacgcccgcggcgaggcgtggacgctgtactacctggggcaggcgctggaggagaccggcggcctggaccaggcggtgcgcgagctggagagggcccgcacgatgttctcccggatgcgtgacgtctacggtctggcctgcgcccgccaccactcggcccgggtgacccgcgaccagcgggcggcgcagacgggctcgctgcgcaactccggtttcgcccgccagctcctggtcgacgcccgcgccgacttccagcgcatcggcgtggcgcacggcgaggcctggacgtgcctggagctggccgtggtcgacgcgggcaacgcccgcaccccgcaggccctcgccctgtgcgacgaggcgctggccctgttcacctcctacggcgaccggcgcggcgaggactgggcgcgcttcctgcgctgcacgctgctgccgtacgcggcgcccggcggcgtggaggtcggcacggcggtcgcgcaggaggacctgtcggcgctggcccgcgccggccacccgctgcgggaccgcaagctggagggctacgtcgaggcgtaccagctcgtcctggaacgcggcgtgagcctggaggcgggctggcaggcgtggcgcctgggcatggtcccggaccggcacgcgcgtgaggtgatgggggtggaggcggcgccggcgcggggctgaaggaggatgtgcgggcagggctgagggtgattccgcccaccggaagcggtgagcggaatcaccctcagccctgggcgccgcgcctcagccctggcaccgcgcggggctgtcttggaggggtgggccgtcagcccttggaggggtgggcccggccggtgccgcccgggcccttgccgggctggttgccgtcggcctccggggcctccttgaagtccaccttgcccatgtggcggttcatggacttcatcaggaaccacaccgccagggccatcaccgcgaagacgatgaaaccgaggacgccgggggtgaccttgttcttgtcgaactcggccagggtgaccagatgcgtcgttgccaggctcgcgcttgcgctcatgtcaggcattctccctcagggctaccggacgcccgcaaagaggtcgtcctccggcagcgaggtgtcgacgagcgacttcgccagctcgtactcctcggtcggccagacctccttctggacgtccatcggcacccggaaccagccgccgtcggggtcgatctgcgtggcgtgcgcgatcagcgccttgtcgcggatctcgaagaagtccgcgcagggcacgtgcgtggtcagcgtgcggtccttgtggccggacttctcccagcgctccagccactcgccgtagggggactccaggccgcggtcgagcagggccttgtgcagcgcctcggtgcgcgcgcggttgaagccctggttgtagtacagcttcgccggccggtacgccgggccgtactcctcctccgggtacttctcggtgtccgccgcgccctcgaacgccaccatcgagatcttgtgggtcatgatgtggtcggggtgcgggtagccgccgttctcgtcgtaggtggtgatcacctgcgggcggaaggagcggatccggcgcaccagctcgccggccgccttgtcgacgtcctccagggcgaagcagccctcgggcagcggcggcagcgggtcgccctcgggcaggccggagtcgacgaagccgagccactcctgcttgacgccgaggatctcgcgggcctcgtccatctccttcttgcgcacttcgtggatgtgctcctcgatgtacgcgtcaccctggagcttggggttgaggatggagccgcgctctccgcccgtgcaggtcaccaccagcacgtccaccccctcggacacgtacttcgccatggtggccgcgcccttgctcgactcgtcgtcgggatgcgcgtgcacggccatcagtcgcagctggtcagtcaaggctcattcctcaaggtcaagtcggtgcccggtgtcgtcgggcgttgcacggccgccgcctcggtgcctcgtcgttgcggggtggccaccgagcagcggtccggggcttctatagtgaccgaatcggggggcgaataattccggagcacggctccggagcccctcgcgggacgtccgtcccgcccctgccgagaggacgatcatgagtacggcgagcacccggctgcccgagggccgctacggccgctccccggacgaacgcgccgaccgcaaactcaagatcgccggtgccgtcctgggtgccgtcctgctcgccctgatcggctacttcgcctaccactacgtcgggcagaacaagatcagcgcccaggtcgtctcgttccaggcgtcggacggcgaggtgcagatccatctggaggtgcacaaggacgccggagcgcgcggttactgcacgctgcgctcgcaggcggccgacggcaccgaggtgggccgggccgacttccgcttcgaccagcacgcgaagcaggtcgacaaggtcctcaccctgcgtacgacggcccgcgggacgaccggcgagctgctgggctgccacgccgactgacgcggtgacgtgacgcgactgacgtgactgcggtgacgcggctgacgcgccgccgcggtgcgagtggaatacgcggtcactgacctgcgttgacgcaatttagatggcttatgtcctccccctttcgccgctgaattgttaggctcgtggtttcgcccatccatgagggaccattcttctgggtagggcgttgcttttgtattcccagtaccgacgaggagcacctgtgacccagaccagcgagaacgtcacctggctgacccaggaggcgtacaacaagctcaaggacgagcttgagtaccttactggtcctgcgcgcaccgagatcgccgccaagatcgcggccgcgcgcgaggagggcgacctgcgcgagaacggtgggtaccacgcggccaaggaggagcagggcaagcaggagctccgggtgcgccagctgacccagctcctcgagaacgcccaggtcggcgaggccccggcctccgcggacggcgcggtcgcgcccggcatggtcgtcacgatcgccttcgacggtgacgaggacgacacgctgtccttcctgctggcctcgcgcgaatacgcgagcgccgacatcgagacctactcgccgcagtcgccgctcggctccggcgtgatcggccacaaggtcggcgaggacgcggagtacgagctgccgaacggcaagaaggcctccgtgaagatcctcaaggcggagccctacaacggctgatcccgtacggcgggatcccacgccgtcctgaaacagacgccagagcccccggcgcccttcgcggagcgccgggggctctgtcgcgcccgggggcgcgtgcgctcccgtgggcggcggatcaggcgacgcccgtgcggctcaggcgatgaccgtgtaaccggcctcgcgcagggcctggccga

SEQ ID NO: 907 - DNA, 1421 bp, Unknown
  Kingdom: Bacteria, Phylum: Actinobacteria, Class: Actinobacteria, Order: Streptomycetales, Family: Streptomycetaceae, Genus: Streptomyces
gtgcggcgggtggtgcgtcggccggtggtgttcgtgacgagatcctggtcgacgcgacgaccttccccacggacgggtacatcgcacagtccgccgccaggatgaccggctgcaccctgcgtccggtggtgccgggtgaggtccccggggccctgtcctcccgtaccgccgcggtgctgctgaaccacgtcgactaccgcaccggccgcctgcacgacctgccgtccctgacggccgcggtgcacgaggcgggggcgtacgccgtctgggacctgtgccacagcgcgggcgccctgccggtcgggctggacgagcacggtgtcgacctggcggtcggctgcacgtacaagtatctcaacggcggcccggggtccccggcgttcctgtacgtccgccgcgacctgcaggaccgcttcgactccccgctgcccggctggaactcgcacgccgagcccttcggaatgcgcccggagtacgagccggcgcagggcgcgctgcggggtcgtgtcggcacgccggacatcctctccctgctcgccctggaggcctccctggacgtctgggacggggtgccgatcgaggtggtgcgggccaagtccctggcgctgacggacttcttcctggagtgcgtcgccgcgtacgtccccgccgggcgcgtggagtccgtgactccggcggcgcacggacagcgggggagccaggtcgcgctgcggtgcgcggacgccgggaccgtgatgaagcggctgatcgaacggggcgtggtcggcgacttccgccacccggacgtcctgcgcttcggcttcaccccgctctatgtcgggttcggtgacgtggaacgggcggcgcgggtgctggcggcggtgctcggcgaggccccgtaggcagcggctctccggggcgcgacccgtccgctgtcggcgggtcgcgccccggtcgggtctcgacggggtccacagggggccaccgggcccacaggggttcaccggggtccaccagggtccacctggtccaccggggttcgtcggagggcacggagtccaccgggctcggtgggcctcaccgagcgtgacatccgcgtgtcggcgcacgtcaccggcctgataccgtccccgccaacggccggacccgctcctcgccggttccttgtgttccgttcgttccgtaccgtcaattccgttccgtcgctgagaggttggagcatgccggacgccgccgcaccctgcgatgccgcagaaccggagaacaccaccggcggtgccgccgccgcgcgtgccgcggccgaggaggaggcagtcctctcccaccccgccgtcgacccggacagcaccgccgcgtacggcgaccaccccgaccaggtgatcgacttctacgccccgcgcgggccctcggcggacctcgtttccgtaccgctcgtcgtggtg

SEQ ID NO: 908 - DNA, 4616 bp, Unknown
  Kingdom: Bacteria, Phylum: Actinobacteria, Class: Actinobacteria, Order: Streptomycetales, Family: Streptomycetaceae, Genus: Streptomyces
ccggtccgcgccggcgccgcggcgcgcccgcggaggagccgcagccgcccggccggcggggacgccgcccggaaaagaagaagaagacgaggaccaggaaggtcctgatgtggaccggcggcaccatggcgttcgtcctggtcggcgtcggcaccgcgggctatctgatcttcaagcacctcgagggcaacgtcaccaccacggacgtgggcagcgcggcgaaggacggcttcagcaaggacgaggccttcaacatcctgatcatcggcaccgacaagcggaccggtaagggcaacgagggctacggcgacaagggcagcgtcggccacgcggacaccaacatcctgctgcacgtcgccaaggaccgtacgaacgcgaccgcgttgagcatcccccgcgacctgatcgtgaacgtcccggactgcccgaccaagcagcccgacggcagcaccaaggtcatcccgggctcgcaccatgtccggttcaacgagagcctgggccaggacggccgcgaccccggctgcacgatgcgcacggtcaaggaggtcacgggcgtcgccccggaccacttcatgatggccgacttcaacgcggtgaagaccctgacgtcggcggtgggcggcgtggaggtgtgcctcaagcacgccgtcgacgacccggactcgcacctgaagctgcccgccggttcgtccaagatcgagggcgagcaggcgctggcattcgtccgcacccggcacagcttcggcaaccacggcgacctggaccggatcaaggtgcagcagcagttcctcagttcgctgatgcgcaagatgtcctccagcgacaccctcaccaacccggtcaagctgtacgacctcgcggacgcggccaccaagtcgctgaccgtcgacaccggcatcggcaaggcgagcacgctcaaggacgtggcgcttgagctgaagaaggtgccgacgaagaacatcaccttcctgaccgtgccggtgcgcgacaacccggccgacggcccggtgcacaagacggtcatcgtcgatcagggccaggcgccccaggtcttccaggccatcggcggcgacgtctccttcaccgaggtgaagaagaaggagcagcaggcgaaggacgcgcaggcggcccagctcaagggcacccggtcggcggcgtccgacgtgcgggtgcgcatcctcaacggcggggccaaggacggcgccgcgcaggagaccctcacctggctgcagaaccagcagggcgtgctcaagtcggagaacggcagcaacgcgccccagaagctggacaagaccaccctggagtacgcgcccgaccaggccgaccaggcccgcgaactcgccgcgctcatggggctgccgggctccgcgctcaagccgggcaagagcgtgaccaactcccagggcctgcccgcgatgacgctgaccctgggcaaggactacaagggagcgggagtgtcactcaccgcacccgagaaggcgcccacggtggaggggcagcacacggcggacaaggttcagtgcgccagttgagcgcaccgtgtgacctgacgggcctgtcgtacgtctaacacggcgtacgacaggcctgttcgatgacatgagggcggggaggacggggagttgacgcagagcggtctgcgcggggaggggcccgcggtcgaggacacgatgcctctggcgcagcacgagaagagcgccggaggcgaacacagccgccacggttcgggcggaggcaggggcggaaacggaggcgggcgcggtcggggcagccggggcaccgacggcagaaagcccaaacggcgtgtgctgcgctggtcggccacggtgctcgcggtggtcatactcggcacggccggcgccggatatctctactacgagcacctgaacggcaacatacgcaagggcgagcgcagcagcggcgactccaaggcgcagaagacgaaggcgaacgccgacggccagacgcccgtgaacatcctgctgatcggctccgacagccgtaactccgacgccaacgtcgcactcggcggcagccgggagaaccgcggcagccctccgctcggcgacgtgcagatgctgatccacctggccgcggaccgcaagagcgccgaggtggtgagcatcccgcgcgacacccgcgtggacatccccaagtgcagggacccggagaccggcaaggagtacccggcgaccaacgccatcatcaacgagtccctggcccgcggcggcgccggctgcacgctggccacctggcagaacctcaccggtgtgtacatcgaccactggatgacgatcgacttcgcgggcgtggtcaagatggcggacgccatcggcggcgtggacgtgtgcgtgaagcagaacgtgtgggaccgctcgacggccgccgcacacggcggctccggtctgaaactgacggccggcacccacaaggtcaagggcgtgcaggccctccagtggctgcgcacccggcacgcctggggcagtgacctgctgcgggcccgggcccagcacatgtacctgaactcgatgatccgcacgctcaagagccagagcatcttcaccgacaccggccggctgctggatctggccgaggcggccacgaggtcgctgcatgtctccgaggagatcggcaccggcaagaagctgtacgacctcgccatgcagctcaagacggtccccaccgaccgcatcacgatgacgacgatgcccaacgtccaggacccgcagaaccgcgaccacgtcatccccgacggcgccaacgcccagaagatctggaagctgatccgggacgacgtggccttcgactccaacggcaaggcggaggacccgaagaaggacaccggcgagaacggggacgggggcggcgacaagagcccgcccgccacggaaccggcccaccccgacggccagatcggcgtcacggtgcagaacggcacccgcaccaccgagctggccccggtcggccaccgggcgaccgccatcagcgacgagctggtgagcaagggcttcaccaaggcgtcaccggacagcaccacggccacctcggcgtcccagacggtcgtgcgctacccgagcgccgagctgaagggcgacgccgagcgggtcgccaccgccctgggcatcccgacgacttcggtggagaagtcgacggacgtctccggtgtcacggtcgtcgtcggcgcggactggcgccagggcagcagctatccgaagcagaaggcccccaaggccggcgacatcccggagaactccgacgccatcaacggcgcggacaccaagcagtgcatggacgtgtacgcgccctaccgctggtagggacgggcctgagtaccgaagggcccctcaccgcggcgcggtgaggggcccttcgaggttgctgtcaggggccttcggggtgctgcccgtggcggctgttcagccggaagtggcgaccaccgccggccgacgcgaggcgatgaccctcttggccagggacttcgggctggtcaggaagccccagccccacgacatgtgcatggtggccagggccaccggtatccgcacacgcgcccgcagcggcaggcccttgcccgccggcagcgaacccgcggcgatcgccgccaggtagccgcccgggaccacgagggcccacggggtcacggccgcgcccaccacgatcccggccgcgatggcgcacacggcggtcggcggggcgaggtagcgcaggttgatggaaccctcgtggtagcgggcgacgacgtgccgccagcggccgtagtccttgtactgcttggcgagcgccttcacgttcggccggggccggtaggagacccgcagttcgggcgagaaccagatcaggccgcccgcctcacggatgcggaagttcagctcccagtcctgggcgcggatgaactcctcgttgtagccgccctgttgctccagcgcctcgcggcggaacacgcccaggtagaccgtctcggccgggccggcctggccgccggtgtggaaggccgcgttgccgacaccgatcttcgacgtcatcgcggcggcgaccgcgtgctcccacgcgttctcgccctcggcgtgcatgatgccgcccacgttctgcgcgccggtctcctccaggagccgtaccgccgtggcgatgtagttcggcgagagcatcccgtggccgtcgacgcggacgacgatcggatggcgggacgccttgatcgcggcgttgagcgcggcgggggtgcggccggtggggttcgggaccgtgtgcacgcgcgggtcgtcgcggacgagctgggcggcgatctcgtccgtgcggtccgtggacggacccagggcgatcacgacctccatctcgccgtcgtactcctgcgcgaggatcgcttcgacggccccgcgcagatgccgctcctcgttgaggacgggcatgatcacagaaacggcggggaaccgcacgtcggagttggcgttcatcggtgctcacgttaccgcgaacgggggacaccggtgcgcgccgcggggtccgctgccccgggcagcagatcgtatgggcctacggtgctcacggtgcccacccacgccctacgcggaggtgtcccccatgcccaccacgtcgccccggccgcccaggccgcccgcgcc

SEQ ID NO: 909 - DNA, 497 bp, Unknown
  Kingdom: Bacteria, Phylum: Actinobacteria, Class: Actinobacteria, Order: Streptomycetales, Family: Streptomycetaceae, Genus: Streptomyces
ccggcgccgcggattccggggcgccggcgaccgcctgcgcgaacagttcctcgaggtcgccggagccggcgaacagcacttcgcgcttgtcggcgtagtgccggaagaacgtccgctcggtcagcccggcccgcctggcgatctccgccacgggggtctgctcgaacccgcgctcgctgtacagctccagcgccgctttcgccaggcgctcccgcgcgttcggctcccatctgcccatggcacagatcctacgcgatgacagtgactgacatcgagtgttaggctcgacgatgacagtcactgacatcgtctgctcgttcttcggcattccctcgacagtctggggttctcccatgcgtatcttcgtgaccggcgcgtccggctggatcggctccgccctcgtgccccaactcctcgacgcggggcaccaggtgaccgggctcgcccgctccgacgcctccgccgccgcgctcaccgccgccggggcccaggtcgtc

SEQ ID NO: 910 - DNA, 6095 bp, Unknown
  Kingdom: Bacteria, Phylum: Actinobacteria, Class: Actinobacteria, Order: Streptomycetales, Family: Streptomycetaceae, Genus: Streptomyces
ccggtcttccggcacgggcggcccacgctgagcgtgtgggcgcccaccgcgcagagcgccgccctggaactggacggcagggccgtcgccatgcgccgcgacgacaccaccggcgtctggtcggtgaccggccctgcgtcctggaagggcaagcagtaccggtacgtggtgaaggtgtgggcgcccagcgtccagcggatcgtcaccaacaaggtcaccgatccctactcgctcgccctcaccgcggacagcgggcgcagtctcgtcgtcgacctggacgaccgccggctcgccccggacggctgggcgcacctggccaagcccaaggccgtgccgctgcgcgacgcgcagatccaggaactgcacatccgcgacttctccagcgccgacaagaccgtccccgccaaggaccagggcacctacctcgccttcaccgaccggggcagcgacggctccgagcacctgcggcagctggcgaaggcgggcacgtcctacgtccacctgctgccggccttcgacatcgccaccgtcccggagaagaagtccgagcaggccaccccggcctgtgacctggcctcctacccggccgactccgaccagcagcagaagtgcgtctccgcgaccgccgcgaaggacgcctacaactgggggtatgacccctaccactacacggtccccgagggctcctacgccaccgatcccgacggcaccgcccgcacggtccagttccggcagatggtcacgtccctcaaccaggacgggctgagggtcgtcatggacgtggtctacaaccacacggcggccggcggccaggccgccacgtccgtcctggaccaggtcgtgcccggctactaccagcggctgctggccgacggctcggtggccaacagcacctgctgcgcgaacaccgcgcccgagaacaccatgatgggcaagctcgtcgtcgactcggtcgtcacctgggccaaggagtacaaggtcgacggcttccgcttcgacctcatgggccaccacccgaaagccaacatcctcgcggtcaggaaggcactcgacgcgctcacgctcgccgaggacggcgtggacggcaagaagatcatcctctacggcgagggctggaacttcggcgaggtcgccgacgacgcccgcttcgtgcaggccacgcagaagaacatggccggcaccggcatcgccaccttctccgaccgggcccgcgacgcggtgcgcggcggcagccccttcgacgccgaccccggcgtccagggcttcgcctccggcctctacaccgacccgaactcctccgccgccaacggcaccgaggccgagcagaaggcccgcctgctgcactaccaggacctgatcaaggtcggtctgagcggcagcctcgccaagtaccgcttcaccgactccgacggcaaggaggtcaccggcgaccagatcgactacaacggcacccccgccggctacgcggacgcccccggggacgccgtcgcctacgccgacgcgcacgacaacgagaccctgttcgacaccctcgcctacaaactgcccaaggacacctccgccgccgaccgggcccgcatgcaggtcctggcgatggccacggccgcgctctcccagggccccgcgctctcccaggccggcaccgacctgctgcgctcgaagtccctggaccgcgactccttcgacagcggcgactggttcaacgccatccactggagatgcgcggacggcaacggcttcggccggggcctgccgagggcggccggcaaccaggccaagtggccctacgccaagccgctgctgacctccgtcaaggtcggctgcccgcagatccagggcgcctcggccgcctaccaggacctgctgaggatccgcacgagcgagaacgccttctccctcgcgacagccgggcaggtgcagtcccggctctccttcccgctctccggcaaggacgagacgcccggcgtgatcaccatgaagctcggcaacctggtcgtcgtcttcaacgccacccccgagcggcagagccagcgggttcccggtctcgcgggcggcccctaccgcctgcacccggcccaggcgcacggctcggacccggtggtgaagacctcggcgtacaccccggcgaccggcaccttcacggtcccggcccggacggtggcggtcttcacgaactagggtgaccccgtcgtcgtagaagtcgcaggtaaaagcagaacaggagcgctcatgccgcagatcaccgtcgactactccgagcagttggcggacgccttcgaccggcccgcgttcgcgcgggacgtgcacgcacgcaccgtcgagatcgcggacgccaggccgccggcgtgcaagacgcagttccgccggaccgaggacaccaccgtcggcccggacgccgaggggcacgcgatcgtgcacgtcacgatcgggctgctggccgggcgcacggaggagaccaaggcgcgcctggccgaggccgtgctggaggcgctgcgcgtccatgtgaaaccggtcgcgggcctggcactgcacgcatcggccgagatccgcgacctggacgcctcctaccggaagtacgacgtctagaggctcggcaacggcagcggtgggacggacggtcgaccaccggccgtcccaccggccggtggtcgatcctcgcttcaccgacccggttccctttttggcacaccggacttccaaaactgcaccgctacttcccggaccgggagtcgctgatcaacgcggtcgtcgaggactccgcccgcatgatgaaccaggcgatccaggaggcccggcttgacgacgccgagccggtgcagagcctgcgccggctcgtcgcgacgctgctcgatgccggcgaccacctgctgttcctgttcggcgacccgggcgtgcgcgccactacgagagcctgggcgggccgggagcgaggaccgacgccgtggcccggctgatcgaacgcggccgcgcggaaggcgtcttcgacccgggggtgagccgcgcctggaccgagagcgtgttctgggcgctcgtctgcgccggctgcgatgccgtccaccaagggcggctgccgcgacatgaggccctcacctcggtcctgcgcagcctggagaacggcatcggggtcggggacgccggggacaggccaggcgtctgacatcgagcgagcgaccgccggacttaccaggaagcgagcttcaggagccggccgagcaggtcaccgaaggggccgtcggccggctccgccgtgaagacgccgcgcagcagtgcggtcagttcctcgtcgtgggcggcggcgacggccaggagcgcggcgaagtcgtgcaccagctggacctccagctcggcgcgcgggatgcgccggccgtccagccagatcagcgccgtcgactccgcgagcgagatccaggagcggaccaccaggtccagccgggcgggcggggtctggatgccgaggtgggacaggagctggtcgtaggcggcctgccgtacggagtcgatgagggcgttggtcgtggtcgagccgacggccgggccaccgcgcatcagggccgagaagccgggcccgtgctcgtcgacgaagtcgaagtagcggcgcatcacgcgcagcagccgcgcgcccagcggcccctcgtgcggctccgcgaaccggccggccaggtcgtcggcggcgcgctgcaacgcggcctcgtacaggctgatcttgccggggaagtagtggtagaccagcgggcgcgagatgcccgccgccgacgctatctcgtcgatggagacgtcctcgggggagcgccggctgaacagttcgagggcgacgccgatcaactgctgccgccgctcctcgacgccaagtctgcggcgtaccccggtagtcatacgcccaccctaccgatcggaaccggccatgaatggtcgggtgttcgactcgccctgccggctgacgcgccggttcctcacatgtcgagcaccagacgttcgccgcgcgcccgggacacgcagatcagcatcgagtcgtcccgttcggcgtcggtgagcagctcgtcgcggtggtccacctcgccctccagcacccgctgctggcaggtcccgcagaagccctgctcgcacgagtacgcggtgcccggcagctcggcgcgtacggcggccagcacggtggtgtccgccgggacggtcaaggtccgtccgctgcggcgcagttcgacctcgaaggcgccgtcgccgtccgtggcggcccggggcgcgaaacgctccaggtgcagcacggcgccctcgggcagccgttcctccacggccgccatcagaccctcgggcccgcagcagtagacggcggtgcccgccgggacgtccgcgaacagcgcgtcgaggtcgggccggccctgctcgtcctcggcgaccacggtcacccgggtgccgtccgggtccagcttggcgatctcctccaggaacggcatcgacgcccggctccgcccgccgtacagcagtcgccatgccacgccctcgcccagcgcccgcagcatgggcaggacgggggtgatgccgatgccgcccgcgacgaacacgtaggacggcgcctcgaccagggggaagcggttgcgcgggccgcgcacctccagctcggtgccctcctgcacctgttcgtgcacctcgcgcgagccgccgcgcccgtcctcggccagccgggtggccacggtgtacgaggagtcgtcctccgggtcgccgcacagcgagtactgccgtacgagcccggagggcagcaccaggtcgaggtgggcgcccggctcccagcggggcaggtcgtgtccctccaggcgcagccgtacgacaccgtcggccaccgtctcgtgcgcggtcaccagcagccgcagggcccgcgtgcgcgggcggcccgagaccggctcgtccagggcgggcatcggccacagcggggacgcctggatgcggcggcgcagggcccgccgcaccaggacggcggcacccgcgaccgccacgaccgtccgcagcttcggcgccttcggcggcttcatacggactccttccggttcttctgggccttttcggcggcgagtgcggccggtgaggacgcgagataggcgacggcctgcgcggtcgagccctcctgggaggggtggtagccgcggccgaggtaggtggggatggaccgcagcatggccccggtcgcgggcagggtgccgcggcgcccgctccggtagaagtcccgcaggcgcgccttgccgtccagcagcgtcggatcgttctccatgaagaaccgggcgccgcgctgccacaggaagaccagggcggtgaacgccgtcgcccaggtgcgggcgcgccgccggtagccgccgtccacgtgcacgaacaggtcgaaggcgaccgagcggtgctcgacctcctcggcgccgtgccagcgcagcaggtccagcatggtcgggtcggcgccgcgccggtcgagttcggtcgcgttgaggacccagtccccgaggaaggcggtgtagtgctcgatcgccgcgatcagcgccacccgctccatcagccaccagcgccgcgccgctcccggcggcagcgtccggtcgccgagcagcttctcgaacagccagtccacctgagcggtgtacggggtcgggtcgagccccagctccttcaggtgcggcagcacctcgtcgtgcgcctgcgagtgcatcgcctcctgcccgatgaacccgatgacgtcctcgcgcagccgctcgtcgcggatgtacggcagcacctgcttgtagacgtgcacgaaccagcgttcgcctgcgggcagcagcaggtgcagcacgttgatggtgtgcgaggtgaacgggtccccgggcacccagtgcagcggggtgccctcccaggagaaggagacgttccgcgccttgagcggcaccgggccccggtccggcgtgttagacatggcgtcaatgtactggcgggtagggcgtgcgggaagcccttggcggagtcttgttgacgccgatgtcagcagggggcgttcgaagccccttgagtcttctagggtccgtcttcaaagatcatcaggtcgtggatcatggtggggtggtacgtcgtcatgaactcaccgatcgcga

SEQ ID NO: 911 - DNA, 3069 bp, Unknown
  Kingdom: Bacteria, Phylum: Actinobacteria, Class: Actinobacteria, Order: Streptomycetales, Family: Streptomycetaceae, Genus: Streptomyces
cggcgtcgaccaggtcgcccttgcgcaggccgtggcggcggatcagggcggcggtgacctgcgggtcggcgggggaggggaggagatcggggccgcgcaggtggccctttccgccggtgtcgatgtcgaggacaccggtgacgagccgggcggccggggaggactgcgcgctcacctgggagtggtcgagtgtgacggtcatgggtggtggtcctttcacggacggaggcgcacggcgtggaagaggtgcgggaggggaagagccacgcgggaggcgtcgggtacggccctgacaccgcgggcaaaaccaccagctcggtgcggccgttcggcggcgcgcggtgcgctgtccgaggggcatgagatggcggtgggaagctgctgtgccggaggcgaaggcgtcggatcgacggtcgcgtcggtggatcagctcagaaggagaatcacatcgcaccggcgcccagagaagagagggcgtgacacaggtgctttctgcaaggtaacacactcgtgccgggccggccacccacgggacgagagactcacagcgtatggctcacggcgcgtgacgcacggcgcatgactccgggcgtgtgactcgacacgagtggctaagctggcgcggatgttcagcccggaaggacccacggtccgtgaactcgccgtgcaggcgctctcctccgtcgagcacggctacgacctgctcgcgcccaagttcgaccacaccccgttccgtaccccggacccggtgctggacgccgtggcgtccctgctggagcggaccggaccgtacggcgacgggctcgacctgtgctgcgggaccggcgcgggtctcgacgtgctcacgcgggtgtgccgcgggacggtcaccggggtcgacttcagcgcgggcatgctcgccgtcgcgcgacagcgcgccggccgggccgccttggtgcgcggtgacgcgcgggccctgccgttcaccgaagccttcgacctcgtcgtcagtctcggtgcgctcggtcacttcctcccggccgaactgcccgccctcttcgggcaggtgcgcgcggtcctgcggcccggtggcgtgttcgcgctgcccgtgttcgcgccgccttcgccgcggtcgggggcgttctgggtgctgctcgggttcgacgtggtgatgcgggtgcgcaacgccgtgtggcgaccgccgttcgtgatgtactaccgcgcgttccgtttcggcgacgtcctgcgggaactggagcgcgccggactgcggacggagctgtaccccctgcccgggttcggcaggcgccccgacggcagcccacgggcccggctggtcatggcccgtcggctgcgctgagaccgcggccggtcggctcgccggcgcgtggccgggcgtccccgaagggcggtttccaggtgcggtggctcagcccgccgacggcagcgtgaactcgtagacgagcgcgtcccgccgcgcgtccaccgtcaggtcggtgatctccagtatgcgggcgtactggtcgtggacgcgccgggtcacgcgcaccgaggggccgtccgggtgccgggtgatcgtgtcccggtggtgcagggtcaggcccgcgcggcgcatccagtcgtaggcccggcgcagttgggcggcgcacgccccgtccgcgcggtcccggtagcgggccagctcgtccacctcggcgagtgccacggcggagaacgatgtcaccgccgtgcgcagcccggtgccgtctgccgtcgccgagcggtaacggtgcaccagggtgggccggcgcggtgccagacccagctccgccgcgtgctccggcggcggtgtctcccaggcgaccgtggcccggtcgcaggcgtccggaacggccgcacgggcgcccaccgggaagtccagggacgtgggcgactcgaccggcaggccggtcagcgtggcgtgggtgccgcgccggtcggtggcgacgagcccgtctcggcgcagcacttcgagggcctgccgtacggtctcccggctgactcggaagtgcacggccaagttccgttcgctgggcaggcgttgaccgggcggtatggtgccggcgcgcagttcgccgagcagttgggtggcgatcctccagtacagcggccgtccctcggtcgctccttcggtcgtcggtcgggggtcgggggtggtgcgggccatgccgcgcctcctgttgatgacgtacggtagccgtgtgggctcggtgcgccaccacatctaccattggtctaaaccagtcggaaggtggtccgcgcggttcgaccgaaatccgcccatgccgcttcggcatcgctcgacggggagtgttccgggttgccccgcgggccggccggccgtcagccgaagcgctccacgcggacgcggtccaccggcaggcccgccgcgacgagcagccgacaggcgtgctcagcgaaggagttggacccgcacacgtaggcctcccagccgccgtcgggcgactcggcgacgaacggcgccagatgcgcggcggacagccgtcccgccggctcgccggccggggcctcacgggtgaagacggccgtggtctccgcgccgtactcccgtgcgtagatgagctgttcgggactgcgcgcggacaccagcagccgcagcggcacggtcagtccgcgtgcccggtggtggcgcaccatcgacatcagcggtacgaccccgctgcccgcgcccagcagcagcgccggacggtcgccgggccaggcgaagaaaccgctcagcggaccgcgtacctccacctggtcgcccggccgggccacggtgtggaaccagccggagacctcgccgccctcgacgtggtccagggtcagctcgatgtgccccgagtcgtcgggcgcggaggcgatggagtagtggcgctgggccacgtagccgtccggcgcggtcagccgcagcatcaggtgctgtccgggcaggtggcccgcccagcccgggaccgcgaggcggaaggtggcggcgcgcggggtctcccggcggatgacggccacggtcgccgtccgccaggtcgtggcggcctgctcactgacggcgatacggccgggaacggcgaaccg

SEQ ID NO: 912 - DNA, 1078 bp, Unknown
  Kingdom: Bacteria, Phylum: Actinobacteria, Class: Actinobacteria, Order: Streptomycetales, Family: Streptomycetaceae, Genus: Streptomyces
ctccggcagttgctcgccctcgctgcccgcggagggcgagcaactgccggaggatccggagcacccgcgcaatcagccccgccccttcgtccgcgccgagcaggagaagcggctcaaggccgccgagcgcgcctaccagcagctcggcaaggtcaacccgctggccctggaggagttcgcggcgctggaggagcgccacaagttcctcagcgagcagctggaggacctgaagaagacccgcgccgacctgctccaggtggtcaaggaggtcgacgagcgcgtcgagcaggtcttcaccgaggcgtaccgggacaccgcacgcgagttcgaaggcgtcttcggacggctcttcccgggcggcgagggccgtctcgtgctgaccgaccccgagaacatgctcaccaccggcgtggacgtcgaggcgcgcccgcccggcaagaaggtgaagcggctctcgctgctctccggcggcgagcggtcgctgacggccgtggccctgctggtgtcgatcttcaaggcacggccgagtccgttctacgtcatggacgaggtcgaggcggccctcgacgacaccaacctccagcggctcatccgcatcatgcaggaactgcaggaggcctcccagctcatcgtgatcacgcaccagaagcgcaccatggaggtggccgacgccctgtacggcgtctccatgcagggcgacggtgtgtcgaaggtcatcagccagcggctccgctagggccgacggcccgcgcgctgccgcctgctcgcgcgccatcgcgggtccccgccctgtcgcgccgccccgtccctctcctgtccccgctctcctgtcccgctctcccgtccccgcgccctggcctgccctcgcgtgtcctcgcgacttcggggtagtcggagcatgtcccgctacttgatttcaacatttgaacgcaagctcgccacgcgggtgggtcaaactcacagcagaagaagtattgacttcgaaagttgaaggcatagtctctgcaacgttgcttttaccttcagggtctcaaggcccggaagggttgaccccaccccggcagcgctgccggagtgc

SEQ ID NO: 913 - DNA, 969 bp, Unknown
  Kingdom: Bacteria, Phylum: Actinobacteria, Class: Actinobacteria, Order: Streptomycetales, Family: Streptomycetaceae, Genus: Streptomyces
  misc_feature (249)..(250): n is a, c, g, or t
ccgtcgcgacgaactcccggccgcgccgctcgagttcggcgtcggcggcggggtcggccgcgagcagggacgcgcccgcgtcgagggcgtcgtcggaggcggcgtagagggcggcccggaaggcacggtcgacggtgccggactcgccggaggtgcctgaggtgcggtcggaagtgcgggacgtgtgggacgtggtcacggatcgatcgtgccatgagggcgggaaggtcgggattcttcgtccacagnncgtccacagcctgtggacaaccgggcggcaggcgagcgggtggcggtcggccgagccactcggagtcggtgtcaacccaaggttgacgccgcttcactgtcaacctatggttgacacatgacgaaccccagcatccggtcgacggtccgtctcgacgacctcatctcggccatcaagaaggtccaccaggaacccctcgaacagctccaggacgccgtgatcgccggcgaacacctcggcgaggtggccgaccacctcatcgggcacttcgtcgaccaggcccgccgctccggcgcctcctggaccgacatcggcgccagcatgggcgtcacccggcaggccgcgcagaagcggttcgtgcccaaggagtccgccgatctcgaccccagccaggggttcagccgctacacaccgcgcgcgcggaaggtcgtcatggccgctcacgaggcggccaagtcggcgaagagcccggagggactgcccgcgcacctcgtcctcggcctgctcaccgagccggaggccctcgccccgaaggcgatccaggaacagggcgtcaccctggaagccgtccgcgaggccgcgaccgccgccctgccgcccgcggccgccgacgcccccgacctcgtcccctacggtcccgccgccaagaaggccctggaactcaccttccgcgaggccctgcggctcggccacaactacatcggcaccgagcacatcct

SEQ ID NO: 914 - DNA, 1590 bp, Unknown
  Kingdom: Bacteria, Phylum: Actinobacteria, Class: Actinobacteria, Order: Streptomycetales, Family: Streptomycetaceae, Genus: Streptomyces
gcacgacggccgtgtgcggagcgctggcaccgggcgtccagccgaaggcgtgaggcggcgcgggctcagtcctcgtcgcggggcgtcccgtcgccgtcggtgtccttgggcggcgcgtccttgggcggggtgtccttgggcggcgccgagccggtgaatccgctgaagccgcgccggacccggtcgcccaggtcgcccgcaccgcccgcgaggtcggtcaccagcttcatcagcgggtccttggagctcttcacatggcccgcgtagtgcgcggccgactcccggaaggagtcgccgaccgaggtgtccttgtcctcgctgcggcgcggatagtgaccgtccacgatccgctggtagtcgcgggactcggcccacttcttcagctcggccgcccgcacggtggtgaaggggtgggtgcgcggcaggacgttgaggatcttcaggacggaatcgcgcaggtcgcccgccgactcatactcctccgcctgccgcaggaaggcgtcgacgttcatctcgtgcaggtggttgccgcccgcgatcttcatcaggccgcgcatggacgccctcaggtcctgtccgacgagcaggccggcccggtccgccgacagctccgacttgcggaaccactcgcgcagcgccgtcacgatcgccatgatcgctatgttgcccagcgggatccacgccacccgcaccgccaggctggtcaggaacagcaggatcgtgcggtacaccgcgtggccggagagggcgtggcccacctcgtggccgatgaccgcccgcatctcctcctcgtcgagcagctccaccaggcccgtggtcaccacgatgaccggctcgtccaggccgatgcacatcgcgttgggctgcgggtcctggttgacgtacatcggcgggaccttctccaggtccaggatgtagcaggcgtcccgcagcatgtcgttcaggtgcgcgaactgctcgtccgagacgcgtaccgagtcggacaggaagagcagccggagactgcgctcgggcagcaggccgctgagggccttgaacaccgtgtcgaaaccgctcagcttgcgcagcgcgaccagcgcggagcggtcggccggatgctcgtacgcacgcgaggagatccccgggaagcgtgtgcgccgccggccgggcacctgctcgtgcccgtcgtgttcgcggcggtcgtcggacatgtgatcccccatatgcgtctgtgtcgcccaatgtgcccccgaagcaggggccagcctaggcggagatacggtgggcgggcagtacagcgaaggagtcacgccatggagcactaccccgcagccgtccggctggccgcggccgccaacaccacagcgcagcaccaggggtcgggtgacctgctccgcatcgtcctcgtcgtgatggtcctgggctgtgtgctcaccggctggttcctgctgcgcggctacaaacggaacgacgactgacccttccgcaaggttcccgcccccggaaatcaccgggcgcgaggccctgcggggccgctcgccgggctgcgcggcgtgctgggatgcgccgcgcgggggcggcgtgagcccggggcgcccagctgcggccgtc

SEQ ID NO: 915 - DNA, 3239 bp, Unknown
  Kingdom: Bacteria, Phylum: Actinobacteria, Class: Actinobacteria, Order: Streptomycetales, Family: Streptomycetaceae, Genus: Streptomyces
ccgcccccccgttcgacgagtgaagccgcacatccgcacgtaccgtcggaagcatgagtcacaccgacgccggcgcggaactggacccggtgcaccccatacccgtgccgcgggccacggcgagcggcctcaccggcgccgaggtcgccgaacgcgtcgcccgcggcgagatcaacgacgtaccggtgcgcagcagccgcaccctcgccgagatcgtccgcgcgaacgtcttcacccgcttcaacgcgatcatcggcgtcctctggctgatcaccctgttcgtcgctccgatccaggacagcctcttcggcttcgtcatcatcgccaacaccggcatcggcatcctccaggagtggcgggccaagcagaccctggactcgctcgccgtgatcggggagtcccggcccaccgtccggcgtgacggcaccgccaccgagatcgccacctcgcagatcgtcctcggcgacgtgatcgagatcgggcccggggacaaggtcgtcgtcgacggcacctgcgtggaggccgacgggctggagatcgacgagtccctgctcaccggcgaggccgaccccgtcgtcaaacacgccggcgaccaggtcatgtccggcagcttcgtcgtcgccggcggtggcgcgttccaggcggtcagggtcggccgcgaggcctacgccgcccagctcgccgaggaggcctcccgcttcaccctcgtccactccgagctgcgcacgggcatctccacgatcctcaagtacgtcacgtggatgatggtgccgaccgcgatcggcctggtggtcagccagctcgtcgcgaagaacgacgacctcaaggactccgtggcccgcaccatcggcgggatcgtcccgatggtcccggagggcctggtgctgctcacctccgtcgccttcgccatcggtgtcatccggctgggccgcaagcagtgcctggtgcaggagctacccgccatcgagggtctggcccgcgtcgacacggtgtgcctggacaagacgggcacgctcaccgagggcggcatggacgtcaccgagctgcggatgctcaacggccacgcggagccgtacgtacgccaggtgctcggcgcgctcggcgagtccgacccgcgccccaacgcctccctccaggcgatcatcgacgcctgcccggacagcgaggagtggcgctgcgtggagtcgctgcccttctcctccgcccgcaagtacagcggcgccagcttcagcgagggcgacggcgagtccagtacgtggctgctgggcgccccggacgtgctcctgcccgacggctcccccgccctcaccgagaccgtgcggctcaacgagcaggggctgcgcgtgctgctgctggcccgcgccgggcgtgagctggacgacccgaaggtggccggcgacgtcacgcccgccgcgctcgtcgtgctggagcagcggctgcggcccgacgccgccgacacgctgcgctacttcgccgaccaggacgtacgcgcgaaggtcatctccggggacaacgcggtgtcggtgggcgcggtggccgccaaggtggggctcgccggcagtgcggtcgacgcgcgcaggctgccggcagagcgggacgacctggccagggaactggacgaggcgaccgtgttcggccgggtcaccccgcagcagaagcgggacatggtgggcgccctccagtcgcgcgggcacacggtcgccatgaccggtgacggcgtgaacgacgtcctcgccctcaaggacgccgacatcggcgtctccatgggctccggttcggaggccacccgggcggtcgcccagatcgtgctgctggacaacagcttctcggtcctgccgtcggtggtcgcggagggccggcgggtcatcgggaacatcacccgggtcgcgaccctgttcctggtcaagaccgtctactcggtgctgctggccgtgctggtggtgtgctcgcaggtggagtacccgttcctgccccggcacctgaccctgctgtccaccctcaccatcggcgtccccgccttcttcctcgccctcgcccccaacacggaacgggcccgcccgcacttcgtccgccgggtcatgcggtacgcgatcccgggcggcgtcctggccgccttcgccaccttcgccacgtacctggtcgcccgcggccactacaccggcccggacgccctcgacgcggagaccagcgccgccaccctcacgctcttcctgatctccctgtggatcctcgcgatcatcgcgcgcccctacacctggtggcgggtgctcctggtggccgcgatgggcgtggcgttcgtggtcgtgctggcggtgccgtccctgcagcggttcttcgcgctgaagctggtcgggacggcgatgccctggctggcggtgggcatcgccgtcgtggcgtcggtggtgctggagttcctgtggaggtgggtggggcggcgcttcccggtgtagcccgacccggccctttggtgtgcgggggtcagtcgaaccagcggtcgcgggccagttcctccgtccgggacgggtcctccaggagggcggcgacctcgaagcggcggggccactggccggcggcccaggcgaggcccgcggcgacgccttccagggtggccgcgtgcaggacgccgtcgtgcgtgaggcgccagtcgagttcggtgccgtcgacgacgagttcctcgtgctcgacgtaggtcgcgggcgtgtgcgggccgagcaggatcccgaccggctccggtacgtcgtgctcggtgccctcggagtccaccgagccggtgaccgactcgctcaggcgccgcacctggaacaggtcggccagctcggcggcgagcgcgggccgcaccggcagcagcgggacgcccgaggtgaagggcagcaggtccggggagtcgcagaccacggcgtcggccgcgtccacgacctccacacgcccgtcgacgacggctcgcagctcgtcgggcagggtgacctgctccgggtccagctcggccagcgcgccgtacagggcgtgcaactgggccgccgtcaccggacgttcggggtcggcgaggcggtcgagcagttcgacggcgccgcccggttcgtcgagcagcgcggcgacggaggtgcgcacgcccagggcgcgcagcacctgttcgtcctcgaagccggtggcgtcggcctcgtcgtacaggccgcgcagcagcgggtcggagcccgtggcgcgcagaccggccgggcggcgcccgccgagcaccgggtggc

SEQ ID NO: 916 - DNA, 1111 bp, Unknown
  Kingdom: Bacteria, Phylum: Actinobacteria, Class: Actinobacteria, Order: Streptomycetales, Family: Streptomycetaceae, Genus: Streptomyces
gaggtacgccgtgagggcggcgccgcccggacgtacccgttccgcgcagtcggcgacgaccggtaccggcgcgtcgggcgcgagccggtccgcgtgtccggtgaggtcgcggtcgagcagggcgtcgccgaccacgaccaggggtgccttgcccgtcatgtcacctcccgcccccgccgagggcgtcccgtcgacgcgtgtccccttcgatggccgcgtcgaaggcggcgcagatcatgtgcacggcgaccaggtggagttcctgcacggtggccgtggaggcaccagccgcgcacagcgcctcgtcgccgcccgcgctgagcgggttgggcgccggaccggtgagggcccacacgcgcaggcccgcggcgcgccccgcgtcggccgccgagagcaggttggcgctggcgccgctggtggacagcagcatgagcacgtcgccgcggcggccgtgggcgcgtacctggcgggcgaacacctcgtcgacgccgtagtcgttggcgatggcggtggtggaggaggtgtcggcgtgcagggcgatcgccgagtacggcgggcggtcgtcccggtagcggccgacgagttcggcggtcaggtgctgggcctgggcggcgctgccgccgttgcccgcggcgagcagccgtccgccgccgccgaggacggcggcgagccgttcgccccagcgctgggtgatgtgcgcggagtcgcggaacttctccagggcgacgaggagttcgtcgcagtgcccggtgacagcggggatcccgatggtcatgacatcacctccggggtctgacagggtacgtccggggtctggcgcgcacggtccggcgtcttgcggggaacgtccggaccagggcaggaaacacggcgcatcaggccacctccgtcttgacctcgtgctcggcggcgacccgccggtagacctgttcggcgccgtcgacccggcccgcatgcccgcgctgatgcgcagcgccgacctggtgctgtgcacgccggtgtacgaaccgttcggcatcgtgccgctggaggccatggcgtgcgccgtgccggtcgtcgccaccgacgtcggcggccaccgcgactcggtcgccgacgtcggtggcgacga

SEQ ID NO: 917 - DNA, 1925 bp, Unknown
  Kingdom: Bacteria, Phylum: Actinobacteria, Class: Actinobacteria, Order: Streptomycetales, Family: Streptomycetaceae, Genus: Streptomyces
ggcaggggggtggctggagccgggggcgacaaggagtggctcacctcttcgccttctgggagagccgcgccttctacgactcgttcatggcccggtcccacgaccggctggcgacggcccaggccggcaccttcaaggatgcccgggtccggcttttcgatcaccggttcgatgtgaagacgggcttccagcctcgcttcgcggacgcggacctggtgcgtgtcgcgctctgcagggtccatgaggagcgcgccgagcacttcacgctgatgcaggagaaggtctggaacccggcgatggccggctcgcccggcatggtccggggcctgttcggtgaggcggccggcagtgaattcctggtcctgtccatgtggcagtcgtccgccgagcacggtaaataccgcaccgagcggatcgagcgtctcgcgttgcgtgcccagacggaagccgacgtcgcgtccatgaccggtgcgatcgtggacctcgagcccgcctggaccgtgtgacccgcgcgcgggagcaccactccgcccgcgcgccggagtgcgaggcgcgccctcagtggctcatgggtccagtacggccctgtacggcccagtacgtgtgatctgtgccgtatgagggccgctcgagtctccgatcggccgtcgctcgatctagtgttttggcatggcacgaccacggcgcatcgttcttgtccggcacggcgagtcgacgggcaatgtcgatgactccgtctacgagcgcgagcccgatcacgcgctggcgctgaccgaacggggtcttcaggaggccgaggacaccggcaaggagctgcgcgaactgttcggacgcgaacgcgtcagcgtgtacgtgtccccgtaccgccgcacccacgagaccctccgcgccttccacctcgaccccgacctcatacgcgtacgggaggagccgcggctgcgcgagcaggactggggaaactggcaggaccgcgacgacgtacgtctccagaaggcctaccgggacgcctacggccacttcttctaccgcttcgcccaaggagagtcgggtgccgacgtctacgaccgggtcggcggcttcctggagagcctcttccgcagcttcgaggcccccgaccacccgcccaacgtcctcctggtgacccacggcctcgcgatgcgcctgttctgcatgcggtggttccactggaccgtcgcggaattcgaagcgctgtcgaacccggggaacgccgagatgcggatgctcgttctcggtgacgacggcaggtacgccatggaccggccgttcgagcggtggcgggacccggaaccctacgggatcactggatagagtggcgagcgatgacctcagactcctctcccggcaggcgcctggagcgcgccctggccagcacgcgcggactctcggtcggggacgcgctgggctcgcagttcttcgtgccggcgaactatccgctccttcaccgtcgtgagctgccgcccgggccgtggcagtggaccgacgacaccgagatggcctgctcagtggtggccgtcctcgtcgcgcaccaccgcatcgaccaggacgccctggccgactccttcgcccgccaccacgacttcgaccgggggtacggtcccgcggtcaaccggctgctgcgcctcgtccgggaaggcggggactggcgcgaactggccgcggccctcttcaatggacagggctcctggggcaacggcgccgcgatgcgcatcgcccccctgggcgcgtggtacgcggacgacccggagcaggccacccaccaggccgagatctcggcgtacccgacacatcagcaccgcgaagccgtcgtgggcgccatggcggtcgccgcggcggccgctctgaccgcggcacccggcggcccgccgagccccggagcactgctggacggcgtcatcgacctggtg

SEQ ID NO: 918 - DNA, 1007 bp, Unknown
  Kingdom: Bacteria, Phylum: Actinobacteria, Class: Actinobacteria, Order: Streptomycetales, Family: Streptomycetaceae, Genus: Streptomyces
gggcggcgaagagggaccagagggtgatggccagggcgggcgtgccgaggcccaggagggggcgggtcgcgccgtggccggtggtgaagccccaccaggtcagagcggccagtgcggcgagttcgaggaggaaggccaggacttcgttggccgcgtaccagggtcgtatgcgcggtgtcgtcgccgcgttgcggacggggtcctgtgtcgtgccgtccatggtccctccccctgggccgtcgcctcgtcggccgcagggcacagcatggcacgggctggctggcaggccgagaggctggggccatcgcccgctttgccgggccgggggttccgacatcgcgcggttgccggaggctccgggcctgccgccatctcgtcggggcgagttcatgactcggtcagggctcaggccaagaacgtcctcaccgcctcgtacagggcttccggctggtccaggtggacgtcgtggcccgcggcggggacggtcaggggcgtggtgccgtgcgggcggcgggcccgcatctcggtgaactccgcctcgcgcatcgtgccgtcggcgcccctcaccaccagcgtggggcaggtgatcgtctgccactcgcgccagtggtcacggcgggtcagttcggtgatcgaggacaccatcacgtccttgtcggtcctcggccaccagccgtccgcgcgctcctccagaccccgtgcccaggcctcgttgccgaagaagccggtggccgcctcgaccgtggggaacgggaccggccaggagtccagccaggccgcgatctgcccggggacctccggcgatgccgccgccgggcccgcctcgatcaggaccagcgacttcaccaggtcggggcgggctgcggccaggaggagtgcggtgtggccgccgaaggactggccgacgacgaccgccggggcgagcgcgcggtcctcgatcagcgccgccgcgtccgccacgcaggccgtgcgggtcacgtccggcgggcggcgcgtgctgtcgccgt

SEQ ID NO: 919 - DNA, 4456 bp, Unknown
  Kingdom: Bacteria, Phylum: Actinobacteria, Class: Actinobacteria, Order: Streptomycetales, Family: Streptomycetaceae, Genus: Streptomyces
gcggtggcgtgctcgggacgtgaccggcggcgggcaacgggaggcgcggtgacgggtgcgggcggtccggcggccgggcggggccgcgggcgccgaccgggcgaggcggtcctcggcagcagaccggcctactccgcatggctcgcgccgcgcttccgcccggtgcggacgccgcccgccgccgagcacccccgggccgagcgcacggtgccctggctgcgggtcgccgcttcctacgcctggcgcctcatcctcgtcggcgccgccgtctacggcttcttcacggtcctgggccgtttccagctcatcgcggtggccctgttcgtcgccctcgtcgtgacctcggtcctgcggcccttcgccgacctgctgaaccggctgctgcccagacccctgtgcgtcgccctcgtcctcgtcggcagcctgctgttcctgctcggcctgctcgccttcgtgggcgacgcggtggcggggcagtgggagcagctcacgaccgagctgaccggcggcatccaccggatcgaacagtggctgcagcgcccgccgttccgcctcagccccggcaagctctccgcactgcagaagcagttcctctcctacctgtccgcccaccgggcgagcctcgtcaacagcgccgtcagcggcctcgggcgcatcgtcgaactggtcacggccgccgcgctcgcgctgttcacctccatcttcttcatccactccggcgagcgcctgtggagctgggcgcgcgaccaactgctgcccagcggggcccggcaggtgtgggaccgcgccgggcacgcggcctggcgcgcgttcgccggctacacgcgcggcatcatcatcatcgccgccaccaacgccgtactggtcggtgtcgccctgttcgtgctgcgggtgccgctggccctgccgctggccctgctggagttcttcgccgccttcatcccgctggtcggctcgccggtcgccctggcggtggccacggtcgtcgcgctcgccggacgcggtccgttcacggctctggccgtgctcgtgctcatcgtcgtcatcggcgaactcgaagggcacgtcctgcatcccctggtgatgagctgggcggtgcggctgcacccgctcgtcgtggccgtctccgtcatcgcgggcagcatcgtcgccggggtgatcggcgcgatcgtggcggtgcccttcgtctcggtcgtctgggccgtcctgcgtgccctgcgccccgcgccgtcgtgatgtcgggcggggccgtcccgacgcgtgcttttcggccgcgccagaacgggcacgcggtcctggtacgactccgagcggagggacggtcccgcgatgtccgagtacgaacgttcccgcacgatgcccgcacagcccgaacaagtattcgatcaggccgccgatgtcggccggttcgacgcctggctgcccgacgccctgcacgtgcacgccgagcagccacccgccgtcaccgtgcacgaggacgacaccggtgaggacacctccgccctgctgcgcgccgagcgcgaccagatgcggatcgagtggggcacccgcgagcagggcggctacgccggctggctccaggtcgccgggatcggcagcggcgccagtgaggtgaccgtgcacctgtcgttcttcgaggacagccacgatccgggagagcgggccgcctgcgacgccctcgacagcagcctgcggaagctggaggagcaggtgcggatacgggtcgacaacgcggccggctgacccgcgcccggcacccggagacagaagaaggcggacacagacagaagaaggcggacacagacagaagaaggcggacacaagaaggcggacacgccacggcgtgcggtccgaagaccgggccgcacgccgtggcttgctggatctgttcggtcagcgtccgccgccgtggccaccgccaccgccgtggccaccaccgccgtggccaccaccaccgtggccaccgccaccgtggtcgcctccgccgccgtggtcaccaccacgtccgccgtggtcaccgtagtccccacgtccgccgtggtcaccgcgtccgtggtcgccgtggtccccacgtccgccgtggtcaccgtagcgtccgccgtggtcaccgcggtggtcgccgtagttgccgcagtcgtcccaccagccgccgtggtccgagcagtcgcggctgtatccggagtggtcgtgcgagttgtagttggagtcgtgggccgatgcggtccccgcagcgccgatcgcggcgccgccggccatcatgatgccggccgcggacacgacgaagaggcgcttgacgcgctgtgctcgcatgggtaatacctttccttccatcgtctcgcgcaacgggaaccgcgcgagaatgatggccgcgcccagctgaagtggatgtgcggcgcggtcgtaggcgtcgcagccgtatgagaagcacgtcctggtctccggcgccgccgtgcacccccgcggaaactagcgggggccggcaccgcggcaacggatcccgcagtggagacctcgccggaggggcgtgcgcccggttgcggctctcatggatagacgctagtcgcccgttcgcgtgatggcatcttgagcggcgcccgtcagacggtaagaaagaaacaggtgaaaaccagtcgtaagacgagggaagcgggacgttcacgcataacacgaccgatgccgggcacgcgaagcagtgcccaagggggtgcatcacatgtcaacgggaactcttctcgccatcatcatcccaatcgtcgtcgtgctggccctgatcgctgtggcggtttccctgctgacacggcgtcgccgtctgcgtgagcgcttcggccccgagtacgaacggaccgtcgagggcgccgagagccgcagggcgggcgagcgcgaactcaaggcccgcgaaaagcggcacgactcgctggacatcaagccgctgcccgccgtctcgcgggaccgctacacacgcgagtggagcagcgtccaggaagagttcgtggaccggcccgaggacgcggtgcacgacgcggaccgcctggtgacctcgctgatgcacgagcggggctaccccaccgacggtttcgagcagcaggccgcggacctgtcggtggagcacggcaggacgctcgaccactaccgggccgcccacgagatcgaggcgctcagcaccagcaacagggccaccaccgagcagttgcggggcgccatggtgcactaccgcgcgctcttcgacgaactgctctccgacggcggccgggcccagcccgcccgctcctgacacccggttccgacagccggtcctgaagcccggcccgccaccccggccggcgcccgccgacgacgccggcccggcagggaggaacaccatgcacagagacaaagaccagccgagccgcttcagcggcggcctgtccaccgaggacctggcgcagcagtcctccggcgcaccgggacagaccgaggaggaatcgacgacggccgcgcgccgagcgcctgtctacccgggcgagagcaccggcggcccggggggcaggcagccggcctccaccaccccgtcgacgggcacacccgactcggcgacggacacggccgcgacccgggagacggaccgaacagccggacaggaacggcctgcggacacggcggcgagccctgacacggcgcctcccgacacaactgcgggccccgacacggccatgagcgcggaaacagcggagagcccgggccgggacaccgccgggaccgcggagacgaccgcgcccgccggtgacgacgagggcgcgccccggctgctcggcccggaggacgagcaggcgttccgcggccgctggcacgacatccagagcacgttcgtcgacgacccccgcgaggccgtgcacaccgccgacaccctggtggccgacgtcatgcagaccctggccgccacgttcgcccagcacaagcaggagctggaggcccagtggagccagggcgagcaggtggacaccgaggagctgcgcaaggcgctgcgccgctaccggtccttcttcaaccgtctgctcagcacctgacaccctctgctcagcgcctgagggaacggcccgtacggacgtgtcctccgccgccgccggggtaccggcgtgtcgtgcggaggaccgccgtcgctgagggacgatgggcccgcccggacggaagagcgggctcggaacggaggggctgcggtggaccagcgggtcgcggggcagcgcgaacgggacaggggcgccgcgcagacggccgggagcggcgcccacggcggcgccgctcccggccggtccgcgccggacgcccggcgccggattccccgcaccgacgccgtcctgcgcgatccgcggctgctccaggcggcgggacggctcgggccgcgccccgtgaaggcggccgtacggcaggcgcaggagcaggcgcgccacggcacggtggcacccgaggacgtggccgacac

SEQ ID NO: 920 - DNA, 3435 bp, Unknown
  Kingdom: Bacteria, Phylum: Actinobacteria, Class: Actinobacteria, Order: Streptomycetales, Family: Streptomycetaceae, Genus: Streptomyces
ccggcagcgctgccggagtgcccgaggagtacacgtgaccagcacagcgcaggcgccgaagccaggagccggtacggctcatcccgatcatctcgggcatgtcatcttcatcgcggcggcagccgccatgggcgggttcctgttcggctacgacagctccgtgatcaacggcgccgtcgaggccatccgggaccgctacgacatcggccctgccgcgctggcccaggtcatcgccatcgcgctgatcggctgcgccgtcggtgccgccaccgcgggccgcatcgccgaccgcatcggccgcatccgctgcatgcagatcgccgccgtcctgttcaccatcagcgccgtcggttcggccctgccgttcgcgctgtgggacctcgcgctgtggcgcatcatcggcggcttcgccatcggtatggcctccgtcatcggccccgcctacatcgccgaggtcgcgccgcccgcctaccgcggccgcctgggctccttccagcaggccgcgatcgtcgtcggcatcgccatctcgcagctggtcaactggggcctgctcaacgccgccggcggcaaccagcgcggcaagctgatgggcatcgaggcctggcaggtcatgctcggcgtgatggtcgtcccggccgtcctgtacggcctgctctccttcgccatccccgagtccccgcgcttcctgctctccgtcggccgccgcgacaaggcccgccagatcctcgccgaggtcgagggcgagaacaccgacctcgacgagcgcgtggccgagatcgagaacgccatgcggcgcgagcacaagtccaccttcaaggacctgctcggcggcggcttcttcttcaagccgatcgtctggatcggcatcggtctgtcggtcttccagcagttcgtcggcatcaacgtcgcgttctactactcctcgacgctgtggcagtcggtcggtgtcgacccgacgcagtcgttcttctactccttcacgacgtcgatcatcaacatcatcggcaccgtgatcgcgatgatcttcgtcgaccggatcggccgcaagccgctcgccctcatcggctcggtcggcatggtcgtcggtctcgccctggaggcctgggccttctcccaccacctggtcgacggcaagctgcccgccacccagggctgggtcgccctcgtcgccgcccacgtgttcgtgctcttcttcgccctgtcctggggcgtggtcgtgtgggtcttcctcggcgagatgttcccgaaccggatccgcgccgccgccctcggtgtggccgcctccgcccagtggatcgccaactgggccatcaccgcgagcttcccgtcgctggccgactggaacctctccggtacgtacatgatctacacggtcttcgccgcgctctccatcccgttcgtcctgaagttcgtcaaggagacgaagggcaaggcgctggaggagatgggctgagcctccccggaggcccacgatcccgaggagacgggccaagtccccgctgcccttctcctcgaaccgtccgccgcccccgtcccggtcaccagcccgggccgggggcggcggtgtgtgcagatgccttttgaatgcgggcgggtgccgcgcgggcgcgggtcaccacgtcaccagatgaggacgccgccgccggcctcccgggcccgctggatcgccgcctcgatgttgtccagccgggctgcgatgcaggccatgccttcctcgaccgtcagggggcctgcggtggcggcggcgatcacgtccagccgggagcgcaggcacgcgatctcgtccaggaactccgtcagttccccggcctccacctgcatccattcgtcgcgcacccggggcaggaagcgcgcccccagggaccgtacggcgtccgatccccacaccgccgtgcgccacgattccggcccggccgcgtcgtagtggtcctccggcacgtcgagtacacgcatcgtcccgtccggagcacggacgaacacatccaccgacaggctcatcgccacagtggagcactgcacgcgcgagcgtgccaagggcactacgaaagccccctccgctgccgggcagcgaagggggacagggcagaaggaaagagaacgggcagaggggaagcgaactcgtgggcggcagccggcgagccgactcccgcgactcggctcggacggcgtgcagcggttcccgcggcgcaggtcggacggcgagcggtggtgctcgcagcccgggtcagacggcgagcgactcccgctctccggcggacgtcgtagcggacggagccgccggcgtgaccgccggcttcggcaggaccacgtacagcaggcccgagatcacgatggtggcgacccagccgaggccgtactcgccgatgacgttgttgtgggcgagcgggccggtgaaccagtcggacgtggtgaacatcaggcccgcgaccaggccgatcgcccaggcggcgaccgcggcgggggagaagccgcccttgtaccagtaggcgctggtgcgcgtcgtgtcggccatcgccgcgccgtcgtactccgtgcgccgcagcatgtccgcgccgaagacgccgacccaggcggagaaggccacggcgagcagggacaggaaggcgatgaacgagcccatgaagctagtcgccaccagcatcagcacaccgccgaaggccagcgagatcacggcgttgaccgagaccgcccagtgacgcggcaccttgaagccgagggtctgcgcggtgaagccggccgagtacatcgacatcgagttgatcagcagcatgccgatcagcgcgatcagcaggtacggcaccgcgatccaggtcggcaggatctcgccgaggaaggagaccgggtcggaggccgaggccaggtcgggcgtggagaccgccatcaccgcgcccatcagcaccatcggcaggacgacgatgccggcgccgccgaccgaggtgcccacgatcgccttggacgaggcggtgcgcggcaggtaccgggtgaagtccggcgcggtcgggatccagctgacgccgcccgccgcgatcatgccgacgccggtgatgaccgcggccgtggagcccgcggagtgcgcgaacaccttcgaccagtcggtgtcgacgatcagatagaccagcaccagcacggagaagaggccgaagacataggtcgcgtacttgttgcacttctgcacggcgccgatgccgagcccggagatcgcgaaggtggcgacgacgaagatcagcagcgccacgatgtccagcacgtggttggccttcaggccgaacacgatgtcgagcacgctgagcatcgcgtaggcgccggtcacggcgttgatcgtctcccagccccagcgggcgacccagatcagcgaaccgggcagcaggttgccgcgctgaccgaagacggcgcgggacagcgccatgccgggcgcgccgccgcgcttgcccgcga

SEQ ID NO: 921 - DNA, 1001 bp, Unknown
  Kingdom: Bacteria, Phylum: Actinobacteria, Class: Actinobacteria, Order: Streptomycetales, Family: Streptomycetaceae, Genus: Streptomyces
ctgccgacgggcgcggcggcgcaggacgacgacgcggtgagcggcgagccggggctcgagagctcggcgcaggcgccggggcggtcccgggaggacgacggcggcgggctggagcggcgggtcgcgagcgggctggcgttcctgcgccggcggctcaccggggagtacgacgtcgacgacttcggctacgacgccgagctgaccgaccaggtcctgatgtcgctgctgcggccggtgtacgagaagtacttccgggtcgaggtgaaggggatcgagaacatccccaagtcgggcggcgcgctgctcgtcgccaaccactcgggcacgctgccgctggacgggctgatgatgcaggtcgcggtgcacgaccatcatccggccgggcgtcatctgcggctgctcgcggccgacctggtcttcgtgctgcccgtggtcaacgagctggcccgcaagctgggccacaccctggcctgcgcggaggacgccgaacggctgctgggccagggcgagctggtgggggtgatgccggaggggttcaagggcatcgggaagcccttcagcgagcgctacaagctgcagcgcttcgggcgcggcggtttcgtgtccacggcactgcggcagggggtgccgatcattccgtgctcgatcgtcggggcggaggagatctacccgatgatcggcaacgccaagaccctggcgcggctcctcgggttcccgtacttcccgctgacgccgaccttcccgtggctggggcctctgggtgcggtgcctcttccgacgaagtggacgatccagttcggcgagccgatcccgacggacggctatccgccggaggcggccgaggaccccatgctgatgttcaacctgaccgaccaggtccgcgaacagatccagcacacgctgtacaagctgctggtgcagcggcggtcggtgttcttctgagcttcgcgtcgggttgtggctgagggctggggggctgaccggtgggtcggggcctgggg

SEQ ID NO: 922 - DNA, 2136 bp, Unknown
  Kingdom: Bacteria, Phylum: Actinobacteria, Class: Actinobacteria, Order: Streptomycetales, Family: Streptomycetaceae, Genus: Streptomyces
gcacggactcgccggtcagcatggaggcgtccaccgccgaggtgccctcgacgacggtgccgtcggtggcgaccttctcgccgggccgtacgacgaaccggtcgcccacggccagcgcggacaccggcatccggacctcgcggccgtcgcgcagcacggacacgtccttggcgcccagttccagcagggcgcgcagcgcggcgcccgcgcgccgcttggagcgggcctccaggtagcggccgagcaggatgaacgccacgaccccggaggcgacttccaggtagatcgtcgaggcggcgtccatccgggagacggtgagccggaactcgtcgtgcatgccgggcatgcccgcgtcaccgaggaagagcgcccacagcgaccagccgaacgcggcgagcgtgccgaccgagaccagggtgtccatggtggcggcgccgtgccgggcgttggtgagcgccgcgcggtggaagggcagggcgccccagacgacgaccggcgcggccagggtcagcgccagccactgccagttgtcgaactggagggcggggaccatggagagcagcacgaccgggacggcgagcagcgccgagacggtcaggcgctggcgcagcgaggtcagttccgggtcggcggcgggcgcggtcccggcgtcctgcggggcaggctccggctcgggcggcggtggttcctcggccgtgtaccccgtcttcaccacggtcgcgacgagatcggacaccgctaccccccgggggtaggtcaccctcgccttctcggtggcgaagttgacggtcgcgctgacgccctccatccggttgagcttcttctccacgcgggccgcgcaggaggcgcaggtcatcccgccgatgagcagctcgacctcggaggccggggcggtgtcgggcggagtcgccgtgctggtgatggtgctggtcatgtccgtactccagtgaacggaccgggccgtacggaaccagtatcagctggtcgatacggcccggtgtcgagagatacgtgagaggtgcgcccggtgttcaggcgcggccgacgagctcgaagcccgcctcgtccaccgcggcgcgcaccgcggcctcctccagcgggcccgcggagaccacggtgacctcgccggtcgaggcgacggccttcaccgagctgacgcccgccagctcggagatctcggcggagacggagccctcgcagtgtccgcagctcatgccgctcaccttgtagacggtggtgacggtgtccggggtctcggtctgggcggtcatgtcgctctcctcgtcatggcgtgtgtggtggcgtgtgggacagaggtggcccacaggggctcacttcattcgagactatacccctagggggtatttttcaaaggaccggcgcggcggcggacgctagcgttcgcctgcgagcggcacgggtctcccgtcgacgggaggggagacccggcagcgggaggcgagggtggtcgtcgatgcgggcggtggtgttcgagcggttcggtgagccggccgaggtgcgcgaggtcgcggacccgcggcccgcggagcacggggtcgtggtgcgggtcgaggcgaccggcctgtgccgcagcgactggcacggctggcagggtcacgaccccggcatcacgctgccgcacgtgcccggccatgaactggccggcgtggtcgaggcggtgggagcgcgggtggagcggtggcggtccggcgaccgggtgaccgtgcccttcgtgtgcgcctgcggcacctgcgccgcctgcgcggcgggcgaccagcaggtctgcgaacggcagacccagcccgggttcacccactggggctccttcgcccagtacgtggcgctcgaccacgccgacgtgaacctggtcgccgtgcccggcgagctgtcgtccgcgaccgccgcctcgctcggctgccgcttcgccaccgcataccgcgccgtggtccagcagggcagggtcgccgcgggtgagtgggtcgccgtgcacggctgcggcggtgtggggctgtccgcggtgatgatcgcggcggcgtccggcgcgcgggtggtcgcggtggacgtgtcgcccgccgccctggagctggcgcggcggttcggtgccgcggaggccgtggacgcctccgctgtcccgga

SEQ ID NO: 923 - DNA, 666 bp, Unknown
  Kingdom: Bacteria, Phylum: Actinobacteria, Class: Actinobacteria, Order: Streptomycetales, Family: Streptomycetaceae, Genus: Streptomyces
cacgggcgcgtccgcccctgccccgctgacgcctgcgcccggccccgcggcgtcactcgaccgcgctgcccgccttccactccgcccagcccatgttccagccgccgagtccgttgctcgggctgaccgtcttgtcctcgctgtggacgatctccaccacgtcaccgacgaggctgcggtcgaagaaccagcccgccggggtgtccgagccgccgcccttgacgtcctccagacccacgcagccgtgactgacgttggcgcggccgaacggctcgggtgtcgaccagtagttgccgtgcaggaaggtgccggagccggtgaggcgcatggcgtgcgggacgtcggggatgtcgtactcgccgccgaagccgacggtccggctgttcatgcgggtgacctccagcatctccatcaccaccatcttcccgttgtaggtggtgtgctcgggcgccccggccgtgatgggcacggtggcgagcagttcgccgtcgcggcgcacctgcatggtgtgcgcggcggcgtcgaccagggagacctggctgcggcccacggtgaaggagaaggacttgtgctggaggccgtagacaccgggtgccgcctggacgtccctgaggcgcaggtcgacggtgacccgggtgccgggggtccagtagtgctcgggacgga

SEQ ID NO: 924 - DNA, 6768 bp, Unknown
  Kingdom: Bacteria, Phylum: Actinobacteria, Class: Actinobacteria, Order: Streptomycetales, Family: Streptomycetaceae, Genus: Streptomyces
ttacggatacccgggccagcccggccagccgggttacggctaccccggccagcccggcgccccgacgcagccgcagccgcaggccggtgtgccgggcggcggcggcgcgggccgctgggacaagaagcagctgtggatcatcgtggcggccgtcgccgccatcgcgctgatcatcggcggcggcgtctggtacgcgaactcgtccggtggcgacggcaagaaggacaccgcgtccaccggcggcgcgaccggcggcggtgacgacggcggcaagtccggccccggcggcaccgcgacgggcggacaggagaaggtgccgtccaaccccgccgccaaggtcctctaccagctcccgatgcccgccgtcgacgacacgacggccaccaccggctcctggctcaccggcaaggtgtacgccaagaccggcaacgccgagatcggcggctacgacccggtcaagggcaccaagctgtggacgatcaagctccccggcccgatctgccaggccacccgccacatcacgggggacggcaagaccgcgatcctctacgagcccgccatgcccaccaaggccaagccctcgcacggctgcagtcaggtcgcggcgatcgacctcgcggcgggcaggaagctgtggacgcgtgaggtcaagtccggcgacgacgcggtcagcctcgacaacgtcaccatcggcggcggcagcaccgtcgccgtgggcagcaccagcggcggcgccgccttcaccctcgccggcggcaagccgctgtgggcccccaagcccggcgacacctgctacgacgccggctacggcggcggccggaaactggtcgcggtgcgcaagtgcggccagtacggccagcgtcagctgctcatccagaccatcgacccgaagtcgggcaaggtgctctcggagtacaagctggccaacggcatcgagtacgcggggatcgtctccgccgacccgctcgtcgtcgcggccgacctcggcggcgaccacggcatctcggacttcttcgccatcgacggcgcgaccggcaagctgcgctcgcacatcagcgcgcccggcgaacagtacgcgggccgctgcgacgcgatcaccaggatcgagtactgctcgggcatcgtggccggcaacgaccggctgtacctggcgaccgagcagcacgacggcagcggcgaccacggccagaccaacgagatcgtcgcgttcgacctcgccaccggccggcagaccggccagcgcgcggacgccggcgacggctaccagatctatccgctgcgcatggacggcggcaacctgctcgcctacaagcgcccgccctacgacaagggcggccaggtggtgagcatcgacggcaccagcttcaaggagaccgtgctgctggagaacccggccacgcgggacgtacgggccgcggagaccggcatgtccccggactacgcggagttcctctacgcgcgcggccgcctctacatgtcggcggtctacgcccacaagcagcgctcgtcggcctacggcaaggagtacctggcgctggtcttcggcgtggccggctgacccgcccctccgcacggccacgcggctgtactgctgtacgccacgcggctgtacggccgcacctgcaccggccccgtccccgcgtcctgcgcgggggcggggccgcgcgcgtcgcgccgcggggtgcttgcgtgcttccgcgcgccgggtgttttccgcgatccggggcacttctcgccggtagggcagcgcggcaccgggcgagcgtgtagcttccgggagggaactggggggttgccgatgggagtccggctcatggtggtcgacgaccaccgactgctcgccgaggcgctggcctcggcgctgaagctgcgcgggcaccgggtgctggccgctgcggcgcccgcggcgggcgcggcggacctggtgatcagccgggcgccggaggtgtgcctgctgggcacggcggcaccggccgagccgggcgcgttcgacccggtggcgcggatcaagcaggaacgcccgcaggtggcggtggtcgtgctgggcccggtgccctcaccgcgcggcatcgccgcggccttcgcggcgggcgcctcgggctatgtgcggcacgacgagcgcatagagggcgtggagcgggcgatcatgaaggcgcgcgccggtgaggcggcggtggctccgcagctgctccaggtcgccttcggcgagctgctgaacccggccgtccagccggacgacgaggggcagcggctgctgcggatgctgacaccccgggaggtggaggtgctggtgcgggtggccgagggcgaggacacgcggctgatcgcggccgggatgggcatcgccccgagcaccgcccgcactcatgtgcagcgcgtcctgatgaagctgggcgtgggctcgcgcctggaggcggcggccctggcggcccgcacgggcctgctggcccgcgcgggccgcccatgaggtgagggggagcggacggccgggccctactcggcgtccgttccctgcgccggcggggtcggcggggcggccggccgcagcttcagccacaccaggaagaacacgccgaggagcagcatgccgatcccggtccacaggttgatgttgacgccctgtgccttgtcgatggcggcctgcgagtcggtgatcccggtgaccgtgacgatgacgccgtagaggacgaacagcccgccgatgatccgccgcaggtcgaagatgcgggcggcggtcgcggacttgccctccaggtcggtgacctcgcgctggacgtcctgctcggagtaaccggagtgcgggcccaagtgctcggaccggccggggttctcagactgtgacatggtctctcaatcctcccgcgatcagaacgagaacgggatgtagcaggcggcggcgaggacgacggcgccccagccgagcagcgcgggccggcggtaccaggcctcgtcgccgggcgcgggcgcctcggccatgccgggtgacctggtgccgtagacgagtccttgcagggccgcctccggcttgggcttggtgaacagggtgacggccaccatgacgaccgcgccggcgacgaaaccggcgatcgccgagacgaagttggcgccctggtcggtggggatgtggatgatgtccttcttgtagaggacgaagtagttcaccatcgccgcggtggtgcccgcgagcaggccccagaagccggacttcacggacgcgcgcttccagaacatgccgacgatgaacaccacgaacatcggcacgttgaagaaggagaacagcgtctgcaggtagctcatgatgttcgagaacgaggacgccaggaacgcggtgccgaccgaggcgagcacgccgacggcggtgatgagccggccgaaccgcacgtagtaggagtcctcgcggcccttgacgacgtacttggcccagatgtcgttggtgaacacggtgttgaaggacgacacgttggcggccatgccggccatgaaggcggcgagcagcccggtgaccgcgatgccgaggacgccgttgggcagcagttcctgcatcaggtaggggatcgcgtcgttgtactggagcccggaggcggaggtgccgatcttcgggacgacggcggcggcgaccaggccggggatcatcaccaggaagacgatgaagatcttcgggaacgcggcgatcagcggggtgcgctgcgcggccgagaggttcttcgcggacagggcgcgctgcacctcggcgaagttggtcgtccagtagccgaaggagagcacgaagccgaggccgaggacgatggtcagccagttggcgccgagcgggttggcgtggccgatgccggtgccgccccaggcggtggtgaagttcgcgccgtgggtctcggtgagcttgtgggtcaggccgtcccagccgccgaccttcttcaggctgaggaccacgagcgggatgagggccgccaggatcacgaagaactgcagcacctcgttgtagatcgcggaggacagcccgccgagggtgatgtaggccaggacgaagaagccggcgacgacgatggcgacccactgcggccagccgagcagcgcctcgacgacgatcgcgagggcgtagaggttcacaccggcgatcaggatggcagcgaaggcgaacaggatcgaactcagcaggtgcgcgcccctgtcgaagcgcagcagcaggaactcggggaccgagcgcaccttggagccgtagtagaagggcatcatcaccaggccgaggaagaccatggccgggatggcgccgatccagtaccagtgcacggtgtaggcgccgtactgggcgctgttggcggccatgccgaggatctcggtcgcggccaggttggcggagatgaacgccaggccggtgatccacgcgggcagggagcgtccggagaggaagaagtcgagactggtcttcaccgagcgccgggcggcgaagccgatgccgaggaccacgacgaagtatatggcgaggatcgtgtagtcgagggcgttggtcggcagccgtagctccgccgccagatacgcgggcgcgtaggtgggggatgtgggggtttgcataagtactcgcttcgttgcgcgaacggatccagccgggaacctacgccttcgcgttcatgaattgaacactcatgttgattgtctttgtttgattgtgatgtgccgcccgtggcgcctccttgcgcgccgccggtagcctcccatggtgagttgtgatgtgttatgttcgattgtgttggatgacgcgtgatcgggtgcgacccgggcttggacgaacagggagtccgaagtgaagaagacctcgacccggctggccgacggtcgtgagctgatctactacgacctgcgtgacgacaccgtccgcgacgccgtcgaccggcgcccgctggagccgaccgtcaccagctccgagatccgcccggacgtgctgctcggcgacgcggtcgccgtggcctcccaccgccagggccgcacctaccacccgccggccgacgagtgcccgctgtgcccgacccacggcgagcggctcaccgagatcccggactccgcctacgacgtggtggtcttcgagaaccgcttcccgtcgctggccggcgactcgggccgctgcgaggtcgtctgcttcacctccgaccacgacgcgtccttcgcctcgctgagcgaggagcaggcgcgcctcgtcctggaggcgtggaccgaccgcacggccgagctgtcccacctgccctccgtcgagcaggtgttctgcttcgagaaccgcggcgccgagatcggcgtgaccctgggccacccgcacggccagatctacgcctacccgttcaccaccccgcgcaccgcgctgatgctgcgttcactggccgcccacaaggacgccaccggcggcgggaacctcttcgacgccgtactggagcgcgaactggccggtgagcgggtcgtcctggagaccgagcactgggcggccttcgtgccgtacgccgcgcactggccctacgaggtccacctctaccccaagcgccgtgtccccgacctgctcgcgctcgacgaggccgcgcgcacagagttcccccaggtctatctggaactgttgcggcgcttcgaccgtatcttcgatggggcggccggcggggaaggcgccgggggtgaaccgccgacgccgtacatcgcggcctggcaccaggcgccgttcggcgcgctggaggagttcgacggggtcgtccgcgaggacttcgccctccacctcgagcttttcaccatccgacggacttccggcaagctgaagttcctcgcgggctccgagtccggcatgaacgtcttcatcaacgacgtgccgccggagcgcgcggcccagcgattgcgagaggtagcgagttcatgagcgggaagtacctggtgacgggtggcgcgggttacgtcgggagcgtggtcgcccagcacctgctggaggccggccacgaggtcgtcgtgctcgacaacctctcgacgggcttccgtgagggcgtgcccgccggcgccaccttcgtcgagggcgacatccgcgacgccgccaagtggctggacgcctccttcggcgcggtgctgcacttcgccgcgttctcgcaggtcggcgagtcggtggtgaagccggagaagtactgggagaacaacgtcggcggcaccatggcgctgctcgccgcgatgcgcgaggcgggcgtgcgcaagctggtcttctcctccaccgccgcgacctacggcgagcccgagcggacgccgatcgtcgagacggccccgaccaagcccaccaacccctacggcgcctccaagctcgccgtcgaccacatgatcaccggcgaggcggcggcgcacggcctgggcgcggtctccctgcgctacttcaacgtggccggcgcctacggcgcctacggcgagcgccacgaccccgagtcgcacctgatcccgctggtcctccaggtcgcccagggccgccgcgaggcgatcaacgtcttcggcgacgactacccgacgccggacggcacctgcgtgcgcgactacatccacgtggcggacctggccgaggcccacctgctcgcgctcgaggccgccaccgcgggcgagcacctgatctgcaacctcggcaacggcagcggcttctccgtgcgcgaggtgatcgagacggtccggcaggtcaccggccacccgatcccggaggtcgtggccccgcgccgggccggcgacccggcggtcctggtcgcctcggccgacgccgcccgcgagaagcttcgctgg

SEQ ID NO: 925 - DNA, 2760 bp, Unknown
  Kingdom: Bacteria, Phylum: Actinobacteria, Class: Actinobacteria, Order: Streptomycetales, Family: Streptomycetaceae, Genus: Streptomyces
cggggcccggcccggcgcgtctgcacgcgccgaggcgccgcaggatcccccgctgctcgaccttgagggcgccctggacgtcgcggggaacccggcgaagagccggatccctccgcgtaggtctggggactaccggcgggcgaggggactgtaaatcgttcggtgtaactcccgatcatggaggatgcatcgatgaccagtgagaacctggccgagcaggacgcgggcgagccgcaggagtcctagcggcggttgacgccggcccgctccagcggccggctacgggcgggggagctgttcgatcagccactgccgggggccgttcacttcccgagtggggcgttcccagaggccggtgtccttcacgtcggtgaaccccgcgaacttcgcgttcggccgttcggcgcgcatctgatcgtgcaccagggcttcacgatcaggatcgtggccgcggcgcggtcgtcttgcccggccttgcggaaggcgtcggcgagtgccagggtccgggcctctgcggctgccttcgcggccccatatacggcgccgcgggcggtgggccgggtggcggtggaagcgctgatcagcgtgaaccgaccatttgcgctgcggctgagcgcgttgcagaaggcgagagaggtgtgctggacggtccggacgagcagcttctccagcagatcccagtcgtcgaggtcggtctcggcgaacgtggcggagccgcgccagccgccgacgaggtggaccaggccgtcgatgcggccgaactcctgctcggtgcgctccgcccagctgcgggtgacgccccggtcgagcaggtcgaccgtctccccgatcacagtgctggcgctgtgcgcatagcgtccaccgcctccgcaagacgggacggtcagaatcggcggcgccggtgcggcgcggccacggctacacgctgcgcgtcaccgccgcccccgcggtgcaccggcaactcctcgaccgctgccggccgctcgacggcccccggagcgtcccggcccagcgcaaggaccgccgtgagtacgagacccgcgtcagcaccctcacgccgaccgggccatgatcgttctcaccgggatttcctgcacagcaactactcacactcgaagagccccgtgagttcgcggaaactgaaggttcctcacggcgaacccgcgggtcgaccaccccgattctcgcgaaaggacccgcgagttcacttcaagacacgggcccatcctcagctgactccacggccggcgccacccccgcatggtggatggtgtggacgctgaggacgggatcgagggcaggaacgaggaccctggtggcgatgtccaccaggtgcggtggtgcggtgccagcctgcagggcggtgacgtactcgatgacttgcgcgtgcgtgagggtctggacccgctgtcgcagcacgtgcatggcgacgattcgtccatcggccaccgctgtccggcggatctcctcatgcagctcatccactgcggtgcatgtggtcatcttcctgatgcgggtccggtagtccagctcccactcgccggtgaccgcagcgaccggtccgatctggtggaggctcccgtcgaggcgatccaccaggtaggggccgttgccgcccaagagctcacctgggtctcccgtgcgtaggtattctgcggtttggtagtagacgatccagacgagttcgtgctcctcagccccagccaccaccagccgccccgagtacttgcggcccagatcttcctgggccacccggatcgcgaagtcacggtcgatcatgtccggcagcatctcgcatgccgagggacatgaacaggagttttcttcagctgggttcgctgcgttcccagaggaggtattcaggcgcacgctgcgcggagatgcgcctcgaccgggcccaggtgctggtcatgggccagggcgatttcgcccgcgagattgaggacgcggatgctccctgtcgcggccggcccatggcctccatgggggagcacgggcggtcgggcccccctcggcgaccaggtccggcgcatcacgtggccccactctcaccaggcatgattccgatatgcccgggtatcaccggaatagcatctccgtggcagacagggacgccttgccaggcctgtcatcagcgaccgctgaggaaggagaccaccatgatcgctcttggcgtcatcctgctcatcgtcgggttcgtcctgcacatcggcatcctgtggacgatcggcatcatccttctcgcgatcgggctcatcctgttcgtcctcggttccatcggacacgccgtcggaggccgacgccattactggtaggtgcagcggccggctgcccgtggcgagccgccgcccactggggctcggcggaagcggtggcggaaggcgcctcattccggggccgggatggtgtcgttggtgacgatctcgggttccggatcattcgggccgctgacggccttgatccggtcgagggccgcggcgacggcgtacacccggcgggaagatgcggtgtgggactgccgtcgtaccgggacctcgaggacggcggcgtggaggctgcggagtaccgggtgtgggtccgcgctcccgaccatgtggggccggtcgacggcgtcgactacgaccaggtccccaccgaccgcctggagacgccggccccgccgtcggccgtccgcgagatcctcggcgagcgccggcccaccggctgggtggtgcagaaagtccgcgcccggcggggcccggcccggcgtgtgctgcacgc

SEQ ID NO: 926 - DNA, 1782 bp, Unknown
  Kingdom: Bacteria, Phylum: Actinobacteria, Class: Actinobacteria, Order: Streptomycetales, Family: Streptomycetaceae, Genus: Streptomyces
tgcggcccaccgggccgaaggcccgcagcagcaccgcgctgatcacccggaccaccccgcccgccagcagcgggccgacgacgacgaaaccgatcagggtcaggaccacgccgagtcccaggaccgccgagccgtcgctcgccttgtcggcggtggccgccgcgtacagggaggccgcgcccgcgccggtcaggaccagaccgatcacggcgcgcacccagcccgccctgccgtcggccggcgtaccggcgtcgcgcagtgcggccatcggggagaccttcccggcgcggcgggccggcaggtaggcggccaggacggtgacgacgatgccgaggaccagaccggccaccggagtggtcgctttgatcgtcaggtcatcggtggacaggtccatgcccgccgcgcccatcagcttcatcagcccgatcgcgatgccgacgcccgcgccgaccccgaggaccgagccgacgaagcccagcagcagcgcctcgacgagcaccgaccggttgacctgcttgcgcgaggagccgatcgcccgcatcaggccgatctcccgggtgcgctgggcgaccagcatgctgaaggtgttgatgatcaggaagatgccgaccaggaaggcgatcccggcgaagccgagcatggcgtacttgatgacgtccatgaacgagccgaggctctcgcggttctcgtcggcgttctccttggcggtctggatcttgtacgcggctgccccggtcccggcggtgctctgggtcccggcggtgcccagcgtccgcgtcacgttctgcttgagctgctcgtcggagacgccggaggccgcggtgaccgagatgtccgtgaaccggccggtggtgccgagcagtccgcgctgggcggtggcggtgtcgaagtagacgacggaggcgcccgggttggtcaccttgaaggtggcgatgccgacgatccgggccctgaggtcaccggtctgcgcgatggtgcgcagctcgtcgccgagcttcaggtcgtgcttgtccgcggtgtcggcgtccaccatcatctcgcccggcccgtgcggggcgtggccggaggtgatctccatcgacttcaggctgccggcggaccagttgcccgcgatggtcggaccgccgttcgaggagcccatgttcttgttgtgactgtcgacgacggtcacgttcgacgaactgacgccgccctcggccgacttgacgccctcggtgtgccggacccggtccaccgtggcggccggcagggtctcgggcaccccgctctgcgggctctcgccgctcttcgccgccttcggcgagacggtcacgtcggccgccgtcaccgcgaacagcttgtcgaacgtcgtgttcatggtgtccgtgaacaccagcgtgccgcacacgaacgccaccgacagcagcaccgccaccgccgagagcgccatgcgtcccttgtgcgcgaagaagttgcgcagggaggtcctcaggacggtcatgacgtacgcccccgggcgtcgaagtccttcatgcggtccaggacctggtcggccgtcggctggtgcatctcgtcgacgatccggccgtcggcgaggtacagcacccggtcggcgtaggaggcggccaccgggtcgtgcgtgaccatcacgatggtctggcccagctcgtcgacggagcggcgcaggaagcccagcacctcggcgccggcccgcgagtcgaggtttccggtcggctcgtcaccgaagatgatctcgggacgggccgccagggcgcgggccacggcgacgcgctgctgctggcc

SEQ ID NO: 927 - DNA, 11127 bp, Unknown
  Kingdom: Bacteria, Phylum: Actinobacteria, Class: Actinobacteria, Order: Streptomycetales, Family: Streptomycetaceae, Genus: Streptomyces
tgccgggccggtcacggcgatgcacatcgccgtgaccggcccggcagggacggtcgaactcgcgctggaggtcaccgacatgcccgaccgggtggtgtggctgccgctgaactccgtgggcgccggcgtcgcctccgacaccggggcacagcccggctccctcgtccgtatcggcccggcgacccgcgcgaccgaggcccccgaggaggtggaggcatgaacccgtccctcgccgcagagaacctctcgatgttcggcaccgacccgtggtggctggtcgtcgtcaaggcggtgttctgcttcgccttcctgatggtgaccgtgctgttctccatcgtctgggagcgcaaggtcgtcgcctggatgcagctgcgcatcggccccaaccggcacggcccctggggcatgctccagtcgctcgccgacggcgtgaagctgatgctcaaggaggacctcgtcgtcaagcgcgcggacaaggtcgtctacgtcctggcgccgatcgtcgcggccatcccggcgttcatggcgatcgccgtgatccccttcggccccgccgacaacgagatctcgatcttcggccaccgcaccgcgatgcagctgaccgacctgccgatcgccatgctgtacatcctggcgatcgcctcggtcggcatctacggcatcgtcctggcgggctggagctccgggtcgacgtacccgctgctgggcggcctgcgctcatgcgcgcagatgatctcctacgagatcgccatgggcgccgcgttcgcctcggtgttcctgtactcgggatcgatgtcgacgtcgaccatcgtcgaacagcagcacgaccgctggtacatcctgctgctgccggtctccttcatcctctacatcgtcaccatggtcggggagaccaaccgcgccccgttcgacatgccggagtccgagggcgacctggtcggcggcttcaacaccgagtactcctcgatcaagttcgcgatgttcatgctcgccgagtacgtcaacatggtgaccgtctcggccgtgtcgaccacgctcttcctgggcggctggcgggccccgtggccgatcagcaccttctgggagggcgccaaccacggctggtggccgctgctctggttcgtgatcaaggtgcagctgctgctgttcttcttcatctggctgcgcggcacgctcccacgggtgcgctacgaccagctgatgaagctcggctggaaggtcctcatcccggtctccgtggtctggctgatgctcgtcgcgaccgtgcggacgctgaggaaccagcactacgacttcgccgacatcgccctctacgtcggcggcggcgtcctggccctgctgatcctgtccttcgtcgccgacatgttccgtgagaaggccaaggagaccgagcggccgcccgccgccggcccggccgggttcgacccgatggccggcggattccccgtgcccccgctgcccggacaggagctgcccccggtgccgcgacgccgtccgcaccgcgagcgggagctgattgtcagtggcgggtcggacactgtcagtgacggatcgctggatggaaaggaggcgtccgatggctgaggaacccaaggggaccgatcccggtttccagaaccccgtggccggcttcggcgtgaccttcaaggccatgttcaagaagcggctcaccgagcagtacccggagcagaagaagaccaccgctccgcgtttccacggacggcaccagctcaaccgccatccggacggcctggagaagtgcgtcggctgcgagctgtgcgcctgggcctgccccgccgacgccatctacgtggagggcgccgacaacaccgacgaggagcgctactccccgggcgagcgctacggccgcgtctaccagatcaactacgcccgctgcatcctgtgcgggctgtgcatcgaggcgtgccccacgcgcgcgctgacgatgaccaacgagttcgaactggccgactccagccgcgcgaacctcatctacaccaaggagcagctgctcgccggcctcgaagagggcatggtcgacacgccgcacgccatctaccccggcatggacgaacaggactactaccggggcctggtgaccgaggccgagccgggcacggtgcgccaggtggccgtctccaagggcgagcaggcggcggacgacgaggaggtggacgcatgagcgcgcagctcgcggcctacaccacctccaccggggaggcgttccagttctgggtgctcggcaccttcgcggtgatcggcgcgttgtgcaccgtcttcatgaagagggccgtgcacagcgcgctgtgcctggccggcaccatgatcatcctggcggtgttctacctcgccaacggcgcctacttcctcgggatcgtgcagatcgtcgtctacaccggcgcgatcatgatgctgttcctgttcgtggtgatgctcgtcggcgtgaccgccgcggactccctgaaggagaccatcaagggccagcggtggctggcccttctgtgcggcctcggcttcggcatcctgctgttcgccgggatcgccaacgcctccctgaaggatttcgccggcgcgggcaaggccaacgcgggcggcaacgtggagggcctggccgccctcatcttcacccggtacgtgtacgcgttcgaactcaccggcgccctgctcatcaccgccaccgtcggtgccatggtgctcacccaccgcgagcgcaccgaacgggccaggacccagcgcgagctgtccgagcagcgcgtacgcgagggcaagcacgtaccgccgctgcccgcccccggtgtctacgcccggcacaacgccgtggacatcgcgggcctgctgcccgacggcacgccctccgagctgacggtcagcaagacgctgcgcgaacgcggccagatccgtgacgtctcggccgaggcgctgaacgacctcaaggccctggagcagcgcgccgaggagcgtctggagcgcaccgagatcgacccggcgagccgcaagcggcccgaggaggcgtcgaagtgaatcccgtcaactacctgtacctcgccgccctgttgttcacgatcggcgccaccggtgtcctcatccggcgcaacgccatcgtggtcttcatgtgcatcgagctgatgctgaacgcctgcaacctcgcgttcgtcaccttctcccggatgcacggcaacctcgacggccagatcatcgccttcttcacgatggtcgtcgccgcggcggaggtcgtggtcggactcgcgatcatcgtgtcgctgttccgttcccgccactcggcctcggtcgacgacgccagcctgatgaagctgtaaggggtcggaagaatcgtggagaacctgattgcgctgctgatcgcggcgcccctgctcggagcggccgtcctcctggtcggcggccggcgcctcgacgccgtcggccactggatcggcaccctgctcgccgccgcctccttcgtgatcggcctggccctcttcgccgacctgctcggcaagagcgccgaccaccgcacggtgacccagcacctgttcagctggatcccggtggccggcttccaggcggacgtcaccttccggctcgaccagctgtcgatgacgttcgtcctgctgatcaccggtgtcggctcgctcatccacctgtactcgatcgggtacatggagcacgacgagcggcgccgccgcttcttcggctacctcaacctgttcctcgcggcgatgctgctgctcgtcctcgccgacaactacctgctgctgtacgtcggctgggagggcgtcggtctcgcctcctacctgctgatcggcttctggcagcacaagcccagcgcggccaccgccgcgaagaaggccttcctggtcaaccgggtcggcgacatgggcctgtcgatcgcgatcatgctgatgttcacgacgttcggcaccttcgccttcggcccggtcttcggccacgtcggcgacacctcgcagggcaagctcaccgcgatcggcctgatgctgctgctcgccgcctgcggcaagtccgcccaggtgccgctgcagtcctggctcggcgacgcgatggagggcccgaccccggtctccgccctcatccacgccgccaccatggtgaccgcgggcgtctacctgatcgtccgctcgggtgcgatcttcaacgcggccccggacgcgcagctcgccgtcaccgtcgtcggcgcggtcacgctgctgttcggtgcgatcgtcggttgtgcgaaggacgacatcaagaaggcgctggccggctcgacgatgtcgcagatcggctacatggtgctggccgccgggctcggccccatcggctacgtcttcgcgatcatgcacctggtgacgcacggcttcttcaaggccggactgttcctcggcgccggctccgtcatgcacggcatgaacgacgaggtcgacatgcgcaagtacggcggcctcaggaagtacatgcccatcaccttcatcaccttcggcctcggctacctcgcgatcatcggcttcccgggcctgtccggcttcttctccaaggacaagatcatcgaggcggccttcgccaagggcggcaccgagggctggatcctcggcggcgcggccctgctgggcgcggccatcacggcgtactacatgacacgcgtgatgctgatgacgttcttcggcgaggagcgctggcgcgaccggccgaccgcctcgcccgccgcgcccagcgcggaaccggcggccgaggagcgcggcgcccacgcggagccgcatccgcacgagtcgccgggcgtcatgacgatcccgatgatcgtgctggccgtcgggtcggtcttcggcggtgcgttcttcagcatcggcgaccgcttcctgcactggctggagccggtcaccgggcacagcgagggcaactcgccggtcagcgccgcggtcgtcaccggcgccaccatggtctgcctggtcgtcggtgtcgccatcgcctgggcgcagtacggccgcaaaccggtcccggccgtcgccccgcgcgggtcgctgctcacccgggccgcccggcgcgacctgctccaggacgacttcaaccacgtcgtcctcgtccgcggcggcgaacacctcacccggtcgctggtgtacgtcgaccacaccctggtcgacggcgtcgtcaacggcacggcagcttccgtgggcggcctgtccggccggatgcgccggctgcagaacggcttcgcgcggtcctacgcggtctcgatgttcggcggtgcggcactcctggtcgccgcgaccctgctgatgagggcggtctgataccgatgtcctttcctctgctgacagcgacggcggtcctcccggccgtcggggccgtcgccacggccgccgtaccggccgcccggcgcgccgccgccaagtggctggccctcctcgtctccctcggcacgctcgcgctggcgctcaccaccgtggtccgcttcgaccccggcggcgcccgctaccagctcaccgagtcccactcctggatcgccgccttcggggtccgctacgaactgggcgtggacggcatcggggtggcgctggtcgcgctgaccgcgctgctgatcccgttcgtggtcctcgcgggctggcacgacgccgaccccctggagaccggcagccgccgctggcgtcccacccagggcttcttcgccctgatcctggccgtcgaggcgatggtgatcatctccttcgaggccacggacgtcttcctcttctacatcttcttcgaagccatgctgatcccgctgtacttcctcatcggcggcttcggggaccgtgcccacgagcacggagaggagacggccgccacgcagcggtcgtacgcggcggtgaagttcctcctctacaacctggtcggcggcctgatcatgctggccgcggtgatcggcctgtacgtcgtcgccgggaacttctccctcaccgagatcgcccaggcccgcgccaacggctcgctgcacatggccaccagcaccgaacgctggctgttcctcggcttcttcttcgcttttgcggtgaaggcgccgctgtggccgctgcacacctggctgcccaacgcgatgggcgagtccaccgcgccggtcgccgtcctcatcacggcggtcgtcgacaaggtcggcaccttcgcgatgctccgcttctgcctccagctgttcccggaggcgagcaagtgggcgacgcccgtgatcctcgtcctcgccgtgatcagcatcatctacggggcgctgctggcggtcggccaacgcgacatcaagcgcctgatcgcatacgcgtcgatctcgcacttcggcttcatcatcatgggcatcttcgcgatgaccagccagggccagtccggcgcgacgctctacatggtcaaccacggcctctcgaccgccgcgctgctgctggtcgcaggcttcctgatctcccggcgcggctcccggctcatcgccgacttcggcggcgtgcagaaggtggccccggtgctcgccggcacgttcctgatcggcggcctggcgacgctctccctgccggggctcgcgcccttcgtcagtgagttcctggtcctggtcggcaccttcacgcggtacccggcgatcggcatcgtcgccaccctgggcatcgtgctcgccgcgctgtacaccctcgtcctctaccagcggacgatgaccggcccggtgaagcgggaggtctccgcgatgccggacctcagggtgcgcgagctggtggtcgtggccccgctgatcgtgctgctgatcttcctgggcgtctatccgaagcccctgacgaacatcgtcaacccggcggtcaagcagaccatgtccgacgtacacaagaccgaccccaagcccgacgtggaggcggccaagtgagcgcagcagccgtccacagcctgtggacaaccgcggccgacccgatcgccaagatcggcgcgccgaagatcgagtacgggcagctgtcgcccaccctcatcgtcgtcggcgcggcgatcgtcggggtgctggtcgaggccttcgtcccgcgcaggtcccgctaccacgcgcaggtgttcgtgtccgtcgtggccctgtgcgccgccttcgccgcggtcgtcgcgctggcggcgggcggctacggcaccaccaaggcacacatcgcggcgatgggcgccatcgccgtcgacggcccgtccctcttcctgcagggcacgatcctgctgaccgcgctggtcggcctgttcaccttcgccgagcggcgcctggaccccgaggcgcacggcaaccgcgtcgactccttcgcggcgcaggcctcggccgtgccgggcagcgacagcgagaaggccgcggtgaaggccgggttcaccaccaccgaggtcttcccgctgctcctcttcgccgtcgccggcatgctcgtcttcccctcggcgaacgacctgctgaccctgttcgtcgccctggaggtcttctccctcccgctgtacctgctgtgcgccctggcccgccgcaagcggctcatgtcgcaggaggccgcggtcaagtacttcctgctcggcgcgttcgcctccgcgttcaccctgttcggcatcgccctgctgtacgggtacgcgggctcggtgtcgtacacgacgatctcgcaggtcgtcgagggcaacgtgccccacgtcgacccggcgctggcgaacaccatgggcaacgacgcgctgctgctgatcggcgccgcgatggtggtcatgggactgctgttcaaggtgggcgcggtcccgttccacatgtggacgccggacgtctaccagggcgcgccgaccccggtcaccgggttcatggcggcggcgacgaaggtggccgcgttcggcgcgctgctgcggctgctgtacgtcgtgctgccggggatgcgctgggactggcggccggtcatgtggggcgtggcgatcgtcaccatgctcggcggtgcgatcgtcgcgatcacccagaccgacatcaagcggctgctggcgtactcctcgatcgcccacgcgggcttcatcctcgccggtgtcatcgcgacctcgcgcaacggcgtctcgtccgtcctcttctacctggccgcgtactccttcgtgacgatcggcgcgttcgccgtggtcaccctagtgcgcgacgcgggcggcgaggcgacgcacctgtccaagtgggccggactcggccggcgctccccgctggtggcggccgtgttcgcggtgttcctgctggccttcgcgggcatcccgctgaccagcggattcgccggtaagttcgccgtgttcaaggctgcggctcaggccggtgcggcaccgctggtcgtcatcggtgtgatctcgtccgcggtcgcggccttcttctacatccgggtgatcgtgctgatgttcttcagcgagccgcgggcggagggcccgacggtggcggtgccgtcgccgctgacgatgacggcgatcggcgtgggcgtggccgtcacggtggtgctgggtgtggccccgcagtacttcctggacctggcgaaccaggcgggggtgttcgtgcgctgaggcgaccaccctgccgacgcggctgcccggtgtcccggtgggggcgccgggcagtggcgtgcgagggagatcacccgcgccgacggggttaccaggggatgccggacaggtccggtgttcagcggcctggccttccgccgcctgtggataaccgcgaggttgtccgcggcgccccctatcgtggaggaagtggtcgagggacgacgtacgggggacgagacgatgagtgggacgggcggtgtcaccgagatggcagtgacggacagcgaggcgctggccacgctgcgccgggtcttcggatacgaggccttccggggtgagcaggaagcggtcatcgagcatgtggtgacgggcggcgacgccgtcgtgctcatgcccaccggcggcggcaagtccctgtgctaccagattccggccctggtcagacccggtacgggcatcgtggtgtcgccgctgatcgccctcatgcaggaccaggtggacgccctgcgcgccctcggcgtgcgcgctggcttcatcaactccacgcaggacttcgacgagcggcgcgtggtcgaggcggagttcctcgccggcgagctggacctgctctacctcgcgcccgagcggcttcgcctggacgccacgctcgacctgctctcccgcggcaagatctccgtcttcgccatcgacgaggcgcactgcgtctcccagtggggccacgacttccgccccgactacctggccctgtcactgctgggcgagcgctggccggacgtgccccgcatcgcgctcacggcgaccgccacccgcgccacgcaccgggagatcaccgagcggctgaacatgccgcaggcccggcacttcgaggccagtttcgaccggcccaacatccagtaccggatcgtgcccaaggccgaccccaagaagcagctcctggccttcctgcgcgcggagcacgcgggcgacgccggcatcgtgtactgcctctcgcgcaactccgtggagaagaccgccgagttcctgtcggccaacggcatccaggcggtgccctaccacgcgggcctggacgcgggcacgcgcgccgcgcaccagtcgcgcttcctgcgcgaggaaggcctggtcgtggtcgcgaccatcgccttcggcatgggcatcgacaagccggacgtccggttcgtcgcccacctcgacctgcccaagtccgtcgagggctactaccaggagaccggccgtgcgggacgcgacggactggcgtccaccgcctggatggcctacggcctcaacgacgtcatccagcagcgcaagctgatccagtccggcgagggggacgaggctttccgccgccgcgccgccgcccacctggactcgatgctcgccctgtgcgagacggcccggtgccgccggggccagctcctcgcctacttcggccaggacccgcaggagtccggctgcggcaactgcgacacctgcctgaccccgccggagacctgggacggcacggtcgccgcccagaaggtgctgtcgacggtcgtacggctccagcgcgagcgcggacagaagttcggcgcggtccagatcatcgacatcctgctcggcaagcgcaccgccaaggtgatccagttcgaccacgaccagctgtcggtgttcggtatcggcgaagagctgaccgagggcgaatggcgaggagccgtgcggcagttgctggcccagggcctgctcgcggtcgagggcgagtacggcacgctggtgctgaccgacgccagtgcctcggtgctgcgcggcgagcgcgaggtgccgctgcgcaaggaaccgaagcggccggccacctcgcggcaggcctcgtcctcctccgggcggagcaagggcaagaccgccgtggccgagctgcccgagcacctgctccccgccttcgaggccctgcgcgcctggcgcgccgaccaggcccgcgaacagggtgtcccggcgtacgtcatcttccacgacgccacgctgcgcgagatcgtcacggcctggccgacctcggtcgcccagctcggcacggtcggcggagtcggcgagaagaagctcgcgacgtacggggagggcgtgatcggggtcctggagtcactggcagccccggccggcgaccgtcccgaccccggcacggaacccgagccggagcccgagcccgcaccggacgacgactggatatagacgtctggatgagggcgactggagatagctggatacagccgcgcggtccggtccggtcccggtcggccttctcagcccagcgccgtcagccccggcgcgaacgtgatcagcagcggaagcaacggcaccagagccgccaccgtcgtggtcagggccctgcgcctgcggtccagccggggcgggggctcgaggaggcggtccacccgttcaccgagcagacggtggctggaggcgcaggacaggacaccgcggtgctggttgagttcgatcagggcgagagctgtggtgaggtggccgtggcggcgggacgcggtgtcgtcggcggacagttcgaccaggcggtgggtctggtcgcagaagtgcgcgaagagagggatgcgcggaaaaccggtcgccagcgcggtcgacaggtgcagcagccagtcgtggtgggcgcgggcatgcccgcgc

SEQ ID NO: 928 - DNA, 517 bp, Unknown
  Kingdom: Bacteria, Phylum: Actinobacteria, Class: Actinobacteria, Order: Streptomycetales, Family: Streptomycetaceae, Genus: Streptomyces
ttcgagtcgctgtaccggatcggcgcgctgtgcctgtggtgctgcctggcctgggccgccaccgtcctgctgttctggtacgtgacgtcgtacgccgtccgctgccgcttcctgcccgcgcccgccggggtgcgccggttcctcgacgagttcccctgggtgctgccgctgctgcacctggcggtgatcggcctgctggtcctgacccgctggtgggacttctggacgggctgacccggccgtgacggttcagccgccccgtcgtccagcggccccgtcgccccgtcgccctcccggtctccccgtcgttcagtcgtcacgtcgcaccgtcgtactactgcggcactcgggggaatcttgcgctggtcgcgagtcaggatcgttgaccggtacggacgatgccgaacccgaccctgaaagggaccgtgcctgccatgaagtcgaccactcgaggaaccctcgccgcgctcgtcacgggcgtggcggcagccgtcggcgccgccgccaccgcgactcc

SEQ ID NO: 929 - DNA, 1798 bp, Unknown
  Kingdom: Bacteria, Phylum: Actinobacteria, Class: Actinobacteria, Order: Streptomycetales, Family: Streptomycetaceae, Genus: Streptomyces
ccggctcggccggcgacggcagcgacccgtacgagcccctgctcgcccgcgccgcccagcagctgaccggcggcgccttcgacccgcgggaccccgacttcgccgccgcgctcgccgccctcgacaccgaggccgccacctggtggcagcggctcgacacctccgccggccgcgaggcgctgtgggccgatctgtccccggcctccgaccccggcatgttcggccagagctatccgcggctgcgcacactcgcgatcgcctgggccactcccggcacctcgctcaccgggcaggcggccgtgcgcgacgggatcctcgacgcgctgcgcttcctgcacaccgccggctacaacgcgtcccgccgcgagagcggcaactggtggttctgggagatcggcgcgccgcgcgccctgatggacgtgtgcgtgctgctgcgcgcggacctccctcaggaggaccgcgacgcctacgtgaagacggtggccgcgttcgtccccggcccggatcgccgcaccaatgcgcccacgctcgccgagaccggcgccaaccgcgccgacaaggccgtcatcgtcgcgctgcgcgggctgctcgcgggcgatcccgccgcgctcgcggcggcccgtgacggcctgtccgacgtgcgcgacaacggcaggaacagcctgttccagtacgtcacttcgggtgacggcttctaccgggacggctcgttcgtgcagcactcggacgtcgcgtacacgggcacgtacggcagtgtcctgctgggcggcgccggccagctgatggcgctgctcgccggttccgactgggccgtcaccgaccccgcggtcgaggtgctgtacgaggccgtcgagcggagtttcgcacccttcctgttcgacggggtgatgatggacgcggtgcgcggccgcgccatctcgcgcgaggccgcccgcgaccacgacgacggggcgacggcggtcgcgcacatcctgcagctcgccgacgccgcaccgccggcgtacgcggaccgctggcgcgcggcggccaagggctggatgctgcgcaacacgagcaccccgtacaaggaactcgtccacatccccgacctggcccgcgcgaaggccctcctcgacgatccttccgtgcggcccgcggaccggctcaccgggcacttcgtcctcgccgacatggaccgcgtggtgcaccgccgcccgtcgtgggcgtgcacgctgtcgctgtcgtcgaagcgcatcgccgcctacgaggcgggcaacggcgagaacctgcacggctggtacaccggcgacggcatgacgtacctgtacgacggcgacgaccaggacgccttcggtgactccttctggccgaccgtcgacccgtaccggctgccgggcaccacggtggacacccgcacccggaccgacctcggcaccggcgccgggaccggcacgttccgcccgaagaacgcggtggcgggcggggcggtcctcgacgcccgctacggcgccgcggcgatggagctgatcgcggacgggtcgacgctgcgggccaagaaggcgtggttcttcctggacaacgcggtcgtcgcgctcggcgccgggatcacggcgagcgacggcaggacgatcgagacggtcgtggagaaccggaacctgcacgccgacggcacgccccggctcgtcgtcgacgggcagcggcagcccacggaacaaggctggtcggccgcgctcgaggacgcgcgctgggcccatctggaaggcaccggcggatacgtcttcccctccggcgggccgctgcgcgcgtcctcgagcgcggc

SEQ ID NO: 930 - DNA, 7003 bp, Unknown
  Kingdom: Bacteria, Phylum: Actinobacteria, Class: Actinobacteria, Order: Streptomycetales, Family: Streptomycetaceae, Genus: Streptomyces
gtgctcgcgctgcccgcaccgggctggctggtcgtcgctgccgtggttgtgcaggcgtaccagaccgtcggcggcggtggactggaccagccagcccggtgcgggcagcgcgagcacggcgtcggcgcgctcggccggggcgggttcctcgccggcggtccacaccgggtggccggccggcaacagcagtccgaggaagcccttgctcgcccagtacggcgaggccggccccgagtagggctgcaccagcggcgggcaggggccgtaccagccaagcgtgaggaggccgtcctcgtccgtggcgccccggtcgaggaagtggcgcagggcgccggaggcgaggcggcgggtggtgccgggcgacagcgggctgtggtccgtcagggcgcccgcccacagcgcggcggccgacgcgaaccggtagatgagcgaacggccctggtgcagcggggccccgtcggcgccgaaggtgtgcgcgtacgcgcccaggtgggccgcgagccgggtgccgtagcggtcgagcagctcggagtcgcccgacaggtgggcgtgcaggagggggtagaggtggaaggcccagccgttgtagtggtcgacggcgcgtggccggccgtcggtgtaccagccgtcgcccaggtaccaccgctcgatcctgtccagaccctgtgcgacggcgtgttcggcggcctcggtgtggtggcccgcctcggcgaggaatccgccgacggtgacctggaagagccaccagttgttgtcgacgggggtgtggtgcagcgcgccggcgagccagtccgccgcgcgggtgcggaccggtccgggcaggcggtcccacagccaccggcgggtcaggcgcagggcgagcgcgaccgacgccgcctccaccatggcctgtccccggtcggtgaccgcaggccaggccaccgggtcacggccggtcagttccctgtcggtcgtcgggtggcgcgtgcccgcggccagtccttcggcgtaccggtcgagcagtcccagcgggtccctgccgcccgcaccggcgacgcggaacgcggccagcaggaacgtacgggcgtagccctccagcgcgtccgagcgcggaccggaccagctcgggcgcggcccgggcagcgcgatcagcgcgtgctcaggaccggcgtgccgcagcgccgcgccgagcagccggtccgccgccgcctcccagtgggcccgggtccacccggtgtacgggctgagtgcgcggtcctcgggcgggaagggcgtaagcggcatgacgacggctcctgggtctgggatgtgccgaatctaggagccgtgcgatcgatcgtcaatcagagcgatcgaatgatccgagcgtgaaccgagaaagtcctggaataagcagaatgttcccgtacgcaccctagtctcatgtgatcagatccgatcgttcgatcgaaaggtattgacttcgatcggatgtcttctcaagatgtgcctacccgggcccgacggccacggagtccggcaggtctcgccgccggctcccaccgggcaccttccacccgtctcgttccccaggagccgagccatgtccgctgcccccgcccgcagtcacagagccctccgcgccgccgccgcgctcaccgccgccgccctgtccgccaccctcctcgccgcctgcggcggcggtggcgacgacgggccgtcggccggtgcgggcaagcccgtcgacatcacgttctggggctgggccaaggggaccaagcaggtcgtggacgccttcaacgcctcgcacaaggacgtccacgtcagctacgaggagatcccctccggttcggccggcggctacgccaagctgtccaacgcggtcaaggccggcaacgcccccgacgtcttcaacgtcgagtacccgcagctccccgacttcgtcagccagggcgccgtccaggacatcagcaagtacgtcggctccgacctgaagagcaagtacctgccgcaggcggtgcagctgaccacgctcggcggtgccacgtacgcgctgccgctggacgccgccccgcaggccttctactaccgcaaggacctgttcgccaaggccggcatcaaggcacccacgacctgggacgagttccgcacggccgccgagaagctgaagaaggcggagcccggcagccgcatcgccaccttcttccccgacgacccgaccaccttcgaggcgatggcgtggcaggccggcgccccctggttcggcacgtccggcgacacctggcaggtgagcctggagagcgccggcacccagaaggtcgccgcctactggcagaagatgatcgacgacgacctggtccgggtggagccctcgttcagccagcagtggacggcctcgctgcagaaggggcagaccgccggctacctgggcgcctcctggggcggcggcgtgctcaaggccaccctcccgaaggaccaggccggcaagtgggccgtcgccccgctgccctcctggaacgccaccccggccagcggcatgctcggcggcaccaccttcgccgtctccaaggacagcaagaaggccgaggcggccgtggagttcgccacctgggccaccacgaccgcgcagggcatccaggcccgtatctcctccggtgactcctcggcctacccggccgaccccgagctggtcccggtcgccgcgaaggccttctccaccgacttctacggcggccaggacatctacgccgtctacaagagcgccgcgcagtccatcgggcagaagtggacctggggaccggcgatgggcgtcaccaacaactccctgaaggactccttcggcaagctctcctccggctccggcagcatcgcgcaggcactcaccacggcgcagaaggacaccgtcgccgagatgaagacccgcggcctgaaggtctccgtgcgatgactccgaccgcccccacggccgcccgcgcgcatcccgccgcgccctcccgtaccgctgccgtccggcggcggcggtacggggcgccggccgtgctgctcgccccgttcttcgtgctcttcaccgccgccacgctggtgccgatcggctacgccgtctacctgagcctgtacgcggagcaccgttccggtctcggcttcggcggcagcgagaccgtcttcaccggcctcggcaactacacgcgggccctgggcgacaccgccttccgcggcggtttcctcaacctcctccagtactgcctgctgtacatcccgctgatgatggcgctggccctcggcctcgccctgctgctggactccgcgctggtgcgggcccgccgcttcttccagctcgcgctgttcctgccgcacgcggtgcccggcaccatcgccgcactggtctggatctacctctacacacccggcatcagcccggtcatcggcgcgctgaactccttcggcggccagaccgatctgctgggtcatcccctgccggccgtcgtcaacatggcggtgtgggagtggaccggctacaacatggtgatcttcttcgccgcgctgcaggccatcccgcgcgaggtcctggaggccgccgtggtcgacggcgccgggccgctgcgcaccgcgctcagcatcaagatcccgctgatccgttcctcgctcacggtggtcggcctgttcaccgtcatcggctcgctgcagctgttcaccgagccgatgatcctgcacggcaccacgcccagcgtcgtctccacctggtcccccaacatgtacgcctacaccgcggccttcgagcggcacgactacggcctggccgccgcgtcctccgtcctgctcgcgctggccgccgccgcgctctccttcgtcgtcacccgcgccacccgcggccggggcgagcgggcccggtcccagcacgccacggaggccgccgcatgaccaccgccaccgcacagtccggtgccgcccgcggacgcggccgcccctggtcgctgtccaggaccgccgtcaacggcgccctggtgctggccaccgcctacaccctgctgccgctcggctggctgctgaccgccgccgccaagaacaccggcgacctgctcggcggccgtaccctctccccctccacctggcacctcggcgccaacctgcacgccctggtcaccaccggcgacggcatctacttccgctggtacctcaactcgctgctgtacgccgggatcggcgccgtgctgtgcgcgctggtgtgcgtgtgcgcgggatacgccttccacgtctacgccttccccggcaaggagaagctcttcggcctcgtcctgctcggcgtgctggtgcccaccacggcgctcgccctgccgatgtacctgctggcctccaaggtcggcgtcgtcaacaccttctgggccgtcttcatccccagcctggtcaaccccttcggggtctatctcgcgcgtgtcttctgcgccggatacgtgcccggcgaggtgctggaggccgcccgcatggacggcgccggcgagctgcggacgttctggtcggtgggactgcgcatggtcatgcccggcttcgtcaccgtcttcctgttccagttcaccgccatctggaacaacttcttcctgccgctggtgatgctgtccgacaaccggctcttcccggtcagcctcggcctgtacagctggaacacgcagacccatgccttccccgagtactacccgctggtcgtcaccggctccctgctcggcatcgtcccgctggtcatcgccttcgtcgcactgcagcgccactggaaggccggcctcaccgcaggaagcgtcaaatgacgtccgcccctgccgcacccgcaccggagtaccgagtgtccaaccccccgaccgcatccgccgcgcagccggacaccgccccctcggggcaccggcgcccgcgcaccctgctggccatgcacaccgatctcgccgcccggctgatcgacccggccaccctcgcccggctcaccacgctcgccgacctcgaccccgcgctcgtcgtcgacgacttcaccgccccgcatgccgccgccgcgctgcgcgagaccgaggtcatcgtgagcagctggggctgcccgccgctggacgagaccgtcctggaccgggcgcccgcgctgcgcgccgtcatccacgccgccggttcggtcaagcaccacatcaccgaggcctgctggcagcgcggcatccaggtcacctcggcggcctgggcgaacgcgctgccggtcgccgagtacaccgtggccgccgtgctgctcgccaacaagcaactgctgcgcatccgggacgactaccgctcccggcgcgccgaccacgactggcaggcggcctacgccggcgccggcaactaccggcgtacggtcggcgtcgtcggcgcctcccgcatcggccgccgcgtcctggaactgctccgaccccacgacctcgacctgctcctgcacgacccgtacgtcggtgccgacgaggccgccgcgctcggcgcccgctcggtggagctggacgaactgtgcgcggcgagcgacgtggtcacggtgcacgcgcccgaactgcccgccacccgccacctcatcgacggccgccgcctcgccctgttccgcgacgacgccaccttggtgaacacctcccggggctccctcgtcgaccaggacgcgctcgtcgcggagctgcgctcggggcggctcaacgcggtcctggacgtcaccgtccccgaagtcctgcccgccgactcgccgttgtacgacctgcccaacgtcgtgctcaccccgcacgtcgcgggctccctcggcggcgagctgcaccgcatggcggcggccgccgccgacgaactggcccgctacacggccggtctccccttcgcgcacgccgtccaccgggaggacgccacgcgctcggcctgaggcgcacccggcccagtgggcgagcggcctagagggcgagcgggccggcgggccaccgagcgaaagggccgccgggccggcggccgagcggccgggcagggccggccccgagtcgcgctcagggttctcggggccttgacagggaagttgcagccaccatacttccagctgaaccgaacggccggtatatcgagtccagttcgatataccgaaccattcggtggtggtgagagcccgacggcacgacatggctccctggaccggcccctgcgcgcgggcggccccgtcgtgtccggacgacgacctgtacctgccccgtacagaaaggccgccccacgtgacgcgtccccagctgcccagacgccacttcctcgcaaccgccgccacggccggtctcgccggcccggccctcgccctcacggccggtcccggctccgcgcgggccgcggtgccggccccggacaccggcccggaaaccgcctccccgcacggcggcaccggcctgccgtaccccacactccgccggcccttcgccatgcccggcgtcaaggaccaggactggaccggtgccctcttcgtcggcgacggcgaggcacggttcgcgctgcgcgtcggcctgctcaccgcgcagggcaagctcatccgcgagaagatgaccgaccacctggggcggatcggccccatgacacccgacggggcgtaccggcaggtcgaggtcagcaccgatgaccgcaagatcatgcccgcccacctggcggcgctgcgcgaggtggtcgggcacccggaccagtggtccgcgcaggaggtcgccgacgccaccgcgcaactcccgcagctgcgggagcggtacgaccgcacgcagcgcgagaagcgcgccctgcgcatccgttacgcgcgcaccggtgacggcagcggcctggtcggagccgtcaccgcactcgacgacgacaccaccgtcgtcctcgaagccgccacgccctggggcgagcaggcgacgttcgcgctggacggcggcggcgtgacgggcagcgccccgggcgtgctggacgcctcccgcaccggtcacctgcggctgtcccccaccgaacccgccgacagtggcggctgctgggcctcggtcgccgacatgacggcggccgtgaccggcggggc

SEQ ID NO: 931 - DNA, 2891 bp, Unknown
  Kingdom: Bacteria, Phylum: Actinobacteria, Class: Actinobacteria, Order: Streptomycetales, Family: Streptomycetaceae, Genus: Streptomyces
ccggtcggcgagcgcggccagcgccgggtcatgggcgcgcacggcctccagggcgcgctgggcgcccgcgacgagggtggcggcgtcgatgccctccgggtcctccggatcgcccgcgagggcggcgtgcgccgccgtcgcggcggacgccagggcctcggcgtgtccgagccgctcggcctcctcggccagctcggcgtcctcaccggcgcgcggctcgacggcggcgatctcgtccaggccgaagcggagcatgccggcctcctgggcccgctcccgcgcgcgcgtggtgatctcctccagctccgcggagaccgcccgcagccgccggtacgcctcgctgtacttggtgagcggtacggcgaccgcgtcgcccgcgtaccggtccagtgcctgccgctgccgggacagcttcaggagcccctgctggtcggtctggccgtgcacggcgaccaggtcgtcggccagctccgcgagcagccccaccggaacgctccgcccgcccaggtgggcccgcgagcggccttcggcggaaacggtacggctgatcagcagcgccccgtcgtccagctcggcgcccgcctcctcggcccgcaggaccgccgcggcgcccgagggcacggcgacgcgtccctccacgaccgccttgccggccccgatccgtacgagcgccgggtcggcgcgcccgcccagcagcagtcccaggctggtgaccaccatggtcttgcccgcacccgtctcacccgtgaccgcggtgaagccgggcgacagctcgacgacagcgtcgtcgatcacaccgagcgaccgtatccgcatctcctccaacacgcacacgaccatacgaggtccagggcggcgagtgcgaccgccccgcccttgtcacccgcgcgggtggtccgggagacgacggcgtgcctagtgcggtgcgcctcgccagccggagaccggcagcgcgaacttggccaccaggcggtccgtgaacgacgcgtggtggagccgggccagccgtacggggacggcgccgcgccgcacctccacgcgtgcccccggcggcagctcgaccgtgcggcgcccgtcgcaccacaggacccccggcggcacgtgcggcagcacctccaccgcgagcacggagtccggcgaggtcaccagcggcttcgcgaacagcgcgtgcgcgctgatcggcaccatcagcagcgcctccacctccggccacaccacaggaccgcccgcggagaaggcataggccgtcgacccggtgggcgtggcgcacacgatgccgtcgcagccgaacccggtcacgggccgcccgtcgatctccaggacgacctccagcatccgctcggcggacaccttctgcacggccgcctcgttcagcgcccagtcggtgtgcacgatgtcgccgttgcggtgcacgacgacgtcgacagtcatccgctcctcgacctcgtaggcccgcgacaccacccggtccacgaccttgtccaggtcgtcccgctcggcctcggcgaggaaccccaccctgcccagattcacgccgagcatcggcacgcccgaggcgcgggcgaactcggcaccgcgcagcagcgtgccgtcaccgccgaggacgatcagcagctcgcacccgtccaggcactgcggcgtggcctcgccgaccagctgcacctcgtccggcagcggcaggtcccgcgcctccgcctccaggacgcgcaccccgatcccggagtgcagcagccctttgacgaccagctcggcgctgcggactgcggcaggccgcccggtgtgggccagcaggaaaacggtacgagcatggctctttgtcaacgcggcccctccgccactgcacggtcgacgtcggccggttccagggcgggcgccccggcacgcagccacagaaagtactcgacgttgccggacggcccgggcagcggactggcggtgacccccttcaccccgagccccagctcccacgccttcccggcgacaccccgcacggcctccgcccgcagctgcggactccgtacgacacccccgctgcccagccgctccttccccacctcgaactgcggcttgaccatcatcaccagatcggcgtccggcgtcacgcaccgggtcagggcgggcagcaccaggccgagcgggatgaaggacaggtctcccacgacgaggtccacaggttccccgtcgatcgcctccagcgtcaactcccgtacgttcgtacggtccttgacggtgacgcgttcatcctgccggagcgaccaggcgagttggccgtagccgacgtcgacggcgacgacgtgcgcggcgcccgcccgcagcagcacgtcggtgaagcctccggtggacgccccggcgtccagcgcccgccgcccttcgacgacgagcccctgcggcacgaaggcgtccagcgccccggcgagtttgtgaccgccccgcgagacgtagtcgggatcgttgtcgtcggccgtgaccacgatcgcggcggcggtctccacctgtgtggcgggcttggtcgcgacggtcttgccgacggtgacccgtccggcggcgatcaactggctcgcgtgctcgcgcgagcgcgccagcttgcggcggaccagttccgcgtcgagacggcggcgtgcgactcctgccacgttcggttcagctcctgtgtcggtacgacggtgaaggcgccggcggcgccgtggggccccctggccccgggggccttggcggtcccgtgggtcccggaggtcccgggcgggcgtcgagcgcggtgagcgcgtcgcgcaacccccggtgtacatcctcgtacacctcgaggtgtccgtcggtgtcgaggtggtcggcgtcgccgagccgctccagggccgcgtcgacgtcggcgtcaccggtgggcgtgcggggcacgc

SEQ ID NO: 932 - DNA, 4027 bp, Unknown
  Kingdom: Bacteria, Phylum: Actinobacteria, Class: Actinobacteria, Order: Streptomycetales, Family: Streptomycetaceae, Genus: Streptomyces
gcgagggcgagcggtccggcgccgagttcggcgaggagctggcgttcgatctggcgggtgctgtagccgaggcgggcggcgaggccgggaacgccgtcgcggtccacgaccccgtcggcgatgagccgcatggcgcgggccacgaggtcggcgcgccggttccactccggtgagccggggctggtgtccgggcggcagcgtttgcaggcccggaacccggcctgctggcaggaggccgcgctcggcaggaacgtcatgttctccggcttgggcggcaccgcggggcagctgggccggcagtagatgcgagtggtcaggacggcggtgaagaaccagccgtcgaatcgtgcgtccttggactggacggcgcggacacagcgtgcacggtcggtgtgcatccccttctgcatgcgtccaggatcctgcatcggccacccgggggctggcgggaatccgacatcacctttgtgtgtcctgggcgggtccggatcgccttggcgaacttttcaccgtatttcggcgtgcgcaccggcaacccggctcccccattttgcatcctgactggtgctgggggtgttcgcagggtcagcccgtcgagacaccagcttcttggttttcggacggcggccgcagacgcggctcgccgctacgggaaggtggccgcgtggcgctgactggtgcgacgttcttcttcgttctcgtcgtcgcgacggtcctcgcgatgatcggcacggttgcggtgtggtccaaggtgcgtgggccgcggccggtgcgctggctggtgcacggcgcgatgatcgccctgtgccagctcaccgccatcaccgtggtggcgacctggataaacaacagctacgggctgtacgcctcgtggcaggatctgctgggcacgaccagcagcgcgaacgcggacgcgatgccgggtccgccggcgagccgtgccaagttcaaccacgcgacgcgtgacggcgtgctcgacacgtacttccgcggcagccgctccactctgtcggggcaggtcctggtgtggacaccgccgcagtacaaggagcccgcctaccgcaagaagcggttcccggtgctgatcatgatgcacggcgtgcccggttcgccgcagtcctggctggagcacggcggcatgcccggcgacttcgagaagctgatgaacgagcggaaggtgcatcccttcatcctggtgatgccggtgatcgacccgggcagcgtcgacacggactgcagcgaccttcccgaccgcaaggtcgccacctggctcgcgtacgacgtccccgacctggtccggcacaagttccgcaccctgcacggcagcaagggctggggcctgatgggctactccaccggcggctactgcgccgcgaaactgccgctgcagtacccgaaggtcttcggtgcgggcgcggccatcgaccccgacccgctgacgggcgacaacgcggtcctgcgcgaccccaaggtacgccgggccaacacgcccgccgatctggtcgtcggctccacggcccgggtcagcctgttcctcgccacctcccgccaggaccgggtcagtccgcccgcctccatcgagaagttcctggcggcgtcggcggcgtcctccgtacaggtacgcacccagttgctgcccagcggcgggcacaactaccagacgttcgcggcgtcgtacccgatggccttccactggctgagcgcctggctgtcggcaccgaagtgaggccgggcccgggcggacagcccggcggcccggccagcccggcggtccggacggccgcgcgactcaggcgagttgcgcggcgaacgcctggtacgcctgctcgtcgaagaggacgaacgtgacctcttcgacggcggtcccggcctcccgcaccgcccggacggcgactcgggcggcgtcgtcgagcggccagcggtagacgccggtggagatcgccgggaaggcgaccgtacgcgcgcccagttcgtcggcgacgcgcagggactcgcggtagcaggaggcgaggggcgaggggtcgctgcccgggccctggtacaccgggccgacggtgtggatcacccagcgggcgtccagctcgcccgcggtggtggcgacggcctggccggtgggcaggcccttgccgtaccgcgaggcgcgcagcgcgcggcattcctccaggatggcggggccgccacggcggtggatggcgccgtcgacgccgcctcccccgagcagggaggagttggcggcgttgacgagggcgtcggcgtgctgccgtgtgatgtcgccgcggacgagagtgagggcagggcttgtgttcatgtctgtctcagccttctccagacggccttggcggcgttgtgtccggacatgccgtgcacaccggggcccggcggggtggccgaggagcagatgaagacggccgggtgcggtgtgtggtacgggaacagggtgagcttgggacggagcaggatctggagtccggagaccgcgccggaggcgatgtcgccgccgacgtagttggcgttgcgggcggccagttgggccggtccggcggtggcgcgggcgaggacgcggtcgcggaacccgggtgcgtagcgctccagttgacgttcgatggcgtcggtgaggtcgccgtcccagccggtcggcacatgtccgtacgcccagaagacgtgcttgccggcgggggcccgggtggggtccacgacgctgggctggacggtgatgaggaagggtctgtcgggtgcgcggccctcgcgggaggcggcgcgcagcgcggtgccgatctcggcgcagtccgcgccgatctgcacggtgcctgcgacgcggggctcctcggcggtccacgggacgggtccgtccagcgcatagtcgatcttgaagacgccggggccgtaccggtaggagtcgtagtagcggccgaggcccgcgatacgggccagcgcggtgggtgaggtgtcgaagacgtacgcccgggccggcggcaggtcgtcgaggcgtttgacctcgtagtcggtgtggacggcgccgccgaggtcctcgaggtacgcggcgagggcgtcggagatcgcctgcgagccgccgcgggccagcggccagccgcgggcgtgcgcggccagcgcgaagaccaggccgatggcgccggtggcgaagccgccgagcggtgccatcacgtgggcgacgaggcccgcgaagagcgtcttggcccgctcgtcgcggaagcggcgcgtcagccaggtcgagggcggcagtccggtcaggccgaagcgggcgagggtgaccgggtcgcggggcagcgcggtcagcggcagggacatgaagtcgcgggccagcgtgtcccagcggggcaggaagggctcgaccagtctgcggtacgcgccggcgtcccgtggcccgaaggaggcggccgtctcggcgacggagcgggccaggacggccgcggtgccgtcggggaaggggtgggccatgggcagctcggggtggagccaccgcaggccgtagcggtccaggggcagggcgcggaaggcgggcgagttgacggcgagggggtgggcggcggagcacggatcgtgccggaagccggggagggtcagctcctcggtgcgggcgccgccgccgaccgtgtcacgcgcctcgaacacggctgtggagaagccgcgccgggccagctccaccgcggccgtcaagccgttcggtcccgcccccaccaccacgacatcgagcatcgacggcaccttcggaccccttcgtcagccgatggccacgcggacctgtcgtccgggccaggatatgccgccgcaccgacacgacggaccgcagggcggcctgcgggacggccctcgacggcggccactgaccagtggcgctgggtggcactcagtggcggtcagtggccgacgggccgtgagtcactgggcgacgggccggagggcggctgggccactgggccactgggccactgggccactgggccactgggccacggtcccgtggtcgccgggcgaggtccactggccgacgggccggtgggcggctggg

SEQ ID NO: 933 - DNA, 877 bp, Unknown
  Kingdom: Bacteria, Phylum: Actinobacteria, Class: Actinobacteria, Order: Streptomycetales, Family: Streptomycetaceae, Genus: Streptomyces
gccccggaccgcacccaggcaggtcacgccgccgcgctgggccgtgccgtggaccgggcgtgcgccgccgccaaggccgccggcacccggatcgaactggtcctgcccggcgccgtgggaacggtcctgcagaccgccgaggagtccgtcctcgaccgcttcgacgccgaacgcgtagacgtgcgcaccgcggtcggcgagtgcggcggcgccctcggcgccatgcagctcgccgccgcactcgccctcggccgccccggcaccggcgtcctgatcaccggggtcgacgagtccggtgccgtcgccgcgaccgtgctcaccctcggggagcgggcatgagcgtcatcaccgccggtccccgggtgcgccgggagctggtccaccgcgccaacgaacaggagatcctcgtctccccgccccggcgggaaccggacggcggctacggcggtacgaccgtcaccaccggcctcgccccctactaccgcgaccaccccgccacccaccggctggacgccctgctgctgatcgaggcctgccgccaggcggcgctcagcgcggcccacgcgttcgaggacctctcctgcgacatcgcgttcttcttcaactcgatcgacatggagatcacggacaccgcccgactggccgccatggacggcgagttgacgatcctgtcccggttcgagcagttgcggctgcgcggcgacggctcaccgaagcagatcacgtacaaccagcgcggcacggacggctcgggccgcacggtggtacgtacgtcgatggcggtacagggcctgcccaaggcccgctacccggagctgcgcgcctaccagcggggcggctcgcccgcgccgaccaccgcgctgctgcgctccggcgc

SEQ ID NO: 934 - DNA, 3499 bp, Unknown
  Kingdom: Bacteria, Phylum: Actinobacteria, Class: Actinobacteria, Order: Streptomycetales, Family: Streptomycetaceae, Genus: Streptomyces
gacgaggtcgtcttcctcaccacccgcgacgcctacgagccccactacgtcgacgaccgcaagtacttcgaactgaacagcttctacgacgagttcgccaagccctggcaggagcgccggatgccgatgcgccacgaggcacgcgaggatgccgtcgaggtgtaccggttctggcaggagcgcaacggcggcgagcgccgcgtcgccggtgcccccaccgcctgagcctgccgtacccaatgtgatcgagaaaggtggcctggggccacctgggcgagggccggctcctgaccgcccgcactcgaggccgtgatcggttcccctgtctggcggcaagcccgaacccggcgagagcatcgagcagaccctggtccgccagatccgcgaggaactcggcgtggaggcctcggccgacggcaaaaccaccgggacgatcgtgtgcacggtgtgttgcactgccgcacccaccggcacaccgcggccgtgcgtggagatcgccgagaccgccttccgcacccacggcgaccgccccctgccagcgccgccaccggcgaagtaatcgaccgcctcgcagccaccggccagctcctgcgctggtgacctcaccggtgcaccggccccatacccccccggggctggtgcgccgccgcgggtgtccgttcccacacctcatcccgaacccgtctctccccaaggtggtgccgtgtccgagctgtccccgaggcagcggctgctggtccttgccgtgtgctgctcagccctgttcctcgtcagcctcgacaacacggccctgaacaccgcgctgcctgccatccggcacgacttcgacgcctccaccgccgcactgcagtggaccgtcgacgcctacctcgtcgtcctttcctccctgctgctgctcgccggttcggccggggaccgcataggccgccgccgcgtcttccgcgccggactcgccctgttcaccacagcttccctgctgtgctccctggcccccaccctcggctggctgatcgccttccgcgccctgcaggccgtaggcggctgcatgctcacccctgtggccatggccatcatcaccgacgtcttcaccgaccgccgcgaacgcgcccgcgccatcggcgtctggagtgccgtccagggcatcaccatggcggccggacccctgctcggcgggctcctgatcgacaccgccggatggcgctggatcttcctgatcaacctgcccgtcggtctcctcgcgctggccctgaccggccaggtacccgagtcccgcgccccgcagccccgccgcctggacgcgatcggccaagcgctggtcgtcgtcctgctcgtcacgaccgtctacgcgatcatccagggaccagccacgggctggacctccgccccggtactggcctgcgcgctcaccgccgccgtggcactgcccgtactggtcgtcgccgagctcacccagcgcgagccgctgatcgaactgcgcttcttccgccagcccccgttcaccgcgtccgccctcagcgccgtatgtgccttcgccgcgctgagcggcttcctcttcctcaccgccctcgatctccagggcgcccgcggcctggacgcctggcaggccggcctctgcctgctgcccatggccgccatgaccatcgcctgcccgcccctggccgggcacctcaccgccgcccgcggcccccacctgcccctgttgctctcaggcaccgccaccaccctcgccggactcctggccctcctcggagcccagcggcacacccccctcctgctggcctgctacctcctcttcggcaccggcttcggactcgtcaacgcccccatcacccacaccgccgtctccggcatgccccgcgcccaggccggcgtggcctccgccatcaccaccaccagccgccagatcggcagcgccctcggcgtcgccgtcaccggcgccaccctccccgccgccggctacaccgccgccacgttcgaccacgcgagccgcccagcctggtggatcatcaccggctgcggcatcaccatcgctgccctggccgccctcactcgctaccacacccaccgcagcgccccacccggcacggcaccgaggaggaccagccggcaccgacggcagacttcgcgggcaggggtgtgaccggtgcgggccccccggggcggggcccgcacacagccgtgcccccgcgggcccgggcgggcggcgcaggcacggagggaagggcaatccggctgcttctgggcggaagacgccacggcgcgcgcccgctttccgcgcgctcgagagctaccgcctcgcttggaactggtagcggtcgccgtgctccaggtagtggaacttgaccggcgccgaggacgcggcggcggcctttttgaactcgtcgagcggggaggcgaagaccgagaagtcgttgtagtggatcgggatcgcggtctttggcttgaccatctccgcgcagcggacggcctgagcccccgtcatggtcaccgtggtcaagaacaacgtggtcccaccggtgtggaacatgcccaggtcgatgttcgggtagtggcgggggatgtcgtgcagccggttgtgcagcatggtgtcgccactgatgtagagccggtacagcaactggtcgccgtcgtagaagtccagcagattgccgttgacgggcatcagcatgtccgccatctcgaagtcgctggtgtgctcgcccggcatggcggtcaccacgagccgggcgtcgccccgctgcacggtctggctctcccaggtgtccagcgcgtgaccgttggtgaagcccagagggtgcagctgtttgatcgcatgcccggtgctgatgaccgggatcttcttgtccaggtcctgagccgcgacatggtcgaagtggtcgccgtggtaatgcgacaggacgatgaggtccagcgggggcaggtcggccacctggcagtccggctccatctcgcggcgggcgtagatgccgtgcccgaggtggacatggtcacctttgtgcatgaacgcggggtcggtcagaaccgtgaaccccgcgaaacggatcagcatcgtggcgttaccgatgaagtacacctcaccggaatcgaattcaggcttttcccctggcgagagcgtgattgtcgcgttgatcggagacctccaggaagagcggggccaatgcggcccaggctgccccccccgcgtggaccgcgacccgatacgacgggcatcatgcgcaatacggacattacctccgccgggttccagggagccactcggcgcactcggcccttcacgtacacggctgagcgaaggcccgaggaggcccggaagcaggcggacgcgctgtcgatgcctccggctccatcgggaccagcggcgctgcgacggtgctctcggacgtgacggactccttgtgcacgggccgccgcgctggccgcggcggcctcagcagcggtcttcggagcgcggtgccggggacggagcccgcgccccggcggcgagcgcactggcgtcaag

SEQ ID NO: 935 - DNA, 507 bp, Unknown
  Kingdom: Bacteria, Phylum: Actinobacteria, Class: Actinobacteria, Order: Streptomycetales, Family: Streptomycetaceae, Genus: Streptomyces
ccttcgcggccgtgttcgccgtagccggcctggatcaccgcgtcgtacgggccggggtgggcgcgcacggtctccatgacggcgacggcggcgaggtagctctcgtagttgccctcgacggactccgcgccgaaggacggggtcagcggcacgatctccgtgcccggcgacgcggcgcccgccgcctgtttcccgatggcgtcggtgatggactgggtggtgttgacgttgacgacgaggatgcgcatggaagggggcttcggccttctgctcgggttgctcgggttgctcgggcgggctattcggcggcgacggcgatggcctcgccgtccaggtcacggatgggggtggtgcggtcggcgagggccgtgtacagcacggcggcgaggacggcgccgacgaaccaggagaacccggccacggtgtggaagaacggcaccagggcgacgacgacggcgatcgcggcgctcgggacgaaggcggcgacggcgcgcgggttgtagccgc

SEQ ID NO: 936 - DNA, 2788 bp, Unknown
  Kingdom: Bacteria, Phylum: Actinobacteria, Class: Actinobacteria, Order: Streptomycetales, Family: Streptomycetaceae, Genus: Streptomyces
gcgggcagcggtccgatagagctgctggtggagctggagccgggcggctgtcacgtggaggtgcgcgatccggacccggcgccgcccggcggcctcgcccggcccggcctgaccccgcccgacctctggcgggaggacgggcgcggcctgctgctgatccgggcgctcagctcgtcctgcggacaccggccgaccgcgtccggcaaggcggtgtggttccggctgtccgcaccgccggtggggccggacggcgcctgagcgccccgggctctagccccgcgccagcgtggcgaccaggatcgccttgatggtgtgcagccggttctcggcctcgtcgaagacgaccgagtgaggcgactcgaagacctcgtcggtgacttccagggaccgcaggccgtgctgctcgtggatctcgcgggcgaccttgctgccgaggtcgtggaaggccggcaggcagtgcaggaacttcacgtccggattgccggtggcgcgcaggacgtccatggtcaccgcgtacggcgcgagcgactggatccgctcgtgccagacctccttgggctcgcccatggagacccacacgtcggtggcgacgaagtcggcgccgcgcacgccctcctccagcgactcggtgagggtgacgcgcgcgccgctcgcggcggccagctcgtgggcccggtcgacgatctcctgggcgggccagtaggtcttgggggcgacgagccgcacgtccatgccgagcagggcgccggtgatcaggtaggagttgcccatgttgaagcgggcgtcgccgaggtaggcgaaggccgtctcgcgcagcggcttgccgctgtgctcggtcatggtgagcacgtcggcgagcatctgggtgggatgccagtcgtcggtgagcccgttgtagacggggacgccggcgtgcgcggccagctcctcgacggccgcctggctgtctccccggaactcgatcgcgtcgaacatccgcccgaggacccgtgcggtgtccttcatggactccttgtgcccgatctgcgagccggacgggtcgagatacgtggtcgaggcaccctggtcggcggcggcgacctcgaacgcgcagcgggtgcgcgtcgaggtcttctcgaagatcagcgcgatgttcttcccgctcaggtaccgcgtctcggtcccggccttcttcgcggccttcagttcggcggccagctcgatcaggccgcggaactcctccgccgtgaagtccagctccttgaggaagtggcggccggcgagggcggtcgggactgtcgccatgggggcgctccaacgggtgagggacagggactcctggaattatatacgactctcagaatttgtatgcggcgcggccggtgccgccgtgcgctgccggcatcgctccgtcgtgccggcgtcgccgtgcgctgccggcgtcgctatgcgctgaccgcgtcccgttccaccgggcagctcatgcagcgcgggccgccccggccccggcccagctcactgcccgggatctcgatcacctcgatgccctgcttgcgcaggtgggtgttggtggtggcgttgcgttcgtaggcgacgacgacgcccggctccaccgcgaggacgttgcagccgtcgtcccactgctcgcgctcggccgcgtggacgtcctgcgtggcggtgagcacccggatctcgctcagcccgagcgcggcggcgatcgcgcggtgcatgtgctccggcggatggtcggtgaccttcagctccttgtcgccggagcccggttcgatggtgtacgagcggagcatgccgagcccggcgtactgggtgaacgtgtccgcgtcgaccatggtcatcaccgtgtccaggtgcatgaacgcgcgccgcttgggcatgtcgagcgccacgatcgtacgggccgacccggcggcgaacagcttgtgcgcgagcatctcgacggcctgcggggtggtccgctcgctcatcccgatgagcacggcgccgttgccgatgaccaggacgtccccgccctcgatggtggacgggtagtcggcctgcccctcggaccacaggtggaacggctcgccgcggaagagcgggtggtagcggtagatcgcctcgaagtgcacggtctcgcgctgccgggcgggccagcgcatcgcgttgatggagacgccgtcgtagatccaggcggaggtgtcgcgggtgaagaggtggttgggcagcgggccgagcaggaagtcgtccaggtccatgacgtggaaccgcacggaggccggctcggcgtgcgcctgcaggaactcccgcttggtcatgccgccgaccagcgcctcggctagttccggcgcgtccagcgtctggaacgcggccctgaggtggtcggtggcgagcgggccgtactccttctcgtcgaagacgcggtccaggacgagcgaccgggccgacgggatctccatcgtctcggtcagcaggtcgccgaagaggtgcacggcgaccccgcggtcgcgcagcacgtcggcgaacccgtcgtgctcggcgcgcgcccggcgcacccacagcacgtcgtcgaacaggagggcgtccttgttgctgggggtgagcctcttgagctccagatccggccggtgcagtatgacgcggcgcagccgcccggcctcggagtcgacatggaatgccatgcctccatcctgaccaccgccgggcgacttcacccgctgctcgccggtttccgtacgaacccgctttcccgtgcgccgcacctccgtccgtcccggcccgccgcgctgggcgcgggggccgggacggacggagg

SEQ ID NO: 937 - DNA, 1457 bp, Unknown
  Kingdom: Bacteria, Phylum: Actinobacteria, Class: Actinobacteria, Order: Streptomycetales, Family: Streptomycetaceae, Genus: Streptomyces
cgctggccgcgtccagcgaggcgagggtcttggcgagctggaagggcacgtgcagcggggcgaccagcacgctgctgccgaggctcacccgctcggtgacggccgcggccagggtgagcgtgaccagcgggtcggccacgtggcggtaggagtcgggccagggcaggccctcgatgccgtagagcccctgggtggcgggctcggggaacagcgcccgctcgtacacccagaggctgtcgtagccgatgtcctccgcggtccgtgccacgtcgggcacgtccttgccgaggtcgtactgccggttctgcggaaggcccagtcccagacgggtcgccatggtggtgcgctccttcgtgatggccggtgatcgccggtgtccaggggccaacgtacagcgatcacacgggagttccggggagcagcgcggggtgcggcggagcggccgggggagccctgaaggcgcggcgggtccggcgcaggggagggccggtcaggcggggagcggggtgagcatcatgcgtccggcgaagccgaccgccgcgtccagccgctgggtgaagtcctcggccacgtcgggcagccggcgcagcgcccacagcgcccgcgcggccgaccatgcggcgtcccgcgcctgctccaggctccaggcgccgagcagatgggtgagcgggtcggcgatccggagcaggtcggggcccggcgtcaggtcgtcgcggacgcgttcctccagtgcgacgagcagatcgcccacgcgctcgaagtcgccctccaggtcggccggttcgcactccagcgccgcgcacgtgtccaccacggcgagcgccaggtcgtgtccgatgtgcgcgttgacacccgccagcgcgaactggagcggtcgtacgcccggatgacggcgcgactggaggagcggccgccagcaggccggtgcgcgccgctcctcggccgccgggtccacggcggcgaggtaccgctcggcgaaccgtacgtccagcctggtcgtggcccgcgggccggtgaaccgtcctgtcaccacgcgtcggccggcctcctcggtgaccgcgaggtagacccggttgaagacggcgaccccgtcccgctccggcagagcggcggccagcgcgcgcatccgcgccacgacctcgtccacggtgtccggacgctcgtccgctgtgtctggacgcttgtccgctgtgtccggacgctcgtccactgtgtccggacgacggatgagttgtaccgattgccccatgggggcagggtcccaggcccgcaccggtccgggtgccgaccggccggacgcttccccggaacgggggaacgcccgcgcgagccgggcccggacgcgggggcgttcgcctatggtgcgctacgccccggcctggagcgccggcctacgacgcggtacgtcccgagccgctgccgcccgcctgcccctcggcgccgctcccgtcccgccc

SEQ ID NO: 938 - DNA, 3404 bp, Unknown
  Kingdom: Bacteria, Phylum: Actinobacteria, Class: Actinobacteria, Order: Streptomycetales, Family: Streptomycetaceae, Genus: Streptomyces
gccttcatcgtggcgcactggactacgccaagccgtcggcgggcgacgtgcggctggccgtcgcccggaagaaggccacggggccgggcagccggctgggctcgctcatggtgaacccgggcggaccgggcggttcggccatcggctacctgcagcagtacgcagcgctcggctacccggccgaggtccgcgcccgctacgacatggtggcgatggacccgcgcggggtcgcccgcagcgagcccgtcgagtgcctcggcgaccgggacatggacacttacacccagaccgatgtcacccccgacgaccgtaaggagaccgacgcgctggtgagcgcgtaccggaagttcgccgagggctgcggcgcgcacgacccgcggctgctgcggcacgtctccacggtcgaggcggcccgggacatggacatcctccgggcggtcctcggggacccccggctgacctatgtgggggcgtcgtacgggacgttcctgggcgcgacgtacgccgggctgtacccggaccgggtgggccgcctcgtgctggacggcgcgctcgacccgtccctgaccgcggcgcggatgaacctggaccagacggcgggtttcgagaccgcgttccagtcgttcgcgaaggactgcgtgcgccagagcgactgcccgctcggcggcccgggcacgacgccggagcaggccggtgaccacctcgcggccttcttccgcaagctcgacgcccacccggtccccgccggtgacacgagcggccgcaggctcggcgaggcgctcgccacgaccggggtgatcgcggcgatgtacgaccagtccgcctggccgcagctgcgcggggcgctgacctcggcgatgaaggaaggcgacggtgccgctctcctcgcgatgtccgacagctactacgaacgcgactccggcggccactacaacaacctgatgtacgccaacgccgccgtgaactgcctcgacctgcccccggcgtactccaccccggcggaggtggagaaggccctcccggcgttcgagaaggcgtcccccgtcttcggcaggggcctcgcctgggcctcgttgaactgcgcgtactggccggtgaaacccaccggcgggccgcaccgcatcgaggcgaagggtgccgcgcccatcgtggtggtcggcaccctccgtgacccggccaccccctaccgctgggcccagtccctcgcccaccagctctcctcggcccgcctcctgaccttcgacggcgacggtcacaccgccttcggccgcggcagccgctgcatcgactccgcgatcgacgcctacctgctccgcggcaccccgccggcccagggaaagcgctgctcatagcccctaccgcccgccccggagcaccacctccggggcgggtacgaagcacctccggaaactgtgtagacttacggacgttgccgatcgcaccatggtgcgggcagctcgccgctttagctcagatggccagagcaacgcactcgtaatgcgtaggtctcgggttcgaatcccgaaagcggctccaccggaagcctcaggtcaggtatcagctgacctggggtttctgtgttggccgggggtggtctgggggctgctcggggcgatagagaagcaatatatgtgcggcccggacattggggacgctcgccggaagtgaccggtgggtgtgccccgtgtccgtggaggaagtcgtgcgccgccgttctctcgcgatgatcgtcaccgccgcagccctgtccgcagtcgccgggctcgccgggcccgctgtggccgtgcccgccgacaaggcgcaggtgctcggttcctggacccaggacagtgccgccagtgccggtgcctgggccgctgccggcggggctcgcggggcctggtcggcctacgggttcgactggtcgaccgactactgcacgacctccccggacaaccctttcggcttccccttcaagaccgcctgcgcacgtcatgacttcgggtaccgcaattacaaggccgccgggaccctcgcagccgccaagccccggctcgacagcgccttctacggcgacctgaagcggatctgcgccacgtacagcggagtgaagaagacttcctgcgacaccacggcctggacctactaccaggccgtcgacaagttcggctccgcctccgtccgaggcgtggcggggggagccgggtagcggccggggtctccgcctcggcttctcttttccttgtttcggaggacgcgtgtcccgcattctgcacaagaccgccgtggtgttcgccgccgcgggtgccgccttcgccctcacagccggctccgcccaggcggcggccccgacgtgggagatcatcaccaagcccccgacggacggcgggctctacgacatcctgccggtcggcgacggctccgtggccttcggacagaccgtctggggccgcaacagcggtgacggcgaagtcgtgcgctactggctccgccagggcaccgcgtgggaggagctcacctacgacaaggaccgcgcggacgccggtgtctgggcggcgaccgccgccgacgacttctgggtgctgggcaagaagtacctgcagccgatgtccgtcggtcactggaacggcacggcctgggagcagcgcgacctggccgacacctcggtcggcttcgccgggatcaaggcggtctccgccaaggacgtgtgggccgtgggcgagtcgcggaccgagggcgccaggaccaaccccgccgccgtcgggcactgggacgggtccgcctggaccgtcaccaagctcccgcagcgcgccggcggcagttcgctcctgaagtccgtgcaggtcgtctccgccgacgacatctgggccgccgggcagacctgcaccgatgccgggggcaccaaatgccgtccgtacatggtgcggtacgacggcggcacatggcaggaggtggccacccccgcgggactgagcgggtccttcaccaagatcgtcgccaggggttccgacgacgtctgggtggcgggcggcaccaccgtcctgcactgggacggtgcgaggtggtcccgtgccgacgtcgcactcagcggcgtgacggcggtccgggatctcgccttccacgacggccagttgtacgccggcctcgactcctcggccgacggcggactcgcccgcttcaacggcacggcctgggagagcgtgcccgggcccgtcgcgtacgcggcccacggtctgcgcctgaacgccacgaccgacggagccctgtggctcgcgggccggaagatggacttcttcggttcgagtggtccgtacgtcgccaggctggcggcgcccacggcgggctgacgtccggcggccggacagtacgccacggccgacggcccgcccggccgcctcctccggccgcctcgtccggccccagcg

SEQ ID NO: 939 - DNA, 3430 bp, Unknown
  Kingdom: Bacteria, Phylum: Actinobacteria, Class: Actinobacteria, Order: Streptomycetales, Family: Streptomycetaceae, Genus: Streptomyces
taatgcggcgtacggccggcccggccggccgtacgccgcattactcgatgaccagttcttcgaacgcgatcgtcacggtctcggtcagcgcggcggcctcgcccgccttgaccgtgctcgcgtcgatcttgctgcaccaggcgttgcgcaggtggtagcgcttcaccgggttgttctggaagtccatcatgatgatggacgcgttcttgcgggccgtggtcatctgcccgctgatggactggttgatccactgcgtgaacgacgccgactgggtcatgccgcgcacgaccgtgcaggtgccgttcttcttcacgcccggcaggttcttgacgacgttctggccgcccggggtgttctgctggtacgtgatgacgtcctgctcgatgctcagaccgctgacctcggccaggtactcgaccatcacgccgtcgatctgcaggccgaaattgtgcgaggtgagggcgtcacccggctggagactcatgtgttcgctgtccttctcgaagacctagctggggggaagaggaaccggggggggcgggcgcggggcctactcctccagctcaccgctgccgctggagaactgggccagccggaagatcacgaactcggccggcttgaccggcgcgatgccgatctcgcagacgacccggccgacgtcgaccgactccggcgggttcgtctcctcgtcacacttgacgtagtacgcctcttcgggacgctggccgaacagggcgccgctgcgccactcgttgaccaggaacgcggagatgttgcgccggatgcgcgcccacagggcgtggtcgttcggctcgaacaccgtccactgggtgccgatgaggatggactcctcgaggtagttgaagtaccggcggatgttcaggtagcgccaggccgggtcggaggagagggtgcgggcaccccagacgcggatgccgcggcccgggaaggcgcggatgcagttgacgccgatcgggttgagcaggtcctgctcgccgcgggtgatctggttctccaggtcgaccgcgccgcgcacgacctcgttggcgggcgccttgtggacgccgcgctcggcgtcgttgcgggcccacacgccggcgacgtggccgctcggcgggatcagccgggtctggccgctgctcgggtcgaacgtcttgatccaggggtagtacagggcggcgtacttcgagtcgtagccggccgtctcctggcgccagacccggatctgctgggcgttcaggcccggcggcgggtcgatgacggcgacccggtcgcccatcagttcgcagtgcgcgatcagaccgagctggaccgccttgacggcctccaggtcgatcgcgccgcgctggtaggcggccatcaggtcggggacggcgaccatggagacctcgtcgacggcctccaggccgccgaagccggtgcggtcagcggagtcgccgaggtactgggccgggccggggtggacgtccggcacggactcctgggccggcggcgtggcggggaccgcgacgggcgccggggccggcagggccagcgtctggttctccgggcggaccagctgcgcggcggggacggcctcggtcacggtgatgagcttcgagcgctccttcacctgtgtgacgacgtagttgcggccgcccttcttcgccgtgacgtcgaaggactccacggccttgtcgccgtccttgacgaccagcttgaagcgctcggccggcccctcgccctccgggtcggcgacctcgacgctcagtccgcccttggcgttggcgatcgcggtcaccgtgaacgtgccgagctgacgcggctcaccggccggcagcgcggccggggcggcggaaccgttcaccgcggcgggcgtcgaagaggcgcggccgaccgagccgtcggcgccctcggcggcgccgcccacgcggacgacgtaggccgcggtgccgccgttctggaagaagccgtacaccgagtgggccaggtagtacccgtcggtgaactcaccgaaggccgccacgtactggctccagttggtcaccagggtcggctcgttgaggggcccggccggggcgaggcccacgaaggccgccaccgaggtgccgacaccctcgatcggacgcgaaccgctggccacctcctcgacgtagacgccgggtgacaggtaggacggcatgctctgctctcctcggggtacgagacaggaacggattccaccctcacgcgcgaagcgcgtggtccgaaacgtcctgcggtacctcttcgcgggcacaccggttgccctgacgggcagtccggctacccccgctgcccgcacggccgggcccgctgcccgcgtgactgcccccgcgtcccttccgcccgtccgcgcgcgcggacgaggctggggtgtgtcgtcactctcccgcccgccccgccctccgggcggacggcccggaggcgacggcagatctggtgccgccggcagcggaggggagcgcggtgcgcgtacgagaacaaggacgcgacgacggggcggacggcctaggcggcgcccgccggggcgcgccaccggcagccgtgccctccgcaggcggcggcctcgccgagtaccacgccacgaagaccccggagcagtgacctgacagatgagcctttggacctctctggaacccgcctccgcgaccgtcgacccagggggcagcacccgcgtgcggctgcggctgcgcaacaccggtgacgtcgtcgacgagtaccgcttcgaacccgtcggggacatcgcgccctggacggtcgtggagccgcagacgctgcggctctacccggggacgaccggcacggtggagctgaccttctccccgccccgcaccccggacgccaccgcgggaccgaacccgtacgcggtccgcatcatccccaccgaacaccccgaggccgtcaccgtccccgagggcaacctcaccatcacgcccttcaccgagatccgggccgagctggtcccgccggtcgtcaagggccgcttccgcgggcgcccccgcctcgcggtcgacaacctcggcaacaccaaggtcaccgcctccctcaccggcaacgacaacggcgaccagctctcctacgacctgcacccgagcaatgtgcagatcgagccgggacgggccgccttcgtcaaggccaccctcaaaccgcggaagatcatctggttcgggtccaaggagcagcggccctacacgctcgccgtccagcgctccggcgcgaacccccacccggtcgagggcacttacgtgcagcgcggcttcctgccgcgctggctcgccacgttcttcggcgtgctgctggcgctctccatcaccttcgtgatgctctggatcgcctacaaacccaggttcggcaccggtgccaacgagaaggtcgccgaggcgggcaccacgctcgcgccgtccccgagcgcgcccccgtccctggcgcc

SEQ ID NO: 940 - DNA, 944 bp, Unknown
  Kingdom: Bacteria, Phylum: Actinobacteria, Class: Actinobacteria, Order: Streptomycetales, Family: Streptomycetaceae, Genus: Streptomyces
  misc_feature (360)..(428): n is a, c, g, or t
ctcgccgaggccgtcgccgagcgcgtaaccgtccgtgcccgggacctccgcctccagcgacagcgctgcgaagcagtccagggcctccatcccggtgcgcacgtcgtccatgctcaggtgcgtgtacgcggcgatctccgcgacggtcggcgcccggcccggcgtcgtctgcgccagttccttggcggcccgccgcacgcggttgcgcaggtcctggacccggcgcggcacgtgcagcgtccacatgtggtcgcggaagtgccgctttatctcgccggtgacggtcggcaccgcgtacgcctcgaaggcgtagccgcgcgccggatcgtagtggtcgaccgccttgaccaggccgagcgnnnnnnnnnnnnnnnnnnnnnnnnnnnnnnnnnnnnnnnnnnnnnnnnnnnnnnnnnnnnnnnnnnnnngccgttcgaaggcggctgcggtgtcgggggcgtcgtcgtgcgggtggctcttcgttctgccggtggtacgcatacgctgcgcctccctcagcaggtgctggatggacggacaccacgggaggcgcgggggcaacgtctggctcgcatcgcgtcgggccccggcgcaccggctcccacgggcgtgcctccggtccgaagcactgaattgcggattcccggagccggccattccgaaacaattcaccgaatgtggtgacggtatgcgaccgggcgattcgaattcgtcgccgaccggccacggaattccgcgtgaggccaatctatgaggcggcgacatcgatgacgggtaaatcagggacgggaaatgctgtgcgtttcaaccaacgtatcgctgcttgctgctgccgttcttgaccgccgcttgggaaacttacctctgctacagaggtaacgtcggaacatggaaccggaacccggacccgcacaggcacccgagcccgtacccgtacccgtacc

SEQ ID NO: 941 - DNA, 3382 bp, Unknown
  Kingdom: Bacteria, Phylum: Actinobacteria, Class: Actinobacteria, Order: Streptomycetales, Family: Streptomycetaceae, Genus: Streptomyces
ggcgggctccgtttcgacggtgtccgcttccgctaccccgacgccccgcccggctccccgccgctcctcgaccgcgtcgacctgcacatccgccccggcgagtcgatggccctggtcggcgcgaccgggagcggcaagacgaccctgaccgcgctcgtgccccgcctgcacgaggtgacgtccggccggatcacgctggacggcaccgacatccgcgcgctggaccggcaggcgctgcgcaccctcgtcgccgtcgccttcgaggaacccaccctgttctccgcgagcgtcggcgacaacgttctcatgggcgccgacggcagcgcgggcgccgccgaactggaccgcgcgctcgccgtggcgcaggccgacttcgcgcacgccctcccccagggcaccggcacccaggtcggcgagcagggcctgagcctgtccggcggacagcgccagcgtctggcactggcacgcgcggtcgtgggccggccccgcttcctggtcctggacgacccgctgtccgcgctggacgtgcacacggaggcagccgtcgaggcggcgctgcgccaggtgctcgccgacaccacggccctgatcgtcgcccaccgcccttccacggtgctgctggccgaccgcgtcgcgctgctcgccgacggccggatcaccgccgtgggcacccaccacgaactgctgcgcacgaacgccgagtacgcccgcctgatgtccggcggcggcacccgcgacgaggaggacgacgaccgatgacggcccccacgacgtccgtccccgccaccgggggcgaggacgacctgccgcggacggacgccaccgaggacaccggcggcaccggcgaccccttcgaccgggacgtcctgcccactcccccgggcgccacggccgcgctgctgcgctcgctgctcgcgcccatgagagcccgcgtggccctcgccgcgctcgtgctgctgctccagcaggcggccgtgcaggcgggccccctgctggtggcgtacgccatcgacacagccgttccggcgttccggggccgcgaccacgggccgctgatcgcggtcggcgtcggttacctgctgtgcgcgctggcctcgggcgggctgcagtggctgttcatcgtggcctcggcccgggtcaaccaggacgtgctgctggacctgcgcggccgcatcttccggcacgcgcaggcgctcagcgtggacttccacgagcgctacacctcgggccggctgatctcgcggtccaccacggacgtggagtcgctgcgcgaactgctcagcgagggcctgcaggagctgatcgccgtcgtcctgtccttcgtgtccatctcggcgatgctgctctggctcgacgccggtctcggcgcggtagcggtggcgtcgttcgtgccgctgtacctgctggtgcggcgctaccggcggcgcgtggggcgggtgtaccgggagcggtccacggcgatcgcggcggtgatcgtgaagttcgtggagacgatgaacggcatccggccggtgcgggcgttccggcgggagcgggccaacgacgccgccttcgccgccctgaaccggcgccacgagcgggccaacggcgacgcgctcctggagatggcccgctacgtcgtcggttcccggctggtggcgaacacggcggtcgcggcgatcgtgctgtggggcgcctggcgggtgacggacggctcgctggagctgggtgtgctggcggcggcggtgctgtacctgcgccggctgtacgacccgatcgaccggctcggcatgttcctcaactcctaccagtcggcggcggcctccctggagaagatcgcgggcctgctcgcgcagaccccgtcggtgccggagccgtcggtgccgcgccggctgccgccccgggagtccgccctccccggccgggaggtcgtcttcgacggcgtccgcttcgcctaccgcacgggcggcgaggtgctgccccgcttcgacctgacactcccggccgggcagaccgtcgcggtggtcggttccaccggcgcgggcaagtcgacactggcgaagctgctggcccgcttctacgacccgagcgagggccgggtgctgctggacggcaccgacctgcgcgagctggccgggtccgaactgcggcgcggggtggtcatggtgacgcaggaggcgttcctgttctccgggacggtcgccgagaacatcgccatcggccgccccgaagcgagccgcgaggagatcgagcgggccgcgaaggcgatcggcgcccacgacttcatcagcgccctgccggacggctacgacacggacgtacgcaagcgcggcggccgtatctccgcgggccagcgccaactggtcgccttcgcgcgggcgctgctcgccgaccccgcggtgctgatcctggacgaggcgaccagttcgctggacatccccggcgagcaggccgtacagcgcgcgatggcgacggtgctgcggggccgtacggccgtggtcatcgcgcaccgcctgtccacggtggagatcgccgaccgggtgctggtgatggagcacggccggatcgtggaggacggcactccatccgaactcgtcgcgggcaccggccggttcgcgcacctgcaccgcgcctggcgcgacagcctggcctgaccggccgcgaagggggagcagtgatcgacgcgtacgcggacccgggcacgcccgacagccggggcggctggtggtacctgtggtggctggtgacccggcagccgggccggtcggtcgccggtgcggtgctggccagtgtgtggatggtgctgctcgcggcgacgccgtacctgatgtcccgtgcggtcgacgacggcctccagagaggcgacatggccgccctggccctgtggtcgggcgcgttgaccgcggtcggcgccttcaacgcctggctgagcatcatgcgccaccgcacgatgacacgggtgcggatggacgccaacttccgcacggtcaaggtcgtcgtggaccacgtggtgcgcctcggcgccgcgctgccgcgcaggaccggcgccggcgaggtcgtcaccatcggcgtcggcgacgtgcagatcatcagccagtgcctgaccgtggtcggccccggggtgggcggggtcgtcgtctacgcggtggtggcggggctgctgctgtcggtgtcggtgacgctggccgtggtggtgctgctgggggcgccgctgaccgcgctgctgatcgggccgctgacccggcggctgcagggcgtcgagggcgagtaccgggagcggcagggcgtgctgaccgcgcggatcggcgacctcgcgggcgggctgcgggtgctcaacgggctcggcggcaaggggctgttcgcggacgcgttccggcaggactcgcagcgcctgcagccagct

SEQ ID NO: 942 - DNA, 1886 bp, Unknown
  Kingdom: Bacteria, Phylum: Actinobacteria, Class: Actinobacteria, Order: Streptomycetales, Family: Streptomycetaceae, Genus: Streptomyces
  misc_feature (1519)..(1539): n is a, c, g, or t
ttcggcgggctcgacctgccgggcttccccaagggcctggacacggtgatcggcccgctgtccggcggcgagcggcgccgcatcgcgctggccaagctgctcatcgaggagcaggacctgctcgtcctggacgagcccaccaaccacctcgacgtcgagggcatcgcctggctcgccgggcacctgcgcgagcgccgctccgcgctcgtctgcgtcacccacgaccgctggttcctcgaccaggtctgcacccgcatgtgggacgtgcagcgcggcaccgtctacgagtacgagggcggctactccgactacgtcttcgcccgcgccgaacgcgagcgcatcgccgccaccgaggagaccaagcggcagaacctggtccgcaaggagctggcctggctgcgccgcggcgcccccgcccgtacgtccaagccgcgcttccgcgtggaggccgccaacgagctgatcgcggacgtgccgccgccgcgcgaccgcagcgagctgatgaagttcgcgtcctcccggctcggcaagacggtcttcgacctggaggacgtgaccgtccaggccgggccgaaggtgctgctcgagcacgtcacctggcagctcggccccggcgaccgcatcggcctggtcggcgtcaacggcgccggaaagacctccctgctgcgggccatggagcaggcggcgcgcagcgacggcgagacgcagcccgcgggcggccggatcgccgtcggcaggaccgtcaagctggcctacctgtcccaggaggtcgccgaactcgacccgacctggcgggtccttgaggccgtgcagcgggtgcgcgagcgcgtcgacctgggcaagggccgggagatgaccgccgggcagctgtgcgagacgttcggcttcggcaaggagaagcagtggacgccggtcggcgacctgtccggcggtgagcggcggcggctgcaactgctgcgcctgctgatggacgagcccaacgtcctcttcctggacgagcccaccaacgacctcgacatcgagaccctgacgcagctggaggacctgctcgacggctggccgggctcgatgatcgtcatctcccacgaccggttcttcatcgagcgcaccaccgacacggtgcaggcgctgctgggcgacggcacgctgcggatgctgccgcgcggcatcgacgagtacctggagcgccgccaccgcatggagcagcaggccgcagcggcctccgccccggccccggccgccgagtccgccgcacccgagaagagcgccgccgaactgcgcgccgccaagaaggaactccagaagatcgaacggcagttggacaaggtctccgagaaggagagcaccctgcacgcccggatcgcggagaacgccaccgatttcgcgaaggtggccgaactcgacgccgcgctgcgggacctggtggcggagcgcgaggaactggagctgcgctggctcgaactcgccgaggacgcgtagcgcgtacaccgcggggcgcgcgccccgcggtgtacgcgcnnnnnnnnnnnnnnnnnnnnncgcgtgaaggcatgggcgggcgcgtaacgaggccatcacaggccggttctcccttgggaacaggggcgggcgcgggacggtggggtgccggcggccagtggtagaaagggcggtccggaccctgtccggaaccgtccgcgtacgtctctgcgtccaccagggatctcagggcgtggctaaaaatcagtgaacgaggggggaacgcgctgatgtctcagccgcccagtcagccgccgcaaggcggcttcggagcaccgccgccgcaggacgggccttcgcagccgcaaccaccgcagggaggcggattcggcgccccgcaggacccgcgccaggccacgcccccaccc

SEQ ID NO: 943 - DNA, 2798 bp, Unknown
  Kingdom: Bacteria, Phylum: Actinobacteria, Class: Actinobacteria, Order: Streptomycetales, Family: Streptomycetaceae, Genus: Streptomyces
ggcctcgggcgacctggtccacggcctgctgctgatcgtgtccgaactggtcacgaacgccgtccggcacgccgcggtgctgtcgccgatgctcgccgtggaggtcgccgtcggcgccgactggctgcgggtctccgtcgaggacgaccatccctaccggccgaccgcgctggagaccgaccacggccgcaccggcgggcgcggactgctgctcgtgcgcgagatcgcccgggaggccggcggagtctgcgacgtcgagcacacggccggtggcggcaaggtgatctgggccgccctgccgctcacccccgggctctagcggttcctgggcaggctcaccagcccgcggggccggtcagctccctgatcgccgggcgggccgcgtcgagcacggtcatgaaccacgcggagaacggctcgcgcgcgtgccgctccgccagctcctcgggcgccacgaacgcggtgtcgccgatctccttggggtcgggccgcagcggtgactgcaccaggccgacgaagaggtggttgaactcctgctccaccaggcccgacgccgggtccgggtggttgtagcggacggtgcccgcctcggccatcagcgtgggggagacccccagctcctcgtaggtccgccgggccgccgccgcgaagggcgcctcaccggggtaggggtggccgcagcaggtgttggaccacaccccgggggagtggtacttgcccagcgcccgctgctggagcagcagccggccctgctcgtcgaagaggaacacggagaaggcgcggtgcaactgccccggcggctggtgcgcggcgagcttctccgcggtgccgatcgtcacgccgtcctcgtcgacgagttccagcaagatcgcgtccgcggtgccgttcgacgagctgtgcgtcgcggtggcaggtgtgatcggcatacccatccttcgcatcggtcctcgagccccaagtctgccgcacgaaaccggcgctcccggcacttcccggcgtacccgcatgtccccgcggtcccgtgccccggcgtgggcgcggtggtcaccggacggtcaccggaagcgggacccggttactgatcgtgccctgccgggcgccaccggaaccgtccgggtaccccggcggaccgggggccgtgggggcgctcagtggcacagacgcgcctcgtgctcggcgtgcccgccgggctccagctggaaggtgcagtgctccacgtcgaagtggtggccgaggcagccctgcagctcgtgcaacagcttttcgtgaccgatggcgctcagtacctcggaactgaccaccacgtgcgcggacagtaccggaagaccggaagtgatcgtccaggcgtgcaggtcgtgcacgtcctcgacgccgtccagcgccaggatgtgcgcccgcacctcgtccatgtcgacgttcttcggggcggcctccagcagcacgtccagggtctcgcgcagcagcttgaccgtgcgcggcacgatcagcaggccgatggccagcgaggcgatcgggtcggcggcctgccagccggtgagcaggatgaccgcggccgagatcatgacggccagcgagccgagcgcgtccgcggccacctccaggaacgcgccccgcacgttcaggctctcccgctggccgcgcatcaggagcgtcagcgagacggagttcgccaccaggccgatcagaccgaacacgatcatcagcccgccgtgcgtctcggcgggcgtcacgaaccgctgcaccgcctcgtacagcacgtacccgccgacgccgagaagcagcagacagttggcgagcgcggcgaggatctcggcgcgggcgtagccgaaggtgcggttcccgctcggcggccggttggcgaagtggatggcgagcagcgacatgccgaggccgacggcgtccgtcgccatgtgggcggcgtccgcgaccagcgcgagggagtccgcgagcatgccgccgacgatctccaccaccatgacggcgagcgtgatcgacagcgcgatgcgcagcgtgccgcggtgcgcggccgccgccgtgccggtggcgccgtgcgcgtgcccgtggtcgtgaccggcccccatcagcctctccgtcctcgtggatcgcgcccgggtccccgcccgggcggaacccagtcaactacgggtggggggtatggggcaacgcggcactgaacaccgttgtcatgtgccctgacctgcgcaaacgatccgcaggtcagaacgtttcggcaggttcggcgggccgcgtgtcgcccggtgcggaacggggagagagaggctgtaccgccccgccgtcgcgtccccgggcgttcggggtgaatgcccgatctggtgcggagtttgtggcccggcccccggatcaccgatgatgatctcggcgcaggctgcggccagatgacgttgatcggcccgtgaacgggcggtgaacgcgggcttccccgcatccgatagcctctgccgacgtgccgcccggccgccccggggtaagcggcatccctccaccatgcacatgaccggcgcgcacgcgtcggcaccagggagtgagttcggttgtcgaccgccatcctcaccggtcagccggtccccggatcgtcgatcgaggccgatctgcgggccctcggtttcgacgtgcgatgcgccgacgacgtcggtgacgccgaggccgcactggcccgggtgccgggcgaggagcgggtcgccgtcgtcgacacccggttcgtcgggcacccgcacgccctgcgcctgggcctgaccgacccccgcttcccgctcgcagcgggggtcggtcaggcccag

SEQ ID NO: 944 - DNA, 2202 bp, Unknown
  Kingdom: Bacteria, Phylum: Actinobacteria, Class: Actinobacteria, Order: Streptomycetales, Family: Streptomycetaceae, Genus: Streptomyces
ggacaccgccagctccggatcggtgagcgcggacagctcctcgtactccacgtcgatcagccgcagcgcgcggcgggccgtctcgggatggtcggcggccaccagggcgaccggctcgccctggtagcgcacccggtcggcggccagcaccggctggtcggcgaccttcatgccgtaccggggcgcccccggtacgtcctcgtgcgtcagcaccgccaccacgcccggcagccgccgcgcccgtgcggcgtccagccgcacgatccgcgccgaggggtgcgggctgcgcagggtggcgccccacaccatggagtcccagcgcagatcggaggcgtacgcgaactcgccgccgaccttgagccgtccgtcgggacgcagcacactctcgcccacgccgtgccggatgccggtgcccggctcgatggtggtgctcacgatcgtcacttcctctcgcacacggtgggagcaggtcgtgctgcgcggtcacgcgatgggccggaccgccgcctcggtgtgccgcggaccggcggtgtccgggccgaccgcctgggagagccggatccgcagccgacggatgtgctcgcgggcggcctgctcggcggcgtcgggatcgcccgaggtcatcgcctcgaagatccgccggtgctcctcgaccgccagcctgggcccctcctggctgcgccacagcgagtgcagcgccaggtgcgccttgccctggatggtgtcgagcgccgccgtcagatggctgttgccggcggcctcccggatcagccggtggtaggccatgtccatctcggtgtgcgtccgctcgtccagcccggaggcgacctgcgcctcgtgctgttccagcagctcgcgcagtcccgccacccgggccgcgtcgagccgctcggtggcgagcctggccgccagcccctccatgacctcgcggacgacgtacaactgccgtacgtcctcgatgtcgacggtggcgaccaccgcgccccggtgggcgacatgggtggccagaccgtcgtggatcagccgctgcaccgcctcccgcacggggctgcggctgatgcccatctgggcggcgagcgccggcacggacagggcgtcaccggggctgagccggccggccagcacggcgcccttcagctcctcgtacgcgcgctccgcgagcaggctccccgccgagaccgggttcaccggccggaacgactcgtcggacgccgctccgtgcgtcgtcctcggtgatctctgcgtcggcatgtctgcgaactcccctgtcacggccgggccttctcgttcgtttcggggctcggccccgcgaactccccggcctctcttacatgttgcatgtaatgttccggcgggtcaatggagctgtcggacctcttcccggcgcccggcagcggaagatgatggaagaacaggttgagcagtacggccgtgagcgtgccgaggatgatgccgctctggaagagcacatgcagttgctgcccgggcatccgctcggcgaactgcgggaacgcggtgggcaggaagccgatgcccagactcgccgcgacgagcacggtgttgcggtggtcggccaggtcggcctgaccaaggatctgcaccccgacgacggcgatcgtggagaacagcacgagggtggccccgccgagcaccgaggcgggcatcgccgccaccgcggcccccaccttcggcaccagcccgagcaccatcatgatcccgccgcccgccgcgacgatccaccgggaccgcaccccggtgagctggatcaggccgatgttctgcgaatagaccgtgctcgggaaggagttgagggtaccggccacggccgtggccaggccgtcggcgcgcagcgcccgggtgacatgacggccgtccacctcccgtccgacgatcttccccacggcgaagaactgcccgatggactccaccgcgatgatgatcatcaccaggaacagcgacagcaccgccgtcgcgtccaggcgcggcgtcccgtagtgcagcggcgccgtgatgcccacccagcgcgaccggccgatccccgagaagtcggtccgtccggcgagcgccgcgaccgccgtgcccagcgccagcccgaccagcacggccaccgtggcgaggaacccccgcgagaccttgtgcagcaccacgatcgcgcccagcgtgacggcggccaggcccaggtgggccggggagccgaaggag

SEQ ID NO: 945 - DNA, 1147 bp, Unknown
  Kingdom: Bacteria, Phylum: Actinobacteria, Class: Actinobacteria, Order: Streptomycetales, Family: Streptomycetaceae, Genus: Streptomyces
gctcaccgccgccgcgaccggtcccgcggcggcggtcgcggcggcggtgagcaggacggcggagcccatcagcagcagccgtacccgctcgacgcgcacccccagggcgtaggacacgtcgtcgcccatctccagcatccgcagcccgcgggcgttggcgaggacgagcgggagcaggactgcgcacagggcgagcagcggccacacctgggcccagtcgcggccgcccagcgagccggtcagccagttcaccgcgcgggccgcgtccacgaagtcggccttggtgatgaggtagccgttgacggcggtggcgaccgcgttgacgccgataccgaccagcaccagccggtagccgtggaccccctgcttccaggcgaggaggtagatggcggccccggtcgccaggccgcccacgagcgcgccggcggtgaccgcggtcgcgttgccggacagcagcacgatgacgacgagcgccccggccgtcgagccctgcgacaggccgagcacgtccgggctgccgagcgggttgcgggcgacggactggaacagcgcaccgctcaggcccaggcaggcgcccaccagcagcccgaccagcacgcgcggcagccgcagttcacggacgatgaactcctggcccgggttgccctgcccggccagcgtcttcagcacgtcggaggcggggatcgggaagtcgccggtgccgatcagcacgacgccggcggcgagcgcggcgagcaccagcaggacgacgacggtgagcgccctggtctcgagacggaaggacaggccgccgggggcgcggacggctcgtacggcacggggggcgcgggcggtgccgggagtgcctgggatggccgcggtgtctggggtgtgtccgggaccggccgtcggggtggtcttcacagctgggtcgtcctccgccgccgaacgagcaggatgaacaccgggccgccgatgagcgcggtgacgacgccgacctggacctcgccgggccgggcgacgatccgtccgatcacgtcggagccgagcagcagcacgggcgacaggaccgtggagaagggcaggatccagcgcagatccggcccggtgaaggagcgcaccgcgtgcgggaccatgagcccgacgaaaacgatcggcccgcaggcgg

SEQ ID NO: 946 - DNA, 750 bp, Unknown
  Kingdom: Bacteria, Phylum: Actinobacteria, Class: Actinobacteria, Order: Streptomycetales, Family: Streptomycetaceae, Genus: Streptomyces
gccgccatgtgcgcggtggaactgcagaagctccgccacgaccgcaccgagctgtacacccgtgcgatccagcccgccctgtggctgctgatcttcggccagaccttcacccggatccgcgcgatcccgaccggcggcatcccctacatcgacttcatggcgcccggcatcatcgcccagtccgccatgttcatcgccatcttctacggcatccagatcatctgggagcgcgacgccggcgtcctcaacaaactcctggtcacgcccaccccgcgctcggcgctggtcaccggcaaggcgttcgcggccggagtgaagtcgctgatccaggcgctcgtggtcgtcgtcatcgccgcgctgctcggagtggcgctgacctggaacccgctgcggctgctcggggtcgccgcggccgtggtgctcggctcggcgttcttctcctgcctgtcgatgaccatcgccggcatcgtgctcagccgcgaccgcctgatgggcatcggacaggccatcaccatgccgctgttcttcggctccaacgccctgtacccgctggccgtcatgcccggctggctgcaggccgtcagcaaggccaacccgctcagctaccaggtcgacgccctgcgcggactgctgctcggcacctcctcgcacctggcgctcgacttcgccgtgctcgtggtggccgccgcggccggcatcaccgcggcctccgccctcatcggccggctggcccggtgaggaccgccgggc

SEQ ID NO: 947 - DNA, 3518 bp, Unknown
  Kingdom: Bacteria, Phylum: Actinobacteria, Class: Actinobacteria, Order: Streptomycetales, Family: Streptomycetaceae, Genus: Streptomyces
tgtacgcggcgggcgccggcccggcccgcaccgtcgcatacgccccgctggcggaggagttgctgcgccgggccggccaggaccgcaggctgacccaggaggcgggcgccgcgcccacgccggaacgccggcacagggtcgccaggtgccaccgcgacaacgccgaggcccttgaggagatcgtgcgccgccacggctggccgaccgccgacacggtgggcgcgcaggcgtcgaccgccgcgctgatgatcctgctgcacgcccccgggctggacctgcggctgcgctgccgggacctgatcgcgcaggccacggcggacggccgctgccctgccgtccacttcgcctacatcgccgaccactgcgccgtcgacctgggcgaaccgcagttctacggaacccggatcgacccggcgacactgcgtccgtatccggtccgcctgcccgagagtctcgacgagcgccgccaggacgtcgggctcggcccgatggaggaacagctgagggcgctgcggctgcgtggttgagcggccgggcgccgtgagggtttcgcaggtcacgacggaggtacccgcgcctcggccgtacgccgtgcggccggccgcagtgccacgcgcggacccgcgaaggaggacatcgtgaccggacaccgcccgcccgtgccgcgggacatgccggaccagcaggcggatgtggacgaggatccctgggagacggcgcggtccgccggatccgagcggcccggcaagcagccgccccgcagagagccctcccacgacgaggtccccggggccgacgaggagaaccccgtaccggacgaaccttccggctgaggctgatgccgtccgtccgccgggggtggcgggcggacggacgagcagtggcccgatgagcgggcggagcggcggtcgggcccgtccgcccgccgctctcatcccaccttgcggccgcgcagcggctcggtgtccgcgccctcgccgcgctggagcccccgcaggaactcctccacgacctcggtcgccgtgtgccgggggctccagccgagttcggtctgggcccgggtgcagtccatcaggggcagccgcagaaccgcgtcgaacaggtgcggcgaggccggcagcagatgcaggccccaggccgccgcgatcgcggagcgggcggcggtgcgcggcagccgcacgggccgtgtgccgagcagctcgccgagcacccgtgcgtcgagcggcggatcggcggccaggttgaaggcgccgcgcacctcgtggcgcagcgccagcaggtaggcgcgggcgccgtcgtccgtgtgcaggacctggaccctgaggccggggatgtccggcaggaacggcagcaggtcgggccgcgccatcggccccggcaggaaccggccgccgaagatccgccgctgctcgctcgcggactccgccttgaacaggaacccggggcgcatccgcaccacccgcacgtcgggatggtcccgctcgaacgtgtccagggcccgctccaggtacgccttctcccgggtgtacgccgcgtccggccagccgtgggtcggccacgactcgtcgacggcgtggtccttcggccccggcgagtacgcacccaccgaggaggcgtgcaccagcaccggcacccgcgcggcggccacggcctcctggacgcggatgccgccgaggacgttcgtgcgccaggtcgtcgccggatcgtgcgtcggctggaacgcccaggccagatggatcacggcgtccgcgccctcgaactgtccggccagtgcggcctgctcggatgcgatgtcgacctgcgcccactgtgttttcggcggtgcccaccgcgggatccggcgggccaggccccgtatcgaggccacctccgggtcctcggagagcagacggacgacgctcgtcccgacattgccggtggcgcccgtgacgacgaccctgctgcccgacacgctgctcacgttcggctcctctcgccaacggtcgagtccgcggcccgagtacccgctccgcaccggacgacccggcaccggctccggcacggcttcgcgggccgccgtcacggcacgcgtgcggtcaggagcggccggcgaacgcgtccacgcccgtcagctccgccgacagcgcccacagacgggccgcctggtcagggtcggtggcccagggcttgacgccgccggagtgcatgccgtcgtcggggaccggctccgcgatgtcgcagtcctccaggtagacacccccgaggccgtccaaccggggcgaggtcgccgcccagacctgggtggccgcgccctgctgcggggtcttgaagcccgccgggttcagcgggacgccgttctcgtcgacccagccgcgctcgatcatctcctgccgggacagatggcgctggagcggcgtgatgatggcaccggggtggagagcgaaggcccggacaccggcgtcgcgggcgagccggtcgaggtggacggcgaacaggacgttcgcggtcttggcctggccgtaggcctcccacttgtcgtagccgccgcgccagtggacgtcgtcccagcggatcccggagaagtggtggccgcgggaggagaccgagacgacccgggcgccgcccgcctcgatcgccggccacagacggttgaccagcgcgaagtgacccagatggttggtcgcgaactgggcctcccagccgggcccgacccgggtctgggggcaggccatgatcccggcgttgtcgatgacgaggtcgaccgtgcggccggaggccaggaaccgttcggcgaaggcgcggacgctgtccaggtccgccaggtcgagtgtgtccgcctcggcgccctcgacgccgtgcagcgcctcccgtgcggtgtcgggacggcgggcggggacgatcacgcgggcgcccgccttcgtcagtgcccgggtggtctccagaccgagaccggagtagccgccggtgacgatcgccagcttcccggtgaggtcgatgccccgcaggacgtcgtcggcggtgctggtggctccgaaaccggaaccgatcctgtgctgtggtgtagcgctcatgtccggaacgctacgaactggagcgctctcgaagtcaagggcgcacccggcggcttcacggacggccggtgcgggactggcggggagcatggggaagccccggccggacgggggaatcgcggccggggcggtcctggtgtgggcacgcatggcggtcgcctctcggcgagacgctccacagggcttcagccgaacgatcgtccctgtgggcaataggtgaggcccggggacactgtcccatccgcacccacggtgagttcaacggaggaagggtgcccggtgttccggactctgccgcgttttgtggtgatccgggtcactccgcagcggtacgcgaggccggccccgacgccgggtacgaaccgggtgccggtcccggtcccgacgccgcttccgatgccgatgccgatgccgatgccgcgtccgcttccgacgccgcgtccgcttccgacgccgcgtccgcttccg

SEQ ID NO: 948 - DNA, 3462 bp, Unknown
  Kingdom: Bacteria, Phylum: Actinobacteria, Class: Actinobacteria, Order: Streptomycetales, Family: Streptomycetaceae, Genus: Streptomyces
atgagggcgtccagctcgcccagtggtccccgggcgagctggacgccctcatctggtcccacgcccccgacccggacgcccgtacggccccgcggacgctctccgacgtcccggccgtcaccccgcagtccacggcgctgtccaaggccctgaagaagcgcggcctgcgcttcgtcggcccgacgacggcgtacgccctgatgcaggcgtgcgggctggtcgacgaccacctcgccgactgcgtggcacggcgccgcccctgaccgcgggggcggcgccgccgtgctgccgggggtcagcggcccaggtacttcggcttctccttgttcacgaacgcctgtacggcgatgtggtggtcctcggagctgcccgcgcgcgtctgcagctcgtcctccttctccagcgtctgagccagggagtgcgtcaggccgtaggccaccgactccttgagcgcggcgtacgccagcgtcgggcccaaggccagcttccgcgcggccttctcggcctcggcgcgcagttcgcccgccggtacgacccggtcggcgatccccagctccagggcctcctgggcggtgatcgtccgcgggaagagcagcaggtcggtggcgcggccggcgccgaccacccgcggcagggtccaggagatgccggagtccgcggtgagcgcgacgccggcgaaggacgtgttgaaggacgcggtgtccgcgacgatccggtggtcggcggcgagcgcgaagccgaagcccgccccggcggccacgccgttgaccgcggcgaccaccggcttcgccgcaccggccagcgcccgcacgatcgggttgtagtgctcgcgcacggtgctcatcgtctgccccgaaccgctctcccggtcggcggccagcagcccgatgtgctccttgaggtcctggcccacgcagaacgcccggtcaccggcggcggtcagcagcacggcccgtacggcgtcgtcggccgccgcggactcggccgcgtcccgcagcgcgaccttggtcgcgatgttcagcgcgttcatcgcctccgggcggttcagcgtgatcgtcgcgagcccgtcgctcacctcgtagagcacggtgtcggccatggggcatcccctccgctgtcggctcggcgtaccgctcggtacgtcctgtgtccgaaggacagcatgacggagatcaccggtcccggcggggagcgggcgtgtgacctgcgtcaaagaattcgggcgggccgggtgccgggaaaggcgggcgcgggggcgcagtatcgcagtcacatccccgaattgagtggttttgctcgcgcgcgttgcccaagcgatgccgaccgatgttggtcatcgggtcctgagatgcgggataatggctgggaagcaatgtgttcgatgccggtgtcgcgtgtcctgggcagttttgcgcgtggaccgcgcgtgccctttcggtgcgccgtcggctttgacgatgagctgggtttcaggaaggggaacgagcatggcggccatgaagccgcggacgggtgatggcccgctcgaggtgaccaaggaggggcggggcatcgtcatgcgcgttccgctcgaaggcggcggtcgactcgtcgtcgagctgacccctgacgaggccgacgcgctcggcgacgccctcaagaaggtcgtcggctgacgcggaagcgaccatgtcttttcagcgaccccggcatcgtacgcggtgccggggtcgctgttttcgcgggcaccgccgcccggctgtccgggcggacctcggcccgttctccgaggggcggtcggcggtcctcgtcccgcttcccgcccggcgaccggcggtcctcgtcgcgttgtccgcggcggtggctcagcgcttgaccgcgcacagcaggccgtcgcccaccgggagcagcgacggcaccagatcggggctctcgcgcaccgtgcgcagcagctcccgcagccgcacgacctccgcgggctgcggtccggagtcgaccgtacggccgtgcgcgaagacgccctcgaagacgaccaggccgcccgggcgcagcagacgcaacgattcggcgagatagtccaggaactcctgccggtcgccgtcgcagaacaccaggtcgtatccggcgtccgcgaggcggggcaggacgtccagggcgcggccggggatgaagcgggcgcggttgctggcgaagcccgcggcccggaacgcctgccgggcgaactgctggtgctcgggctcggggtcgacggtggtcagcaccccgtcggggcgcatgccgtgcaggaggtggatgccggagacgccggtgccggtcccgatctccgcgaccgccttcgcgtccacggtggcggcgagcagccgcagcgccgcgcccgcggcgggggacaccgaacgcagccctgcctcgccggcccggtcccgggcccagagcagcgcgtcgtcctcggcgacataggcgtcggcgaacgcccagctcgtctgccggttgccggtaatgaccctctcctgtcccatggatgcctgggcgtgactgtatccgttggggccgggaacccgcagatgggaccgggcgtttgaagaggtgggggagcgccgggcgaggtgaccggaggcaggacggggggtatgggatggaacgggacgacgggcaagggctgacgcagccggatgaggcgtggcagggcgtgtcaaattcaagtaaaaccgcttatccggagctaacgggcgaggtggctatggtaggggctccactggacaccaccagagccgacaggggaggtgcggccgcgcctgtggatcggggaggagtgctccggcgctttctcggatcggcaggcaggccgaaatccgtgaacgacaccgctgctgaccgtacccacgccgagggcaccgccccggccgcgaccgcgaccttctccagcgacgcggacgggcaggcgtggactccgcccacctgggaggagatcgtcagcacccacagcggccgcgtctaccgtctggcctaccgcctcaccggtaaccagcacgacgccgaggacctcacccaggaggtcttcgtccgtgtcttccgctccctgtcgacctacacgcccggcaccttcgagggctggctgcaccgcatcacgaccaacctcttcctggacatggtccgccgcaagcagcgcatccgcttcgacgcgctcggagacgacgcggcggagcggctggccagcaaggagcccaccccgcagcagctcttcaacgacgcgcacttcgacgcggacgtccagcaggccctggacaccctcgcgcccgagttccgcgccgcggtcgtcctgtgcgacatcgagggactctcctacgaggagatcgccgccacgctgggcgtcaagctcggcacggtccgctcccgtatccaccgcggccgctcgcagctgcgcaaggccctggcgcaccgttcgcccgaggcccggcaggccgagcggcgccgcttcgtgccccg

SEQ ID NO: 949 - DNA, 2726 bp, Unknown
  Kingdom: Bacteria, Phylum: Actinobacteria, Class: Actinobacteria, Order: Streptomycetales, Family: Streptomycetaceae, Genus: Streptomyces
gcacacggcccacgaccgacaccttcttcccgcccgggcccgcacccgtacccgagcccgccgccgggtcgagcgccgcctcgttggagacgaactccatcgtcagcgactgcttgatctcgcccttggtgagggcccgtacgtcgttgttcggggtggggaccgaggcgcccgaggcggccgtctgcttctggtagtggcgcgtggcgaagaagaccagggcgccgccgtcggcggtgcgcagcgccagcggggcgaagtcgccgccggtcagcggctcgtcgatgtactgcgtggccagacccggccgtaccgcgttcttcgcgcgcagcgcccgccagcccgaggtgtgcacacccgtggcgaacgtcttgccgccgtccttcagataggtcgcgtaggcgccgctcagcccgcccggcgcggcgaccaggccgggggagccggcgggcacggcctcggcccagccgtcctcgtccgtgcggaacttcggcacccgcccgggagccaccagcgtcaggtacgccacctgccacttctcggtgagcgcgtggcgcgtgaacagcagcagccagcgcgcggagccgcccttgttgcccttcgcgtcggcgaggaaccagcgcggccagccggccttcttcgggatcgtgaacttcgcgtccgtcagcttcagcggcgtgtgccgggggttcccggaagggctgttgatgtggcccgccttcagccgggcggcgtcgatcgcgccgagcgcgccggtgacgtgaccggcgtccagcgaactgtcgtacgccttgtcggccttgttgtacgcggaggtgaactgcgccagcgccttcgcggcctcggccctggtggccgccgggagcacctcgcgctccccgtgcaccaccacacacccgccggcggtcagcgccagcgcggtcaccgaggccgccagtacggccgtccgctcaagcctgcgaagccttcgagggccgcgacccctgctcatcagctaccgtcaccttccccttcccggaggcgaaccctaccggggcgaagaacacggtgagcgtcgggaccaggtacagcagccacaccgtgacctggaggacggtcgggtccggctggaagttgaacacgcccttcaggagcgtgccgtaccagctgtccggcgggatggtgccggagatgtcgaacgccaggttcgtcagcccgggcagccagtcggcctcctggaggtcgtggaagccgtacgcgagcacgcccgccgcgaccacgaccagcatggcgccggtccaggtgaagaacttggccaggttgatcttcagcgcgccccggtagaacagccagccgagcaggatcgcggtggcgatgccgagggcgacgccgatcagcgggcgcggggtgccgtcggaggcggcgtgcacggacgcccacacgaacagcgcggtctccaggccctcgcggcccaccgcaaggaacgcggtggcgaccagcgcgccggtgcccatcgcgagggccgcgtccagcttgccgtgcagttcggacttcaggtgccgggcggtgcgccgcatccagaacaccatccacgtcaccaggccgaccgcgatgacggacagcgaaccgcccagcgcctcctgcgcctcgaacgtcagctcctgcgagccgaattcgaggacgcagccgaagcccatcgcgatggcgaccgcgatgccgatgccggtccagatcggccgcagggcgtcccggcggccggtcttgaccagataggcgatgaggatgcacacgacgaggctggcctccagcccctcgcgcagaccgatcagatagttggagaacacggacctacgcctcctcggacagcagggtgcggccccaccagtcgttcgcgtcgcggacaccgggcgggatcgcgaagaccgccgaacccacgtgctggatatactcgttgagcgcgtcgtgcgcggccagcctgcgctggagcgggatgaaaccctcgcgggggtcgcgctggtaggccaggaagaacagtccggcgtcgaggcggcccaggccgtcggtgccgtcggtgaaggagtagccccggcgcaggatggtgatgccgccgttggcgtcggggtgcgcgagccggacgtgcgcgtcgggcttcatcgccttcaggaagggctcgtcgtgctccttggccttgccgaccggcgcgccctcgcccttgtcccgcccgaagacgtcctcctgctcctgcagcgaggtccggtcccaggtctcgatgttcatccggatgcgccgggccacgaggtacgaccccccgcccatccaggcgtccttcgcgccgccgtccccgtgcccggcccacacgaacttctccagccggtccgtctccgtcccggcgatgttgcgcgtgccgtccttgaaaccgaacaggttgcgcggggtctgggagccgggcgtggtcgaggacgtcttgccgaagccgagctgggaccagcggatggcgaccttgccgaagccgatgcgggccaggttgcggatggcgtgcacggcgacctgcgggtcgtcggcgcaggcctggatgcacaggtcgccgccggtgcgggagccgtcgaggttgtcgccggggaacttgggcaggtcgaccagggccgccggccgcttctcccgcagcccgaacttctcgaacagggacgggccgaagccgagggtgagggtgagccgggagggcggcaggcccagcgcctcgccggtgt

SEQ ID NO: 950 - DNA, 1886 bp, Unknown
  Kingdom: Bacteria, Phylum: Actinobacteria, Class: Actinobacteria, Order: Streptomycetales, Family: Streptomycetaceae, Genus: Streptomyces
cgtccgggcgaccgggcgcgcacggtgtgcagcagccgcaagtaggcctgcacggcggtgcgttcatggtcggtcaggacgacggtcggcatgggcgctctccccggtttcggcagcacacggtcgacgcgcgcgcccggtcgcccggacggcgcgccgcgccccgcacagcggcggcgcaccctccagcttgccgcccgccactgacaatgcccgcgcgctgcgcaccggttcgcccactcagcgcagcgagacccctgctcgcgggggccgggagcgaggacgacgccggatcactcctcggggcgcttcacgctctccaggagcatgtccagccactccgcgaccttgtcccggtgctggtccgtgggcagttgagcggcgcgccaggcgatgccgcgcaccccgtggttctgcagcagccgctccagcgggtcgccgtcggcggccgcggcctcccgttcgcggtcggcgaggcgttgcagcagttcctgctccgtgcgctgcagggcgccggcgagcgcctcggagtcctccgcggtgaggaacccggcgtggacgcggaagaaacgctgcagggcgtcgcagtgctccatggtggggcgccggtcgccgttgatgagggcgcccgcctgctggcgtgacatgcccgcgccgtcggcgatctcctgctgcgtgtaccgccggccgttgggtttgagccgggtgcggcgcagcagaccgagccgttgcagaaaccgtgcctgcacgtccggttcgcccgcgccgcgtccgctcagcagcgccttgaccacgtcctgcggcacgccgcaggccacggagaggcggtcgatggcgaagacctcagcctggggtacgccgagccggtcggcgagcgcggtgacacgcgtgaccacggccggcagtacgaccgacgccgtggtgcccggatcctcgatgccgtccgtcaccgacagatctcctacgtctctcacaggcttctcacggggcggggcgccgtgaacttcccggagagtagcccgtcgtccgaacccgcatccaggtctcgccacaactgtggccaatttcagccgtcaaccttcgcgaaatgccacgatagttgacatggcatgccgctgagcagcaggatcaaggcgccgcgtgaaggccgcagaggcaagaggggtgacctcccgatggcatttcaggcaggagggcagcggccggtgccgcggtccgttcccgtccgtcccgaggcgcaggcctacctgcgggactacgccgcgctcctggaggccgtctccttcccttccttcgtcgtcgaccaccgctgggacgtcgtcctggccaacggcgcctacacctcgctcttcagaggcgtcggcccgcacccgtcggccatgccgggcgacaacttcctgcgtttcgtcctgttccacccggatgccggcacggtcctcggcgaccacgagtcccgctggtgcctgccgatgctggcgcagttcgcggccaccatggagagccacggccccgaccacgggctgcaggccatccgccgggacatcgcccaggacccgatcatggaagccgcctaccggcacggactgccgcactggatccgcgcggtcggcgccgcggccacccgctccgacggcgccgtccgcccgctgctgcaccccgatccccgctggggcgccaccgactgccgtgtggtcgaggagacccccgagaccctgcgggacctcgggtacagccggctcaccctggtgctgcgcgaggcacgccgtcccgctttggccgcgcgcgggacgcgccgggtccgccgtccgtccggtcacctcagcgtggtgccggactccgaggcctgacccggctccgtcggcgttcaggtcgccgacggcgccggg

SEQ ID NO: 951 - DNA, 2148 bp, Unknown
  Kingdom: Bacteria, Phylum: Actinobacteria, Class: Actinobacteria, Order: Streptomycetales, Family: Streptomycetaceae, Genus: Streptomyces
ggcgtgcgcgggggccctggggtcgctgccctggtgctactgcgcggaggccgtgaggtcgccgcggcgcggcgcggcgaagccctccagatcggcgcgggtcaggccggtgaggcgggccacctcggcgatgtccagggcgccgcagtccaggccgcgcagcaggtagccgctgagcgccttggccgtggcgggctcgtccatgacgtcgccgccggcgcgattggcgtagcgggacaggcgggccgccgcctgctcgaagccctcgcggtagaaggcgaagacagccgcgtaccgggtggggatgtgggccgggtgcatgtcccagccctggtagtaggcgcgggcgagggcgcggcgggtgaggccgtagtgcaggcgccaggcgtcgtggaccttctcggtcgggccgaccggcagcacgttcgtggagccgtccgagacccggacgccggtgccggccgcggcgacctgcatgacggccttggcgtggtcggcggcggggtggtcgctggcctggtaggcggcggagacgcccaggcaggcgctgtagtcgaaggtgccgtagtgcaggccggtggcgcggccctcggcggcctggatcatccgggctacggcggcggtgccgtcggaggccaggatggactggctggtctcgatctggatctcgaagccgagccgccccggctgaagtccatgggccttctcgaaggcctccaggagccggaccatcgcggtgacctgttcggcgtacgtcaccttcggcagcgtcaggaccagcccgtcgggcagtccgccggcctgcatcaggccgctgaggaagacgtcgagggtgcggatgccccggtcgcgtaccggcgcttccatgcacttcatgcggatgcccatgtagggcgcggccgtgcccttggcgtacgcctcggccaccagccgggccgcgcgggcggcggcctggtcctcctcggcgtccgggcgggggccgtagccgtcctcgaagtcgatccgcaggtcctcgatcggttcgcgctccagcttggcgcggacgcgggagtagaccggctcggcgagttcgtcgctcagacccaggaccgcggcgaaggacgtggcgtccggggcgtgttcgtcgagggacgcgagcgcctggtcgccccaggagcggatggtgtcctcggagaaggcgtcaccggggacgtacacggtgtggacgggctggcgggtccccggatcgcccgggtagcagcgctccagctcggcgtcgaccggcgcgagggaggcgctgatctcctcgctgacggcgcccgcaaggctcgtcgccaccgtctcctgctggccctgacccattccacaccctcctgttttccgttgtgcggaatcaataatccgctctacgaagctatctgtggagcttcccgccggtcaacacctgtccgcagcctgggccatcgcctcgcctgggacaagccggacaagccgaggcccccgcgaccgcggtgcggtcacgggggcctggcccgaggcagccccggcaggggcccggaggatcagcccttgcgggtcttgatctcctcggtgagctgggggacgacgtcgaagaggtcgccgacgacgccgtagtcgaccaggtcgaagatcggggcctcggggtccttgttcacggccacgatggtcttcgaggtctgcatgccggcccggtgctggatggcgccggagatgccgttggcgatgtagagctgcggggagacggacttgccggtctggccgacctggttggtgtgcgggtaccagccggcgtccaccgcggcacgcgaggcgccgacggccgctccgagcgagtcggccagggcctcgatgagcgcgaagttctccgcgccgttgacgccacggccaccggagaccacgatcgcggcctcggtcagctccggacggcccgtcgactcacgcggcgtccggccggtgaccttcgtgcccgtcgcctggccggagaaggtcacgtccagggcctcgaccgcaccggcggccgcagccgcctccacggcggcgctgttgggcttgaccgtgatgaccggcgtgcccttgcagacacgggacctggtggtgaaagaggccgcgaacaccggctgggtggcccccggaacctccgagccggcc

SEQ ID NO: 952 - DNA, 1502 bp, Unknown
  Kingdom: Bacteria, Phylum: Actinobacteria, Class: Actinobacteria, Order: Streptomycetales, Family: Streptomycetaceae, Genus: Streptomyces
gctggacgtcgacgcggcggccgaattcccgcagcagcaggcccggttcgacctgtgggccgagggctgggagacccgcaggcccaagggcacgcagtgagcaccgccgccgcgtcgacgtccagctccacacccaggccgggctcgtgggagaggtggaagcagccgtcctccgggtcgacctgcggggcgcccttgacgaccttcttgatctccgcgtccgcgaagtcgttgaagtgctccaggatcttgaagttgggcgaggtgaaaccgacctggagggacgcggcggtcagcaccgacccgccgacgttgtgcggcgcgaccagcatgtagtgcgtctcggcggtggcggccagcttgcgggtctcccagatgccgccgatgtggccgacgtccggctggatgatgtcgacggcctggctctcgaacagctcgcggaactcgatccggtcgtggatgcgttcacccgtggcgaccgggatgtccaccttcgcggcgaccttctccagcgccttgaggttctccggcggcaccggctcctccagccaggccggcttgaagggcgccatctccttggccagccggacggcggtggccggggagaagcggccgtgcatctccagcatcagctcggcgtccggaccgatggcgtcgcgcaccgcctcgatgagggagacggcgtacagggtccgctcgtggtccagctcgaggtgcccggtgccgaacgggtcgatcttcagcgcccggtaaccgcgcgccatgactccctgcgcggccttgtggtacgcctccggagtgcgctcggtcgtgtaccagccgttggcgtacgccttgaccttgtcggtgaccttcccgcccagcagctgccacaccgggacgccgagggccttgcccttgatgtcccagcacgccgtctccacgaccgcgatgccggacatgacgatctcgccggcgcggccgtagtcgccgtacttcatccggcgcacgaggtcctcgacggcgaacgggtccgagccgaggatgtggttggcctcggcctcccgcaggtagccgatcagcgcgtcggtgtgacccagcatccgggtctcgccgacccccgtgatcccttcgtcggtgtgcacctggacgtacgtcaggttgcgccacggcgtcccgaccacgtgtgtgctgattccggtgatacgcacggcagttgcccctcagctgttcgcgattgctgtaccgactgctgactgttcgatatttcgtcacgcgttcgaaatgctggcgtgacagtagagacggggcgcggagagtgtcaatggggccgacaggtaacggtttcggcaagccttcccggagttctctctttcccctacggaaccttcacagacgcccctaggaacggcgcccgcccggaacttagtcttcccgcgtcatgaactactgccacccgtgccgacggcatctcaacggcgccctcgcctgcccggggtgcggcaccccgggcaggcgagggc

SEQ ID NO: 953 - DNA, 1719 bp, Unknown
  Kingdom: Bacteria, Phylum: Actinobacteria, Class: Actinobacteria, Order: Streptomycetales, Family: Streptomycetaceae, Genus: Streptomyces
ccgaggacggccggccggagccgggctccgccggccgtcctcgggccgtcgcctgtcatcgccatcactagcgcactccttctcgctgccgtgccgtcgtccggcctgcccgtgctcccgggtccggccggtgggttcactgtggcaacggcagctccgctcccgctcaccacgggcccacacgccgctcacgtcagggcgtgagcgccaagtgagtcgtgcgggagcggcggttgcgaacatggtcgaggcgcctggcggcacaccactgacccggggcgctcgggggcgcgccgtgcgtactcaaacgccgcggccacccggttcacgaacgtgtacgacgtgtacgaggagacgaaccagtgcgggaacgcaggatcggtacggacggtccgttggtctcggccatcggcctgggctgcatgggcatgtcggagttctacgggcccaccgacgaggcgcagagcctgcggacacttcaggcggcgctggaccgcggggtcaccttcctcgacaccgccgacatgtacggcaagggccacaacgagcggctcgtggggcgggccgtggccggccggcgggaccaggtggtcctcgccaccaagttcggcctccggcgcgacgaccgcgacccgcggcagggccgccaggtcgactccagccccgcgtactgccggcaggcgatcgacgcctcactgcagcggctcggtgtcgaccacgtcgacctgtactacctccaccgccgcagccccggcgtcccgatcgaggagaccgtcggcgccatggcggagctcgtgacggccggcaaggtccgtcacctggggctgtccgaggtcagcgccgagacgctgcgcagggcgcacgcggtccacccgatcgcggccctgcagaccgagtactcgttgtggacccgcgaggtcgagcacggcgtcctgcccgccacgcgggaactcgggatcggcctcgtcgcctactcgccgatcggccggggcttcctgaccggtgccatcacccgctccgaggacctggacccctccgacttccggcactcccacccgcggttccagccggagcacctggagcgcaacatccgcatggtcgaacggctgcgcgagatcgcccgcgacgccggctgcacgcccgtccagctcgcgctggcctggctgctgtcccgcggcgaggacatcgtgcccatccccggcacccgccgtgaggaccgtctgcgggagaacctcgccgcagcggacgtcgaactcaccggcgagcaactggccgcggtggaggccgccgtgccgccggaggccgtgtccggcgagcgctacgaccctgcgggcatggccaccgtcggcctgtgaccgccgcgtccgtgcacggacgcaccagccctgaacgcccccggcgacaccacccgagaaacggaaaccctcccgtggcagacaagctccggcacctgaagctggccgccgtgaacatcgacggcgtccttctcaacgacaccttcagcccggtcatctacaacttcatcgtcagccgaggcggcgagtacaccgccgaggtcgaacgcggcatcttctcccagccccagctggtgggcggccagggcatggccaacgccgcacggatgccgtggaccgcgcaggaagccatcgacgtctacttcaaggaacgcgaggagtacgtccgggaccaccccgtccagctcctcgacggcgccgtcga

SEQ ID NO: 954 - DNA, 6986 bp, Unknown
  Kingdom: Bacteria, Phylum: Actinobacteria, Class: Actinobacteria, Order: Streptomycetales, Family: Streptomycetaceae, Genus: Streptomyces
ggacggcgcccagcagcgtcttgcccaggaaaccggtcaccgccagcggtacgagcatgagggcgaaagcgctcaggaacatgccgaccgcgacgctcctgtcctgctgcggcgcgacgatgtgcagcacgcccagcgcggcccacgaggtggcgaacaggccgagcgcggcagcggcggcggtgtcccggctcaggaaggccgtcaccgcggcgaggaactccagcgggaagacgaacaccgcgagcaggatgcccgccggacgcacctggtcgccggtgaccacgcccaggctgatcccggccagcaggaccatgccgatgccgaaggcgaagaagccgagcggcaggggattgccgtacggccggacggtgacggtggcggcctgctcaggttccgcgtcggtgccggtcacgcacgccgcgtacccgcgggcccgcgcgggaaacgccgcggtggcgacggcgtcagggctgcgtcaaggccgaggtgagcgccgtaagagaggcgtcaacgggggccgaagccggccgaagaggggatttcctctactcgtccgaagcatccgcacctcattccaggagcccgcgatggccgatctggccttcgtcgtcaccacactcgccctcttcgcgctggtggccctcgtcgccaagggggtgacgaagctgtgaccgccgagaacgtcgtcggcctggtcgtggccgtcgctctgctgggctatctcgtcctcgccctgatcttcccggagaggttctgagccccgccatgagtcccgtacttgccggtgtgctccagttgctcgccctggtgggcgcactggcgctcgcccacgttcccctcggttcctacatggcccgggtctactccagcgaccggcactggcgcgtggagcggtggatctaccgggcgataggcgccgacccggacacgaagatgcgctggccggcctacctgcgcgccgtcctcgccttctccgcggccggtgtcctcttcttgtacctgctccagcggatccagggcgtactgccgctctcgctcggcttccggtccatcgaacccgctcaggcgttcgacacggcggcttccttcgtcaccaacaccgactggcagtcctacgccggcgagcagaccatggggcacgtcgtgcagaccgcggggctggccgtgcagaacttcgtctcggccgcggtgggcatcgcggtggccgtcgcgctggtccgcggcttcgccgtcccccgggctctcggctccgctcgagcaggggaaaaccccgtccgcaccggcgagctgggcaacttctgggccgacctggtgcgcggcaccgtccgcgtcctggtgccgatcgccgcgctcgccgccgtcgtcctggtggcgtgcggcgcgatccagaacttctccggcatccacgaggtcgggcagttcatgggaggggcgcagcagtggaacggcggcgcggtcgcctcccaggaggccatcaaggagctgggcaccaacggcggcggctacttcaacgccaacagcgcccaccccttcgagaacccgacgcccttcaccaacctgttcgagatcttcctgatcctggtcatcccgttcgcgctgacccgtacgttcggactgatggtcggctcggtacgccagggccacgccatcctggccgccatggtcacggtctggctcggcttcacggcgctgatgatgtggaccgagttcgcccaccacgagggcgccctgcagctcgcgggcggcgccatggagggcaaggagactcggttcggcgtgggcgcctcctcgatcttcgcggtggccacgacgctcacctcgaccggcgcggtggactcgttccactcctccttcagcgggctcggcggcggcatcaccctgctcggcatgatgctcggcgagatcgcgcccggcggcaccggctccggcctctacggcatgctgatcatggctgtgatcgcagtgttcctcgccggcctcatggtcggccgcacacccgagtacctgggccgcaagatcggctcccgggagatcaaactcgcggcctgccacatcctcgtcaccccggccctcgtcctcgtcttcaccgccctggcgacggccctgccgaccccgccgcactccgcgctcaacccgggcgcgcacggcttctccgagatcctctacgcctacacgtccgccgcgaacaacaacggctcggccttcgccggcctgaacgcggacacggactggttcaacaccaccaccggcatcgccatgctgctcggccggttcctgccgatggtgttcgtcctggcgctggccggctcactggccgggcagcggcccgtcccggtcggcgccggcaccctgcgcaccgagaagcccctgttctccgggctgctcgtgggcgccgtcctgatcgtcaccggtctgacctacttcccggcgctggcgctgggtccgctcgccgaagggctggcgtgatgacgacccgtaccgagagccaagaggactccatgtccacagcgacccccacccgcgcgccgcaccgcgacgtacccaccggaaccccgcagaccccgggccgcgtcggcgcgggcctgttcgaccccgcgcagttgctcaggtcgctgccggacgccttgcgcaaactcgacccgcgggtccaggccaagtcgcccgtgatgttcgtggtgtggatcggatcggtgctgaccaccgtcttctcctgcaccgaccccggtgactggttcggctggacgatcagcgcctggctgtggctgaccgtcctgttcgcgggtctcgccgaggccgtcgccgaggggcgcggcaaggcccaggccgacacgctgcgccaggccaggaccggcaccgtggcccgccggctggccgccgggaagcaggagcgggtccccggcaccgagctgcgcgtcggtgacctcgtggtctgcgaggccggggacgtcatacccggggacggcgacgtcgtcgagggcgtcgccagcgtcgacgagtcggcgatcaccggagagtccgcgccggtcatccgggagtccggcggtgaccgctccgcggtgaccggcgggaccaaggtcctctcggaccgcgtcgtcgtcgagatcaccaccaggccgggcgagacgttcatcgaccggatgatcagcctggtggagggcgccgcacggcagaagacgcccaacgagatcgcgctgaacatcctgctggcgtccctgaccatcgtgttcctgctggcctgcgccacgctgccggccttcgccggtcacgccggcacgcacctgaccctggtcgtgctggtggcgctcctcgtctgcctcataccgacgacgatcggcgcgctcctgtccgccatcggcatcgcgggcatggaccggctggtgcagcgcaacgtgctcgccatgtccggacgggccgtggaagccgcgggcgacgtctccacactgctgctggacaagaccggcaccatcaccctgggcaaccggcaggccagtgagttcgtgcccgtgcgcggcaccaccgcggccgaactcgccgacgccgcccacctctcctcgctcgccgacgagacacccgagggccgctcggtcgtcgtcctggcgaagcaggcgtacgggctcagggagcggcaccagggcgaactggccggcgccgagtggatcacgttcaccgcccagacccggatgtccggcgtggacgtcgacggccggcggatccgcaagggtgcggccggctcggtcgtcgcctgggtcgaggagcgcggcggcacggtcgccgaggacgccggtgccctcgtggacggtatctccggagccgggggcaccccgctgctggtggccgtcgaggacggccgcggtgcccgcgtgctcggcgtcatccacctcaaggacgtcgtcaaggacggcatgcgcgaacggttcgacgagctgcgccgcatgggcatcaagaccgtcatgatcaccggcgacaacccgctcacggcccaggcgatcgccgaggaggcaggcgtcgacgacttcctcgccgaggccacccccgaggacaagatggccctcatcaagcgggaacaggcgggcggcaagctggtcgcgatgaccggcgacggcaccaacgacgcacccgccctcgcccaggcggacgtcggcgtggccatgaacacgggcacgtcggccgccaaggaggccggcaacatggtcgacctcgactccgaccccaccaaactgatcgagatcgtcgagatcggcaagcagctcctcatcacccggggcgcgctcaccacgttctccatcgccaacgacgtcgccaagtacttcgcgatcatcccggcgctgttcgccgcggtctacccgggcctggacaagctcaacatcatgcacctgtcctcgcccggctcggcgatcctgtccgccgtcgtcttcaacgcgctgatcatcgtcgcgctggtgccgctcgccctgaagggcgtgcgctaccggcccacgagcgcggaccggatgctgcgccgcaacctcgccgtctacggcctcggcggcctgatcgcgcccttcgccggcatcaagctgatcgacctgctcctgtccctcatccccggaatcggctgaccgccatggacaactccctcacgaacacggcccggttgctcacagcgggcctgcgcgccctgctcgtactgaccctggtgaccggcgtcctctacccgctcgccgtcaccggcatcgcccagggtctgttccccggcaaggccgacggctccgaggtcgaggcggacgggcgggtcgtcggctcggcgctcatcgggcagtcctacgacctgcccctgaagaaggggcagcagacaccgcaggccgacctgaagtggttccagggcaggcccgcgaacggcctggcgaccaacggcctcaacacccgccaccacctgctcgtctccggcgccaccaacctggccgccgacaacaaggcactgatcgagcaggtacgggacgcgcgggcggccgtcgtcaaggacaactcggtgcccggttacacggtcgacccgtccgacgtcccggccgacgcggtgacatcctccggctcgggtctcgaccccgacatctccccgcagtacgcgcggctccaggcccaccgggtcgccgtacgcaacgcgctgcccctcgcccgggtcgagcgactcgtcgcggaccacaccgagggccgcaccctgggcttcatgggcgagccccgggtgaacgtcctgcggctcaacaccgccctcgcggacctcgtggccggacggcactgagcgcggcccgccgggccggcgccctcacacgctgagggtccggtccgacgggtggcgcaggcgggcttccgccgcggcgcgggccgcctccagcacaccgaggaggacctgcttgccggaggcgcggtcgcgtacgtcgcacaggaccaccggcgtggccgggtccaggtcgagcgccgcccggacctgctcggccgtgcagtcgcgccgcccgtggaagcagttgatgcccacggcgaacgggattccgcgctcctcgaagaagtcgatcgaggcgaacgacgcctccagacgccgtgtgtcggcgaggacgaccgcacccagcgcacccgtggccaggtcgtcccacatgaaccagaaccggtcctggccgggcgtgccgaacaggtacagcaccagttcaggaccgatcgtgatacgcccgaagtccatcgccaccgtcgtggaggccttgccctccacacccgacaggtcgtcgacaccgaggctcgcctcggtcatgcgctcctccgtctccagcggagggacctcgctcaccgcggtcaccatggtggtcttgcccacgccgaagccgcccgcgatcaggatcttcaacgcggtcggcaggacggggccggccatgacggggtcagagctgacggataccatccatcaccctttcgatgagttccacgctcggccggctctcccgacccggcggcgactgcaccaggatcagtgaggcgtcgagcagatcgccgcacagcaccttcaccacgctcaccggcagatccagcagcgcggcgatctccgcgagcgccagcgcgcggtcccggcacaggtccaggatgtgcgccgcctccggctccagatggccggtgcccgacccccgttcggaccgcgcgacgaccagcgtgatcagcgtgaacgcgtgctgactgtgctgggtacggccaccggtgatggcgtacggccgtaagtagcgcccggcctccgactcgtcgtgccgacgcggttcaggcattctgaacggggccgccggccggggactgtacgcgcggtgcggccgtcaggtactggcccacctgcttgacgagcgtgcccatctcgtacgccatcatcccgacatccacttcctccgaggccagcgccgccagccgcgccccctggcccgcggccgtgacgaaaaggaacgccttgtccatctgaatgaccgtctgctgcacgcgaccgctgtggaaatggcgggcggcgccgcgcgcgagactgtgcactcccgaggccaccgccgacaggtgctcggcgtcgtcgcggagcatgtccttggacttgccgatcagaaggccgtccccggagagcacgacggcgcagcggatctccggaatgcggtccaccaggccgtccaggagccagtccagctgacgtccggtctgtacctgctcagtcattgcgtaacgtcctcacagttcatgggcaggcgggcctgcctcatcgctctgccgcccgtgcgcaccgtgcggcgtgtcgtcgtcctcggacatccaggcccgcttgagcccctggtggatggcgttcatcgcgcgggccgacgcgtccggcgagatgacgtcgtcatcacccccgcccgccggttcgtcctcggcgtgcgcggcctccctgcgcaactgctgtgccaggctggcccccctgacgcgttgcggcaggaccgtgggggtcgtcagcgggcggg

SEQ ID NO: 955 - DNA, 13403 bp, Unknown
  Kingdom: Bacteria, Phylum: Actinobacteria, Class: Actinobacteria, Order: Streptomycetales, Family: Streptomycetaceae, Genus: Streptomyces
ggccggcgcagcggcggcgatcggggcctgcggtcggcgacgccccgggctccaggcggctcaagggtgcgggcccatccggccggggatcggtgatcgggccctgtggcttttcggcttctgttccggcggctacagccggcggagggcagaactcagtgtttcgatctcctgcggggagagcttgtcggtgaagtggcggcgtaccgcggcgtccaggccggggtgcacggcggtgacggcctgccgtccggtgtcggtgagggtgacgatgacaccgccggcgcgttcgcgggtgacgagttggcgcttgctcatgcgggtgagctggtgggagatgcgggtgcggtcccaggcgagcgacgcggcgagctcgctctggcgcaaagacccccccgccttgctcaggttgacgaggatcgtcaagtccggctcggacaggcccgccgcctcggcggcgtccgcgatgacacggcttcggacgatctcatgggcgcgcttgaaggcggaccagaggtcgactggatccagtgcggccttgcccatgggctcgtccggctcgtgatctccgcgatctggtgttgacatatcaacgcacccgttcttagtgttgagatgtcaacggtagcaggtggctgccgcctcgccggtcccgtcggccgcgcccacctttccaccccgcggaaggatccatgcacacccgaacccttggaaccggtggcccgcaggtcgctcatctcgcgttgggctgcgccggtatgtccgatcagaccgctcccgctgacgaggctgacgccatcgccacgatccacgcggcccttgctgccggcgtcaccctcctcgacaccgccgacttctacggcatgggccacaacgaggacctcatccgccgcgcactccccggccgcgaccgcgatagggcgctcctgagcgtcaagttcggcgctctgcgcagtcctgacggaaccttcgtcggcatcgagggccgtcccgcccatgtgaagaacgcgctcgcctactcgctgcgccgcctcggcaccgaccacgtcgacatctaccgcccctcccgcctcgaccccggcaccccgatcgaggacacgatcggcgccatctccgaactggtccaggccggacacgtgcgccacatcgggctgtccgaggtggggccggagaccatccgccgcgcccacgccgtgcacccgatctgcgacgtacagatcgaatactccctgttcagccgtggccccgaggtcaacggcatcctggacacctgccgcgagctggggatcggcgtcaccgcttacggggtgctcgcacatggcctgctcaccggcacctaccgacaacccgccggaggagacccacgcgcccactggctgccccgctttcaccccggcaacctcgccacgaacctcgccctggtcgaccggctgcggccgctcgccgacgcacacggcatcagcgtcgcgcagctcgccaccgcctgggtcaccgcccagggtcgcgagcgcggcaccatcgtggccgtcctgggcgcccgccggcccggccgcgtcgctgaggccctggccgcggccgacgtcacactgaccgacgcggacctcggcaggatcgacgaggccgtcccggccgacgcggtggccggaacccggtacgccgcacccctcatggctctgctggacagcgagcgcggcccgaagccgcctgcgagcacgtgagatcgaccgccgacggtcgagcaggcttcgcgccttccaccggcacggtctttcgtcagcatgctcggtgaaccgagccagagattccgcgatcccggcgggagcaccgtgtcccgcacgcccgtccgcggcatcacccgccgaccccgtgcccaccgtgcgtgaatctcccacgccggcgcctgcccgacacgcggtcccgcctctcgtgacggggcgctgcgacgggcactccctatgtgcttcatggccacagcgagggacgtcggtgccacccctacaaagaacaggtgacgagtcatgaacacatctgagtcactccttgccgaactggccggttccgagaaggtgatcggagtagggatcatcggactcggggcgcacggtagctgggccgagcgctcccacctgcccgccctgcgcgctgtcccgggctatgagctgagggcgttgagtacgagttcgaaacagtcggcggagcgctccgggcagaagcacggtgtatccagcgccttcgggacggcggccgaactggtcgcctgcgacgacgttgacctcgtggtcgtggcggtgaaggtgcctcaccaccgggaactggtgcagacggcgctgagcgccggaaagagcgtgttgtgcgagtggccgctgggcaacgggcttgcggaggccgaggacatggcgcagtcggcaggcagtcgcgccgtgccgaccatcgtcggactccaggcgcggtcgcacccggcgctcgcctacgcacggcatctcgtggccgacggctacgtgggggaggtgctgtccacgacggttgtgggctccggtggtgcgtggggtgccaccgtcggccccggcgatcactacgtgctcgacgccgcgaacggcacgacgctgctgaccgttcccttcagccacgccctcgacggactcgcgtcggtcctgggagagcccgaggaactgcgggttcgactggcgtcgcggcgtacgtcggccgtggacaccgagagcggacagcccgtgcccatgaccgctgcggaccaggtggtggcctcgggacggctgccgagcggcgcggtggccaccttccactaccgcggaggcatggcccggggaaccaacttccgctgggagatcaacggctccgagggcgacctcgttctcaccgccccggtcggccacccccagctcagcccgctcaccctcgaaggcggccgcggaacgtccaccgcactcgctcccatgacggtgccgcaatcgtacgtccgtgttccggaactggacccccgagccgacgcgccggcctacgcggtcgctcacgcctaccggcagttcctggacgacctgcgcgagggcacatcaggcgtacctgatttcgcacacggcgtcgcccggcaccgcagcatcgaatccgtcatcacgacggcgtgaccggacgcgtgggcctggctcacctccgctcgcgcggagaggaccgggcgatgcgccacctcgcaggccccggatcacagcccggggtagcgccgaaggcgatggacgaggtgctctctcagaccgtcgaccagggcgaggatggccgagcgggcgtagtgggaggcgtcccagcccgcgtacagagggacggtgagggggccgtcgggcgcccggacgatcagttcgcgcaggtcgaagcgcgcgtcgtcggtgaccaggcacaccccccggccccgcgcggcgagggcctgcgcgaaggcggacgagccgctctcgatgacgcacgcgggagtcaggcccgcccggctgacggcctcgtcgacgaccagccgcgccacgtgggagcgcggcatcacgatcagcggctcagtggtcagttcggcgagggcgaccgtggtgtgctcgccccacggatgacgcgcggggacctgggcgacgacgggggtgcggcccaggaaggccgattccagcggggccggggcgggagtggtcgagacgcccaggtcggcgtcgctgcgcagcagggtgtcgaagaccctgctcggttcctcctggagggcgtcgtggagcgtcggtcccgcggtaccgccctccgccatgaacggggccaggaggtaggcgacggtgggggcggcggcgacgacggtgagggaggcctcctctccccggcccgtggcggccatcgtctcggcggcctgctcggcgcggcggaccaggtcctgggcgatgggcaggaagcggcggcccgcggcgttcagtgtcagggaaccggggccgcgcgtgaagaggcagacgcccagatccttctccagacccttcagctgacgcgacagggagggctgggcgacgtgcacctggcgggccgcggcggtgaccgacctggcctccgccacggcgaggaaatagcgcagcacgcggagttccaccacggcctccctcggttccggtgagccgcccatgccttcgaggcatgggaagacgagtaatcaagtattagaccgtatgactggccgaattcacactatggctgtccgctcaccgccccgggtccttcgtcaccggtcccggccgggtcctcccggccgtccaccacgctcgccgaagatccccgtgtccgccggaggcctcatgaacgttccccgctctgcctcttccgccgccgaaagcacgcgcgccccgcgccgggcccgccgcgcgggcctcgctgcgttcgtcggcaccaccatcgagtggtacgacttcttcatctacggcacggcgtccgcgctcgtcttcggcaagctgttcttccccgacgtgtcgcccgccgccggtgtgctcgcctccttcgccaccttctgggtcggtttcctggccagaccgctgggcggcatcgtcttcggccacttcggggaccgcatgggccgcaagggcaccctggtcaccacgctcgtgatgatgggcgccgccaccttcctggtgggcgtcctgcccacacacgcgcagatcggcatagcggcgcccctgctgctggcacttctgcgcgccgtgcagggcatcgccgtcggcggcgagtggggcggcgcggtcctgatggcctccgagaacgcccccaagggcagggggtctctttacgccatgctggtgcagcagggctctccggccggggcgatcctctccacactggtcttcctcgcagcgggcaccctggacgatgccgcgttcatgtcctggggctggcgcgtgccgttcctgctgtcggggctgctcgtcgtggtcggcctcgtcatccgtctcaaggtcgaggagtcggacgacttcgaacgggtcaaggagagcggcgaggtggtgaagctcccggtcgccgaggtgctgcgcaccgcgtggcggaccgtgctgctgggcatcggcgcctcgatcatgggcatctccgccgcctacttcaccaacacgttcgtgctgtcctggaccaccaacgagctgcacatgagccggcagacgatgctgtacgtcctgctcggcatctccgtggtgcagttcctgtggcagccgtacgccgccctgctctccgaacgggtcggggagacccggttcatggtgtgctcgctgctcgtcaacgtcgtcgtcgccgtccccatgttcctgatgatcaacacggcgcggcccgtcctcgtcttctgcggcatcgcgctcggcatcgtcagcggctccgggtactacgccgtcctggccgggttcctcgcccgggccttcccctcccgcgtccgctacaccggcatctccctgtcctaccagctgtgttcgaccctcatcggcggtacgaccccgctggtggcccagtcactgctgacgtccgggggcggctccatctggcccgtggtcgcgttctacgcggtcctgctgctggccaccacggcctgcgtcgccgcgctcgcccggtccaccggccgacgaacgccccgggcccgacccgttcccgcgaccgcctgacggccttcaccctcactgaccgggcggccgcgagcatcctcgccgcggtggccgcccgaccccacccaaggagttgaccacccgtgcgtctcgacgccgtcttccgcaacggacgtttcaccaccctcgacccggaccgccccaccgcccactctctcggtgtcctcaacggccggatcgcggccctcgacgaggagttggcgggctgcacggccgacctggtcgtggacctcggcggcgcccacgccgtccccgggttcaacgacgcgcaccaccacctcagcctcgtcggcaagggattgcgcgaactcgacctctcgtacgccgtcacgccgagcctcgacgcgctgtacgcggcagtgaccgaacgggccgcgacgctgcccgaggacgcctggatcctcggtgcgggctacgaccagaacaagatcggcgcccatccgaccgccgaggcgctcgacaaggcggcacagggccgcccggtgtggctcgtgcacacctcgcaccacatgggcgtggcgagcacggaggcgttcaggcgggccggcttcggcgacctctccgcggtgcccgacctgcccggcggccacgtcgtgcgcgacgcggtggggcgggcccaggggctgctccaggagacggcgatgcaactggtcgaacgggcactgcgtcccgagcccgtcgcggagtggaccgccaacatcgccgccggcgcacgggccgccctcgccgtcggactgaccagcgtgacggagccgggcatcggggtcaccgacggcatcggcaacggccccgccgacctggacgcctacatgagggtgcgggaacgcggtgaactcggcgtccgcatgaccgtcatgccgtacatcaccgcactgcacgactgcggcgccttcgagccgggcgccgactggtacggactggacctcggcctgcgcaccggcttcggcgacgaatggctgcgcgtcggaccgacgaagctgatgtcggacggttcgctgatcggccggtccgcggcgatgtgctgcgactaccaggacaccccgggcaacagcggcctgctccagcacgaacccgggcggatccgccgctacatcgtcgaggcgcaccgctgtggatggcagatcgccacgcacgccatcggggacgcggccctggacatcgtcctcgacgcctacgaggaggcacagcgcctgcacccccgcgccgacgtgcgccaccggatcgagcacgcggcggtcaccagcgccgagcaggtcgcccggatcgccgggctggggctgatcccggtgccgcagggccgcttcctctcggagatcggtgacggcctggtggcggctctcggtcctgtccggagtgaactcgcctaccgcatgcgctcgttcctcgacgcggggatcgtactgccgggctcgtccgacgcgcccgtcgtcgcgcccgatccgctgctgagcatccacgacatggtgaaccgccggaccgcctcgggcctgccgatcgccccgcacgaagcggtgacggcccgggaggccctgcgcgcgtacacggtcggctccgcccacgcggtccacgaggagcacgtcaagggcaccctgtcgcggggcaggctcgcggacttcgccgtcctcagcgacgacctgctggccgtggctcccgagcgcatcgcggaggtgaccgtcgcggccaccgtcgtcggcggccggatcgcccacgacacaggggccctgcgggtctcctgaaccgtcggcgcaggccacggcgggtcctcccgaattgatcgaaatcatctccattgcgccaaaacctaaatggtttaggtttgtcgatcaacacgcttgggggcagcgcctcttcggtgcacatggcggtccgcacagcctctgcaccagaacaacggaattcactgtcgacaacttgtatacaactcgtctacagtcggcataccggctgcggccgggagcctcgcttgatcgccgacgacgcagggaaggcaggtgtgcacatggcggagaacctgacggagcccgtcgtcccgcacctggggccggtgcccgcgggccggcaccacaccgccgtcgacgtcgcctacgcatggatgctgcgcaagatcgtcgcgctgccgtcgggcgaggacatgttcctgaccgagacccaggtggccgaggcggcacaggtgtcccgcaccccggtgtgcgaggccctgacccgcctggagggggacgggatggtgcgccgggtcccgcggcgcggagcgctcgtggcgccgatgagccgcggcgacgtcgacgccctgttcgaggcgcgtggcgtgatcgcggcctgggccaccgccaaggccgcctccgcacgggcgtcactgtccgcccggctgtccgacatcctggcccggcaggccgcggtcctggacgacccggtcgcgttcaacacctcgacgtggagttccacaccgcgatcgtctccgcgggcggcaaccacgtcttcaccggcctgtaccgctccctgcgccaccggcagatgcgcctgggcgtgcgggccgtactgcggcgccaggaacgcggccgggacgtcctggcagagcaccgcgcgatcgccgcggccctcgcccgcggcgacgagcagacggcggtccaggccgcccgcgaccgcctgacctgcaccgtgcgggcgctgcgccacgacggcctccgcgcccgtccgaccgcgcactgaacccccacgcaccgacccccggaaggagtcgtcagtgacgacgaccaccgacgctgtcactctcaccacgcccgacggcgtccccgtcccgctggagaacgccaccgtggtggtggccgggtacgccggccgcgaccaggccggagtcaaggcgcacatcgacgagctggcggccatcggcgtcgcgccaccgcccgaggtgccgatgttctaccccatgccgctcggcctgctgaccaccgcagcccaggccccggcgtccccggactcctccggcgaggtcgagccgctgatcgtgcgccagggcggtcgtttctacctgggcgtggcctccgaccacaccgaccgcgagatcgagaagaccgacatcctgacctcgaagcaggcctgccccaagccgatcggcgcgaccctcgtcccgttcgacccggacaccttcgactgggacggctgcaccctcaccagcaccgccgacggagccccgtaccaggacggcacgctcgccgaactgctccacccgtccgacctgttcgcccgcatgaccgagcgcggcctgatcacggccgacgaggacgtcgtggtcatcggcggcacggtaccgctgctgaccggccggttcctgttcgccacctcctgggtcatcgagctgaccacagcagagggcaccaccatccgccacgagtacaagacgaactgaggagacccctgatgcgtaccggagccgagtacctgtccagtctcaacgacggccgccaggtctacctggacggtcaggccgtcgacaacgtcgccgagcaccccgccttcgccggtgtggcccgcaccgtggccaccctgttcgacgtggcggcgagccccgagcgcggcatgcagaccacccgcgcggacggcgccaccgtcaacaaggtgttcaccgccccctacagccgcgaggacctcgccgagcgccgccgggccatcgagacctgggccgaggtctcccacggctggatcggccgcagccccgaccacgtgggcacctacatggccgcgttcggcgcacaccccgaggtgttcaccaccgagacgcgcgacttctcgcagaacgtgcgcgactacgtccagcgcgtccaggacgagaacctgtacctggcctacgcgatcatcccgccgcagtactcccgggccaccaccgcctccgggtggggcgaggagttcatccaggtcggcgtcgtcgaggagcgcgaggacggcatcgtcgtgcgcggctcgcagatgctggccacgggcgcggccatcgccgacgagatcttcgtgtcctgcatcaagccgctgggcccggacgacgtcgacttcgcggtcagtttcgccgtgccggccgccgccgagggcctcaagctctaccaccgccgcccctacgccccgcaggcgtccagcgagttcgactacccgctgaccacccgcttcgacgagcccgacgccctggtggtgttcgacgacgttctcatcccctgggagcgcgtgttcgcctgccgggacaccgacaccgtgcgccggcagttcttcgacacgggcgcccacgccctgggcaactggcaggcccagatccgcttcaccgccaagctgaagttcatcgcctccgtcgcccggcgcgtcacccaggtcaacggcaccgaccgcatccccggcgtgcgcgagaagctcggtgagatcgcctccctggtctccctgatcgagtccgccgtcctggccgccgagcacaccgccgaacccgacgagtccggcctgatcatcccgggcgcccgcgccctgtacggctccatgggcctgcagtccgagatgtacccgcgcgtgatcgcgatcctgcgcgacctggtcggcggcggcgtcctgcagctgcccgccaccgtgcgcgacctcgagagcgacctgacccgcggcgacctcacccactacgtcaagtccccgggcgtggagaccaccgagcgcgtcaagctcttcaagctcgcctgggacatcatcggcaccgagttcggcggccgccaccagcagtacgagatgttctacgccggcgccccgttcctggtgaagggcgtctacgccttcaacaacttcggctacgagtccctgctgcccgagctggacgccttcctcgcctccgtccccggcccggacgtcaccaccgcccccgcccccaccgacacccaggaggtctccgcatgaagcccgagatcgagttcaccggcatcgaggacgtcacctacgtcccggcccccggcaacgtccccggactgaccatggccgtcctggccgaggaccccgagcacgacgtcgtcacgcgcatcctcaagttcgaaccgggcaccgacacctccgccaacggcgtccaggtgcacgactcctgggaggaggtgttcatcttcgagggctccttcaccgacctggagctcggccggacgttcaccgccccctgctacgcggtgcgcccgcccggcatgcggcacggcccctggaagtccgagaccggcgcccgcatgttcgaggtgcgctacctgcgcaaggaggacgcgtgaccgcgctgacccaacgcctgcgggtacccgacaaactggcgatgcgccgcaccatggggcacttcgtcaccggcgtcgccgtggtcaccaccctggaggacggcaccccgcagggcatgaccgtcaactccctgacgtccatcagcctggagccgccgatcctcatggtctccctgggccacggatcccggaccggcaacgccatcgagtcctgcggcaccttcggcgtctcgatcctgtccgcccgccaggagcaggtggcccgggtcttctcccggcccggccaggaccacttcgccgacggccacttcgacgtgaccgacaacgggatccacctgatcaaggactccctggcccaggcggaatgcaccgtccaccaggcgatcacggtcggtgaccaccgggtcatcttcggagaggtcaccggcgcctgggaccgccagggagccgccctggccttcgacgccggacacttcggggagttcttcggcttcgggcacgacccgatgccctggaccttctgaccgcgccacgacgggggctgcccggaccctccggacagccccgtcctgcggacgtccacggagtgcatacgatgcgcacatgaaccaggcggacactgcggacacccgggccgggcaggccctctccacccgggacaaggttctcgcgtacctgcgcgagaacgtcctgacggaccccgacgtccaggacacctttctcagcgagcaggccatcgccgacaccgtcggcgtctcgcggaccccggtccgcgaggccctggtcatcctcgcctccgaggacctggtgcggctcatgcccaaacgaggcgtgttcgtccccgccatgacctcccgcgaactgaccgaactgttcgagatccgcggagtgctcgagaagcacgccgcacagaagatcacgtccctccccggggccgacctcaccgaactgcgccagcacctggcccaccagcaggaactcgccgacaccaccccgcacaccccgcaggacgcccgggaattcatcgccaccgaccgggaattccaccaggcactggtcgccctcgccggcaaccgcctggccacccgcacctacaccagcctgcgcgaccgccagacacgtgccggactcctcgccgtccaggaacgtgaatcccgctggcaggaggtctgtgccgagcacgccctgatcatgcaggccctcgaaaagggggacgccgaggccgcggcgacggccatcgaccggcacctgaacaccaccctggtcacccttctcgcccagtagagcgcccctgcggccgggagcgcacgggcatcggagcgaccagaccaccgtccatcgccgtccatcgtcacaggaggatccgtgcgtatcgccctggcccagatgctcagcaccaccgacccgcaggagaacctgcgcgccatcaccgacctgaccgcccgggccgccggccggggcgccgacgtcgtcgtcttccccgaggccgccatgtgcgccttctccggctcggtcgccgacgcggccgagccgctggacggaccctgggcccgtcaggtcgcgtccctcgcggccgcccacaaggtgacgatcgtgaccgggatgttcacgccggcccctgacggacgcacgcgcaacacccttctggtcaccgacggagtcaccaccgacgggtatgacaagatccacctgtacgacgcgttcggctaccgcgagtccgacactgtgcaggccggcaccgatctgctcctgcgcgacatcggcggagtgcggttcggattcgccacctgctacgacgtgcgcttccccgagcagttcgtcgcgctcgccgaggccggcgcgcaggtcgtggtcgtctccgcgtcctggggtgacgggccggggaagcccgaggcctggcggctcctgacgaccgctcgtgcgctggattccacctgcttcgtcgccgcctgcgggcaggccgaccccgccagcgtcggcagcccctcggggcccggccccctcggcgtgggacacagccgcctggtcgctcccgacggcaccctcgtcggcgccctcgaccgggaacccggactgctgatcgaggacctgaacctctccacgctcgaaccggccaggcagaccctcccggtcctggccaaccgcgtacggctcacgactcccgctctggcctgacgccggcgtcggcggcacaccgggtgcggggacggtgacgagaggtgaagtcgacggagccccaggtgccgccctccgcgtcgaaccggacgagcagtccgccggctccctcgaccaggaccaggtcgtggtcgggggccagctcggcggcccgctccgcgatctggtgcgggtgcacgggtgcacgggtgcctgtccggcgcggcgggcggcggtggcggatgccagcggatcgggacagcgggcgatctcggccgccgtcaccgcgcccacgaggcgggcgacctcctggacgtccccgggttcgtccggccggacg

SEQ ID NO: 956 - DNA, 2336 bp, Unknown
  Kingdom: Bacteria, Phylum: Actinobacteria, Class: Actinobacteria, Order: Streptomycetales, Family: Streptomycetaceae, Genus: Streptomyces
atggcgcgcccaggagcaccgacaggtcccggtggaaggcgcgcaggaagctcccggcggcgcgcaggttccgctccaggggccgcagatgggcccgtacgagcggtttgggcgccgcgccccgtccggtcagccgtggccacagcgagcgcaggttgtcccgcagcggtacgtcgatgccgcggcccggcgcgtggcggtagaggacgccgagcgggtgacgggtgccgcgtaccggatcggtgtacgtgtagtcgccggcccactcgggggtgcggccggtgccgctcatccgccgcagcagctcgggttcgcggacggtttcgtccagccgccggtaggtcttgtggatgtgcggggcgccgccgatcgacacgagggacagggcgttggaggaccagccctgctcgaacggcagccgccgtaccgcgccggccggggcgcccggcgcccgccggaactccagcacgccgccgcgcgcggtgcccaaccggtccccggcgagcacccggcggacggcggcgagcccggcggaggcgtttccgcccgggtctccgttcgcgtcctcgcccgcgtcctcgtccgcgtccggaaaggccggtcccccggctcgtaccggcaccggcacgaagaaccgctgcccggccgccggaccgcccaccgcggccaccacgagcagcatctcctccgggccaaggaccacgtggtcgatccgctcgtaacggtcggcggcgcgggcgtccccggacatccagggcgcctggcgcagcagccggccgagctgttcgtcacccggcacgttcacgctcgactcactcgactcactcaccgtgatcaactcccggtcatctcgtaggcgttgaccccgtgccgccagacggtcagggcgacggtcaccgctcctgccgtcaccaccggcagccacaccacgagccccgtcgcgccggtcagcaggtagacgcacggcacgtaggaggtgaaggcgaagggcagcacccaggtcagcagcgcgcgcagcgaggagtggtagatgtccagcgggtaggccgcgaactcggacacctggctcgccgcgtacatcgacggcaggctggtcacggtccagaaggacagcgaggcgaagagcagcttcacggcggtgtggatgagcgccccgcacagcacgagcagcggggccatcgcccactgcaccggtgtgaggcgcaggtccagttcgctgccggtccagcccaccagcgcggcgccgacgatcagttcgcccaggccgtccgggtggaagaagcgctccgacaggagcgagaacagcgggttcaccgggcggatcaggtagcggtagaactcgccgcgctgcacgagcttgcggcccagttcccacagctggtcggtgaagaggtggtccaggccgcgtggcaggagcgagaagccgagcaggaacagcacctcgtggtaggtccagccgcccaccgccggaacctggcggaagaccaggcccaccaccgccgtctggagcccgacccgcaccaggaaggcgcccgccccgagggcgaagtccatccggtacgcggtcagccggtgcagtccgacaccgccgaggaagaacgcgaggcgcacatggcgccacaccgtccgggtcatccgccgagcacctccagccggctcagcgaggcccgccacaaagcggtggtgagcagggtcagcgcggccacccagcccagttgccgggcgaggacgtccgccgcgcccgcccagccgtcgtagcggccgagcagcagggtcagcgggccgtcgaccatgccccggaagggcagcgcggaggcgagcgcggcgagcggccccggcatgagcgcgatcggcaccagctgcccggcgaagaaggccaccacgctctgcttcaccatccgcaccccccaggtgttggtggtgaggaaaccggtcatcccggtcagcaggttcacgaagaaggcgaggaggaccgacagcgcggcggacaccaggaacaggaggacgtccgtcggccggggcacgctcagcggcaccagcagggcgaacaggacgagcacgggcaccccgaccagcacggcgttggccgcgaccaccggcaggcaggcgaagaaccgcaccaccgggtagctgaccggccgcaccagcatgaccgcgacgtcaccgcggtacacctcggcggcgacctcgtcgtccacccggttggcgtgcagcacctggagcacctgcgccatgagcaggtacgtggtgatgccctcggcggtgaagccgcccggaccgccgccgggcggcgcgcccgcgtacaccgcccgccacaggaagacggtgacggcggc

SEQ ID NO: 957 - DNA, 4932 bp, Unknown
  Kingdom: Bacteria, Phylum: Actinobacteria, Class: Actinobacteria, Order: Streptomycetales, Family: Streptomycetaceae, Genus: Streptomyces
cacgtcgacggccgaggcgcccggcccggacgggggctgccaggggctggtcgagcgcgcgcgggcgttcatgtaccggctggagcgcatgtgccattcgtggccgccggactgccagtcctgcagacccttggtgtacgccgccaccgccgcgacctgggcgggcgtgaggccgttctccaggaccacggcgggcacttcggtgagcgcggtgtgctcgaactggtgcaggcgcgaggtgaggacgtcgttgacggtgtcggcggcctcctgggtggtgcagccgaagaaggtctccaggaccagcacgccgttgctcagctcaccctcgtcctccacctcccgctggtaggagaacaggtcgttgcgcaggtggacggcgtcggagaacgtctccatcagcaccctgagcggcctggactccgcgacgcaggcgggtacttccgcggtggcgtattccacgagcccggccgaccagggggcgccgccgaccttgcggcgcatctcgatgtactcgacggggttggcgatccgcccctcgttgatgttggacagctcccacagggactcgttcagcaggtgctcggtggccaccgcgaaccggcgtcgccactcggccgacatcgacggcaccgtgcgcgcccacaggtcggcgaggcccgcctccaccgggttctgcggctcggggacgtcggcggcgtcgtcgaggggcatgaacaggggcagccggtccaggtaggccttgccgccggcccggtcctggctgcgtttgaacgtctccaggaagtggtcgtcgaagaagaagacccacacgtaccagtcggtgatcagcgacagggcggggccgtcgcagtcggggtgggtgtaggcgcacagcagtccgtagtcgtgcgcgtcgaggtcggactgctcccagatcccggagccctccagcatgcccatgtcgcgcgcccattgcgtcgaatgggcgcgcgcctcgtcgaggtgcggattcagccgcgcggggtacggcatgtagaagtgcgggagttcgaagggctgctgcgtcatggccgggccctaccccgggtgatcctcacccatcctccggcacgcatccgatcacaccatcgcgtgaatcaccgcggaacgcctccgtacgcggctggacttcgcttccccgcgcggccggtctccgtcgtcgggaacggccgggctccgtcagcggcccgagcggacggcccggcccgccttcgcccggagtgcgacgaacgcatccgggccccgggtcgcgatctggtcgcgctcgtcgggcaggtccaccgacaggtcgagccggggctccggcggcgcagcggcggggtcggcgtcgtcccggaccggcaggtgaggcggaggtcgtgcaggacctggtgatcgccgtagcgccggccgtgggagtcgaggcggagcgtgcggggccgccccccgcccggggggggactgtagagcgcccggcccgtgggcggcgacgcgcaggcgtcaggctccccgcgcctggatcagcgcatgcgtgccgctgacgcgccagccccggccctcggtggcgttcagcgcggcctcggtgggtgcgtcgaggccggtcaccacctcggacttgagggtgcgcagcgccgcgaccgggccggggaagaaggcggtcacggtcgcgaacggtgtcgtcggcggccaccgccggtcgcccaccagacgccggtagttcaggtcccccttgaacacggtcagcgcggcgtcggtgaactcggcgcgcagatcggccggcatcgcggcatagggcagcggcgcgcaggagaaggggtgggcgcggaccgtcagccggccgtcgcccatcgccgaccacagccgccggccgtaccgggcggcggcacccggggctgccgtcagccggcgcacggcgtcgacgacgtcggcggtggtggcgtcggagacgtagtacgggtacggcttgacgtgcaggacgacccgctcgacgtggccgtggtccaggaggtgggccacgaggagcaggtcggggacgagttcgcggcccgcgttgtcggcgaccaggcagagggtgccggtaccggagggcggcagcagcgaccagaacgtgtccgagtcgtcggcaaccagcgcgggagcggaggcggacgcggaggccggggtggcggacgaggcgggggcggaggacagccggaaaccgaggtcggctcggttgccccagagcgagccgtgcagcagggcgagcgcgcgttctccggccggcttcgcctccagggcgtccagcgcggccagttcctcgtccgtctccggcgagtcgagctcggccagcttggacgggcggaacgggtcgatgccgtgccaggggccgggcgcgaagtagccgacggcgtcgaggagtcggcggtagaagtaactctcggaccacagccacggcacctcgaaccaggaccggcccacatactgcgcgaggccccagtccagccagcggtcccggtcgtacgcctcggccggcaggggctcgacgacgccctcggcgcagttctccagcagcgcgtcgagggcgcggcgctgcccgggagcgtacgggaaggcatcccgcacctgccggacgatggccgggtgccgctcggccagcacactgtgcgggaaggagccgggctcatcggccaggagcacgggcgcgggcggggtcacgggcatgcgcctcaccgtaccgggcgggcttgcggatcccgggacgcccacgagcccgcgccgcgcggccccgcacggactcacgtgactccgcgcggccccgcacagtcccggacggcactcgatggccaccgggtcaccctgccccgatctcccgctccagttgtgcggcgaggccgaggtagcgcggtcgccgggggatgggcaccaggccgcggatcagcaggtgccacatctcggtcgtcctgcgcggcagccccgccatcggctccgagggccggcctgtgacccgggtgccgacgaagaaggagaccagggagcgcgcggcggcatggatgtcgatgtcggagtgcacgtcggcttccttgaccgccgcgtggagccggttcgtggcgatctccagccactccgtgaaggggtgccgcagcggtggccgcacctcgacgccgccggtggcgagccggaaacccgcgcggacgaccggaccctcgacggacagccgggtgaacgcgaaggtgatgcgcatcagcgcttccagggacgaacagccccgctcctccacttcgtccgtcacctggcgcacggcccgggactgcaactccatgatggcgtgggcgagatcctccttggccgcgaagtggaagtacagagcgcccttggtgacctgcgcgtgctcgacgatgtcgctgaggctggtgcgctcgtagccgtgccggtcgaagaggtcggcagcagccgtgatgatcgtcgagcgtgtctgctcggcccgtaactgcctcggcatggccagaacactccaagtaacggacggggcatgctgtttgctcttgttcgccttcacgataacccacacatcccggcactcaccagggcgacagcgggaccgatttatgcctgttcattgactgaaaggccatcaaaggtgggcggagttttcacagttccaaaccgatcagacggtttccttcacccttcattcgaccggtgcggaacttatccggcgccccgctagtttctacggtgctgtagatctgaacgatccgacacttggagaacaccatggccctgtgggaccgcatcaaggattccgcgacgcagatgcagacccagctggtggcgaagaagaacgacctgaagagcggcgccttccgcgacgcgagcatggcgatgtgcgcgctcgtggccgccgccgacggcaccgtggacccctcggagcgccagcgcgtcgcccagctgatcgccaccaacgaggtcctgcagaacttccccgcggacgacctgcgccgccgcttcgaggacaacctgaacaagctgaccgccgacttcgacttcggcaaggtgagtgtgctccaggagatcgccaaggcgaagaagaagccggcggaggcgcgtgccgtcgtccagatcggcatcgtgatcggcggcgcggacggcgacttcgacaagaccgagcaggcggtggtccgcgaggcctgctacgccctggacctgccgccgcacgagttcgacctctgaggagcgcgcccggcgccgccgcgctgcccgccgtctcccgccatcgcgatcacaactcggccagcaccggcaggagttcgctcgcggcggcgacgtcggcggtcagcgaactcctgccggtgccggccggcagtgcggcggcggccacggcgaaggccgcgatgcgcggtggctccggacgctggcgcaacgcccgtacggcgacgaccagttcgcaggccaggacggtcgcgtagccgtccacggcgcgcagcgtctggcgggccgcctgcgaggcgaagctggcggcctcctccaggccgtgggagagcaccgcgtgaccggccgaggcgggcgtggcgcaggtgcgcagctcggcgagggcggagtgggcggtgtactccaggatcatcgtgcccgagctgccgggcggaccggcggcgaggaacgcgggcaggccggtgaggtccgggcggcccagcgcggtgagccgggcggcggacagctgggcggtctgcagcacggcgaggccgagggcgtccagggcgaggcccagcggagccgcgtagaagccgccgtggtggtaggccgccgtgccgtcgggtgcgatgagcgggttctccgaggggcagttgacctccacctcgatgatgtgccgcagcgcgtccgccgcgtccagggcagggccgtggacctgcgggaaggcgcggaaaccgaacgggtcctggatccggcggccgccgg

SEQ ID NO: 958 - DNA, 6895 bp, Unknown
  Kingdom: Bacteria, Phylum: Actinobacteria, Class: Actinobacteria, Order: Streptomycetales, Family: Streptomycetaceae, Genus: Streptomyces
gcgcgtgggcggtccgcgtgcacgaggtacgcgccacggcggacgcggtacgcgtggcacgcgccgtggaggaggcgcgcgccaccgcagcggcaccggcgggtccggaccgttttgcagaaggagcccggtgagcgccccccacaccgatgtcgaacaggtcgaggcggccaacaccgccttctacgaggcactggagcagggcgacttcgaggagctgacctccctctggctcaccccgtccgacctgggcgtcgacgaggagtaccacgatccggccgacaccggcgtgatctcctgcgtgcacccgggctggccggtcctcaccggacgcggcgaggtcctgcgcagttacgcgctgatcatggcgaacacggactacatccagttcttcctgaccgacgtgcacgtctcggtcaccggcgacaccgccctggtgacctgcaccgagaacatcctcagcggcggccccgcgcccgacgacggcgacgagctgggcccgctggtcggacagctcgtcgtcgccacgaacgtgttccggcgcactccgctcggctggaagctctggtcccaccacgcctcccccgttctggccgaaaacgacggtgacgaggaggacgggtcgccgtcgtgagcgggtaggtgacgggcacggacgcggaagtggccggaatcacgggcccggcgtcgcgggcggccgccggcccgtgagcggcagggttctccagggcgaacaccgggtgaaacctcccgggcccggctcgccccggcgcccccgagtcccggcgatgtcggtgcccgcaggtagattcgtccaaggccggtgtaccgcccgcacgcggtacgaaccgaccgcaccgacgactgcaggagtgattcgcgtggatcgtgtcgcgctgcgcggcctgaaggcccgcgggcaccacggtgtgttccccaaggagcgcgaggacggccagaccttcctcgtcgacctcgtcctgggcgtggacacccggcaggccgcggccgacgacgacctggcgaagacggtgcactacggcatcgtggccgaggaagtcgtggccgtggtggagggcgagccggtgaacctcatcgagacgctcgccgagcgcatcgcccaggcctgcctgaagcacgaaggggtcctggaggtcgaggtctgcgtgcacaagccggacgccccgatcaccgtccccttcgacgacgtgaccgtcaccatcacccggagccgagtatgacccgacctttcctccagggtcacagcgacccgaccgtccagccggtgcccgcgtccgtcgtcgaacaggtcgacgccgccgacaccacgctcagcaacccgaaacgggccgtgatctccctcggctccaacctcggcaaccgcctggagaccctccagggcgccgtcgacgccctggaggacaccccgggcgtccgcatcaaggcggtctccccggtctacgagacggagccgtggggcgtcgagcccggctcccagccgtcgtacttcaacgccgtggtggtcctcaagacgacgctgccgccgtcctccctgctggagcgggcgcacgccatcgaggaggccttccaccgggtccgcgacgagcgctggggcccgcgcaccatcgacgtcgacatcgtcgcctacgcggacgtggtctccgaggaccccgtcctcaccctcccccacccgcgcgcccacgaacgcgccttcgtcctcgcgccgtggcacgacgtggaccccgaggccctgcttcccggccggggcgcggtggcgggtctgctggcggccgtgacgcgcacgggtgtcgcaccgcgcgaggacctggaactcaggctgcccgagtagtcgttaaggtcgaggaagatccggaagcccggtccagggacggcacggcccgtccgcggccgggccggacgagtcgccgggacgcccgaccacggtccgggggagctgagtccgggggagctgaagggacaccgtgaaagagctgcgcatcggggtgctggcgggcgtgttcgtcgtcgccggagtgctgtcctggggggccgcccgcctgtggaacgcggtggggaccctgcccagcgtcccgctggccgcccccatcgtcctcgccctgatcgccgtggtcctgctgtccacggcgctctcgctgcgcgcccgcctcaaggcccagcgcgagcgccgccccggcgccaagggcgtcgacccgctgatggccgcccgggcggtcgttttcggccaggcgagcgccctggtcgccgctctggtcgccggcctgtacggcggtgcgggggtcttcctgctggagctgctcgacctgcccacccgccgcgaccaggccatctacgccggtgcctcggtcctggccggtctcgcggtgatagcggccgccctcttcctcgaacgggtctgcaaactccccgaggacgacgacgaggaccacggcaacgccgagccggcggcctgaaccaccggcccgtcggccgtacgccaggatctggcaggtccgctgcgctgcgctcagcgcgccatgatgaggctcatcgcctcgttgcgcgtcgccgcgtcccgcagctgaccgcgcaccgccgaggtgagggtcttcgcgccgggcttgcggatgccccgcatcgacatgcacatgtgctcgcactcgacgacgacgatgacgccccggggctccaggatctccatcagtgagtcggcgatctgcgtggtgagtcgttcctgcacctgcgggcggcgggcgtagacgtcgacgagacgggccagcttggacaggcccgtgatcttcccgctgccggccgggatgtagccgacgtgcgcgaccccccggaacggcacgaggtggtgctcacaggtcgagaacacctcgatgtccttcaccagcaccatctcgtcgtggcccaggtcgaacgtcgtcgtcaggacgtcctccggctgctgccacagccccgcgaatatctccttgtacgcccgcgccacccgcgccggcgtctcccgcaggccctcgcggtccgggtcctcgccgaccgcgatgaggagttcgcgtacggcgttctcggcgcgcttctcgtcgaactcgccgatggagccctcggcgtccagcgtcacggggtcggtcatgtgaagcctcgttcctgttctgtctcagctgcggacatgcgaaatgccgcgccccccaggctagaacctggggggcgcggcatacattccggggccggtgggctccggtcagctctccgggcggtcctccggggtctgctccgtcgccggggcgggctccgcggccgtggacttcacggtgctgatcgccgccgtcgcgccgttcgccccgttggtgagggccagctccttcggggagagcaccggcgggcgggtggacggggtgcggcgggaggagccggtccacgcgggccgcggcgggcgcttgacgatcggggcgaagatctcggcgatctcctccttgccgagcgtctccttctccagcagggccaggacgaggttgtcgaggacgtcgcggttctcgaccaggatctcccaggcctcgttgtgcgcgttctcgatgagcttcttgacttcctcgtccaccagcgcggcgacctcttccgagtagtcgcgctggtgagccatctcgcggccgaggaacggctcggtgttgtcgccaccgaacttgatggcgcccagacgctcggtcatgccgtactgcgtgaccatcgcgcgggccgtggaagtggccttctcgatgtcgttggcagcgccggtggtcgggtcgtggaagaccagctcctcggccgcgcggccgccgagcatgtaggccagctggtccagcatctcgttgcgcgtggtcgagtacttgtcctcgtccggcaggaccatcgtgtagccgagggcacggccgcgggacaggatggtgatcttgtggaccgggtcggagttcggcgaggccgccgcgaccagggcgtgaccgccctcgtggtacgcggtgatcttcttctccttgtccgacatgatccgggtccgcttctgcgggcccgcgaccacacggtcgatcgcctcgtccagcatcttgttgtcgatcagcttctggtcgctgcgggccgtgagcagcgcggcctcgttcagcacgttggagagatcggcaccggtgaagccgggggtgcggcgggcgaccgcggccaggtcgacgtccttcgcgaccggcttgcccttctggtggaccttgaggatctccagacggccctgcatgtccgggcggtcgacggcgatctgccggtcgaagcggccggggcgcaggagggccgggtcgaggatgtcgggccggttggtggccgcgatgaggatcacgccgcccttgacgtcgaagccgtccatctcgacgagcagctggttcagcgtctgctcgcgctcgtcgtgaccgccgccgaggccggcgccgcggtggcggccgaccgcgtcgatctcgtcgacgaagacgatcgccggggcgttcgccttggcctgctcgaacaggtcacggacacgggaggcaccgacaccgacgaacatctcgacgaagtcggaaccggagatcgagtagaacggcacgccggcctcgcccgcgacggcacgcgcgagcagggtcttgccggtaccgggcgggccgtagagcaggacgcccttggggatcttcgccccgacggcctggaacttggccggctcctgcaggaactccttgatctcgtggagttcctcgacggcctcgtcggcgcccgcgacgtccgagaacgtcgtcttcggggtgtccttggtgatgagcttggccttggacttcccgaagttcatgacccgggagccgccgccctgcatctggttcatcaggaacaggaagacgaccacgatgaggacgaagggcagcagggagagcaggacgccgaggaaggggttctgcttggacggcgagaccgtgtagccgtccgggatctgcttgtgctggtacttgtcctgcagcgtgttggcgagggctgcgccctggtcgccgatgtagctcgcctggatcttcgagctgccggagaccttctggccgtccttgagctcgaccttgatggtctgctcgtcgccggtggtcagcttggcctgctggacccggttgtcattgatcgctgctacgacctggcctgtgtccaccgtcttgtagccgccggacgagccgacgacctgcatcaacacgaccacggcaaggacggccagcacgatccacatgaccggcccacggaagtatcgcttcacgtccatccatacggagcggtgccgccccgtccctcctgccatagtgagtttgataagacagttcttctgacggtaccccagcattgtggcaagaagccgcacgggagagctggcgatcccgtctgcatgctccaacggctccggtgccgccggggttcccgatcaccgcagggactgcgcccttccgggtcagccgcgttggtcagccgccgtagacgtggggggcgagcgtaccgacgaacgggaggttgcggtacttctcggcgtagtccaggccgtagccgacgacgaactcgttggggatgtcgaagccgacccactccacgtcgatggcgaccttcgcggcgtcgggcttgcgcagcagcgtgcacaccttcagggaggcgggctcgcgcgagccgaggttcgacagcagccacgacagggtcaggccggagtcgatgatgtcctcgacgatcaggacgtgcctgcccttgatgtcggtgtccaggtccttgaggatccggacgacaccggaggactgggtgcccgcgccgtaggaggacacggccatccagtccatggtgaggggggtggacagcgcccgggccaggtcggccatgaccatgaccgcgcccttgagcacaccgacgatcagcaggtccttgcccgcgtactccgcgtcgatcttcgcggccagctcggccagcttggcgtcgatctcttccttggtgatgagcacctgctggaggtcggcacccatgtctttcgcgtccacccgcatcactttcggtcggtcgtcccgcattgacggctcgcggctgttccggacctccctgcggaggatccggccgccgggaacctccccggcggggagaccggcgcctccctgagggggaaggtttcagccttgccgaatcaccagtctgccaccctggcgacgggcgacgactttgcccgggaggttgatggccccctgaccccgccagccggtgatcagccggtcgacctcctcgatgtggcgggcgaacagggaaccggccggggccccggcgtcgatggcggcgcggcgcagcacgcggcggcgtacggccgggggcaggtcgtggagtttggcgcactccaggcagccggcgtcgtcgcgggcggtggcctcggcctgtccggcccagacgtcgagcgcgtcggcgtcgtcgcgggagagctgggcggtgcgggcgagggcttcgacgacgcccttgccgagggccttctccagggcgggcaggccctcgtggcgcagccgggagcgggtgtaggcggggtcggcgttgtgcgggtcgtcccagacggacagcgactgggccatgcaggccttgcgggcggtctgccggtcgatgtgcaggaacgggcgccggtaacggccgccggcccccgagaccgcggccatgcccgacagggagcggatcccggagccgcgggcgagaccgagcaggaccgtctcggcctggtcgtcgcgggtgtggccgagcaggatggcgtgggcgccgtggcggtcggcggcggcgtccagggcggcgtagcgcgcgtcacgggcggcggcctcggggccgccgtcgcggcccacggtgacggcgacggcgtcgaccgggtcgagccccaggt

SEQ ID NO: 959 - DNA, 512 bp, Unknown
  Kingdom: Bacteria, Phylum: Actinobacteria, Class: Actinobacteria, Order: Streptomycetales, Family: Streptomycetaceae, Genus: Streptomyces
ccgtggtcgacccggccaccgccgcgtcgacgtcctcggggccggccagctcgtagctgaggacctcctcgccggtggccgggtcgaccacggcatgggtgcggcccgaggtgcccttcgtgaggtgtccggcgatgaactgcgcgccctcggcgaaacgctcctgtgcggggaatcgttccggggtggcggtgcccggcttgtgcatgtcgctctcctccgccgtcgccgctgttcaggggcgggtggcgtagctccagctcgatttgagtgccgatcctgacagagcacaggggcaccaacaagtgattccgttgttgccttttggttacgcgacggaatctgtcgaccaggtgtcgagtcggcgtggaaaaggcaggacggagtgtcagtggtgcctgccacactcgcgtgcatggggaagatcgattcacgggaagcgctgatcagagaggtccgggcgggggcgaggatcaagtacctgcacttctgggggcaccggccgcggccgg

SEQ ID NO: 960 - DNA, 697 bp, Unknown
  Kingdom: Bacteria, Phylum: Actinobacteria, Class: Actinobacteria, Order: Streptomycetales, Family: Streptomycetaceae, Genus: Streptomyces
gcccagaccggccagtgcctggccgcccaggatccgcagctgcgcccggccgacggcggcgtgcggcgagacgagcgcggtcgcgcgcagcgtgtgcgcgagggccgcctcgtacgcgccggtccccaggcagtgctgggccaggtgctggagggtcagcacctgggtggaggggtggccggcgcggtcggcgagttccaccgcacgggccatcagttccccggagcgcgtgacgttcccggtggcgtccaggacggcggcgaggttgacgcaggcgatggcctcgctgatcgtgtcgcccgcgcgtgcggccagcccgggtgcctgttccaggtggacgagggcctcggcgtcccggccctcctcgtgcaggatccagccgagcagtgcccggctccgcgactgcgcgtcgaggtcgccggcgtgctcggccgcgtcgagtccggcttccagcaggggagtccagccgtccgtggcccgccacagcatcagcggccactggacgagggcgagccgccaggcacggtcgtgcaggccgagggcagcggcggctgcgacggcgccctccagcgcggggcgctcggccgcgtaccaggcgagcgcggcggcccggtcgtcgaactcgcggatggcggcggggcgccgggcgtcggcgggcagcgcgtagcagggctgggagccgggttcggcggcggcg

SEQ ID NO: 961 - DNA, 2221 bp, Unknown
  Kingdom: Bacteria, Phylum: Actinobacteria, Class: Actinobacteria, Order: Streptomycetales, Family: Streptomycetaceae, Genus: Streptomyces
gtgtggggccctgacccggtgcgccaccacggccggatcaccgagatcgactccgccgtgatcggccccaagcccgcccggccgatcccgatcctgctggccgcgggtacgcgcaaggcgcgcgagcggctcgtggagcacgccgacggctggctgccgaccggcatgggcgtcgagcaggtcgccgcccagtggcacgccctgcaggacctggccgccgagcgcggccggcagcagcctatccggacggtgctgcgggccaacgcccgctactcggccaaggcccacgaaggcgccgaccgcagccccttccacggcagcgccgaccagatcgtcgaggacctcctcgcgcacgccgagatcggcatggaggagatcctcgtcgacctgcagagcaccctgcgggacgccggggaactcaaggacgtcgccgcggaggtctacgagaaggcccgggccgccgggctgtgagagcccgagccggggatcagtcctcgggcagctcgacgggcgcgatctcgtcgtagacgtcgcccggaccggggttcgtcgcgtcggtcgccccgccgaagtggtgcatgacgccccagaccgcgttcagcgcggtctggacggcgccctcggcccagccggccgtccaggagatgtcgtcgccggccaggaagatgccccgcttgtcctcgggcagtccctcctgcatgaagtgcgtgaacaggcggcgctggtagcggtagtggccgggcaggttggccttgaacgcacccatgaagtagggctcgttctcccaggagacggtcaccgggttgccgatgatgtgcttcctgacgtcgacgttcggatagatctccgacagcgacttcagcatgacctccatccgctcgttcgcggacagcggcagccacttcaggctgtcatcgcaccaggtgtacgacaggcagatcacggcgggcttgtcggggccgtcgtcgagcaggtaggtgccgcgggtcatgcggtcggtgagcgtcatcgacatgacgtcacgccccgtgacctcgtccttgtccagccagaagggccggtcgaccgggacgaagagcttgctggactccatgtagtgggtgcgttcgatcgccgtccagtggtcgatcgggaacagctcgtcgtcgcactggatcttggacagcagcatccaggactgcgccgtgaagatcgccgcccggtaggtgcggatgtcgccggacgcgtccgtcacggtgatccggttgcccgcggtgcggtgcagccgggtcacggccgggcggggctcgccgccggggtgcagggtcttcagcgaggtgccgtacggccagtggacgatcttctccggctcgcgctcccacagcctgagcggcagctgctgcgagccgccgacgatgccgcggtggtggtcgtcggcctcggtgtagacgacccgcaggatctccaggatggagttcgggaagtcggtgtcccagccgccggtgccgaagccgacctggccgaagatctcccggtgccggaaggacttgaacgcctcggagtcgcacaggaagccgtagaacgtctggttgtcgagcttctctacgaggcgcgaccagatcgcgcggatgcgcggcacgtcgcgctcgcgcagggcgcggttcatgtcggagaagtccgcgccctcctccaggcacttgttccaggcctcggcgacgtcacggtagacctgcggcaggtcgtcgatcgtctcggcgtagtgcgactcgcccttgaggtcgacgacggtcgacggggtggcctccgcgaggggattcgggaagggccgggtctccagtcccaccaggtcgatgtagtgctgcagcgccgtggacgacggcgggaagcgcatcgcgcccatctccgcggtcagagcggggtcgcagccctcgaaaccgacggtgcgcagccggccgccgatccggtccgcctcgtagacgacgggcttgaggcccatcttcatcagctcgtaggcggccacgatgcccgacaggccgccgccgatgacggcgacctcgccgccgtgctcggtcgccggtatctggccgagcccggccgggtgggcgaggaagtcgtcgtacgcgtacgggaagtccgggccgaacatggtgatcggcggctgctgctcgtctgcgtgctcgacggcgttgggcacggtggacgtcatggggtacggactccttgcgcgtgaaaaaggtggggg

SEQ ID NO: 962 - DNA, 4456 bp, Unknown
  Kingdom: Bacteria, Phylum: Actinobacteria, Class: Actinobacteria, Order: Streptomycetales, Family: Streptomycetaceae, Genus: Streptomyces
gtgggaggcgtcggcgacgaagcggtgctggcgttcgaccgactgttccagcgcggcgagggtggcgttggtggtgcgggcgagacgggcgatctcgtcgcgtgaggcgggctcgggaacccggcgggccaggtcgccgctgccggtgatctcggccatctccgcgcggatgccctccaccgggcgcagcgcccggtgggtgacgagccaggtgacggccgcgacgacggccaggaggaacggcaggccgatcagcatggcctggacgacctggccgagggtggtctgtgagtcttccagcgaggtgcccgcgtagacggtgtaggtgcggccgtcgtaggtggttgcctgggccgcggcgaaggcgtagtcgtgggggtcgtcgcccagtttcagagtgatggtcttgtggctcacgtccgtgccgaccttgccccgggccgggttggcgtcgtcgttctcatccttgttgtcgttgttgtggttgtcgccgttgtcgtcttgcgtgtcgttgtgatggtggtcgtcgtcgctgccgccggaggaatggctcggggtggcgctcggggcagccggggcgggcgcataggtggtgaggaggccgtgtccgtgcaggtcttctccggcggccaggaccttgccggaggagccgacgacctggacggggtgactgtcgtcctcgggcaggttcagcgagtcgaagttcccgtgcagcgcggcctgggagccggccaccgtacgggcggtgacctccgactccaggccggcccggtcgacgaggttgtggcgcagcacggcgacgaccgcgataccggcggcgaccagggcgacggagacgacgagtgtggcggcgagcgccgcgcgggcccgtaccgaggcgaagggtctaaacatgacggtcgccgtcggcttccagccggtagccggctccgcggaccgtggtgatggagcgctgcccgaacggggcgtcgatcttacggcgcagggcgctgatgtagacctcgacgatgttggggtcgccgtcgtaggcgaagtcccagacgtgatcgaggatgtccgtcttggacaccacctgcccggcgttcagagcgaggtgttccaggacggcgaactccttcgcggtcagcgtgatgtccgtcccggcccgctccacccgcttggcacccgggttgacggtcaggtcaccgatgcgcacaagcgtgctgccggcgcgggtacgccggcgcagcagggcccggatgcgggcctggagcacgacgtaggagaacggtttggtcaggtagtcgtcggcgccggtgtccaggccctcggcctcgtcgtactcgccgtccttggcggtgagcatcaggatcggtgtgtcgtccccggccgcccgcagctgggcgcagacccggtagccgttcagcccgggcagcatgatgtccagcacgaccaggtcgtagtcctgttcctgcgccatgtgcagaccggtgacgccgtcatgggcgaggtccacggcgaagccctcggcggccagaccacgggcgagggcggtggcgaggcgtttttcgtcctctacgatcagcaggcgcatgccctccagggtctcagacccttcctgaagctttcttcaggtggtttcagcagggcttcaggaacgtcggcgcatgatggtccgcggccggctgacacatcggcattccggcgcacgtcggcatccctgcgacatggtccgcgagttcgaaggaagggatctcctcacgatgaaggccctcaagcgctccttggccggtcgttgccgcaccatcgccgcggtggtctctgccaccgtcgtactcggtggagccggtgccgcatccgccgccgggttcgcagacggccacaacgacggcgccggcaccacggtgggcgcgcacgacgacgaccacgacggtgacggccgtgccggcgccctggacgactccgtcgacgacggtgcgctcgccgcgagcgccgatgccggcctgaagaaggccatcgccgcggccaccaagtccgtcgcgggcaccgtcaccgaagccgagctggagggacagccgggcggggccgtctggaagttcgacgtcatcgatgccgggggcaccgagcacgacgtcgccgtcgacgcacggaccggaaaagtcaccgtcgcgcaggacggccaggaccacgcggaggacaacggaacggaccacgaccgcgaggacgactgacgcacccgcatggtcatggacgcccggcgtccacgcgcaggcggccgctgaccgcgcccgcgacgatttcgacgagacgaagaagccctacgaggcccagatcgccgcgggcggccatccgggcgccagtatccgcgccgctacggatccagtcggacaatggatttcgtcgtcttgcttcttcaaggcaacgaaatgaggagatccatggtggcctggtgatggaatcagtaccatccctctctgtcggcccgccgcagggccagcacccggcccgcactcagagagaaaaaagccatgaactccgatacgccggaacgccagttgccggtcagcgagcgcacccgtcaccgccgcctgcggcaacagggcagcctggaccgcgaccagctcgacgcgatcctcgccgccggtttcgtctgccatctcggcgtcaccgtcgaagggacgccgatggtcgtaccgaccgtctacggttccgacggcagcaccctgtacttccacggctcggtcgccggccgcagcatgctcgcttcacccgaagccatggtctgcgtcacggtcacccatgtcgacggactcgtcctcgcccgctcggtgttcgagcacggcgtcaactaccgcagcgccatggtctacggcatcccccgcctggtcacggacccgggggagaagctcgccggcctgcgctgtctgaccgagcaggccgcgcccggtcagtgggactacgcccgccgcccgagccgcaaggagctcgccgcgaccgctctgctcgccctctccctgaacgaggcgtccgtcaagatccgcactggcgccccggacgacggcgacagcgaggacgcccgactcggcctgtgggcaggcgtgctgccgctgcgcgccacctggggcgcactggagccggacccggtgctgcccgagggcatcgaggccccggcccatctgacgcagcgcgccggtgccctggcgaaccggaccgaggggaccccggcgtccggcagtcaggcgcctcctgcgtgaaccgcgcgccccggacctgcgtcttcctgcatgaccgtcaccacacgaagagggaagacgcactgtgacagacaagggtgtcgagcggaacgacgagcggcacgaggcggagccatggtgggcgggcctcgggatctggggagccgtcgcactgatcgtcttcggtggcctcgcgatcctgtgggtcttcttgcgactgcccggcacgcccgaggagttggcgaccggttaccacggggccgccaaagtcgtcgcgatcgggctggtgatcgcgggaggcgccttgctggggcggcttcgtacccgcgccgcggacaccgaggagacacccgagggggcggcgaaggccacggagtagggggcccggaggagaacccgcgcaagggaaggcgatccgcgaaccccggcgcggccggtgaccctggctcggccgggccgggcggacgaggatgcgcgggcgccggtgcgtaagggcgcgcgccggtcagcggggtgcgggctcgctcgggtcccgtccgccggtccgcgccaccggtgtcggccagccgaaaccgaaggcggcctccacgaagcactgatggtaggccgcctgcgcaccccggcgcagggcgcgttcgagggcttcgggggccggtgaagcgcgccgggaccatccgtcgcgcagcagtgagacggcgaacccggcgaggaaggcgtctccgcagcccatcgtgtcggacatggcggcggggtcggcgacccgggccggcgcggcggccgtgatccggccgtcgtacgcgatcgccccgtccaggccccgggtggccagtgccatcccggctccccgccgcaccgcctcggtgagcagcgcacgcgtggcggcctcgtccaggtgcgagcacgacagcagggccaggtcgacatgggggcagacccggtcgaggtaggcgggcgtgcggtactcgtcctcgtcggagaagtcgaagctgatcagcgggccggccgtggcgaggcgggggagcacggcctcggtaccggagtagacgctggagtgcacgagggtgaaggacgcggcataggcgagcagggcgggtgtgagggggagggcccgggcgacgtcggggccgccggggtcgtagccgaggaagacccggtcgccgtcctgcacgtgcagggtcgagaccgaggtcgtgcccgggcggacgacgctgtggtccacggtgacgccctgcgcacggccgtcg

SEQ ID NO: 963 - DNA, 3324 bp, Unknown
  Kingdom: Bacteria, Phylum: Actinobacteria, Class: Actinobacteria, Order: Streptomycetales, Family: Streptomycetaceae, Genus: Streptomyces
  misc_feature (3000)..(3002): n is a, c, g, or t
  misc_feature (3160)..(3161): n is a, c, g, or t
cccggtcgctgccgggcagcgcggcggcggcgtgtgctgtcagcgggggcgcgccgggtgtggccgcgacggtccggccggacggggtgaggacgtaggccgtggcgccgtcgaggtgcgcgaaggcggtcgcgaggacgagggccgggtcggcgtcctgtgcgaccagccggttcaggcggtcgcgcacgtgctcgggcagtgcgtggtgccggctcagttcgccccactgccgcaggtagacggtgtcggtgatcgctcggaacatgacgtgggccggtactgcggcgaccggcatccggtgcccggcgcatgcctcgaccaggtcgtcgggtaccgcgccgtgggtctcctcgccggcgaggagtgcggcggcgcccgcggccttcaggccggtgacgaagcgttcggccctgtcccggccgccgtccgcgttccaccagacgagtccgctgagcacgacctcgccgggccggacgaaacgggcggggtcctccaggtcggtgacggtgactccgctgatctcgcgccgcagcagtgtgtcctcggcccacagcaggcgcaggccgagggactcgtcctgaatgaggtgttcgacgtgcatgtgcttcggctcctcgtacgggtgccgcagggctgtgtcccggcccccggcatgccgcattcaccaggtgaatccgggtcctggcatggtaagtgcaagctcagaggagcggtatgcctgttggttgatcaaccaagtaccggggtggaaaagccgccgtttccgtgtggtgaaccagtcgtcctggccggttctcgttgcttcactggcggtcatggacctgaacacggtggtggagatacgggacgcacggcacccggcgccctggcggcccggcgacgcctggctgggcggcgggacgtacctgttctcggagccgcagccgcacctgcgccgcctggtcgacctgagccgcaccggctggaccccgctgctgcggcagccggacggctcgctggagatcgcggccacctgcaccatcgccgagctgtccggcttcgcgaaggacctgggggccgaggcggcgccgctgttcgagcagtgctgccgggcgttcctcgcctcgttcaagatctggaacatggccaccgtcggcgggaacctctgcaacggtctgccggccggcccgatgatctccctcacggccgctctcgacggtgagtgcctgctgctcggacaggacggcgcccggcgccgggtccgggtggccgatttcgtcaccggcgcgggccgcaaggacctggcggagggcgaactgctgcgctcggtgacgatcccggcccgcgccctggcctgccgtacggcgttccggcaggcgtcgctgtacgggctcgggcgctccgctgtgctggtcatcggcacgctcgacccgctcgacggctccttcgcgctcaccgtgaccgcggcgaccgtccggccggtgcggctgtggttcccgctgccgccgtcaccggcggcgctgcgaagggcgatcggctcggccgtcgccgacgacgagtggttcgacgacatccacgggctgccggagtggcggcggcacatgacgttccgttacgcgcaggagatccgccgcgagctggcgcaggagggggcacgatgaaggtcgaggtcaacggacggtcccatgaggaggagccgcgcccgggccagtgcctgcgcacctatctgcgcgaacgcggctggttcggcgtgaagaagggctgcgaccagggcgactgcggcgcctgcacggtccacgtggacggcaggcccgtccacagctgcctgtacccggccttccgcgccgacggccaccaggtcaccaccgtcgagggcctggcctcgcccgagggcgaactccaccccgtccagcagaagttcctcgacgctcagggcttccagtgcggcttctgcacggccgggttcctgatgaccacggcggccctcgacgcggaccaactggccgatctcccgcgcgcgttcaagggcaacctgtgccgctgcaccggctaccgggccatcgaggacgccgtgcgcggggtgaagaacaccgaggaaccggcgcccggcgagtccgtcggccgcagcctgcccgccccggccggaccgcaggtcgtgaccggcaccgcccgctacaccttcgacatcgacgtgcccgggctgctgcacatgaagctgctgcgttccccgcacgcccacgcccgtatcctcgcgatcgacacgtccgccgccctgcgcgtgcccggcgtgcacgccgtgttcacccaccgcgacgcaccggagcggcacttctccaccgcccggcacgagcacccggaggaggacccggacgacacccgcgtgctggacgacaccgtccgctacatcggtcagcgcgtcgcggccgtcgtcgccgacagcgaggccgccgcggaggagggctgccggcgcgtcgaggtgacgtacgaggtgctgcccgccgtcctcgatcccgaggaggcgatgcggccgggcgcgccggtcgtccacgccaaggacgcggcggtccaccggatctcccggccggagaacaacgtggtgggcgaggcgcacggggagaccggcgacatcgaggcgggcttcgccgaggccgacgccgtctacgaggacacctaccgcacccagcgcgggcagcacgcgagcctggagacgcacggcgccgtcgcctggttcgacgaggacggccggctcaccgtccgcaccagctcccagacgccgttcctcacccgccgtgcgctctgcgccctgtacgacctgccgccggagaaggtgagggtggtcgcgggccgcgtcggcggcggcttcggcggcaagcaggagatgctggtggaggacatcgtcgccctcgccgtcctgaagctgcgccgcccggtgaaactggagtacacgcgcgccgagcagttctacggcgccaccacccggcatcccttcaccgtccacgtcaaggcgggcgcccgccnnncgggtggtggcgaacacgggcgcgtacggcaaccacggcccggcggtgatgttccacagcgtcggcgagtccatggcgatctaccgcgctccgcacaagaaggtcgacgcctactcggtgtacacgcacaccgtcccggcgggcgccttccgcggctnncgccttcgacgaactggcccgcaggctcggtctggacccgctggagttcaaggcccgcaacgtcatcggcgccgacgagccgatggtcaccccgggcggccacgaggaggacctgcacatcgccagctacggtctcgaccagtgcatcggcatcgtgcgccgg

SEQ ID NO: 964 - DNA, 2857 bp, Unknown
  Kingdom: Bacteria, Phylum: Actinobacteria, Class: Actinobacteria, Order: Streptomycetales, Family: Streptomycetaceae, Genus: Streptomyces
cgcacgcgcgcgtgccgccgctccgggctcctcaggggagacggcgggcagggcggcgacgcgggtgcccgagccctggcgcgccgtcagataaccctcggcgaccagctggtcgtacgccgccttcgcggtaccccgcgagacgcccagctcggccgccagccgccgggtcgccggcagccgggtcccgggcgtcagccgcccgtcccgcacggcgtccctgagcgcctcttccagtcccgcacggcggcccgccgccgcgtccggttccagatgcaggtccaccccggcaccggacaagaagccgttcacgtccacgaaaaccctccccctgggcatgtgtacggccgggcaccgctcgggtgcccggccgctgtccgccgtgtcagcccttcagggccgccatccacgcctcgacctcgtccgagcggcgcggcagcccggaggacaggttccggttgccgtcctcggtgacgaggatgtcgtcctcgatgcggacgccgatgccgcggtactcctcgggaaccgtcaggtcgtccgcctggaagtacaggccgggctcgacggtgaggaccatgcccggctccagcgtcccgtcgacgtacgtctcggtgcgcgcggcggcgcagtcgtggacgtccatgccgagcatgtgaccggtgccgtgcagggtccagcggcgctgcaggcccagctccaggacccgctcgaccgggccctcgaccaggccccaggcgacgagcttctcggccagcacgcgctgcgcggcgtcgtggaagtcgcggtacttggcgcccggcttcaccgccgcgatgccggcctcctgggcctcgtacacggcgtcgtagatcttcttctggatctcgctgtacgtgccgctcaccggcagcgtgcgggtgacgtccgcggtgtagaggctgtgggtctccacacccgcgtccagcaggagcaggtcgccggagcggaccgggccgtcgttgcgcacccagtgcagcgtgcaggcgtgcggtccggcggcggcgatggtgccgtagccgacgtcgttgccctccacgcgggcacggaggaagaacgttccctcgatgtagcgctcgctggtcgcctcggccttgtcgaggaccttcaccacgtcctcgaagccgcgcaccgtggagtccacggccttctgcagctcgccgacctcgaagtcgtccttgaccaggcgggcctcggagaggaagacgcgcagttcctcgtcgcgctcggcggtgaccttgtcggtcagggccgcctcgatgccggcgtcgtgaccgcgtacgacccggacggggccggtcgcctcgcgcagcttctccgtcagttcgcgcacgtcggcggccgggatgccgtagagcgcctcggactcggtcagggagtggcggcggccgacccacagctcgccctgcccgtcgagccagaactcgccgttctcccggtcggaacggggcaggaggtagatcgtctcctggtggccgtccgcggtgggctccaggaccaggacgccgtcctccgtctggttgccggtgaggtaggcgtactcgacggaggcgcggaaggcgtactcggtgtcgttggaacgggtcttcaggttgcccgcggggatcaccaggcgctcaccggggaagcgcgcggacagcgcggcacggcggcgggcggtgtgctccgcctgctcgaccggctccagaccgcgcagctccgtgtcggcccagccggacttcatgttctcggcgagctcgtcggacacgcccgggtacaggccgttcttgcgctgcttgatcggctcttcttcggcagtctccggggtcgccggctgctcctccgccacggtcttcctcctcgatacggcactggaccacccccatcgtacggtcgtacggaagggggcccgaggggtgagcgcctgttaccggcagcgccgtcaccgggccgggccggcaccggccgtgccgcgcgtcccgacaggccgtgccgcgcggctactcgaagcgtgccgcgagcagcaccacgtcctccatgccgtcggtcacgtccaggccgtcgggcaggacggtgcgcagcacgtggtcgacgacggcgtccggatcgtggcgcaccgcgcgcgggacgcccgccgcggcggcgtgcagccgtgtgaaggcgcggtcgacggggtcgccggtgcggtgcagcagcccgtcggtgtagagcagcaccgtttcgcctccggtgacctggaactccacgctcggcgcctcccagcaggcgagcatgcccagtggcgcggacacggtcgtctccacgtactcggtgcgccgctcgccgaccagcagcggcgggcagtgcccggcgccggccacggtgatccgccgcagcgcgggctcgcagtaggcgaacagggcggtggcggaacgggcggactcggtcagccgcaggagcagctccaggtcggacaggacggcgacggggtcctcgccctccatcaccgcgtacgcccgcagggaggcacgcagccggcccgtcgcggcgaccgcgccggggcccgagccggtgacggagccgaccgcgaggccgagcgcggcgtcgggcaggggcagcgcgtcgtaccagtcgccgccgccgcgcggtcctgtgcggtgccgggcggcgagctgcacgccggacatccgcggcagccgggacggcagcagctcctcgtacatcgtcgccatgcgcgcgcgggtgcgttcgcagtcgatgaggcgtgcgaggtgctcggtggcgaagcggacgtagaggccggcgaggtggcgctggcgatcggtcggttcggcgggctcgtcgtagagccacagggcggcgccgaggcggccggcggcctcgg

SEQ ID NO: 965 - DNA, 584 bp, Unknown
  Kingdom: Bacteria, Phylum: Actinobacteria, Class: Actinobacteria, Order: Streptomycetales, Family: Streptomycetaceae, Genus: Streptomyces
gggcgagcaggtcggccgccaccgcccggataacggggaggtcgagcggctgcccgccgtcacccggccgctggtcttccgtggcggcctcgctctggtgcacgccggtgatcctgccgcgttcggcgggccgaggctggcgcgcaccgtgctcgacccggccgcggcggacgtggacgccgacgtcggcccggcaccgcgcactccgcctggtcaaaggctcacgaggcggacgagcctgttcctgctgcacagcatgagccagctccgtaggctagtgctggtcaggggtgacgaggagcggcgggcgagcgcgcagcagcaagtgcgcgctgcgaagggcctcgtcgccgacgccgaattccgggtcgcagccttccgccgggcactggaagtggtggagacgtgcctgggcaacgtggtgtgcgttccagcgcccgtgctctcgcccgaggtgccccccatcggcaagctgcgggggcctgcggctgatctgattcgggcgttcgagaagggccgggacacggcgaagaccgccggggtcatcacgcacctgcgtcgggcgcggccgcacgccgacccgg

SEQ ID NO: 966 - DNA, 2332 bp, Unknown
  Kingdom: Bacteria, Phylum: Actinobacteria, Class: Actinobacteria, Order: Streptomycetales, Family: Streptomycetaceae, Genus: Streptomyces
gtccggaaccggccgcgtccgcggccggttccggacggccgtactcctcctcgtaccggcggatcacctcgcccaccggcagcgcgggccacagcgtgacctcgccgctgtcccgggcgaggaccatccgctgccggcccccgtccgaacgcggcccctccgcacggtcctcggcccacatcacgaagccgagttcgaactcccgtactcgcacctcccggtgctggtacgcgggcacgtccccgttgatccactcttccgcgcgctcctgcgcctgcgcgaacgtcaccatcgccgactcactcccccaccgaagacacggaagagaccgcgactgcctgcgcgaaaccgccgtccaccatcaggttcgccaccgtctccaactccggcggggagcccgccagccgggacaggaacgcgtcgaagtcctcaccgcacggcagcaacagccgctccacgcgctccgcctgcggccacgccggatccacgtcccgcacatcgtcgtacgcgcagaaccacacggagccgagccgatcgccccgcaccttcaccgcgagcagaccgccctgcacgaacccgacgcacaggtagtccttggtgagatggtcgcgcaggcacttgttgacgtagacgaggtcgttgaccgccgcctcctcgcggaccgtgaagaagggctggtcgatcagcagccccagttccgcgtcgagcgccgtgcccaccggagcgcagccgcccgccgccttcaggaaggagcggtacgcgcccggcagccggtagccgaggtcctcctcgacaccctgcacctgctgctccgacaccgccgcacccgacttgggcagcccgaagtgcgccggccgggtctcctgcaacggccgcgtgccgcgcttggcctggtcgacgttcgcggtcgcgatcccgccgtggtggcgcagcagcgccttcacctccaccgggaccagttcgaggcgccgggtgcccgccacgtggtgccaggtccagccgtgcggcgtcgccacgctcggcaccgtgtcccacaggtcgtggccggtcgccgccagcgccgcgttcgccgacacgtagtcggtgagccgcagttcgtccacgccgaaaccctccggcgggtccgcgatctgcgccgccgcccgcgcgtacggcgagaaatcggggtaaccatgctcgtccacccggacacctctggggtgccgggccgcccggaccgggtccgggaagtgcacgatctgtccggcgtaggccgcgttcggcggcgcggcctgccctccggcctggcggccgggtggtgcccccagcccgagccgacctgtcgtcatggcggttgccccctgcggcactctgtacggcccgcggccggcggcttcctgctccgcccgccgagacccgtatcgactacttctctccgacgcgtcctgttcgacgcgctctgttcgatgcgttctcttcaacgcgctcgttcgacgcgctctgttcagcgcgctctctccgacgcgtctctccaacgcaccgaccgcgcgagcgcggcgtgccgacagcctatgcggtacgacgacaccggtcaccgggccaccgcccaccgcccgcacacagcctgccgacgtccggccgccggttcacccccgaccgtgaccggacgtcacccggcggtgacacaacgcccggaaccgggcgtgtcgcaccgccccagcttccacacgggccacgcgatttggcactctgtgtccttcggggggatgctcgggaggggaatgatgatcatgaacgcgacgcagacgggaccgcacaccagcgcttccggcgacccgcggatcggctggagcagcagcgagacaccgcacgcgcccaccctgcgtcaccgccgcgacggcatactccccaccatcgccgcagccctctccgtccgcggcgccacgctcaccggcaccgccgcacgcggcgaggaaccccccgccctgcacccgctcgtccaggacttcctcgacaccctcaccagcgcccagcgcgaccgcttcaccggccgctgcgccgagaccatcctcatctcacggcacatcagcgccgtcgacgcgacccgcagcaaacgcgcctcccgcaaacccatgaccaacggcgaagcacgcaaagccctcaaacaggccaaactcaccgcccgtcgcatccgcgaggacggcgaccccctgcacggcagcttcgccgccccgtgccgcgcctgcaccgcgctcagcgcccacttcggcgtctacgtcgtcgacccgaccggcggcaaggcctgacggcagcgcacccgcgcgaccgcactcagcacccagcacccagcacc

SEQ ID NO: 967 - DNA, 719 bp, Unknown
  Kingdom: Bacteria, Phylum: Actinobacteria, Class: Actinobacteria, Order: Streptomycetales, Family: Streptomycetaceae, Genus: Streptomyces
cgcccgatgaactcgcccgcacccgacccgcgccacaccaccgggaaccgttccccaccccacgaagagccgaaggaaaccgacatgctcccccagcggatcatcaccgaacggcttctgctcagacccccgcgaagcgacgatctgcaaaccctacgacccctcttcaccgaccccctggccctccgccacgccggcaccaccgccgcgtgggaagacgaacgagcccgccgcctgctccaccgacacgccaccacccacgcggaaggccgctgcgccccttacgcgatcgtccggcgcgcggacaccacctccatcggcctcggcggactcacacccgacgacacgggtgtccccgacttcggctgcctgctctcccgccgatactggcgacagggatacttccgcgagctcgccgcggccgtcctgccgacagcccagcagcaccccggcatccccgccatcgccgcgcgcatcgaatccgaccaccccgcccgccccgcgatggaacgcaccgtgttcttccgccacggattcaccaccgaaggcgaggcccgctgccgccacagcggaacactcatgcaccactaccgatgggtgtccccaccatgaccgcaacagccctgccgctccttccgggacctccgcggcctacaccgtgcctcggatcgttcaccccgcccctgcgtcatgacgctccggccgctaccagcgcatcc

SEQ ID NO: 968 - DNA, 4654 bp, Unknown
  Kingdom: Bacteria, Phylum: Actinobacteria, Class: Actinobacteria, Order: Streptomycetales, Family: Streptomycetaceae, Genus: Streptomyces
ctatgggccggaccgtcaggaagccgacggcgacgaccgcgagggtcaggaaccagtgcacgcgcgggtcctgccccgcggccggtcccggggcaggacccgcgcgtgcactggttcctgaccctcgcggtcgtcgccgtcggcttcctgacggtccggcccatagacctcaccggccgcggcctggccgtcgccgccctctgcacggtcagctccgcggcgctgctggcccggcacctgcccgagaacaaggtgccccggcacctcgctctgctctggctgacgctcggcatcgtcgcgtcggccgccctgctcggcgtcagccgcgccgggaccggttacctcttcgccttcttcctcgccgggcacatcggataccggctcgagaccagagccgccctcgtcctcgccgggttctgcagtctgctgtgcggcgccgtcctgtacttccgtctcggaccgggcaacccgctgctgccctggacgctcggtctcaccaccggcgccccggtcctgatcggcatcgtcaaccgcggccagcgccgggccgtacgggcggcgatcgaagcggccgaatcggccgaacgcgcggcccgggccgaggcccggaccgccgtgctcaccgagcgcggccggatcgccagggacgtgcacgacgtcctggcgcactcgctggccgggatcaacatgcagctggaactcgccgacgcgttgctcgacaccggcgacctggagaaggtccgggaggccaacgacaaggcccacgagctggtcaaggagagcctgagacaggcgcagtggaccgtgcacgcgctgcgcgaggactcgctgccgctgctggagaccctgaccgcgatgctcgtgtcgtcgggccaccgtgacgttctcaccgtcaacggcaccgtccgtgaggtgccgccccgggcgacccagaatctgctgcggatcgcccaggaggcactgaccaacgccgcccggcacgctcccggcggagaggtcggcgtggagctgacgttcgccgcctcctcgacggtactggcggtccgcaacagcccggccacccgtaaggtgaacccgggtgcgggcagcggaatggggctgatcggaatgcgtgaacgcgtagcgctgctgggcgggaccgtgaccgcgggcccggtcaccgagggaccgcaccagggcggctggcgagtggaggcagtgatcccgggatgagtgaaccggccgagattccgcagcagttgagggtggtcgtcgccgacgatcaggccgccgtccgggagccgctcgcggcggtgctcgccctgtccgaggacatcgacgtcgtcgcggccgccgcgaacggcagcgaggtgctcgcggcggtcgccgccggcccggtggacgtggtgctgatggacctgaggatgcccgtgatggacgggaccgaggccacccgccggctgggcgaggagcacccggaggtggccgtggtcgtgctcaccaccttcgccgacgacgactccatcctgggcgcactgggcgcgggagcccgcggttacctgacgaagaacgccggacgccgggacatcacccgggcgatccgggccgccgccgcggggcagtccgtgctcgaccgcgaggtccaggaccggctgctcgccaccgtccggaccaggacaccggcacgggcaccggaacaggccctgcccgaggacctcacgccccgcgaacgcgaggtgctcacactgatcggccagggcctgcccaaccggggcatcgcggagaagctcttcatcagcgaggccaccgtcaagacccacatcaacaacctgttcgccaaggcggggatccgcgaccgggcggacgccgtccgccgcgccctcgacgcaggcctgacctgacccccactctcaccgtacggcccggttgcccaacggcagatgaaccggacatggctcgcggatgtggcacggacgacggttgaatcccgtacccgcgcagcccccgtcccgggctcgaccggccattacgttgaggcccgtgcgcacacagcagcagccgggcgacggcacgagcaccagggacgaccggcaggtccggcggccctcccgcaccaccggaccggtcccttcggggacgccgtcccatcccctgctcgccctccagcgggccgccggcaacgcggccaccacccgtgtcctgcgcgacggaggacggcagctcccgcccgtcatcaacgagagcaccgagcaggggctcgtgctgccgccctacctcgcggacctgaccgcggccgggctgtccaccgcgtacgccctcaccggacacgagttcgtgcgcgacacggtgaccgaggccgtcgggcacggcggcggaacggtcgaggagatcgccgccgaactggccggccggccggagaccttcttcgggcagggccgcgccttcgccgtccggggcgcggacggcacggagtggttcgacgtcaccgtcaccgtctcccgcgcgcccgacgacgtaccgccgctcttcctgcccgcgaaggacgtggcaacggccgtcccggaccagtacacggggccgctcgcaccgttggacgaggccgtcggcaaggacaccaaggtcgatgtccagcacaacaccgcggccaccgtggccggcacggccggcgggtcgtcgggccacggcgcgggcggcacggtcttcgggctcgcgcccgtcgtccccgggctctggctcggcgcggcggtcacgggcagcgtgcagccctggcagtcctcgcgggagacgcgcggccagcggaacgtggccgaaccccgcgtgctgcgcagcgactcgggctcggtcgaggtgcggcgcaaggtacggtacggcgtccgggtgcggcgccacggcgccacgcaggtgtccacgtacagcgggtccggcacgctcacccagcgggtgcccaccgagcacctggtcccggggcgcggcggtccgcaggccggcctccggcgggtcggcggggagaccgcacggcagatcacgctcgccgactccctggccacgctgggcgtgaccgacaccgccgcaccgcaccagggcggcggcgggctgttcgacacggtcgcctccgtcctgcacccctccctcaccgcccccggcgcaccgggactcgcccggctgtacgcggccacctccacgacgaccgtcctggaggacctgccccggctgctgcgcgacggtgtgctcggcgaggacctggagtccaaggacgggaagacagcgggcagttaccgcatgagcgcgtcgctcaccggcctcgctcccgcctggagcaccggaaagacgcaactgcgcacccaccagcagacccagcacaccgtcaccgagaccgcgggcaaggggcgggccctggcgggtggtgtggggcccgcggccggtttcggcgcggtctccgacgcggccgtggtgcgcggcaccgccatgccggtcgtggccgcccgctcggcgcggttcaccgtggccgagcagaccgtctccagacggcagggcgccgaggtccggggcgagaaggtgctctaccgcgggacggtgcgcttcaccgtggagggtacgggcccgcggacgcccgggatgctgctggaccccgcgaggcgggtcgccgagcacacgatgggcgtgtggctcagcctgcgggccgacgaggcacacgtgctggggctgccgctgccgccgggcgtgacggccggcgagttcgtcgagaagccgaagcggaccgtggtggacgcggacggccgggaacgggaggaggaggtcgaacggcacctcccgttcggcgccatgggcgccggagtcacgctcggcttcctcgacacccggcccatgaccgaggccgtggagcacctgttcgcgaccgacccccggctggccggatacctcccctccttcggtgccgacaccaccccgacccccaccagcggggaggaggccgccgcgcagcggcacaaccagcgggagctgatggccgccctgtcggagaccaacctccgcgtcagcaaagagcagttgctgtccaccggaatccgggtacggctgcgccgcaagaccagcctgcactcccacgacgtacagatccgggtcaagggcacgctcggggacgccgagtacctcggcgacaccgccgactggctggtgcgcagccactccggcgtcaccagcagcctgcagagcggccgcagcagtacgcgctccatcggcggcatggtcctcggccaggcacggctggcccccggcgtcctgtccggccaggcccgctacgaccgcacccgcagcggcacccgccgcaaccaggcgggccccaccacccgtacggacatcctcaccaacggctccgaacaggccagcaccttcgccgcggccctgcgcctggacgtcgacgtcacgatgacgacccggcgccgcaagctcgcccgcggcctcaccgtcggctcccccggccgcgacgctccccagccgcaccacctgggcgcgctgcacgtgggggagcaggacgtactgctgcgcaccgcaccggagttcacgctggacgacgccggacggcaacggctggacgccctcggggcgcaggcccccggccccgaggcggccctggccgccgagggcatcggcgacctggcggggctcgctcccgttc

SEQ ID NO: 969 - DNA, 751 bp, Unknown
  Kingdom: Bacteria, Phylum: Actinobacteria, Class: Actinobacteria, Order: Streptomycetales, Family: Streptomycetaceae, Genus: Streptomyces
gcgcagcgcgcctgggccgcctgtgggagcgctcgggctcgctcgaactgctggcggaaccggtcctccaggagctgcggacggtgaccggcgacacggtgctgttctgcctgccggacagcttccacatgcgctgcgtggcggccgtcgagggcgaggaggggccgctgcgctactatccgctggtcggcgagctgtacccggcgcacgcgggcgccaccagcaagtcctattacgccttcctccccgacgaccagcgccaccggctgttccgcgaccgtcccatggcacgcttcaccgagcgcacggtcatcgaccccgaccggctggagagggagttccggcaggtgcgcgcgcaggggtacgcctggaccgtcggcgagtacgacgccgggatcggcaccgtcgccgtgccggtcttcctcggcgccgagccctacggcagtctcagcctgggcgccgccaaggagcgcttcccggacgggcccgaggaccgcctcgacgcgctgcgccgcgccgcccggctgctggagcggcgtctgacacacccgccgcagcaccaccgccggccgcgcaccgcccgcccggcgtgacccaccaccgtcccaccgttcgatgaggaacacccctgtgaatctgctgctcctgtccaactccacccagtacggccgcggttacctggaacacgccctggacaccgtgaccggcttcctgccggccggggcacggctggcgttcgtgccgtacgcgc

SEQ ID NO: 970 - DNA, 1674 bp, Unknown
  Kingdom: Bacteria, Phylum: Actinobacteria, Class: Actinobacteria, Order: Streptomycetales, Family: Streptomycetaceae, Genus: Streptomyces
ccctggagccggtggaggcggctccgtaccgggcggccccgcctccaccggctccagggtcagccgggtcggcccggtcccgcgcacgcaggtcacctgtcgcgggtccagccagccgagcttccacttgtgccaggcgaacaggtccggcgagagggcgaactggctgcccatcaggtcccagtcgcccacgtacgtgtcccagtcgcccttgtcgtcggtcggccggtggtacaggtccggcaggtcgaagacgtgccccgtctcgtgtgcgagcaccagccggtccggcgggtgccgttcgaacacggtcaccacccgccggaggtccttgccgtcggcccgcagcggcgtgttcaggttgatgaccttcgtggcgtcggagtcgacgccgggcgcgtccggatccgccacgaggtagacgacgtcgtagcgcgagaagtcgacctgcggatcggcggcggcgaccgcgtcgcgcagataggccgcccggtccttggcgtcccagtcgcggtgcatggcgtacgccgtggacggccgcggcatccggatccagtgccgcagcggatgcgggcgcagcgtgaacctgccgtaggacgcctgccggtagaaccggctggtggccgggaagtggtcggcggcgagttcggccggggtggtgagcggggcggcgtccgggaaggacaggaagatcatcacggcgtcgagcgtcctggtcggccggacgtaggaggggttccaggtgtcgacgccctccgagtggtgggcgtcggtccgccggagcgcgcagggggcggtcgagaagggttcggcgaccgacggaccactgaggatcgaggtggcggcgaccgccgagagggtggtgaacaccgcggcggtgctccgcagtcggggtcgcgtccgcgcacggctcaacgcctggaaagcgtcacgaccgatcgctttcagggggagctgacgcggcacagggacctccggatgcggttcgcggggacaccgcacccagcctgtgggagtttggaggagtacgccctgtttgtctgcaccggaagggtgatcgggagggtgaccgcacgcgcacgccagcgcactcacggaacgtcacaagtggtcgtccctctgaagaacccgtccaggtgtgggcagaaacggtctgccaggaagggcgaacgccgggcggaaccggtaagcggctggaaggcggcccgcgccagcctctatgatcggcacactttcctggcactttcctgcgcggacacgggccgggcggccgttctccatccggccggccacccgacgagaccgatacgaagaccgagtgcactgcgggagcgagcggtgagcggaacgtccgaagggccgacgcccacggcagactgcatgcagccgaaagtcacacagagtgatcttacgaaggctccgggtaccgaaccacccggggccgccgtcggcgagtgtgccgccacggaaccggcatccgggcacgccccggagcgcgcgccggggcatgtgccggtgctcactcccgtacgcggtccggcacccgtgttcactccaacggcggaacccggcgcctcccggccgcaattcaccggtccggcccagtccccggtgacattccacgcggaccacgcggaccacgcggaccatgcggacgctggccccgcccccgcc

SEQ ID NO: 971 - DNA, 3421 bp, Unknown
  Kingdom: Bacteria, Phylum: Actinobacteria, Class: Actinobacteria, Order: Streptomycetales, Family: Streptomycetaceae, Genus: Streptomyces
gaaggggagcggcggggccgggccaggagcaggaggcggatgcgggcggcatgcccgctggcctgcccccggtctgctcagggcgctccgggcgccccgggagtgcggcgctggtgccgggccgggcggctcttccggcggcgggccgggcccctgcggttcttcccgccggggtccgggcgtccgccgactgtcagtgggtcgtggcaggatcgggggcgtggcagagacagcatcgaagaagaccgacaccacccccggcggcacccgtccgcggctgatgctcatggacgggcactcgctggcctaccgcgcgttcttcgcgctgcccgcggagaacttcaccaccgcgacgggccagccgacgaacgcgatctacggcttcgcgtcgatgctggccaacaccctgcgtgacgaggcgcccacgcatttcgcggtggcgttcgacgtctcgcgcaagacctggcgttctcaggagttcaccgagtacaaggcgaaccgttccaagacgccggacgagttcaagggtcaggtgcagctgatctgcgagctgctggacgcgatgcacgcctcccgcttcgcggtcgacgggttcgaggcggacgacgtcatcgccacgctcgcgacccaggccgaggccgagggtttcgaggtgctgatcgtcaccggcgaccgcgactccttccagctggtctccgagcacaccacggtgctgtatccgaccaagggtgtctccgagctgacccggttcaccccggagaaggtcgtcgagaagtacgggttgacgccggcccagtacccggacttcgcggcgctgcgcggcgacccgtcggacaacctgccgggcattccgggcgtgggggagaagacggccgcgaagtggatcaaccagttcggttcgttcgcccagctcgtcgagcgcgtggaggaggtcaagggcaaggcgggacagaacctgcgtgaccacctggaggccgtcaagctcaaccgccgcctcaccgagctggagcgcaacgtcgagctgccgaagaccgtcaccgacctcgccagggcggcgtacgaccgcaaggccgtcgcgatggtcctggacaccctggagatccgcaacccgtcgctgcgcgagcggctcttcgccgtcgacccgggcgccgaggaggccgagagcaccccgatcgcggcggagggtgtggagctggacggcacggtgctcggcaccggcgagctggcgggctggctcgccgagcacggcacgcagactctgggtgtcgccaccgtcgacgcctgggcgctgggcgcgggctcggtcgccgaggtcgcgctggccgccgccggtgggcccgccgcctggttcgacccgtcccggctcgacgaggccgacgagcgggcgttcgcgggctggctggccgacgccggccggtccaaggtgttccacaacgccaagagcgccatgcgggtcttcgccgagcacggctggagtgtggcgggcgtcaccatggacaccgcgctcgccgcctacctggtgaagcccggccgccgctccttcgacctggacgcactctccctggagtacctgcaccgcgagctggcaccggccgcggcggccgacggccagctggccttcggtgcggacgacgccgccgaggccgaggccctgatgatccaggcccgcgccgttctggacctgggcgggaccttcgaggagcgccttcaggaggtcggcgcggcggagctgctgcgcgacatggagctgcccacctccgtgctgctcgcgcgcatggagcggcacggcatcgccgccgaccgggcccacctcgaagccatggaacagatgttcgccggtgcggtgcagcaggccgtgaaggaggcccatgctgcggcggggcacgagttcaacctgggctcgcccaagcagcttcaggaggtcctcttcggcgagctggccctgccgaagaccaagaagaccaagaccggctacaccaccgacgccgatgccctggcctggctggccgggcagacggacaacgagctgccggtgatcatgctccgccaccgtgagcaggccaagctccgcgtcaccgtcgagggcctgatcaagaccatcgcgacggacggccgcatccacaccacgttcaaccagacggtcgccgcgacgggccgactgtcgtcgaccgacccgaacctgcagaacatccccgtccgcaccgacgagggccgcgccatccgccgcggtttcgtggtcggtgagggcttcgagtcgctgatgacggccgactacagccagatcgagctgcgggtcatggcccatctctcggaggacgcgggcctcatcgaggccttcacctccggcgaggacctgcacaccacggcggcctcacaggtcttcgccgtcgagcgctcgaaggtcgacgcggagatgcgccgcaagatcaaggcgatgtcgtacggcctggcgtacggcctgtccgccttcggcctctcccagcagctgaacatcgaggccgccgaggcccgcgccctgatggacgcctacttcgagcgattcggcggcgtacgggactacctgcgccgggcggtcgacgaggcgcgcgcgacgggctacacggcgacgctcttcgggcgccgccgttacctgcccgacctcaacagcgacaaccgccagcgccgcgaggcggccgagcggatggccctcaacgcgccgatccagggcacggcggccgacatcgtcaagatcgccatgctgcacgtggaccgggcgctcagggaggccgacctgaagtcccgcatgctgctccaggtccacgacgaaatcgtcctggagatcgcccccggcgagcgcgcggcggcggaggagatcgtccgccgcgagatgtccggagcggtccggctcagggcacccctggacgtctcggtgggcgtgggccgggactgggagtcggcggcgcactgagccggacgtggcgcgaaggggcgggacgcccaccggccctcccgggcttgtgagcgtccctggctctcccgggcgcgtgggcgtccccgctccggccgggctcgtgggcgttcccggtcctgccgggctcgcggacgtctctagtcctgccgggctcgtgggcgtccccggtcctgccgggcttgccgcaggcgttcccggactgccatggctcgtgggcgtccctggctctcccgggctcgcggacgtctccagtcctgccgggcttgccgcaggcgttcccggcctgccgtggctgctgggggtccctggctctcccgggctcgcgggcgtctccagtcctgccgggctcgtgggcgtccccggtcctgccgggcttgccgcaggcgttcccggccgccgtggctcccgggcgtccctggccctcccgggctcgcgggcgtctccagtcctgccgggctcgtgggcgttccc

SEQ ID NO: 972 - DNA, 2392 bp, Unknown
  Kingdom: Bacteria, Phylum: Actinobacteria, Class: Actinobacteria, Order: Streptomycetales, Family: Streptomycetaceae, Genus: Streptomyces
cccccgccgtgggaccggcccgccaggcacgcgcagtccggctcggcccccgctccctcgccgccctcgtcctggtcagcgccgtcggcgtggccgcgttcacctggccgttcctggcgccgccgaccgcgcagatcggcgcgcacgcgcaggacgcgccctggctcttcgcgggcctgctcgtgctgctcgtcgccgtcgtcgccgcgacgatctccgagtcgggtctcggcccgaaggcggtcgccatgctgggcgtgctggccgcgaccggcgccgcgctgcgcccgatcggcgccgggacggcgggcctggagccgatgttcttcctgatggtgctgagcggacgcgtgctcggtcccggcttcgggtacgtgctcggctcggtgacgatgttcgcgtccgcgctgctcaccggcggggtggggccgtggatgccgttccagatgctggcgatgggctggttcaccatgggcgcgggcctgctgccgggcccggaccggctgcgcggccgtacggaactgctgatgctggcgctgtacgggttcgccgccgcgttcgcctacggcacggtcatgaacctcgcgggctggcccttcatgggcaccctcgcctcctccatcgccttcgacccgcacgcggcggtcggcgccaacctggcccggttcgtcgcgtactgcctggccacctcgctcggctgggacctcggccgggccgtcgtcaccgtcgtcctgaccctcgtcgtcggcccggcggtactgcgggcgctgcgccgggccacccgccgggccgccttcgagacgccggtcaccttcgacgcccagccggccacctccggcggtgaaccgtcggtgagccccgccgacccgacggtgacggccccggtgaggcgtcccacatgacgcgggtcacctacgaagcggggccgtagccgggaggggctggcatgtacgcggctttacccgcgccgacctgcgcattgagacgcccctcacaagcgtacggatcacccgtcatgcgacgaccactagtaaaaggggtgtttgcggacggatttcccgcctgcttctctggacgacgtcgcaaggagccgacggtccccccgggggccacggcaccaggcagctcctcccccgcaccagcgggctccggctgctcgcgaccccctgtccccgacgcaagaggttctccgtgtccgtctccttcatccgccgcatcgccaccccgaagaaggccctctccaccgccgccgtggccgccgccaccgtcggcatggccctcaccgccgcccccgcgcacgcagccaccaccgcctcgggcgccgacgcgaagacgatcgcgcaccagatgatcccggacgacgcccagttcaacgccttcagccgcatcgtcgagcacgagagcggctggaacccgcacgccaccaacgcctcctccggcgcctacggcctcgtccaggcgctgccggcctcgaagatgtcctcggccggcgccgactggaagaccaaccccaagacccagatcaagtggggtctggactacatgaactcccgctacggcagcccggccgccgcctggaacttctggcaggccaacggctggtactgagccgaccccgcagtgtgagcccccggatgcgacccatccggcgcgggccacgcgcaccgcagtcgtgaaggcggcggccccgatccccgggccgccgccttcaccatgtccacccgcgggccctaccgcccgcgggcgtcctccagcgcgccgaaccaccgcgcgatcttcggcagcgcggccatggccgagcccccgtggtccacctccccctggttcatcaccggcgccgtcaccccgtgcgcggccagggcgcgggagcagctgcgggcgttgccgatgggcacgtccgtgtccgcgttcccggcgtacagccgcaccggcaccgccggcttccagtcgcaggtgccgtcgttggccttcagcgcctcggcgagtccgccgctcgggtgggtgagctgcgcgtagaagcggtccgtcagcagctcccgcacgttcggcgcgagctgcgggacgatctgttcctccgtgtgcagtccgtcgaaaagaccctcgacccggtccgcgtagggcgcgcggaagacgtcggccgggtccttgtagatcgggtgcagccggttctgcgcgacgaggaagtacgacatgtagaggacaccgctgatgtcgttgacccggccgtcggtgagcgcgggcatctccgtgcccaccaggtcgtagggcccactgatcggagcgagcgcccgcagtctgaagtgccggtcggcgccctgctcgagggcccgcccgagcgccatcgcgacctgcccgccctgcgagaacccgctcacgtacacgtccccggtga

SEQ ID NO: 973 - DNA, 3169 bp, Unknown
  Kingdom: Bacteria, Phylum: Actinobacteria, Class: Actinobacteria, Order: Streptomycetales, Family: Streptomycetaceae, Genus: Streptomyces
  misc_feature (2836)..(3021): n is a, c, g, or t
tcgcgcacgcggtccgtgtcgatccgggcgggcagcaggccgaccacacggatgccgcgcgggcccagctcgtccgcgagggacttggcgaacccggcgagaccgggccgcagcccgttggagatggtcagccccgcgatcggctcgtgcaccgaaccggacagcacgaaaccgatgacaccgcccgcctccagctccgccgccgctgcccgggccagccgcaccgcacccaggaacaccgactcgaacgccgcctgccactgctcgtccgtgttgtccgcgacgaagcccggcggcggcccgccgacactgatgagcacgccgtggaagccgccgaagcgctcacgcgcggtggcgatcaggcgcgccgcggccccggggtccgcgttgtccactgccacaccgacggcgttcgggcccagctcggccgccgcgtccgccgtccgcttctcgtcccgtccggtgacgaccaccttcgccccgtccgcgaccagctcgcgggcggcggcgtggcccagcccgcgggtggccccggtgacgacgtacacccggtccttcagtccaagatccatggccctatcctgcccgctcgtcccggtacagggcgagggcggtgttcaccaggccgatggggctgaacgcctgcgggcgcgtggtccccgatccgcggggcacggatgtcgggcttcccggcggagcgagggccgatcagacgcccccggacctggaccccggacctgggcgagggcctgtcggagagccgtgtgagcgatcgtgcgggtcaaggcacctggaccgcggccggctccgacttctcccgcacggcttcctccggcgtgctggtccggtcccgcagctcgcggcgggccaggatcagccagccgaccgggatgcacgccgcgaacagccaccactggacggcgtacggcaggttgacgtccgcgttgccgatccagctggtgtccccctggggcgccgggatcagctcggggctgccgctcttgggcgccggggtgagcagttcggcgtagccgtcgagcaccgccttggcggaggcgtcgcccgtgtcacgcagcagtgcgccgacctgctcgctgttgatcagcatgatctgacggtccggcagtcccttgacgttcttgatgccgctggcggccgtcgtctggttctgcatcagccggccggtgatcgtgatctcgccctgggcgggggccgggatccgcgggaaggcggtctgcgagtcgggggaggggatccagccgcggttgacgaggagcaccttgccgtcgtccaggacgaacggggtcaggacgtggtagccgaccttgtcgtcggcgctcgtgcgccggcgcaccaccagctcgtgcgccgtgtcgaagtgccccttggccgtcaccgtgcggtagatgtcgtcgtgcgcgaccgagccgccgaccgaggtcagcgactcgacgggcaccggcttggccgcctgtgaggcggcgatcaccttgttcagcgcctgccggtggtcatggcggtgcaactgccagaagcccagccagatcatcgtcgggatcagtgcgatcgcgatgatcgtcaggatcacccactggcggctcaacaggaagcggtacaccccacgacggtacatctccggccgtggggtgtttcgccagggggcctcagacactgtcgacgatgccgaccctcccctccgcgcgggcacagtgaccgccgcagtaccagtgcccgtcgacctccacgccctggccgatgacctgcacgcggcagtgctcgcagatcggtgccatgcggtggatcgcacaggcgaagcagtcgaagacgtgcaccgcgccctgggcgtgcacctcgaaagtcataccgtagtcattgccgcatacttcacatctcgccatgcgccacagggtgagccgtggccgccgcgcgggcgagcggacggcgggcgagtcgcccggcaatcacccgtacgccccctcgcgcgcgatacgccccgccacgggtgtcgcgcgctcccacgggcgcccctgcacccacgcgcccccgtgctcgcgcccctgcatccgcgcgccccgtgctcgcgtccgccgcggcgcgccggacgtcagtcgccgtccgcgggctccacatccctcaggagctgcccgaacgccgcctcgtccaccaccggcgtgccgaactggcgcgccttggccgccttcgacgtgcccgagtccgggtcgttggtgacgagcaggctggtcagccgggacaggctggtggcgacgtgcagtccggcctcggtcgcccggtcctccagcagttcgcgctcgacggaggtgtcaccggagaacgcgacccgcatgccctgtttgagccgtttgcccgcttcgtagcgccctggattgggataggggcatgcgggccttttgcgggacgggcgccaactgcccgcccggtagccgctgtagccgccgaaaccgccggcctgctgccggggcaccggccggtccgaccactccgtcagcggccggcactccagcagcggcagccggacgccccccgccgccgcggcccgcaggctcggccggaacgcctccgccaggacccgcgcgtcgtccagcgcgtggtgtgcccgctgctgcaccacaccgaagtgcgccgccagcgactccagcttgtggttgggcagcggcagccccagctccttggagagcgcgatggtgcacagccgctgccgcaccggcgcctcgctcttcgcgcgcgcgtactcgcgggcgatcatctgccagtcgaagaccgcgttgtgcgccacgagcacccggccgtccagccgggcggcgaactcgtcggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatacgcggtcggccacggtgtgggggagggccctgcgagggtgcggtcttccagcatggtcactgaggatacgggccacgactgacagcccggtcccgcaggtgccctccgccgtcctccccggccgcgcgtgccgtccgcgagcc

SEQ ID NO: 974 - DNA, 1400 bp, Unknown
  Kingdom: Bacteria, Phylum: Actinobacteria, Class: Actinobacteria, Order: Streptomycetales, Family: Streptomycetaceae, Genus: Streptomyces
tgcgccgctgcacgggcgcgcgacggagcggggtcgcatggggcacgcgcctcatcatgcctgtccgcggcattcgggtgaagcgcgcccgtgcagcggcgcagcgccgaacggctgaccaggatcctcgacgcctgtgccgacctcctcgacgaggtcggttacgacgcgctgagcacgcgcgccgtcgccgcgcgcgccggtgtgcccatcggctcggtctaccggttcttcggcaacaagcgcgcgatggccgacgcgctcgcccaccgcaacctggagcggtacaccgagcgcgtacaggagcggctgaagaaggcggaggacagcggctggcgctccgccctggacgccgtcctcgacgagtacctggcgatgaagcgcaccgctcccggcttctcgctcgtcgacttcggcaaccagataccgctcggcgaccgtcacgccgagcccaaccaccgcctcgccgacctcctcacccgcctgctcgcgggccgactgcgccaggagccggacgacgacctgcgccgtacgttcctgatagccgtggaaaccgccgacaccctggtccaactcgccttccgggtcgaccccggcggcgacgagaagatcatcggcgagatgcgggaactgctgcgggcgtacctcgggcgagtgctggactgagcggcgccggcgcgctgtacgggggatgcgcccggcccttcgttgcgccggacggatgacagtgggcggcgcgtcggggggaggtgcggtgaacccggcgggtgatgtgaaagagagtcaggtgaaagagcgatttgtatgaaaatcgtctgactcggaggagcgcgcatgcccaccctgacactcccacgcatcctcggctcccgcgtcggtgccgccgcggccctgacggccctgaccgcggcgggtgccacgtggctggcagcgcccgtcgccgtggcacagggagaagccggcgacatcaagatccaccgggtgggcgtgcccttcggcgtctccaaggacgacccggtggtctgccggttctacctggacgcggtcaacttcgacgtcctgccgaccatcggctacaccatccaggccatgccgccgctgcccaccagcgccaccgtcaccggcaccctcgccctggccgcgggcgccggccacaccgacccgctggggctggccgacgggcagtacaagctcgtctggaccgtcgcgggcctccccaaggagaagatcttccacgtcaactgccgtgaggagaacggccacaaggaaggcgcacagggtccgggcggccagatcgaggaccacgaccacgacaacaacgaccagcgcggcgggccggcggccaggcaggacccgccgggacccaagggcggtgtgcacgcgggcggcggcggccgtcg

SEQ ID NO: 975 - DNA, 2968 bp, Unknown
  Kingdom: Bacteria, Phylum: Actinobacteria, Class: Actinobacteria, Order: Streptomycetales, Family: Streptomycetaceae, Genus: Streptomyces
gcggtgctcgatgaggccggggggtggccctacgggcacggtgggcgcacgccgttcgccgacgggggcggctggccgttcggtgccgcgacggactccccccgggactgccgggacggaggggacgcagggggatgatgagtagcgggggagccctgatgtggcgtcagcggtatgcgcgggggtgcgggtagcgctcccgccatttctgcggcgaacccgggggcggtgtcgggccggcctggcagcgcgggcaccagtaggtgggacgctcctgggagccgtcgccctggtcggccacccggacggacgtaccgcagcgcaggcaggggcggggcgcacggccgtagacgaacaggtcctgacctcgccggccttgctgaccgcgcggatcacgcaggcccgtggtccggcggacgacacggtcgcggttggcctccaggagccgctgggccagggcgggcagctgcgccgcgccgtcggcgggcagggcgccgacgggcagccatggggtcacaccgagcaggaagcacagctcgctcttgtagacattgccgattccggcgaggttgcgctggtcgagcagggcctcgcccagttcgcgtgacgggtcggcgaggaggttggccagggccaggtccgggtcccagtcggggccgagaaggtccgggccgaggtgaccgacgacccgctcctcctcggtgctgtgcagcaactcgaggagggggagccggtagccgatggcggcgtggccggcggtggcgaggacggcccggatctggtgggcgggaccgcccttccagcggtcgccgctgccgtagaccttccaggcaccctccatccgcagatgcgagtgcagggtcaggccgccctcgaaccgggtgagcaggtgcttgccccgggagacggtgcccagcaccttccggccggccaggtcgaccgtggcgtacttcggtacccggaagtcgctgcgggtcagcacttcgcccgcgagcgcgtcgtgcaaccgcctcgcggcctgccagaccgtgtcaccctcgggcatgcgtcaagggtgacacgggggcgggccttccggtctggtcccggggattcggtcgtgcaggccggtcgtgcgggccggtcgtaggggccagccgtgcggttcggcccgggggttcagtcatgcgcgcaggcgcaacccgcgcggggtcgcgatgaaacccgctccttccaggagggtgcccaagggggaggtgagcgcggaggcgccgttgatccgctccaccgtgaccgtgcccagggagcccgctcgggccgctgcggccaggccctcggcggcctccgccagacggggatcgtcgggggccgccgcgtccgcgtcgtcgggccaggccagcagggtcttgccgccgcgctccatgtagagcgtcagttcgccgtccacgaggaccaccagggaaccggccttgcgtcccggcttgtgcccggcgccggtcggcggctcgggccagggcagggcggcgccgtaggcgttcgcgggatcggccgccgcgagcacgaccgcccgggaaccggcggatccgtgacgcccgccaccccgccggtcgccggagcctgcgccgtacaggaatgagtgtccgccgcctcgggggccgccgcggcccggatcggtgaggtccgcgggcgagaggccctctggagagagacggccggacgccgaccagtcctggcccatgcctggacccgccgtgccgaagccgtcgtcgggcagcgcgtcgatgtcgggcaaggggccgatgtcgggcaggccggccatgggtgggccgaagccgtcaggtccgccaccgtcgaaccccgagccgggcaggccctcgcgccgctcgcgggcgttcgccacggcgcggaggcggtcgacggcgccgtccatggcgaactgcgcggcgcccagcccttcgacgacgtacccgcggcgggcctggccgctgtcctcgaaggccgacaggatccggtacacggcggagaaaccgccctcgacgccttcggcggacaccgctccgcgggtgaccaccccgtgccggtcgagcagcgtgcgggccagggcgtgggcgcgcacggtggtgtcggcttcgcggacgggcagcagggaccagcggccggcgacggtcggcgggccgctgcgcgagacgggccgggccgctgccgtcagggagccgtatcgtccgcgcgggacggcgcgcttggcacggtgggccgtggagccggcggtgcggccggagccgagcagagcacgcatcggggcgagggtgtcgttggtgagcagcccggaccaggcgaggtcccagagcgtgtcggccagttcggggtcggtggcctcggggtgggtggtcgcccggacctggtcggcgatctggcggaagaacaggccgtagccgccggagagggcgtcgaggacggagctgtgcagtgcggtcagctccaaggggtgcggcggcggcaggagcagcggggccgcgtccgccaggtagagcgcgacccagccgtccttgccgggcagcgcgcccgcgccggcccacaccacctcgccggcggcggtgagttcgtcgagcagcgacggcgtgtagccggccacccgggagggcaggacgagcttctccagcgctgacgccggcacggacgccccctgcatctgttcgaccgcgcgcaccagtccgtcgacgccccgcaggccgtgtcccttgccgatgtgctgccactgcggcaggaactgcgcgagagcggccggcggtaccggctccagttcgtgccgcagcgcggccagcgagcggcgccgcagccggcgcagcacggaggcgtcgcaccactcctgaccgatgcccgccgggtggaactcgccctggaccacccggcccgcggcggccagccgctgcaacgcgccctcggtgaccgccgcacccaggccgaaacgggccgccgcgggccgggtggt

SEQ ID NO: 976 - DNA, 3756 bp, Unknown
  Kingdom: Bacteria, Phylum: Actinobacteria, Class: Actinobacteria, Order: Streptomycetales, Family: Streptomycetaceae, Genus: Streptomyces
ccccgccctgcccgccgtacgagcgcccgtacggcgggcagggcggggcccggctgggacagctcgcccgtgatccgcgccatgcccgcctgctggtaccgctccagcgccttcaggtacagctcctgcttgccgccgaaggtcgcgtacaggctggcgcgcccgatcccgaggtgctccacgaggtccgccatcgacgtcgcctcgtagccgcgccgccagaacagctccatggccgactgcagcgcggcgtcgggatcgaattccttggtcctggccacgtccgcagcgtagatcatcttggaacgaccggtcaagaaaagcgaggggtcacacggcggcactccggacgccgtacgccgtcacccgcacccgctcgtcgtccaggcaccgtccggagccgaggtcgaagcgctgcttgagcagcggcgaggcgacgaaggggcggcccgcgtgggtgccggtcaggccgcgggagaggaccgccgcgccggtgaaggggtcgcggttgtcgatggcgtagaggccgcccgagcggtcgcggaacagggccgcctggcggccgtccggcagcagggccgcgacgccgcggccgggcagcagcgtgctcaggtcgcacacggtgaaccagccgtcgccgagccggagctggaccttgtccttcagttcggtgatcgtggctgtggtggtgagggtcatcgctgggtgcttccttccagggcttcttcggtgggacgcgggccgagggtcagcaggggcaggtcgggcttggcctggtcgcgttcggggacgaaggcgacgaccgggtccggggtgtcgggggcgttgacgaaggacacgaaccgggcgagcttgtccgggtcgtcgatcgtctcggcccactcgtcgcggtagtgcgagacgtgcgcggccatctgggactccagctcggcgcagatgccgagcgagtcgtggaccaccacgtcccgtacgtggtcaaggccgccggggatccgctccagccacacgctggtgcgctccagcttgtcggcggtgcggatgtagaacatcaggaaccggtcggtcagccggaccagttcggcgtcggacaggtcctgggcgagcaggtcggcgtggcgcggggcggcgccgccgttgccgccgacgtacaggttccagccgttcgcggtggcgatcacgccgaagtccttcgaccgggcctcggcgcactcgcgggcgcacccggagaccgccgacttcagtttgtgcggtgagcgcaggccccggtagcgcagctccaggtcgatcgccatgcgcacggagtcctggacgccgtagcggcaccaggtggagcccacgcaggacttcaccgtgcgcagcgacttgccgtacgcgtgccccgactcgaagcccgcgtccacaaggcgggcccagatcagcggcagttgttcgacgcgggcgccgaacatgtcgatgcgctgcccgccggtgatcttcgtgtagaggccgaagtcacgggcgatctcgccgatcacgatcagtttcccgggcgcgatctcgccgccggggatgcgcgggacgacggagtaggagccgttcttctggaggttggccaggaagtggtcgttggtgtcctggagggcggcctgctcgccggcgaggacgtacccgtcggcgccgatgaccggggcgagcgaggcgatgaccgaggcgacggccggcttgcaggtctcgcagccgtcgccgccgcgcgcctgctcgcggccgaagcggtcgaggaggtcccggtaggaggtgatgcgcagggccaggacgatctcgtacagctccgggcgggtctgcgcgaagcagccgcacaggcccttgtcgacctcgacgccgctcgcctccagctcggcgtcgaccagctgggtgagcaccttgacgcaggacccgcacccggtgccggccctcgtgcacttcttcacctcgggcacactcgcgcacgcgtggtccgtgaccgcgccgcgcagggtgcccttggtgacgttgtggcaggagcagatcaccgcgtcgtccgggagggcggcggggccgagctgtgcgggagcgccggcaccggccggcagcaccagtgactcgggggagaggggcggcaccgcaccggtgaacgcgcgcagcgtgccgtacgcctccgcgtcgccgaccaggatgccgccgagcagggtgccgtcccggccgatgaccagcttcttgtacacgccggcgcgggagtcggagtagacgacgtccaggcagtcctcggcggtgccgtgcgcgtcgccgaaggaggcgacgtccacgccgagcagcttcagcttggtggacaggtcggcgccggtgaactccgcctcgtgcgccgcgatggtggccgccgccgtctcggcctgctcgtagccgggcgccaccaggccgtagacccggccgtcgaccgcctgcgcgcactcgccgatcgcgaacacgcgcgggtcggtgaccgtacggcaccgctcgtccacgcggatcccgccgcgctcgccgaccgcgagacccgaggcgcgggccagctggtcgcgcgggcggacaccggcgctgaacaccaccatgtcggtggcgagttcggagccgtcggacagtttcatgctggtgaccgcgccgtccgcgccggtcaggatctcctgggtgcccgtgccggtgtgcacggtcagccccatcccctcgatggtgcgcagcagggccgcgccgccgccctcgtcgatctgcaccggcatcaggcgcggcgcgaactccacgatgtgcgtggccagtccgagccccttgagggcgccggccgcctccaggccgagcagcccgccgccgaccaccgctccggtcctcgcccgcgtggcggcgtacgcctcgatggcgagcaggtcctcgatggtgcggtagacgaaacagccctcggcgtccttgccgggcaccggcggtacgaaggggtaggagccggtggcgaggacgaggacgtcgtagccgacggtgagcccggagcgggcggtgacctggcgcgcctcgcggtcgatggtctcggcggggtcgcccaggcgcagctcgatgccgtgctcgtcgaagaacgcgctgtcggtcagggagagttcctcggcggtgcggcccgagaagtacgaggtgagccggacgcggtcgtaggcgggacgcggctcctcgcacagcacgaccacgcggtgggtcgcggtcaggccgcgttcggcgagcgcctcgaggaagcgctggccgaccatgccgtggccgacgagcacgatcgtgggggcggcctggtgggtggtggtcatgcggagcctccgtcgtcggtgagcaggtggagcagcggggcgccgtccggggggagcggctccgctccctcccaggcgcgggtgagcgcgccgacggtgccgagttcgccgacgaggacaccgccgacgaggcggtcgccgcggacgacgaccctgcggtaggtgccgcgggtggcgtcggcgagctgtacgacgtcgtcgccggggcggacgtccgtctcgccgaacgcggccaggtcgaagggggagtccgggccggtcagggtgagccgggtgagcgagcgggtgccgctgtagcgggagggcgccgtgcccgcgagcagtcccgccagcgcggcgacctgttcgagggcgggcgcggcgagcccgtacaccgtgccggcgtgctcggcgcagtcgccgacggcacggatgtgcgggtcgtcggtgcgcagctcgtcgtcgacgacga

SEQ ID NO: 977 - DNA, 2248 bp, Unknown
  Kingdom: Bacteria, Phylum: Actinobacteria, Class: Actinobacteria, Order: Streptomycetales, Family: Streptomycetaceae, Genus: Streptomyces
  misc_feature (1738)..(1790): n is a, c, g, or t
gaggtgtacgagaaggccgccaagcacttcgaggaggccgagctggcccagttgatcgccgcgatcgcggtgatcaacgcctggaaccggttcggcgtgaccacgcgcatgtcgccgggccactaccggccggggcagcacaagtgaaccgttcgcaggtgctggacccgcaggtgttccaggcgatgtcggcgctgagcgcggcggcgaagaaggggctcggtgatccggtcctcgccgagctggtcatgatccgggcctcgcagatcaaccactgcgccttctgcctggacatgcacctccagatcgcccggaagaacggcgagtcggaggaccgcatccagctcctcaacgcctgggaggagaccgaggacctctacagcgagcgggagcgcgccgcgctcgccctggccgaggcgatgaccgtcctcaccgacggcttcgtgccggacgaggtgtacgagaaggccgcccagcacttcggggaggccgaactcgcccatctcatcgccctgatcaccgtcatcaacggctggaaccgcctgatggtcacccgccgcgtcccgccgggaggccgtcagtcatgagcgggtccgacgtctttcgcgctctgcaccacgggcgcctgcccggcgaccccctggtcctgcccggaccctgggacgcggccagcgcacgggtgttcgccgaggccgggttcccggcgctcgccacacccagcgccggcgtcgccgcctcactcggacacgaggacgggtccaccccggcggaggagatgttcgccgccgtcgcgcgtatcgcgcgagccgtggacgtgccggtgtcggcggacgtcgaggacggctacgggctcccggcgaaggaactggtggagcggttgctggaggcaggggcggtgggctgcaacctggaggactcgcgccacggtgtcctcaaggacccgcgcgagcaggccgacttcctcgccgaggtccgctcggccgccggggaccggctgttcctcaacgcccgcgtcgacacgttcacgcacggcgacggcgaccccgaacaggccatccgccgggccgccttgtacgtggccgcgggcgccgactgcgtgtatccgatcctcgctccggccgacgtactgcccctgctgcggtccgggatccagggcccgctgaacgtgctggcccggctggacggcacgggtccctcgcccgcggagctgggcgggctcggagccacccggatcaccttcgggccgggactgcagcggcgggccgcgcaggcgctgcgcggcatcgcggacggcgtgttcgggagcgtcgccgaggcggggtagcacggctccgggcggcgcggctcccggccgtacagctcccggccgtacagctccgggcagtaccgcgcagtgcggctccgcgcagtgcggctccgcgcagtgcggctcgggacagcgcggtggggccccggacggcggggcccggacagcacggctccggacggcgcgggccggtccagccgcttttgccggtggggcgtcgggcgcgggtcagctcgtgggcgtgggggccgggcacacggtgtcgggcgggcagaaccagcccagcgccgtggtgaggacgcgcagttcgtcgccccggccgtcggcgtcgggcccgtaggaggcgatcgcgtagatcttgccgtcgacggagcggaagcgctcgtcgaagacgtgccaggtgccgacgtccggctcgcccttgagcgagtnnnnnnnnnnnnnnnnnnnnnnnnnnnnnnnnnnnnnnnnnnnnnnnnnnnnnggcgaggtctccgccacctcgtacacctggatccgccggtcgcccgagccgctgctgtagttgacgacgtccatgccgaactgggagtggaccgcgtggcggccccagccgtcgggcacggcgatccggaatccctccgggtcgtcctcaagggcgtagccggcgggcggctgcgccgcggtgggggacgggctgtcggtggtggcggtggtggtctcctcggacacgtccgtggacggcgacggctcgggcaccgtgggcgcggtggtggtgctcgccgccggcgcgcccttgtcgtcgtggcccgcccggccgaaacccagcgtcaccaccaggctgacgacgacaccgactccggcggccgcggccaccaccgtccacacggtacggcggctgtacccgccggacacggccggcggacccggtacggtcaccacccccgacggaccggccggacc

SEQ ID NO: 978 - DNA, 2075 bp, Unknown
  Kingdom: Bacteria, Phylum: Actinobacteria, Class: Actinobacteria, Order: Streptomycetales, Family: Streptomycetaceae, Genus: Streptomyces
tgccggcctcggttcccacggatgcatttccaggatccagtgctgcaggtcgatgacgagcagtgcggtacggaccgtggtcatgtgcttcccccaagcgccgctttcggacacgaagtccgacgtgcagttcggacgtgcggttcggacatgaagtccggccgtgaacgctagcagaaatgatcagccggatcggcgctgcaccctagggtgcagttccgttcctcagggtcctgagccctcgtaatgtagagatcgcggtcgggaagtcgggaacagatcccgtatcccgcaaaacttctgacgcatccccagaaagggtggaagaacaattatggagctgagggcggatcgtctggaaaagctggggaactatttcggccggctgaccgccgagggaaagatccccggctggtcggccatggtctcccagcgcggcgagacgatatacgagtcctccggcggaatggcgaacatcgccgccggaattccgatgacggcggacagcatcttccgcacctggtcgctcagcaagccgatgacctcggtggctttcatgaagctcgtcgaggacgggctggtgggcctgaacgacccggtggccgactacctgcccgccttccgtgaccagcgcgtctaccgcgccggcctgccggcggcccccctcaccgagggcctggtggagccgatgcggatgtggcacctgctgacccacaccgcgggcctcggctacggcgcgcaccagtcgcaccccgtggacaccctgtacgtcggccagggctacaccgtggagccgccggccggcacctccctcgccgaggccgtcgacgcctgggccgccctgccgctgcggttccagccgggcacggcctggaactacggcgtgagcaccgacgtcctgggccgggtcatcgaggtggtgtccggcaagcgtctggacgtgttcatgcgcgagtcgttcttcgagccgctgggcctgaaggacaccggcttctgcgtggagacgcgcaacaaggaccgctacgccgagatctacacgcccaccgccgacggcggcatcgagcacaacccgcaggccggcgcctacccgaccgaggccccggtgttcctgtccggcggcggcggcatctacaccacggtcgccgactacatggcgttcctcggcatgctggcgaacgacggcaaggccgccggcaccggcgagcactacctctcgccgctgaccgtcgagcagatccgcggcaaccacctgccggcggacgtcacgctgggctccggattcggcagctggggcgtgccggccgtcaacgagctgatgccggccgccggtttcgggctgggcttcatgacggtccagcacccgcgcgaggcgcacctgctgacgcgcgagggcgagtacttctggctctcgatgagcagcgcgaacttcttcatcgaccccgcgagcggtgtcagcgccctggtctccccgcagctgtacccgtcccggaccctgccgatcaccaaccgcctgcggcagttcgtctaccaggcctattgctgagcccagccggccacgtcaccacgaggtgagtcgatgagcacgccaaccagcatcccgaccagtacggaatccagcacggaatgcggcaccgggtccagcgcgatatcgctgcccgtcgagatcccgctccgctggggtgacatggattcctacggtcatgtcaacaactgcgagatcgtgcggatcatcgaggaggcccgcatgagatggctcatgaaaagcggtgtcttcgacggtgagaccgcggtcgtcgcggcccatgagatcggatatctgcgcccgctgcagtactcgctcgacccggtcaatgtcgaagtgtggacgtcgaatgtccggcgctccagcttcgagttcaacttccggatcctgaacacctcgcgcgaggtgagcgtcaaggccgtcagccgcatggtgatgttcgacctcgaaaagcaggaggcctacgccatcggcccgcggctgcgccggcacctgcacgccgcctgcggggaccgcctgtaggccccggcccgcagccccctgcccgcagccc

SEQ ID NO: 979 - DNA, 1174 bp, Unknown
  Kingdom: Bacteria, Phylum: Actinobacteria, Class: Actinobacteria, Order: Streptomycetales, Family: Streptomycetaceae, Genus: Streptomyces
ccggtcagccggccggtccggtcagctgctcggccagggcacctgcggtgagcggtagtagccgatgcccagggcgtcccagcgcggcgcctgcgcggcgagccggaccttgtaggtgtcccagtcgtgcgtggcggcgggcgaccagccgagttcggcggcgcccggcagcctcgggaaggccatggtgtcgatctgggcggaggtggacagcgtctccgaccacatcggggcctccacaccccggacggcggacgcgggaacgcccggcaggtaggtggcggggtcccagtcgtaggagcgccgcacctcgacgtacccggcccaggacaggcccagcggggtgtccttggtgtacttcatgtccaggtagacccggtcggccggggagaggatcagtccggttccgtgctgcgcggcctgggcgacctgggccttgtcggcggcgctggtggagtccaggccccagtactgggcgagggcgcccttgaccggggtggccgccgtcagctggtgccagccgatgaccgtcttgccgtacttggcgacgatgggctgcacccggttcatgaaggccacgtagtcgtcgtggctggtggagtgcgcctcgtcaccgccgatgtgcaggtagcggcccggggtcatggcggccagctcgcggatcacgtcgtcgaggaagtcgtacgtgacctgcttgggcacgcacagcgagctgaagccgaccttcgtgccggtgtagagcgggggcgccacgccgtcgcagttcagctccgcgtaggaggcgagggccgcgttcgtgtggctgggcgtgtcgatctcgggcacgacctccaggtagcgggaggcggcgtagcggacgatctcccggtagtcggccttggtgtagaacccgccgggtccgccgccgacctccgtggagccgccgtaagcggccaggcgcggccaggagtcgatggcgatgcgccagccctggtcgtcgctgaggtgcaggtgcagctcgttgatcttgtagagggcgagttcgtcgatgtaccgcttgacctggtcgacggtgaagaagtgccgggagacgtccagcatggcgccccggtaggcgtagcgcggggtgtcacgcacggtgccgcccgcgaccagccagggacccggctgcacggacttcttctcgacggcggcg

SEQ ID NO: 980 - DNA, 1631 bp, Unknown
  Kingdom: Bacteria, Phylum: Actinobacteria, Class: Actinobacteria, Order: Streptomycetales, Family: Streptomycetaceae, Genus: Streptomyces
ctcccccgcgtcggaccggtacccccctccccgctcacaaggagccatgccgtggaccgcacctcgcgcgcgcacaccgtgctgctggacttcgacggagtgctgagcctgaacgcgtccggcctgctgctgcgggccctgcacgaaggcatcaaccgccacaccgaactcccctacgacgccaccgcagcccagttcaaggccatcagcaccttcccccagcgcgagagcctgcgcgtgctgttcgccggactcggcatcgaacagcacctggcggccgagatcgcggcgctgcgctcgctgaccgccgtcgacggcgcccggctgaccctcggtgacggggtcgaggagttctgcgccgaacagcgcgcccacggtgtacggctacgggtgttctccaccatggaccacacgaccgcgcgccgcgccctgctcgacggtctcttcgagacgcgggacttcgtcgctctcggccacgcctccaaggccgaccccgacacctacaccgcactgctggccgccgagcacgagacacacccggagcgctggctgctcgtggacgactcgccgctggccctgcgcgccgcgaagatcgcaggactgcgcaccgtactgatgcgcgggcaggtcttcacggacgccgacgtcgcgccgttcggctcctgcatcgacgcccaggtcacctccttcgcccagctcggcgacgttctgcggcccggcccggtggccttgccggcctgaccgccccgcaccttcccgacacaggaagcctctcgatgtcccccacacctgccgaagcagagccggccgccacccgggccgagccggtcaccgccgtcagcggcgaacgccccgccatcggcgccacccgggtcctcgtggccatcggcctggcggccgtcatgctgcccatctccgtgaccggacccggagtggcgctcgccgacatgtccggcgcgctgcacgcctcggccgcctcctcccagtgggtcctcaacgcctacaacgtcgccttcaccgcgttcatgctggccgccgggtccgccgccgacctctacgggcggcgccgggtgttcctgaccggcacgaccgtcttcgcgctggcctccctggtggccggcaccgcgcccaccatcacgctcgtggacctcgcccggttcgtccagggcatgggcgccgcggccgtcctcaccagcggctcgacgctgctggcgcacaccttcgagggcgccgcgcgggccagggccttcggcatcttcggcgcctcgatcgggttcggactggcgatgggccccttcgtgtccgggctgctcgtcggtgctgcctcctggcatgcggtcttcctcgtcaacgtggtcatcgcagcggtggtcctcgtcctcgcccggcccctgcccgagtcccgcaacccctcggcccggcgcatcgacatgccgggggtggtcaccttcacgctcgccctgctgctgctcgccctggcctttgtcgagggaccctcgcacggctggaccggaccgcagacgctcggctccttcgtgggggccgcgctcttcctcgccgcgttcgtcaccgtcgaactgcgcagcagcgaccccatgttcgacctcggtctgctgcgcagttcgacggtg

SEQ ID NO: 981 - DNA, 1544 bp, Unknown
  Kingdom: Bacteria, Phylum: Actinobacteria, Class: Actinobacteria, Order: Streptomycetales, Family: Streptomycetaceae, Genus: Streptomyces
cgggctcctcgtcggcgtcgccgccgccctgcagcccacgatgctgctgttcacaccgctgctgtggtgcaccggacgcagacgggccgccgccgtcaccggcggcacgttcgccgtgggcaccgcgctcgcctgggcggccatgccgcgcgactccgccacgtactggatccaccacatcgccgggaccggcctcggcggccgggccgacggcctcgccaaccagtccctgcacggcgcgctgctgcggttcgggctgaccgggccgctggagatcggcctgttcctggtcctgggcgcggccgtcgccgtcctcgccctgcgccgggccgtgcgctacgcccgtgacggccagctgctgctcgcggtcgccgtcaccggctgcgccgccatcgccgtgtcgccgaccgcctggcagcaccagctgctgtgggtgctcctcggaatcgtcggccgggccggacggcgcgcctgtgaccgctacgtctggcccctcgccgtggtcctggtgatgacgctgccgtcgaagatgctgctgccggacatgccgctcctgcagccggtgcgcgggaacgccgtcctggtggccgcactggcggcggcgaccttcgtaccgttcctgccgcgcacctcggagcactaccgcaccccggtccccacccggtacgcgggcccggtcccggcccgcttgcggcacgtgccgctggtgccgttcctgcgccgggtcctgacccggccgaacctcctcctcgaagtcctcctgatccgcgtcacctacgccgtctactcccaggtgcgcctcgacgcccgcgccggccgcgccaccgccgagcaccacggccaccagatccactccctcgaacaggccctgcacctcgacatcgagcactgggccaaccactcgatggtccggctgccctggctcgaccacttcctcagctactactacgagacgttccacttcgtcgtgccgctggcggtcctcgccgtgctctacgtccggcggccggtggattaccggtgggcgcgcaccgcgctcggcttcgccacgctgttcgggctgctcggcttctggctctacccgctggccccgccccggctcatgccgggcttcggcttcatcgacacggtgcacggcgtgcaggacttcgcgaagccggactacggtgccatgaccgcgctcaccaaccagtacgccgcgatgccgtcgctgcacttcggctggtcgctgtggtgcggtctggtgatcgccgtcgtggcgccgaagtggtggatgaaggtcctcgggctgctgcacccgctgttcacggtctccgcgatcgtgggcaccgccaaccactgggtgctcgacgcggtgggcggcgccgccgtggtctgcgcgggcttcgccctgacctacctgctgtccggcccccgcgcggtggcggcgccccgcccggcggaggcggaggacgtggagaaggccagacccgcaccggtcgtgcgctgacatggcgcggaagggcagccaccgcccgcgctgtcgccgggcggtgcgggcggcg

SEQ ID NO: 982 - DNA, 3227 bp, Unknown
  Kingdom: Bacteria, Phylum: Actinobacteria, Class: Actinobacteria, Order: Streptomycetales, Family: Streptomycetaceae, Genus: Streptomyces
cccgtgccgtgggtgtgccggttgtcgtggcgcggggcgcgcagccagtgttcctcggcaccgtcggtgagcaggtcgacggcgtcgccggccaggtgcccgcccttgatcagcacccaggccggaccgtacgccaggacggccaccgtggccaccccgaacctcgacgaggtcgcccaactgacgggcgtggaggtcacatcggaggagcagctgcgcgaggccgcggcggccgtcctggcgtacggtccggcctgggtgctgatcaagggcgggcacctggccggcgacgccgtcgacctgctcaccgacggtgccgaggaacactggctgcgcgccccgcgccacgacaaccggcacacccacggcacgggctgcaccctggcctccgcgatcgcctcgcagctcgccaagggccggtccgtgcccgaggcggtgacggccgccaaggagtacgtcaccggcgcgatcgccgccgggttcgcgctcggcggagggatcggccccgtcgaccacggctggaggttccgggagcctcacgccgccgggcagcagcctcacgccgccgggtagtccggcaggtcgatcgcggtggccgccttctcggtgagccgtttgaagaagccggccagcatccgcgagctgagcagccggtacatccggtcccggctgcggatgcgccgctcggtgggcggcgcgaagaacgggcccgcgttgccggacgtcttctggcagcccttggcgaagtcccggacccggtgctcgtacgcggcgaaagcgacccggtgatcgccgcccgcgagggccagttcgccggcgagcacgtacgcgccgacgatcgccacacccgtgcccatgccgcccatggtggcgccgtacccggcgtccccgagcagcgccacccggcccgaggtgagccggtcgacgtggatctgcgcgatcgcgtcgaagtacaggtcgtcggtctcctccagcgccttgaggacgtgcggcgtctcccagcccatgcccgcgaaccgctcggccaggagccgcttctgcgcggcgacgtcccggcggtcgtacgtcagttcctcggaccggaagaccagcagggcgcccgcccgctccgggtcgccgtcgtagttgccgacggcgacggcccggccgggctcgctgtacagcagtccgcggcggcgcaggcccaggtggttggggacctggaaaccggccacgtagtggtcgaagaagcgcaggtggcgggcctcgtcgccgaagacgaggcggcgggtgtccgagtgcagcccgtccgcgccgacgacgaggtcgaagcggcgcggcgggctcttctcgaaggtggcctcgacgccgtccgcggtctcggtcagcgtggcgatcgagtccccgaagacgtactccgcgtgctcctcggtgcgctcgtacatgatccgcgccagttcgccgcggaagatctccacgtcgccgctcatcatctcggacggcaggtccacgcgcggggtgccgtcggcgtcgacgacggtctgcgggcccatgtgcgtctggcgggcgtggatctcgtcccagatgcccatggcggtgagcaccctgcggtggacatggccgcggaagtcgacggcgaagccgccgccgcgcaggtcgggtgccttctcgacgacggtgacccgggcaccgtagcgggccaggtccagggcgagcgccggaccggcgacgccggcgccggagatgaggacgtcgaggtgggcgaggctgcggccgctcttcgggttcgtcatggggcacagcctcggcgcgggcgctgaccgtccgcctaccgtccgctgaccaccgcttgccactcgctgaccgccctaccgttcgtcgaccgccgccgaccgcagccgtacgccccgctcgtaggcctccgcgtacgccgggggcgccagccgcgcgcgcacgtcctgcacggtccgtacgacatcggggtccccctgcgcgggggcgccccgcaggcctgcccccgcacccagcagctccgccgcccgctcgggagtgggagccacaccggccagcgcctcggccgcctcggcgagttcgagctcgcccggcgcgtccgcggcggcgacgacggcctgacggaaccactcgcgcgcgtcctccacctgcccctcggcggcggccgtgcggcccagaccgatgaggatgcgcacgctctcgccgacgctgaaccagttcccggcgcactcctgaagggcccgttcgtagtgcacgcgcgcgcgtgccgggtccccggacagccgggcacagtcaccgagaccgcgccgcgcgcccgccaccttgtcggcggacccggccgtacgggccagcgccagcgcctgcccgaagtccgccgccgcctcgtccgaacggccccggcccagcagcacggtggcgcggctgcgcagcagatcggaggtctcctccggcgcggccagctcccgcacgtgcgcgagcccctcgtccagcagctccagcgcccgccgccactcgccgcgcgtgtgggcgtacagccccagcacgtccaggcagttgcccatgccccagcggtccccggtcgcccggaaccccgtaagcgccgccgagaccagctccttcgcccggtcgggccggcccgcgaactgcgcctggaatccgagccccatgtccagcagcgcccgcgcccacgggtcgtcgccggcctgcctcagcgcccgctcgttggacgcgggcctgggaccggccaccacggaccacagcaccaggatgtacggcagccgcagcgggcccccgcaggcgtccaggacgtcgtccacgcgcgcgcggagccgttcgtcggcggcaggatcaccgccgtcgccggagagcgcgttcatcgcgcacagggcgtactcctccggcagacccggcggtggcacctcgcccaccgcggccagcagtgcgcgggcggtgggcacctgctcgccgtgcagcccgcgcagccgccagaaccacgacagcagggccatcaggcgcagggcgcccgcgtggtcccggcggacgaggtggcgcagcgccgcgtccaggtcggcgtgctcggcggccagccgggccagccagggcagctgtccggcaccgcgcagagcgggctccgcccgttcggccagccgaaggaagtacgcggcgtgcgcgtcccgcagcccgtcccgcgccccgtccgtcccggtctgcgccctgcccgcctcggcctgctccct

SEQ ID NO: 983 - DNA, 4333 bp, Unknown
  Kingdom: Bacteria, Phylum: Actinobacteria, Class: Actinobacteria, Order: Streptomycetales, Family: Streptomycetaceae, Genus: Streptomyces
gcgccggacggtccaccagcagccggtgcgcgaccgcgcgcgggttggcgatgcccggcagcggcagcttcttcggcagcgtggagatcggctcgaagtcgtcgcccagcgggtggcccggcagcgactccagcttcttcatcacggtgcgcccgatgtgccggaacgtcgtccacttgccgcccgcgacggacagcatgccgcccttgccctcggtcaccaccgtctcgcgcttggccttggcggtgtcaccggggccgcccggcagcacccgcagacccgcgaaggcgtacgtgatcaggtcacggtcgagctgctggtcgcggatggagaacgcggcctcgtcgagtatctgggcgacgtccttgtcgttgaccgccacgtcggccgggtcgccctcgtactcctcgtcggtggtgccgagcagcagcatgtcctcccacgggagggcgaaggtgatgcggtacttgtcgatcggggtcgccagcgcggccttccacggcgcggtgcgcttgaggaccaggtgcgcgcccttggacaggcggatggacggcgccgcgttcgggtcctccagcttgcgcaggtggtcgacccacgggccggtcgcgttcagcaccagccgggcgtccaccccgaactcgtcgccacagagccggtccttcagctcggcgccggtgacccgccccttggtgaagcgcagcccggtgacctcggcgtggttgaggaccaccgcacccgcctcgacggccgcgcggaccgtcatcagcgccatgcgcgcgtcgttcatctggtcgtcgccgtacacggccacggccttgaggttctcggtgcgcagctcgggcacgtcctgcgcggccttcgccgggctgagcaggtggcccacgccgtcaccgaacgcggagagcgcggagtaggcgaacacgcccgccccgagcttcgccgcgccgtgcggcccgcccttgtacacggggaggtagaaggtgagcgggttcgccaggtggggggccacctggcgggagaccgcacggcgctcgaagtggttctccgccaccagcttcacggcgccggtctgcaggtagcgcaggcccccgtggagcagcttggaggaggcggaggaggtggcgccggcccagtcgccggcgtcgaccagggccaccctgaggccggactgcgcggcgtgccaggcggtggagatgcccaggatgccgccgccgatcacgaggaggtcgtacgtcgccttggagagctgctcccgggtctcggcccggctcgggttcgagccggaggccgggtgcgtccccagggcaggcacggactgcagggtggactgactggtcattgcggttcttactcctcgtcctcgagccagcccatggtccgctcgacggccttgagccagctcttgtactcacggtcgcgggtgtccgcgtccatgcggggggtccattcggcggcccggcgccagttctggcgcaggtcgtccgtggaggcccagaagccgacggcgagaccggcggcgtaggcggcgccgaggcaggtggtctcggcgaccatcgggcgcaccaccggcgcgtccaggaagtccgagagcgtctgcatcagcaggttgttggaggtcatgccaccgtcgaccttcagcgccgtcagctcgacaccggagtccttggtcatggcgtccgcgatctcccgcgtctgccaggcggtggcctccaggacggcgcgcgcgaggtgcgccttggtgacgtaccgggtgaggccggcgatcacgccccgggcgtcggagcgccagtacggggcgaacaggccggagaaggccggcacgaagtaggcccctccattgtcctccaccgacagcgccagcgtctcgatctcggcggcggtggagatcaggcccatctggtcgcgcatccactgcaccagggagccggtgacggcgatcgagccctccagcgcgtagaccggcttctggtcgccgatctggtagccgaccgtggtcagcagcccgctgtaggagttgatgatcttgtcaccggtgttcatcaccatgaacgtgccggtgccgtacgtcgacttcgtctcgccctcggcgaaacaggtctgcccgaacagggccgcctgctggtcgccgagcgcggaggcgaccgggatgccgccgagcaggtcgcccagccggccgcccttgatctcgccgtagacctcggcggaggaacggatctcgggcaggatccgcgtcggcacgccgatggactcggcgatccgctcgtcccactccatgctgtgcaggttcatcaggagcgtgcgggaggcgttggtgacgtcggtgacgtgccggccgccctccacgccgccggtcaggttccagatgacccaggtgtccatggtgccgaagaggatgtcgcccgcctcggcgcgctcgcgcagaccctcgacgttgtcgagcagccagcgggccttggggccggcgaagtaggaggccagcggcaggccggtctcgcggcggaagcggtcctggccgacgttgcggcccagctcgcggcagagggagtcggtgcgggtgtcctgccagacgatggcgttgtggacgggctcaccggtgttcttgtcccacagcacggtggtctcgcgctggttggtgatgccgatggccttgatgtcgtcgcgggtgatgccggccttctcgacggcgccggcgacgacctcctggacgttggtccagatctcggcggcgtcgtgctcgacccagcccggcttggggaagatctgctcgtgttccttctggtcgacggagacgatccggccgtcgcggtcgaagacgatgcagcgcgaggaggtcgtgccctggtcgatggcggcgatgaagggtccggcggtgtgggcgtcggtcactgtctgctcctgaggtccgtggtcagtggggctgcgcgtgcggggcgcggtgcgggccggcgcccgccgcgaagacgcggcgagcgccggccgtcaggcgaaggcgacgttgtagacgcctccggcgatggccgcgccgatcagcgggccgaccaccgggatccacgcgtagccccagtccgagccgcccttgttgggcagcgggaggagggcgtgcacgatgcgggggccgaggtcacggaccgggttgatggcgtagcccgtggggccgccgagcgagaggccgatggagacgaccaccaggccggtgatcagggcgccgatgacgccgaggccgttgcccttgtcgttcaggccctgcgtgaggatcgcgatgatcagcacgaacgtgccgatgatctccgtgatgaggttctgcaccacgttgcggatctccgggccggtggagaagacgccgagcacggggccggcgcccttctcctgcgcctcgaccgccttggcgccggtcgcctgggcgccgggtccgccgacgatctccttgtcggtcaggtgcgcctggaactggccgtagtaggcgccccagacgagcaccgcgccgatcatggcgccgagcagctggccggcgaggtaggtcggcacgttcgtccacacgccgtccttgatggcgatggcgagcgtcacggccgggttgaggtgggcgccggagagcgggcccgatatgtacgcggccgtcatgaccgcgaagccccacccgaaggcgatggcgagccagccggcgttgcgggccttggaggccttcagggtgacggcggcgcagacgccaccgccgagcaggatgagtatggcggtaccgatggtctcgccgatgaagatgtcggagctggacacccgcgactcctttgtccttcgtccaggggtaggcgaaccccgggtccctccgggggtctggtgccctcggggtgagagcgatgccggcccttggcgctgtcacactctaacgcgcttttccgcaaggtgttcgacaatgccgaccgatggacgcgagtctcaccttgtcgtcacacgggcgtcaagagttctgttacccaaagcacgatcgttactgaacgtcccgcgccgcacgcacggaacaccccccgcggaacaccccagcggaacgccccgcccggaacggcccgagcggcgtggcggtgcgcgggcacgcgaaaggccggcacgcgcgtgcgtaccggcctggcgccccgccgggggtgcgggtgcggggaagggcttctacggcgctcagaaccgcccggcgcccaggtcccgggagaccgcgcgggcgcagtcgcgcaccgccgctatcagctccgggcgcagctcgccctcccggcacagccgctccacggcgccggtgatgccgaccgcgccgaccggcatccgccgccggtcgtggatgggggcggcg

SEQ ID NO: 984 - DNA, 6961 bp, Unknown
  Kingdom: Bacteria, Phylum: Actinobacteria, Class: Actinobacteria, Order: Streptomycetales, Family: Streptomycetaceae, Genus: Streptomyces
ccgggccgtgtcgcccaccgggccgtgtcgcccaccggtcggccgtggtgccctccggtcggtcggccgccgtctgaacgacccctccggccccacccggacccatgcgcccgaccggcgcgccgccagaccgccccgcaggcctacctgtggcctctcggcctgtggccgctcggccgctcacccgcaccgttctgcgcgcccgcgctcgcccccgcgtgcgccgtccggcggtcgatcacccggcggccgttcgatcgcccctgggtcgatcggtcggtccgaggccggctggacgtcctctgtcggtcgtcgtaggaggctccaaactcctgcacgtgcgtgcagggcgatcacgctattccgcgtcctcgcgcgcgtgcggcacgatgggagcatggcaccgacccacgatcaccccggcgagtacgccgcagacgaccccatcaagctcatcggcatccgggagaccgcgctctccctggacgaggtcttccgggccgtcggggacgacgcggccggcgggacggcactgttcgtggggaccgtgcgcaaccacgacggaggcgccgacgtcgacgagctggggtactccagccaccccagcgccgaggccgagatgcggcggatcgccgagaaggtcgtggccgagtacccggtgcgggcgctcgccgccgtccaccgggtgggggatctgaaggtcggggatctcgcagtcgtggtcggcgtgtcgtgcccgcaccgcggtgaggccttcgaagcctgccggaagctgatcgacgacctcaagcacgaggtgccgatctggaagcaccagaagttctccgacggtacggaggaatgggtgggggcctgctgacgcgaccccggttgcgtaaccggcaccctggcccgagcgttgtcagtgcggatggttaatctgctgatcagtcactcgcggtcgctcgattggggtagggaggtcggcatggcagcgctcgcctggttgctgattccgctcgtggcggggatagccgccggtctgtgggggagctggtcgaaccgcacccgcaagatccgcagcgacggccccgagctggacgggtacaaccgcttccgcgaggccatggagaggtccacgtccgggacctgaccacccggccgggcggggagggcgtacggccgccctgacggtgcgccgacaggcccgtcccgtactgtcgagtcatgccacgccgcaccgcgacgatgctcgcctccaccctgatgctgatcgggctcctgtgcgcgggagtcttcctcccggtgccgtacgcggagatgtccccgggaccgacggtcaacacgctcagcgagcacgacggcgagccggtgctgcagatcagcgggcacaagacgtacccgacggacggccatctgaacatgaccaccgtccgggtcaccagccccgactaccggatgaacctcgtggaggcggtctacggctggctcgcccacgacgacaagatcgtcccgcacaacacgctctacccggacggcaagacggagcagcagtccacccaggagaacgccgaggagttcagccagtcccaggagagcgcgaaggtcgccgccctgaagcagctgggcatccccgtgcagacctcggtgatcgtctccaccgtcgtcaagggcacccccgcccagggcaggctgcacgccggcgacgtcatcaaggccgtggacggcaccccggtcaaggagcccgcagacgtcgccaagctggtcaccaagcacaagcccggtcaggacgtcgtcttcacggtcgtgcccgccaaggaccaggccgccgccgagaaggcgcacaagacggcgacggccaccaaggacgtcaccatcacgacggcgcagtcggacgacgccggtgccaagcgggccgtcgtcgggatctccgcggggaccgaccacaccttcccgttcacgatcgacatcaagctcgcggacgtcggcggccccagcgccggtctgatgttcgccctcggcctctacgacaagctcaccccgggcagtctgaccggcgggaagttcgtggccggcaccgggacgatcgacgacgacggcaaggtcggaccgatcggcggcgtcgagctgaagaccatcggcgcgcgggacaagggcgcgcagtacttcctgacgcccgccgacaactgcgccgccgccgcacaggacaagccgtccggactgaccctcgtcaaggtcggcaccatcggcgacgccctcggcgccctcaaggacatccgctccggaaagaccgccgacctgaccacctgcacgaccaagggctgaacggcccaccgcgcacggctcacgaccgccacgcccgaacctggaacggccggcggcacaacctgaagggcctggcccccgccctctcggcggcacaaccgtcaagggcctggccgccgcccctcccggcggccaggaacggtccgtcgctcagtcctcgaacgtcgccgccagcgcctccgcgagccccggcaccagcccggagccggtgaggacctccgtggcggagtccttctcccgcaggcgcagcgccgagtcccgggagccgtcgcgcagcaccgcgaccgtcatgcggacctcctggcgctcggggtggccggccacccactcggacagcttggcctcgttcagcccctgcgggacctgtgcctcggcggacggcggcagcatgaggcgctccacggtgagcgcacagccggccaccgcgtcgggccaggcgatcgtggcgaggaactcgtcgagcgggcggtccgcggggacctcgtcctgctcgatcggggtgagaccggaggtctcctgctcgtcctccaggccgagctgggccgcgagggcgggttcctgggtccgcagccgtgcggtgtcgacgagggcgaagaggcgggcgggctggtcccagccgaggccggaggcgtactcgtcgatctcgagcacggcccgggtgagcgggttcgctgccatgggagtgttggacatggtcacaatcctgcctcgttcccggcccggatcgggaaccgaataaacggtgagtaagttgcataggtgtgcgcccgcgatccgcgggcgcaccgtacggtccgcggacacgggggcctgacgcaaccgacagcgaaccaccagcgaacttcgaggtgcgcaccttggctttccagatgccggaccgcggcggaggcccgtccgggccgcggatcagagtcggccgcccgtcccggcgagcccggaccctgctcatgacactgggcgtccttgccgctctcggcatcgcgttcacgatgttcgcgggcttctggacggactggctgtggtaccggtcggtgcactactcgtccgtgttcaccaccacactgtggaccaagatcgggctgttcttcgtcttcggcctgctgatggctgcggccgtcgggttcaacgtctggctcgcgcaccggctgcggcccccgctcagcgccatgtcgatggagcagcagaacctcgaccgctaccggatgggcatcgcgccgtacaagaagtggctgctgtgcgggatcacggccgtggtgggcctgatcgcgggagcctccgccgccggccagtggcggacctggctgctgtgggtcaacggcgtgccgttccacaagacggacccgcagttccacctggacgtctcgttctacgccttcgacctgccctggtaccgcttcctgctgggcttcggcttcgccgccacgatcctgtccctgatcgccgcggtgctgacccactacctgtacggcggactgcgggtcaccagccccggcgcgagggccacggcagcggccaccgggcacctgtcggtcctgctcggcgtcttcgtggcgctgaaagccgtcgcgtactggctggaccggtacgggctcgcggtcaagtcgagcgacttcaaggccaccggcaactggacgggcctgaggtacgtcgacgccaacgcctacctgccggccaagacgatcctgttctgcatcgcggtcatctgcgcgctgctgttcttcgccacgctgtggcggcgcacctggcagctgcctgtgatcggcttcggtctgatggtgctctcggcgatcctcatcggcggcctgtacccggcgatcgtgcagaagttccaggtccagcccaacgagcaggccaaggaagcgccgtacgtcgcgaagaacatcgaggcgacgcgcgaggcgtacggcatcgaccacaccgaggtgtccgactacgacggcacgagcagcaccaaggacaagtcgacgctgcgtgatcaggtggacaagacggcgagcgtccgcatcctcgacccgaacatcgtctcgcccaccttccagcagatccagcagatccgcggcttctacaccttcccgaacaacctggacgtcgaccggtaccccaccaaggacggcaaggtccaggacacggtcgtgggcctgcgtgagctgaacttcgacggcatcaagaagaactggatcaacagccacttccgttacacccacggctacggcgtggtcgcggccaagggcaccgaggccagcaacggcgagccggtcttcaccgagaagaacctgccgtccaccggcgacctcggcacgtacgagcagcgcgtctactacggtgagaagacgaccacgtactcgatcgtcggcggtccccagaaggagatcgactactcgaacaacgacggcgagaaaacgaccagttaccagggcaagagcggcgtcagcctgtccagcccggtcaaccgggcggcgtacgcgctggcgttcggcgagccgcagatcctctactccggcgcgatcggcgacggctcgcggatcctgtacaaccgcacgcccaaggagcgggtcgaggcggtggcgccctggctgaccatcgacggcgacgcctacccggcggtggtcaagggccgcatccagtggatcgtcgacgcgtacacgacgaccaacgggtacccgtacgcctctcgtacgacgctcggcgacaccacggcggactcgctgacgtacaacaacaaccagcgcgcggtggtggcccagcagaaccaggtcaactacatccgcaactcggtgaaggcgaccgtcgacgcctacaccggcgaggtcaagctgtaccagtgggacacccaggacccggtcctcaagacctggatgaaggcgttccccggcaccgtgcagccgaagtcggccatctcgtcccagctgatggagcacctgcggtacccgcaggacctgttcaaggtccagcgcgaactgctcacccgctaccacgtgcaggacgcgcagaccttcctcagcagcagcgaggtgtggcaggtgcccgacgacccgaccaacaagtcgggcaacgcggtgccgccgtactacctgaccatgaagatgcccgaccaggcctcccaggcgttctcgctcacgacgacgttcacgcccaacggccgggacaacctcagcgcgttcatggcggtcgactcgcaggcgggcacgcccgactacggcaagatcaggatcctgaagccgagaagcacgacggtcggcggccccaaacaggtgcagagccagttcaactccaactcctcgcagaacatcgccgagttcgtgaagctcatcagaggcggtgactcggagatcgagtacggcaacctgctgaccatcccgctcgacggcggattcctctacgtcgaaccggtctacgtgcgcggcgggcagctcaagtacccgctgatgcgcaaggtcctggtgacctacggcggggccaccgccttcgaggacagcctcggccaggccctcgacaaggtcttcgggacatccggctccgcgaatccgccgccggacacgggaaccggcaccggcaacccgccggcggcgggcaacccgacggtccagcaggccctgaaggacgcccagagggcgttcgacgaggggcagaccgcgctgaacgagaagccgaccgactggcaggcgtacggcaaggcgcagaaggacctgcaggacgcgctcaagagggccgaggacgcccaggccgaggcccagaagcagggcaagagcagcggcaagaacggcaaggacaagggcgggaacggaggctgaccgttcctgatcgcgtcggaggcccggatccccgtgcggatccgggcctccgtggtgtgcgaacgcatgtgccgacctgccggaccgccgtgccgacgtggggagttgggcgatctgtgtttgacttgtctctctgtgggcatgtcgacaaaacgctgaagtgacctcactggctgcggtataccaggtgtacccaggttgcaggtggtgcgacgatggacgttatgggggacaaggtaactctgttcgagacagggcgatttgtgcagacttccgaccgcgggccgaccgaggggcccgaggacaccggaagcgcgaacccgtacggaaccggcgccgaccttgccggtacgggccctgccggtacgggccctcccggttcgcaccgggccggcaccggctcggcggccccggagccggccgtcgcggacgagaccgcctcggacgggaccggaacggacatggccggcggggacgggaccggcgcggacgtggccgacgcggacgggaccggtgcggtcgccgaagaggtcgccgagctggcgcgccgccggctcgccgccgaggccggtgacgtcgaggcgatgagcgtcctcggggccatcggtcggcccgcggtcggaagtctgcacaaatcgccctgtctcgaacagagttaccttgtcccccataacgtccatcgtcgcaccacctgcaacctgggtacacctggtataccgcagccagtgaggtcacttcagcgttttgtcgacatgcccacagagagacaagtcaaacacagatcgcccaactccccacgtcggcacggcggtccggcaggtcggcacatgcgttcgcacaccacggaggcccggatccgcacgggg

SEQ ID NO: 985 - DNA, 6685 bp, Unknown
  Kingdom: Bacteria, Phylum: Actinobacteria, Class: Actinobacteria, Order: Streptomycetales, Family: Streptomycetaceae, Genus: Streptomyces
tgcgcacggacggcgggtgccggtgacggcgcccaagacgggcacgggccgggcgtactgcgcggctccggtgctggacacggcggcggcggtgctctcgatggagcacggtctgatcccgccgacccccaatgtcttcgacatctgccatgacctcgatctggtgaccggccgcgcgcgtgccgcgcaggtgcgcacggcgctggtcctgggccgggggctcatgggctcgaactcggcgctggtgctgcggcacggcaccgccgacgccgcctaggtcctgacggcagggtcgggtggcgccgggagctgcacgccgggagcaacaaggagaggaacccgcatgagtgaccgaatcaccgtggaagaactgtccgaactcatgaagaaggccgccggcatcaccgtcagccccgaggaactgacggaccgggccgacaccggcttcgacgagctcggcatcgactcgctcggcctgctcggcatcgtgggcgaactggagaaccggcacggtatgccgatgccggccgacgcggagcgctgcaagacgccccggaagttcctcgacctcgtcaacagcacccttctggcaggagcctgacatggctggacacacgcagaacgagatcaccatcgccgcaccggtggacctggtgtgggagatgaccaacgacgtggagaagtggccgcagctgttcagcgagtacgcctccgcggagatcctcaagcaggagggcgccaagtgcaccttccggctgaccatgcaccccgacgagaacggcacggtgtggagctgggtctccgagcgtgagccggaccgggccacgctgacggtgaaggcccgccgggtcgagaccgggccgttcgcccacatgaacatccactgggcctacgaggaggtcccgggcggcacccggatggtgtggacgcaggacttcgcgatgaagcctcaggcgccggtcgacgacgactggatgaccgacaacatcaacaagaactccaaggtccagatggagctgatccgggccaaggtcgagcaggcggcggccgggcggcggcccgagccggccctgaccaccgactgaaccggaccggacgacaggagcggatccatgcaccaggccctgatcgtggcccggatggcgccgggctcggcgccggacatcgccaagatcttcgaggagtccgaccggggggagctgccgcacctggtcggtgtcacgcggcgcagcctcttccagttcggcgatgtgtacatgcatctcgtcgaggcggaccgggacccgggcccggccatcgccaaggtggcggggcacccggagttccggggcatcagcgaacggctgtcgtcgtacgtgagcgcgtacgaccccgagacgtggcgttcgccgaaggacgcgatggcgcggcgtttctacctctgggagcgtgacggccgcggctgacgccggagccggaccggtaccaggagcgtcgtacggggatgtcgtgcgacggacggacaacggccgccggacccgcactgtggcgggcccggcggccgtcgtcgcgtgtggtccgctggggtgtcaggcggggacggtgcagtcgaaggcgtgcaggtaggggttgaccgggctgatgtcgtcgatgaccaggccggccgcctccaggcggctcaccatcgactgggtggtgtgcttggcgccgccgacgttgagcagaagcagcaggtccatggcggtgctgaaccgcatcgagggggtgtcgtcgacgaggttctcgatgacgacgacccgtgccttggcgccgccggcctgcatgacgttgcgcaggcagcgggcggtggagtcgtcgtcccactccaggatgttcttgatgatgtagacgtcggcgtggacggggacggcctcgcggcagtcgccgggcacgatgtccacgcggccggcgagcgagccgccctcgcgcagcctcgggtcggcgttgtcgacgacgcgcggcaggtccatcagggtgccgtgcatccgcgggtacttctccagcaggctggccacgacgtggccctggccgccgccgatgtcggcgacggaggcggcgccggacaggtcgaggagttcggcgacgtcacgggcggactgcttgctggaggtcgtcatggcccggttgaagacgtccgccgactcgggggcgtcctcgttgaggtagacgaagaactccttgccgtacaggtcctcgacgacgttgcggccggtgcgcaccgcctcgtccagcttgggccaggcgtcccaggtccacggttcggtgcaccacagggagatgttgcgcaggctgttcgggtcgtcctcgcgcagcagccgggacatgtcggtgtgcgcgaaggtgccgtcggggcgttcctcgaagacgccgtagcaggccagggcccgcagcaggcggcgcagcggcttgggttcggtcttcaccgcggcggcgaggtcctcggcggtcaggggggtgtcgccgagtgcgtcggccacgccgaggcgggccgcggcgcgcagggcggcggcacatgccgccccgaacacgagctccctgagccgcatggacggcggtggggcggtctgagcggtcgtcatgtgccgccttccttccttcggtgtgcacgggtggtgtgcgggtgatgccgggtgtgcgggtggtgagcggtggcgtgcggctcagcacagccccgcgggcttggaggcccggcaggagttgtggctgaaggtgttgccgcgcttggtgctctcctggttgaccaggtcggcgggggcgttgccggacaccgcgttgtcggcgatccggttgttgtcgctggtggcgccgacgaagctcttgaacaggacgatgccgccggacagcggggacgtgcccgagttgccgctgaccaggttgtcggtgacctgggtcttctcggcgccggtcaggacgatgccggagccctgcaggaacggcagccggtcggtcttggcgcagtacttgttgttcttcacgacgcggttgtcgcgcacggtcagtgcgccggccttcggcttgttctcgtcgccgacgacgaagacgcccgcgcagttgccggtgacctcgttggcggcgacggtgaggttgcgcagccggcggacggtgacgccgatccggttgcccgccaccaggttgtgcgcgatcagcgtttccttgctgtcggcggcgccctgttcggcggtgatggtgttggcgaggaagatgcccgcgtcgccgttgtcccgggcgacgtcgcgctcgtaggtgctgtgctcggagcgttcctcggcgaagccccagacgccgttcttgtcggaggtcacgtgccgcacggtcaggccgtcggcgcccacggagaccatgccggcgcgggagtagccggtgaggaccaggtgggagacggtgacgcccatgaggcgcttggtcttggtgcccgccacgcagatgccgttgccgcgcttgccgcagtcgtccgtcgccttggtggccggctggaggacggtggagctgccggagccgcgcagggtcaggccgggcgtcgtgatcttgacgctctggtggtaggtgccgggcagcaccagcacggtgtcgcccggctgcgcggcgtccaccgccttctggatcgattccccggggcggaccaggtgcgtggtcggcaccgagaccggcgcggcggcggccacgccggagccgacgagtgctgcggcgcttaccagcagggagatgtggcgtttcgtcatattctgtacgctatgacctgatgacccgctggactgcccgatgggccatccggcggcgtgtcacacccgcgcggcggcggccggtgtgcgccgactcgacctttacgaggtcgagttcaggcgcgcagcatgcggccgatctccagctgtacggcctccggcggacggccgtcctcgatctcccacaggcagttctgcagcacccgcccgagcgtccaggcgcgcgcccgctgccggtccaggccgagccgcgcggtcagcgcgtcgaaacgccacagggtctcggcggggtcgtagcggttgtcgagcgcgggcatcaggtcgaagccggggtcgccggcgagcggcttggggtcgatggcgagccagggcgcgcggcctgcggcgaggacgttgtcgtagtgcaggtcccagtgcagcagccggtcgccgggggcgtccgcgacctcgcggccggccgccgcgcagtcggcgagcagccgccggtcggcggcgtccggcacccgggtcagggcccacggcacctgttccagcatcgcctgggcgatgtcacccagccgccgtactcccgccggggcgcgcaccgcggtgagccgcgcgaggagcccgccgatcacctcgacggccgcgcggctgtccggcagcgccgacagcatccgggattcgtccagtcgttcgaggaggagggtgcaggtgggttcgtcgtgctccagcagccgtacggccccgtcgccgtcccaggcgcgcagcgcgaccggctcgcccgcgctctcctcgtccagcggctggagcttgagggcggccggtgtccctcccccacgctctgacgagcagggggcgcccccggcccgtaccaccggaaggaccagcgcgcacaccccgtacatcggcgggccgtccaggcgcagctcccagtgcgccaggaagcgggccgcccgctcgggcagcccggcgacgaacgccctgcccgccgctccgttgaacttctcctgcgtagcggccagctcggcgggcacctcgatcaccgtgccgaccatacttgccggtgtgagcggggtcatccggtttcggcgcgggctttcggcggcggcggcgtacgtgcgcgccgcgccggggacgtacgtctggctgctgatcctgttcgtcaccaccgtcgccctgcaccacatgtcgccggatttcgaggaggacttcctgcggcagcgctcgacgaacatccacgagctgtcggacaacccggtgcgggtgctgttcgccagcgccatgtggatcccgagcgggcgctggctgccgtacgccgtcctctactcgctcttccacgcgcaggccgagcgctggctgggcaccctgcgctggctgctggtgtgcgtggccgcgcacgtgctggccacgctgatcagcgagggcgcgctgctgtgggcgatcggacgccatgtggcgccggagtccgcggtcaacacgctggacgtcggcgtcagttacgcgctggccggggtggtcggcgtgctgacctaccggatccgcagtccctggcggtatccgtacgccgccgcggtgctcgtcttcttcggcgtgccgctgctggccgggcgcaccttcaccgatctcgggcatttcaccgcggtgctgatcggtctggcgtgccggccactggtcaaagccgcgggaaaagcacggaatccgaaggagacaccggccccgaccaggcgttaacgtccggccatgagcagctcggcaaggagtgccgcgagcggcggcacaggcaacggcggcgtcgtgaacggcggcatctccttctggttcgcggacgacggcatccccgccgtgcgcgagccgctcaccggcgacgcgagcgccgacgtggtgatcgtcggcggcggctacacgggactgtggacggcgtactacctgaagaaggccgcgcccttcctgcggatcaccgtcctggagcagaagttctgcggctacggcgcctccgggcgcaacggcggctggctctacaacggcgtcgccggacgcgaccggtacgcggcactgcacggccacgaggccgcggtacggctccagcgggcgatgaacgacaccgtggacgaggtgatccgcgtcgccgccgaggagggcatcgacgccgacgtccacaagggcggcgtcctggaggtcgcccgcacccccgcgcagctcgcccgcctgaaggccttccacgagcacgaactgtcctacggcgagaaggaccgcgagctgtacggcgcccgcgagaccgcggagcgcgtccgcgtcgccgacgcggtcggctccacctggaccccgcacggcgcccgcctgaacccggccaagctggtcaagggcctggccgccgtggtggaggcgctcggcgtgacgatccacgaggcgaccccggtcaccgagatccgccccctgcacgcggtcaccccgtacggcaccgtccgcgccccctacgtgctgcgctgcaccgagggcttcaccgcctccctcaagggccagcggcgcacctggctgccgatgaactcctcgatgatcgccaccgaaccgctgagcgaggcgcagtgggcgcagctcggctgggacggccgcgagaccctcggcgacatggcgcacgcctacatgtacgcccagcgcaccgccgacggccgcatcgcgctcggcgggcgcggagtgccgtaccgcttcggctcgcgcaccgacaacgacggccgcacccagcgcgagaccgtccgcgacctgcgcgacatcctcgtcggcttcttcccctccctggccgggctgcggatcgcgcacgcctggtccggtgtcctcggcgtcccgcgcgactggtgcgcgaccgtcaccctggaccggtcgagcggcctcggctgggcgggcggctacgtcggctcgggcgtcgccaccaccaacctggccgcccgcaccctggccgacctggtccggct

SEQ ID NO: 986 - DNA, 1128 bp, Unknown
  Kingdom: Bacteria, Phylum: Actinobacteria, Class: Actinobacteria, Order: Streptomycetales, Family: Streptomycetaceae, Genus: Streptomyces
ccccgtccccgggaagcgaccgtgaccatgcccgacgaccggttcacgccccgcgcgcagcgtcccgctcccggcgaccgcgccccggcccccgtccgcatcctcctcgccgacgaccacgcgctggtccggcgcggtgtgcggctcatcctcgaccaggaaccggacctggaggtcgtcgccgaggccggtgacggtgcggaggccatcgagatggcccgcacgcacgccgtcgacctcgcggtcctggacatcgccatgccccggctgaccggcctccaggccgcccgcgaactggcctccctcaagccggacctgcgcgtcctcatgctcacgatgcacgacaacgagcagtacttcttccaggcgctgaaggccggggcctgcggttacgtgctgaagtccgtcgccgaccgcgatctggtcgccgcctgccgggccgcgatgcgggacgagccgttcctgtacccgggcgcggtgaccgcgctgatccgcaactacctggaccgggtgcggcacggggaggagacccccgaccaggtcctgacaccccgtgaggaggaggtcctcaagctggtcgccgaggggcactcgtcgaaggagatcgccgagatcctcttcatcagcgtcaagacggtccagcggcaccgcgccaacctgctgcacaagctgggcctgcgcgaccgcctcgaactcacccggtacgccatccgggccggcctcgtcgagccctgaccgccgcacgggcgcggacccgtccccgtacgaccacgtcccgcaccgctcccacgaccacccgggatcccggccgcctactccccggccgggatcccgggtacgacagccgccgaccggcccgcaggaagccgcagggaagccgcaggaaggggaacggcgcatgcccggcgcaccacgcaccgccaccgtccccgtccgcgctctccccgctcttcccgctctcctcgccctgctgaccgcagccctgctgctcctgttccccgccctccccgccttcgcggcgggcgacacgcccgcgcagcggtcccagcccaccgcttctcacaccggccggcccgctgaccgcggcgacgacgacgcccatccccacgccggcaccgcctgccccac

SEQ ID NO: 987 - DNA, 4242 bp, Unknown
  Kingdom: Bacteria, Phylum: Actinobacteria, Class: Actinobacteria, Order: Streptomycetales, Family: Streptomycetaceae, Genus: Streptomyces
  misc_feature (278)..(317): n is a, c, g, or t
cgcgtggctggctccggacaccacccccgagacggtcctggcggggctcaccgccgtcacggcggaagccggccgggccaccgccccctacgccatcgaggcccgcgtacgactcagccaccgcacccaccgcgcgcggcatgtccactgacgtgccccgcacccgccgccgtgccacgcgccgcacgcgcaaccacccggtccgcacctggtggccggctctgcgccgcaccccggtgtccatgtggaacgacgacatcaccgactacgccgccgcnnnnnnnnnnnnnnnnnnnnnnnnnnnnnnnnnnnnnnnncgccttcgggctgatcagccccggcaccgccgaggacttcatcgcccacgtcaccgactacgcaccgggccagtccggcgccgagctgcacggcgtgctcgaacggatgctcacccagcagtccgccatctggaccctgctcgccaccggctccgcgagcgccctgtggtcggcctgcagctacctcgccgtcttccgccgcgccctgcaccgcatgcaccgcacgaccgaccgccgctcaccctggcgcaaggcccaccggatcgtgctcaccgccctggtcctgctcgccctgctcgtcgtcagcggcctcgtcctcgtgctcagcgcaccggtcgccggagcactcggccgcgtcctgcacctggacgccaccaccgcgttcgtctggagcgtggcccgctggcccgcgctgctctgcctggtggcgctgctggtggtggtcgtcttccacaccggccccgcctccgcgcgccgacgcgcccacagcctgcccggcggcgccctggccgccgtcctgtggctgacggtctcggcgggcttcgccctgtacgcctcgctcctgggcgcctacagccggctgtacggatcactggccggtgtcgtggttttcctcatctggctgtggctctccaacctcgccctgctcaccggcgcccagttcaccgccgaactggccaaggcccacaggtctgccacgatggcctgatgaaggacaacgcagagcgcgccgtcgcattcctggaacgtgcttcgtcaggacgggtcgaggaggcctacgagctcaccaagcccggcggcaggcatcacaacgcctacttcgccccgggctgggacgccctgaagcagggcatgctcgcggcctccgcccaggctcccgggcagcggctcacggtcgccaacgtcgtggcctccggagacatggtggccgtgcactcccacgtcgttccccggccgggtgacgccggcatcgccgtcgtccacctgttccggttcgaggacggaaagatcgcggaactctgggacgtgggccaaccggtggaccccgcctcgccgaacagtgacggcatgttctgacgccagggtccgaggtccggtggcgcgctcgcgcggggccggcgtccgctgcgtcaccccgggcgtcccccgtgcgtcaccctggaacggacgcggagtcgtccctggcgcgggccagcagggcgtcggcggccgggacggcttggaggccggggaggaccaggtgccacagggcggtcagccggtcctcgatgaggcgccgctcgtcgagcgcgtcggacaccgtgtgcaggccgaagaaggcggacaccagggtcgcggcgtcccgcgccggttcggccccgggggcgagcgctccttgcgtgcgggcctcggtgagcaggcgttccaccgtggcgatccagtccaggaaaggcgggggcatctccacgttgatcgaccggcgttcggcccacagacgtgcgcccgcgcgtacgaagacgtcgtcgcggaacgcccgtgcgaccgcgaagctgaggcgcacgaggttctcgagtgccggcgcgcccgcggcttcctggcgggcgatcagggagggccaggtggcgaaatgcgcctcgaccaccgcacgcgccagtttctctttgccggcgtaatggaaatagatggcaccgctcgtccgtgcggaccgttcgctgatgtcggcgatactggtcgccgcgtacccccgttcgaagaacaggtgcgcggctgcctgcaacactgccctgcgggtgtcttccgcccgttcgtgcacgcgtgttccttgcccttgggggagatcgcgaaggggaatatagcccctttgccgcaacgcccggaaggctcgacgtgccgaccggggaatggtctgattagcatcctgctcatgggctccgggcgcagtgcgcgcgcgccgcgtgtctcggacgggccacagggctgcggcgccggtgagacgtgcctggcgccgtccagctggtcccgtaccgtcccccgcgaactcgtccaccgtgtctcggtggccgaggttctgctgaccgacgtacggccctgtggccgccgcaccttctgcgccgccgcggtgtggccgcgttcccatccgacgttcccccgcggggccgacagccggcacagtccgtggatggtcgtcgagaccgtgcgccagctcggcatctacatcccgcagcgccacttcggcgtccccgccaccgacaggcccctgatcgacgacgtctcgtaccggatcgacccgggccgtgaaccgcgggcgccccgcggagccaccgagatcacctgcagggtctcggtcaccggcctggtcgaggagcccgggtcagggcgcgtggccgggatgcggctgcgagccgacttcctcaccggagcgcaggtgttcgcgcgtgcggacggcggcgcacgcttcctgacggccgagcggtacgcggcgatccgacagcccctcaacgccggtccgtaccccggctgccaccccgggccgcaccccggtcggcaccgtgccgtcaccggccgcccgcggccccagccggccctgctcggcacgtggtcggaggcggacgccctggtcgcgctgcacgacggcgccctggtcgtggaccccgccgacacccaccacccgttcctgttcgaccacgagacggaccacgttcccggaatggccctgctggaagcggcacgacaggccatcgccctgcgcagcggcgggcgcctgatccggccggtcggcgggcggatgaccgcggcgcggttcaccgaacacactccgccggccgtcgtggagggcaccgcccacggccgtagcgcggtcttccgcttccgtcagaacggtgcggtgacggccaacggcgtgctccgctacccctgagacgtcacccacacgtgggtattgcacctgcacactccgatcggcgagccggtcgagcgtaacgttcattatgtttccgatccggaaacaggacggtgcttccccacggcgccgtcctcgcccgtcgcgctgcctgcgggccgcgacaagacatgcttcgcgatttctcccagcgaagcaccggagcagcccgttcgggctgcggacgggcgccccaccgatcccgatcgcacccacgccaggaacggcgaagcacatgacgaaacatcacaccctcgacccggactgggcacccgaagcagtcgtcttcgactgcgacggcaccctcgtggactccgaacggcactgggaacgcgcccgtgccgtcgtcctgcggggcttcggccatgcccccgacccggagttcggcaggcggaccaagggcctgcactacatcgagtgcggtaccctgatggccgagttcatcggcagaccggactgcgcgcaggagctggcggaacagcttctggcggcgtaccgcgccctggtcgcacgcgacccggcgcccatgtcgggcgctcgggaactcgtcgccgccctgagccgcacggcaccgctcgccgtcgccagcaactgccccgcggacctcgtggagttcagcctggagtcggtcggcctgcgccaccacttccagcacgtggtcgtccccgagggccccatccggcccaagccgtacccggacacctacgcggaagccgtacggcgcctgggctcgaacggcgagaacgcgctggccgtcgaggactcggtcaacggactccgagcggccaggcaggccggactgcgcgtggtcggcgtcggtgcccggccgagccccgacgccctcggcctgtcctcgctgtgggtccgtgacctggaggaccccgcgctcctggcctgggccagcggtcttccgaacgcctcaggccggcgctccgccgccccgtccgagccgcacgtgccaccgccgggcgcaccgcccgacacggacaccggagccgtgcgctgacg

SEQ ID NO: 988 - DNA, 4915 bp, Unknown
  Kingdom: Bacteria, Phylum: Actinobacteria, Class: Actinobacteria, Order: Streptomycetales, Family: Streptomycetaceae, Genus: Streptomyces
gacgacgaggcccacgccgaggcagagcgcgccccccgacatctcgccggacagcgcgatcaccacggccgacagcagcacgaaggaggcgaccagcaggaccagcgcggccacgcccacccgccaggggccgggccggtaggggcgccgccagcgctctcggtcgtcgaacggcagcgcgacatcgtccgctgtgtcgaaggcacggtcggccgtcaggaagggcaggggcacggcggttcctcactcggtccacgcgggggctgtgcccggtgaggctatccggctgtgtcgcggctcaccacttgcgggggtccggctgagtggcccgatccccgagcgcccgagtcactgcctgtgtccccgcccgcgccggtgccggtgtcagcgcccgtgcgaggcctgctgggtctgcggcggagagtgcgtggtcgccagtgcgggcatccccaggaccagtgaacccacgagtcccgcgacgatggtcaggccgagcagacagcgcccggctatctgggccgccgacgcccgccgccggggcgggggagtgacattgctgcggaaccggtcggcctcggctacgaaggcgaacgggacgggctcacgccgacggaacatcgcggctacggctcccttcgggggtcggacggtccgggcggggacggttcaggaacgggttcggtgtcgaacgggtgcgtctcactcatacagacgcatgggtgtcccgaaaggtgcccatttccggaaattgactggggcgtgagtgcggacgggggcaggagtggccgcccacgtagagtgggcgccgcccgtcagacgtgaaggaagggaccccccgcaccgtgaccgacacccccgccgacgacccgaagcccagcttccgcagcgacgtcaccgtcgagctggtcaagcacaccgcgtcggacaacgacgtgctcttcgcggcccgcgtctcgaccatcggcgagcagtccctggacgagctgaacaaggacccggagcgctccaggggcctgatcaactacctgatgcgggaccggcacggcagccccttcgagcacaactcgatgaccttcctcatcagcgccccgatcttcgtcttccgcgagttcatgcgccaccgcgtcggctggtcctacaacgaggagtccggccgctaccgcgagctgcagcccgtcttctacgtccccgacgcctcccggaagctggtccaggagggccgcccgggcaaataccggttcgtcgagggcacgcaggcccagcaggaactggtcggccgcgtgatggaggactcctaccgccaggcctacgaggcctaccaggagatgctcgccgccggcgtcgcccgcgaggtcgcccgcgcggtcctgcccgtgggcctgttctcctcgatgtacgccacctgcaacgcccgctcgctgatgcacttcctcggcctgcgcacccagcacgaactggccaaggtgccgtccttcccgcagcgggagatcgagatggtcggcgagcggatggaggccgagtgggcgaagctcatgcccctgacgtacgccgccttcaacgccaacggccgggtcgcgccgtagcccgtgccgtcgcgcggaccgggtgtgcgcgcccccgcctttccacgggggcggagccggggaccgagccaggcactgatgtgcggatcagccgtgcgaagtgtccgtattgcggcatttatggaagttatctagcctgatcgaacggacccggcactgcttgaacccccgagcaggcagtgccgggctccacttttgtcccgacttgtcgcccgccccgacggcacaccccgccttgagcagcgagtagcgtgttacccatggctccgacctcgactccgcagacccccttcgggcgggtcctcaccgccatggtcacgcccttcacggcggacggcgcactcgacctcgacggcgcgcagcggctcgccgcccacctggtggacgcaggcaacgacggcctcgtcgtcaacggcaccaccggcgagtcccccaccaccagcgatgcggagaaaacggagctggtacgcgcggtcgtggcggccgtcggagaccgcgcccacgtcgtggccggcgtcggcaccaacgacacccaccacagcatcgagctggcccgcgccgccgagcaggccggcgcacacggcctgctgaccgtcacgccgtactacaacaagcccccgcaggagggcctgtaccggcacttcaaggccatcgccgacgcgagcggcctgccggtcatgctctacgacatccccggccgcagcggcgtcccgatcaacacggagacgatcgtccgcctcgccgagcacccccggatcgtcgccaacaaggacgccaagggcgacctcggccgcgccagctgggccatcgcccgctccggcctcgcctggtactccggcgacgacatgctgaacctgccgctgctctccgtcggcgcggtcggcttcgtctcggtcgtcggccacctcgtcacgcccgacctgcgcgccctcatcgaggcgtacacctccggtgacgtccagaaggcgaccgagatccaccagaagctgctgccggtctacaccggcatgttccgcacccagggcgtcatgaccaccaaggccgcgctcgccctgcagggcctgcccggcgggccgctgcggctgcccatggtcgagctggcgcccgaggagaccgaacagctcaagatcgatcttgccgccggcggggtacagctctgacacgagacttcgcgagacccctcgcaccgcccggctccacccggaaccacacccgggaaccgggcaccacaactgaacaagcaccgaaaccgcaggccaccggtgcctgcacaccacaatgacaactgcttctgcacgaacgtcacgcgcgccacgtgcccaccggtacgtggcgcgcgtggtgaggagggtcttttgagtcatccgcatcctgaactcgcgccgcccccgccgctcgccgacggaggcctccgtgtcactccgctcggcggtctcggagagatcgggcgcaacatgacggtcttcgagtacggcggacgcctgctgatcgtcgactgcggagtgctcttccccgaggaggagcagcccggaatcgacctgatcctgccggacttctcgtccatcagggaccgcctcgacgacatcgagggcatcgtcctcacgcacggccacgaggaccacatcggcggcgtcccctacctcctgcgggagaagccggacatcccgctgatcggctccaagctgaccctcgcactcatcgaggccaagctccaggagcaccgcatccgcccctacaccctcgaggtcgtcgaggggaaccgggagcgcatcggccccttcgactgcgagttcgtcgcggtcaaccactccatcccggacgcgctggccgtcgccatccgcaccccggccggcatggtggtccacaccggcgacttcaagatggaccagctcccgctggaccgcaggctcaccgacctgcatgcgttcgcacggctgagcgaagagggcatcgacctcctcctcgcggactccaccaacgccgaggtgccgggattcgtcccgcccgagcgggacatctccggtgtgctgcgccaagtgttcgccggcgccgacaagcggatcatcgtggcgagcttcgccagccacgtccaccgcatccagcagatcctggacgccgcccacgagtacggccgccgggtcgccttcgtcggccgctccatggtccgcaacatgggcatcgcacgcgacctcggctacctgaaggtgccgccggggctggtggtggacgtccgcacgctcgacgacctgccggaccacgaggtggtcctggtctgcacgggctcccagggcgaaccgatggccgcgctgtcccgcatggccaaccgggaccaccagatccgcatcgtcgagggcgacacggtgatccttgcgtcctcgctgatcccgggcaacgagaacgcggtgtaccgggtcatcaacggcctcacccgctggggcgccaacgtcgtccacaagggcaacgccaaggtgcacgtctcgggccacgcctcggccggcgagctgctgtacttctacaacatctgccgccccaggaacctgatgccggtccacggcgaatggcgccacctgcgcgccaacgcggaactgggcgcgatgaccggcgtcccgcacgaccggatcgtcatcgccgaggacggcgtgaccgtcgacctcgtcgagggcaaggccaagatctccggcaaggtccaggccgggtacgtctacgtcgacgggctctccgtcggtgacgtgggcgagcccgccctgaaggaccgcaagatcctcggcgacgagggcctcatctcggtcttcgtggtggtcgactccaccaccggcaaggtcaccggcggcccgcacgtccaggcccgcggttccggcatcgacgactccgcgttcggcgcggtcatccccaagatcaaggatgccctggagaagtcggcccaggagggcatcgccgactcccaccagctgcagcagctcatccgccgcacgctgggcaagtgggtctcggacacctaccggcgccggccgatgatcctcccggtcgtcgtggaggtctgacggtccgtaggaccggccgtacgactgtcctacggcagctcgtgtgcgcgaactggtggcggggcgcctcgatttgcatcgaggcgccccgctccagtacgtttacggctccgccaggacgggaacctggacgcctcgtgcgtaccggaggacgttcccggagaggcggaaaatccgactcagaacttctgataaagtcggaaccgccggaaagggaaacgcaaagcgaaagcggagcgggaacctggaaagcaccgaggaaatcggatcggaaagatctgatagagtcgg

SEQ ID NO: 989 - DNA, 2760 bp, Unknown
  Kingdom: Bacteria, Phylum: Actinobacteria, Class: Actinobacteria, Order: Streptomycetales, Family: Streptomycetaceae, Genus: Streptomyces
ctgctcaccggcggccgggccaagatcggcatgtacatcgcgctcaggctgctgcgcgacggcgcccacaccacgatcaccactcgcttcccgaacgacgcgatccgccgcttcaaggcccagcccgacagcgccgactggatccaccggctgaagatcgtcggcatcgacctgcgggaccccgcccaggtggtcgccctcgccgactcggtcgccgccgaggggccgctggacatcctgatcaacaacgccgcccagaccgtacgccgctccccgcaggcctacagcgaactggtcttggcggagtcggccccgctgcccgccggtgagctgccctcggccgaggtgatcggcaccttcggctccggcgcggtcgccgccctgccggtggcgggctccagcgcgctcaccgccgaggacgtcaccgggctcgccctggtctccggctcggcctccctggagcggatcgccgccggaacggccatcgacgcgggtggcctggtgcccgacctgcacgacaccaacagctggatccagacggtggacgaggtcacgccggtggaactgctcgaggtgcagctgtgcaactccaccgcgccgttcatcctgatcagccgtctgcgcccggcgatggcagcggcggcggcccggcggacgtacatcgtgaacgtctccgcgatggagggcgtcttcgaccgcggttacaagggcgccggccatccgcacaccaacatggccaaggccgccctcaacatgctcacccgcaccgccgcccaggagatgttcgacaaggacggcatcctgatgacggccgtcgacaccggctggatcaccggagccaagacccaccacttcttcgacaacgcccgcctgctgctcgggcagaacgtccaggccggcgacaagatcacgctggaggcggcgaacgtccaggtcaccgtggacgtcgccgacttcgagcaggtcgcgccggccgccgcccagcctgccggttcggtctccgtggtcgccaagggcgccgaccccagcggtcagggcgactccacccaggccttccgcgacgccgtgaacgccgcgcagggcggggtggtgtggatcccgccgggcgactaccggctgacgtcctcgctcggcggcgtgcagaacgtcaccctccagggcgcgggcagctggtactccgtcgtgcacagctccagcttcatcaaccagggcagctcctcgggcaaggtgcacctgaaggacttcgcggtcatcggagaggtcaccgaacgcaacgacggcagccccgacaacttcgtcaacggctcgctcgggccggactccaccgtctccggcatgtggatccagcacctcaagtgcggcctgtggctgaccgggaacaacgacaacctcgtcgtcgaggacaaccgcatcctcgacaccaccgccgacggcctcaacctcaacggcaacgccaggggcgttcgggtccgcgacaacttcctgcgcaaccagggcgacgactccctcgccatgtggtccctgtacgcaccggacacgaacagcagcttcgagaacaacaccatctcgcagcccaacctcgccaacggcatcgccatctacggcggcaccgacatcaccgtctcgaacaacctggtctccgacaccaacgccctcggcagcggcatcgccatctccaaccagaagttcatggaccccttcaacccgctcgccgggacgatcacggtcgccgggaacaccctggtgcgcgcgggcgccatgaaccccaactggaaccacccgatgggcgcgctgcgcgtcgactcctacgacagcgccatcaacgccaccgtcaacatcaccgacaccacgatcaccgacagcccttacagcgccttcgagttcgtctcgggtggcggccagggctacccggtcaagaacgtcaacgtcaccggcgcgaccgtgaagaacaccggcacggtcgtcgtccaggccgaggcgcagggcgcggcgaccttccggaacgtcaccgcgaccggcgtgggctccgccgggatctacgactgccccttcccgtccggctcgggcagcttcgtcctcaccgacggcggcggcaactccggctggacgagcacctgggaggactgctccacctggccgcagcccggccagggcaaccccgaccccgacccgaaccgcaacctcgccaagggccgtccggcgagcgccaccggctcccaggacgtctacacgcccggcaaggcggtcgacggcgacgcgaacagctactgggagtccaccaacaacgccttcccgcagtccctcaccgtcgacctcggttccagccaggccgtgcgccggctggtgctgaagctcccgccgtccgcggcctggggcgcccgcacccagaccatcgcggtcctgggcagcaccgacggcacgaactacacgaccgtggtcggcgcgcgggactaccgcttcgacccggcgacgggcaacagcgtcaccgtcgcgctgccggacggcaccagcctgcgcgatctgcggctgaccgtgaccgccaacaccggctggccggccggccagttcagcgaagtggaggcgtacgcgacctcgtgatccgtcagcctcgcgccacggtggcgcggggcggcacgggcgccagccggtagacaccccggtcgccggccacccggccggcggtcgggggcgggaagtgcgtgcccagcaggagcgtgccgctgccggcggccgacgcgagcagggcgcgccgggtcgcct

SEQ ID NO: 990 - DNA, 511 bp, Unknown
  Kingdom: Bacteria, Phylum: Actinobacteria, Class: Actinobacteria, Order: Streptomycetales, Family: Streptomycetaceae, Genus: Streptomyces
tggcgcgacctcgcccgcgacctgcagaccgccctgaacgagtacgcgaacgacgagggcaggccacgcgccgagctggaggccgaggtggcgcgagcggcccacccgagcgaaccggacggcacctgagcgcggcgcacgccccggccgcggcgagcggtgcgggtgaccggtgaccggggcgcatgaccggtacgtatccggtggacgcccgcgggtacccgcccggcatggacacctcccgttacgaagcagcctcgggtgccgggtcggtcttcgggatcgtcgtcatcgtcgtcggcgccctcatcatcgtcggcgcgctgatctgggccgtccggttcggtatccgggtcaagcagcgcgaaccgaggactccgcggggcggcgagcacccgacgctgccggattccgggccggtccacgagacccagcagcgacgtgagcccgacgaggtgccgcgcgccgaggagaccggccgccgcctcagcccgcacgaactcggctcgtc

SEQ ID NO: 991 - DNA, 1514 bp, Unknown
  Kingdom: Bacteria, Phylum: Actinobacteria, Class: Actinobacteria, Order: Streptomycetales, Family: Streptomycetaceae, Genus: Streptomyces
ccctcctccgtcacgctcctccccctctccatcccgcctcaccgcgtcgagtccgttttacccctattggcatttcaattcccgttagcggtaaatgctcctgcccggattattccgtgagttgggtcacgcccacctcgccctcccgccaccacccgacaccccctcgcttcccttctgccgcatgcgagttgacccttggcagatgcaaaggatcaagcacccaaatcaccccggaacaaggtcaactagggcgatgtatgaatcaggtacttgttcgggacatgtgctctcgcatacgttcccggccagtcgggcggacgccgaatcctgccaccgcccgatatccatcgaccgaaccacttcatggcaggagcgggggacccaggtaagtcgccgggccggagcgccgtacgtcgtcctacgtcgtacgccgcgccggaacggctcggggtgaagccgtgccacccgagggcacggccgggcacctccccgcccgaacccgacagctcacctcgcaggcgacggagaggaatcccccatgcctgcaaacggtcaccgccgttcccgcaccgctcgcctcgtccgcaccctcgccgtctccggcacgggtgccgccgtcctcgccctgcccctgatcggcgccaccagcgcctccgccgccaccccgacggcgaccacgaccaccgccacggcggcgagcacggtcgcctacccgaacaccctggacggctggatccgcgagtcgctcgcgatcatgggccagaagggcatccccggcacgtacaacggcatctaccgcaacgtgatgcgtgagtcgtccggcaacccgatggccatcaacaactgggactccaacgccgccgccggcatcccgtccaagggactgctccaggtcatccagccgaccttcaacgcctaccacgtggccggcacgtcgttcgacatctacgacccggtcgcgaacatcacggcagcgtgcaactacgcggccgcgcgctacggctccatcgacaacgtcttcagcgcgtactgacgggccctgccctgaggtgaacgaacgcctcaggcgaacaaacgatcgaggacgacggcgacgccgtcgtcctcgttcgacgtggtgacctcgtcggcgaccgccttcagctccgggtgggcgttggccatcgccacgccacgggcggcccaccggaacatggggatgtcgttcggcatgtcgccgaaggcgagggtgtcctcgggccccagccccagatgcccggcggccagcgcgagaccggtcgccttggtgacgccgcagggctgcagttcgacggtgcccgggcccgacatggtgaccgtgacgagggaaccgaccacgccacgggccgtcgccgccagctcgtcgtccgacaggccgggatggcgcagcagcaccttgctgatgggcgcgcgccacaggtcgtcgcgccgctccacccgctgggcgggcagggtcgggtgcggcatgcggtaccccggctcgatgagcgtga

SEQ ID NO: 992 - DNA, 2441 bp, Unknown
  Kingdom: Bacteria, Phylum: Actinobacteria, Class: Actinobacteria, Order: Streptomycetales, Family: Streptomycetaceae, Genus: Streptomyces
cacctccaccaccggcaccgccggtgctccggccgccgtgcccgcgccaccgccggtgccggtggtggaggtgagcggtgcgggcaggtccgcggccgtctgcttggtggcgaagaccgcctcggcctggctgtcgtcgctcacggcgttgtcgtaggagacgacccgctcgaagtcgacgtggaggtggtcggtggcgtccgtggagtccaccttccagcggcagccgaccttgcggtcggtgtcgtaggtgagcgtggcctcgccggcgtaggccttctcccgctggcccgggtccgtgatctgctggatgccgggcagcagcgagtcgagggtggtgtggccgaccgcgaggcaggcttcggggagcgtgcggtacttgcccggctgggccgccgccgtcgccgtgccgggaccgtccgcgttggcgtcgtcggccttgccggcgtccgacgagccgctggtgcagccggccagcgccagcgccgcgagcaacgcggccgcgccggatacgtacgccttccgcagcacggtcaggctcctctcgacgatgtcggggcggggccccgcgccggttattgggttgccggccgggggcgtctcctgcagacaatgtgtatcgcacgcactgccgtggacgccggtccgatgtcctgtttcgtcgaccttggcgccggtattgcgattcgccgcttctgagacttctgtttgttttccgggggaatgaggacgatatgtcgtacgtggaaatgccgggcgcgaaggtgccgatccgcatgtggaccgaccccgcctcggtcgaggacgtggccctgcgccagttgcagaacgtcgccacgctcccgtggatcaagggcctggccgtcatgcccgacgtgcactacggaaagggcgcgaccgtcggctccgtcatcgccatgcgcggcgcggtctgccccgcggcggtgggcgtggacatcggctgcggcatgtccgcggtgaagacgtccctgacggcgaacgacctgccaggcgacctgtcccgcctgcgtacgaagatcgagcaggcgatcccggtgggccgcgggatgcacgaggacccggtcggcccgggcgacttccacgggctggcgacggccgggtgggacgggttctggcggcggttcgacggggtggccgaagcggtcaggttccgtcaggaacgcgccacgaagcagatgggaacgctcggcgcgggcaaccacttcgtcgaggtctgcacggatacggccggtgctgtctggctcatgctccactccggatcccgcaacatcggcaaggaactggccgagcaccacataggtgtcgcgcagaagctcccgcacaaccagggcctggtcgaccgcgacctcgcggtcttcgtcgcggacaccccgcagatggccgcctaccgcaacgacctgttctgggcgcaggagtacgccaagtacaaccgcacgctcatgatggcgctgctgaaggacgtggtccgcaaggagttcaagaaggccaagcccctcttcgagcaggagatctcctgccaccacaactacgtggccgaggagcgctacgacggcatggacctgctggtcacccgcaagggcgcgatccgcgcgggctccggcgactacggcatcatccccggctcgatgggcaccggctcgtacatcgtgaagggcctcggcaacgagaagtccttcaactccgcctcgcacggcgccggccgccggatgagccgcaatgccgccaagcgccgcttctccacgaaggacctggaggagcagacgcagggcgtggagtgccgcaaggactccggcgtggtcgacgagatcccgggtgcctacaagccgatcgagcaggtcatcgaccagcagcgggacctcgtcgaggtcgtcgcgaagctgaagcaggtcgtgtgcgtgaagggctgagcacccgtcagcgccctcagtcccgcagccgcttctccaggagcgtcaccgcgtacgggctgccggtgccgtccctcttcgcgggctgctcgccgacgaccctgtagcccgccgcctcgtagtaggcgcgcaggcgggggttggaggagaggcagtcgaggcgggcgtagcggcggccggtcgcggtgatgcgggactcggcctcggccagcagggcgcggccggcgccgggcggggccgtgtgcggggtggtcatgaggcggtggatgtagccggcctcgggcgggcgcgggccccaggcggccgggtcgtcccaccacagctcccaggcaccggccaggtggtccccggcgtacgccagccagacctcgccctcgcgcatgcgcgcgacgaagtgcgcctcgtccttctcgccgggcttccactggtcgatgccgcgggccagctgccgcagggcggccgtgtcgcgcaggcggaccaggagcggtgcgtcggcggggacggccggtcggt

SEQ ID NO: 993 - DNA, 1156 bp, Unknown
  Kingdom: Bacteria, Phylum: Actinobacteria, Class: Actinobacteria, Order: Streptomycetales, Family: Streptomycetaceae, Genus: Streptomyces
gcccgcgctcctcgcggtcacggcggtggcgtgctgcgcggtcgcgggcacgctgctggcggcgcgggggctgcactacccgtccgagtacgacagcctccaggacctgctcaccgaccactacgcccggcccgaccgggcccgtccgtggcgggagctgttgcacctggaggtggacttctggcgtgagtggctgcgccggcagctgtggcagccgctgttcgcggcgctgctcgccgccggcgcctggggcgcgttcagggcccggaccggtgccggtcgggaccgggcgttcggtgccttcgtggtggcgggcgcgtgcaccgggttcctgaaccaggcggcgcatcccgacatcaccgtgtggggcgagcggctgatcgtgctggcctggctgctgccggtgctggggctgccgctgctgctggacgcactggccccgggagcgcgccgggtcgcggcgggcatcccggggccccgtgcggagagcgcggtcggcggagagcggagccccgaggacaccgtcactcgatgacgagttcgaccgggatgttgccgcgggtggcgttggagtaggggcagacctggtgggcctgctcgaccagcttgcggccggtggcctcgtccacggtgtcgggcagttcgacgcgcagggtgacggcgagcgcgaagccctctccctgcttgcggaggccgacctcgccggtgacggcggcgtcgctcacgtccgtcttcgcctggcggccgacgagggcgagggcactggcgaagcaggccgcgtacccggcggcgaagagctgctccgggttggtgcccagtccgttgccgccgagttcggcgggcggggcgagctgcacgtccagcttgccgtcggagctgaaggcgcggccgtcgcggccgtgggtggcggtggcgacggcggtgtagagcgcgtccatcaagaaccatccctctcgatacgtcgtacgccggcgggtgccgggtcggcgccctgtccggacagccacgagtagagcacacaattaaattgcgcacaactgaatgacgcccgaggtaccctgaggccatgacgaccgaggcaccgcggacccccgcccccgacgaggagtggctgcacctggaccgccaggtctgcttcgcgctgcacgccgcctcc

SEQ ID NO: 994 - DNA, 3220 bp, Unknown
  Kingdom: Bacteria, Phylum: Actinobacteria, Class: Actinobacteria, Order: Streptomycetales, Family: Streptomycetaceae, Genus: Streptomyces
cgtcatgtacctgcccgagccacgggtacggctcgggcaggtacatgacgggtggtgcagggcgaagctatcccgccgtctcacctgccagcaatgagtgggcaatgacttgtccaggccacttgccgaaagaactcataggacttgaaccggtcctcgcgtggcgccgtggaccttggacagggagcccgagcaccatcgggcctccggcgcatccgtatgcgcgtccgtacaccgagatccgcacacgaggagacagacgtggccaccgagacaccgccaccctcgaagacccaggcccccctcccctccgcgcaggagtactccacggtggcccagagccccgagttcggtgaactgcgccgctcctatcgttcgttcgccttcccgctgaccatcgccttcatcgcctggtacctgctctacgtgctgctgtccaactacgcgggcggcttcatgggcgccaggctcttcggcaacatcaacgtcgccctcgccctgggactcgcccagttcctcaccacgttcctcatcgcctggtggtacgcgcggcacgccgcgacgaagctcgacccccaggccgaggccatcaagtcccggatggagggcggcgcatgacccccgctacccaccccgccgcgcacaccgcgcacaccctgctggccgcgggcggcgccgcgagcgagcaccggacactgatcatcacgctgttctctgtcttcgtcgccgcgaccctcgtcatcaccgtctgggcgggccgccagaccaaggacgccgccgacttctacgcgggcggacggcagttcaccggattccagaacggcctcgccgtctccggcgactacatgtccgccgcctccttcctcggcatcgcgggcgccatcgccctcttcggctacgacggcttcctgtactccatcgggttcctcgtcgcctggctggtcgccctgctcctggtcgccgagccgctgcgcaactccggccgctacaccatgggcgacgtcctggcgtaccgcatgcgccagcgcccggtgcgcaccgcggccggcgcctccacgatcgtcgtgtcgatcttctacctgctggcccagatggcgggcgcgggcgtcctggtctcgctgctgctcggcatcaccagcgacggcggcaagatcggcatcgtcgcactggtcggcgtactgatgatcgtctacgtcaccatcggcggcatgaagggcaccacctgggtgcagatggtcaaggccgtgctgctgatggtgggcgcgatcctgctgacgttcctggtgctgctgaagttcgacttcaacatctccgacctcctcggccgcgccgcggacaacagcggcaagggcgccgccttcctggagcccggcctcaagtacggggcgaccggcaccaccaagctggacttcctctcgctcggcatcgccctggtgctcggcacctcgggactgccgcacatcctgatccgcttctacacggtcccgaccgccaaggccgcccgcaagtccgtgatctgggcgatcagcctgatcggcgtcttctacctgatgacgctcgcgctcggcttcggcgccgccgccctcatcaagccggacgagatcatcgcctccaacaaggcgggcaacacggccgcgccactgctcgccctgcacctcggcggagtcgactccaactggggcgccgtcctgctggcatccatctccgcggtcgccttcgcgacgatcctcgccgtcgtcgcgggcctcaccctggcctcgtcctcctccttcgcccacgacatctacgccaacgtcatcaagaaggggcgggccaccgagaagcaggagatcggggcggcccgctgggcgaccgtcggcgtcggcgcggtctccatcgtcctgggcgccctcgcccgcgacctcaacgtcgcaggactggtcgccctcgccttcgccgtggccgcctccgccaacctgcccacgatcctctacagcctcttctggaagcggttcaccaccacgggcgccctgtggtcgatctacggcggcctggtcaccgccgtcggcctggtgctgttctcgccggtcgtgtcgggcaagcccacgtcgatgttcccggacgccgacttccactggttcccgctggagaacccgggcctcatctccatccccgtcggcttcctgctgggcgtcgtcggcaccctgctgtccaaggagacgccggaccccgccaagtacgcggaactggaggtacggtccctgaccggcaccggagcgcactgaccccggcccgtccatccaggacgtgcaccgggcggcggcggccgtgccgtagggatcgtagagacctacgacacggccgccgcccacgtcgtgggatcgggaccggtgtcgctgtcggtcccgtcacgtaggctcgcaggtgagggaacacgaggccttggacgagtgttccgctgacaggcgaagagggagggggcccacgtgctcatcgacacctacggccgagtggccaccgacctgagggtctcactgaccgaccggtgcaacctgcgctgcacctactgcatgcccgaggagggcctgcagtggcttgccaagcccgacctgctcaccgacgacgagatcgtccggctgatcgacatcgcggtcacctccctgggcatcgaggaggtccgcttcaccggcggcgaaccgctgctgcggcccggcctggtcggcatcgtcgagcgcgtcgcggccctggaaccgcgcccgcagatgtcgctgaccaccaacggcatcggtctgcggcgcacggcggctgccctgaaggcggcgggtctcgaccgggtcaacgtctcgctggacacgctgcgcccggacgtcttcaaggccctcacccggcgggaccgccacaaggacgtcctcgacggactcgtggccgcccacgaggccggactgaccccggtgaaggtcaacaccgtcctgatgcccgggctgaacgcggacgaggcccccgacctgctggcctgggccgtggagcacggctacgaactgcgcttcatcgagcagatgccgctggacgcccagcacgggtggaagcgcgagggcatggtcaccgcgggtgacatcctcgcctcgctgcgcacccgtttcgagctgacccccgagggcgccgacgagcgcggctcggccccggccgagcgctggatcgtcgacggcggtccgcaccgcgtcggcgtcatcgcctccgtcac

SEQ ID NO: 995 - DNA, 1936 bp, Unknown
  Kingdom: Bacteria, Phylum: Actinobacteria, Class: Actinobacteria, Order: Streptomycetales, Family: Streptomycetaceae, Genus: Streptomyces
tcccgatcgtgctcgctgccgtccccgtactcgccggggacggcagcgagcacgatcgggagctgagcgtcggtgaggccgtaccggtcctggatcgccgggatgcgcgtcaccaggagggcgaaggcggtgccctgagcgaagaaactgaacgccaaagaggccctaccgcgccgcagcacatctgtcatggcggcgagcgtagggcccgaggctacctgtgggtagatcaagtgaaagatgaatttctttcaggttcacctttcttgggatgcgtggcgggtcgggtcaggcggcgagggcggtagtggcggcagccgcgggctgcccgatcccggcctggtcggctgcggtccgcccggtcccggtctggttggcggctgcgggctgctcgaccgcgggccggccggcctcgacctcggcggtcagcatctcctccatcggtccggcggccagtccgccgctgaccacgaaggcgacggccagcgtgccgaccatgaagaccgtgcccagccagaccatcgtgtccacgggcagcgtgtacgcgcccaccacccgcgccacgcactcggccagcagcgcgagaccccagacgacggagaacgcgcgctccttgctccggaaggcggcggagccggccgccgcaccggacatcagccgctcccaggcggcctccttggcggcgtcgcccttcaccatgaagggcttcatcccggccgtcatcatcggcttgccgagcgccacggagaccaggacggcgatggcgaccgtgctgctgaccccgctgtccttggcgagcatcagccgcgggtcaccggagacgaagctcagcagcagcgagacgacgttcacggcgaggaacagcgtcgccaggacgttggtccggcgctcgctgatcacgctccacaccgtccgcgcggccggcaccgcgctgctccaggccagcgccgcgaaggtgctcatcccgaagacgtccttgaggacgtagtacgagccgagcggtacggcgatgtccaggatcagcggcttgaagttgtccaggacgctcggattctgggcggtgttccggctgtcgttccccgtgttcttcgtcatgccctcagcttcgccgccgcagggggtccgccgacagaaacgatcgtccggaggtccgcgtgacaaatgtcagcccgcgccggtggccccggtcatgcgccggctcataccagcaggtcagccaagtccgtcatgtcggcgaagagttgagtggaaccgccgagccggtcgccgggcgtcatggcggtgaacccgtacacgtccatcccggccgccagggcggcctgtacgcccagcggagagtcttcgaccaccacgcaccgctcgggcgcgacgcccatccgcccggccgcgtggaggaagaggtccggtgccggcttgccccgccccacgtcctgcgagctgaagatccgggcgtcgtcgaaccaccggtcgagccccgtcgtccggtgccccacccggatccgctcgtggctccctgacgaggcgacacagtacggcgtcccgtccgccgtcagcttctccagtacgtcgacgacgcccggcaccggcttcagctcccgctggaacgcggcgaagacccgggcatggaagacgtcgtcgaagtcgtcgggcagccgctgccccgtacgctccagcacgaagtcgtgcacccggtgcatggccgcccccatgtagtcccgaagggagtcctcgtacgaggtggggtggcccagctcggtcagataggcggcgaggagacggttcgagatcggctcactgtcgacgagcacaccgtcgttgtcgaagatgacgaggtcatagcgcatgcgaaagagcctaaacaggcccggaaaaacagaaaaccccgcaccatacggtgcggggttttccctaaaatttgttcggcggtgtcctactc

SEQ ID NO: 996 - DNA, 3502 bp, Unknown
  Kingdom: Bacteria, Phylum: Actinobacteria, Class: Actinobacteria, Order: Streptomycetales, Family: Streptomycetaceae, Genus: Streptomyces
gtcctggtcggtggcctcggcggcctcggcggatgcggtgtcggcggcgtcgaggcgtgcggcgtcgggggccggatccttgcggtcgcccctgccgcggcggcgcttggcgccggtgctctcagtgcccggctgacggaccgcccagcccgcgacgaagccgcggcggaaggacagcgtcacgaaggtctgcccgacggcgaacaggatcgcgcccagcgcgatgaccaggacggacggcatcagcacgccgaccacgacgcagaggaaaccgccgaaggcgagcagccgccagcgcaggcgcgccttgtactgcagcagcacttcgccgagcaaccacagcgcgacgacaccgaacgcgatgtagaggaccgcccagcccatgtacgcccctctcccagtggtcgctccgcagtgtgtcgtacaggggtgcgaccggtctaggcctgcggtgggtggtgcaggcccaggttctcgtagatttccagcgtcgccgtggagttgttgagcgtgatgaagtgcagtccgggcactccttcggccagcagccgcgcgcagaactcggtggcgaactcgatgccaatggagcgtacagcggccggatcgtcctgcgccgcgaggatccgctctttcagggcgtcggggaaggcggcgttggtgagggacgggatccgcgcgacggtcttggcactggcgatgggcatgatctcggggatgatgggcgtctcgcagccggcggcggcgacccggtcgcgcagccgcaggtagtcctccgggtggaagaacatctgtgtgatggcgtagtcggcgcccgcgcggcacttggcgacgaagtggcggacgtcggcctcccagtcggccgagcgcgggtgcatcgcggggaaggccgcgacgccgacgcagaagtcaccggacgtcttgatgagttcgacgagttcggcggcgtagcgcaggccgcgcgggtgcggcacccactcgcccatggggtcgccgggcgggtcaccgcgcagggccagcatgttgcggatcccggcgtcggcgtactgcccgatgatgttgcgcaggtcggccacggagtggtcgacggcggtgaggtgcgcgatcggggtgagcgtggtgtccgacgcgatggcctcggtcgccttgaccgtgccggcacgggtggagccgcccgcgccgtaggtcacggagacgaagtcgggcgccacggcctcgacccggcgcagcgcgttccacaggttccgctcgcccttcggggtcttgggggcgtagaactcgaaggaatacgtcgtcttgccggtcgcgagcatgtcgcggacggtgcgggcgtggtccgacctggtggatgcggtgccgagggccatacccgcaggttagccagggtgcggcggtcccccaaccggacgtaggcgttttgcccgatttgccgacttgttgtccactccttggacactttggcccatctgctcgccgggcgggtcaggcctgccgcagtcgcttcgcgaactcggccgccgccgcgccgggatcgtccgcctcggtgatcgcccggaccacgacgacgcgccgggcgcccgcctccagtacctggtccaggttgccgaggtcgatgccgccgatcgcgaaccagggccggtcggtgccgagggaggcggtgtacctgaccaggtcgaggccgggcgcgtggcggccgggcttggtcggggtgggccagcaggggcccgtgcagaagtagtccacgccgtcctgcgtcgcggcagcggcggcctcggactcggcgtgcgtggaacggccgatcaggacgtcctcgccgaggatcgcgcgcgccgcggggaccggcaggtcgccctggcccaggtgcagtacgtcggcgcgggcggcgtgggcgacatcggcgcggtcgttgaccgcgagcagtctgccgtggcgggcgcaggcgtcggcgaacaccttcaggtgctccagctcctccccggcctccatgcccttgtcgcgcagctgcacgatgtcgacgccgcccgcgagggccgcgtcgaggaactcgggaaggtcgccgcggtccctgcgggcgtccgtgcacaggtacaggcgcgcgtcggccagccgggcgcgggcggcggctgcggcggtgtcggacatgcgggttccccctgagatcggttgcgttgatgtcgatggcgtacgggccgcggctccggaggccctggccggtctcggccagggcccgtctcggcaggggccgtctcggcgggggcccgtccgggccggtaccggcccggaactgcccccggcgcgaggacgaccgcggtccgtacgccggacggatggatcagcccgtcgccggacggatggatcagcccggacggcggacgcccgggtgagcccggacggcggacgcccggggtcatatggcaggtgtccggggcggacagcgggcggcccggacagtgggccgcccttgtgtcagtgggcgccccgggtcagacggcgagcgcctgggcgcggcgcttcacctccgtgccgcggttctcgctcagggcctcggccggggtaccgggcagggtcgggtcgggggtgaagagccactcgatcatttcttcgaccgtgaagccgtcgtcccgcaggagcgtcagggtcccggacaggcccttgacgaccttgtccccgtcgatgaaggcggcggggacgtgcagcgcgcggttctcaccacggcgtacggcgatgagctggccctccttgaccagctgccgcacacgcgtcacgtcgacgccgagcatctcggcgatgtcgggcagggtcagccaggcggggacgagcgcatcggtcttcgcgtcaatctcggtcacggaaccaagcgtgccatctgccactgacactcggaagccgaccccgtccacctgggcggaggccgtccggcgcgcacgctacgcggtggccgccttcagggacctcgacgggtccgccagcagcccgggatccatcgccgcaccggcctcgatcagccgtcggccctgggcgagatcccgcggccggccgaccgccaacagggcgaccaggcgggtgtcgcgcagccagcagaccgtccaggcggggcctgccgggtcgccgcgccagacggtggtgtcggccgcggtgtggtgcccggcgtactgcacgaagcggccgaactgctcggaccagaagtacggcaccgggtcgtagacggccggggtcaggccgatcacgttggcggcgacggtgcgcgggccctggagcgcgttgtcccagtggtggaccagcaggcgctcgccgtaccggcccgaggggaaggaggcgcagtcaccgaccgcgtacacgtccggcgcgccggtgcgcaggtggtcgtcggtgagcacctcgccgtgctcgcccagctcgatgccggagcccgccagccaggcggtcgcgggacgggcgccgatgccgacgacgacggcgcccgcgggcagccgtgacccgtcgtcgagcacgaccgcgccgggct

SEQ ID NO: 997 - DNA, 3882 bp, Unknown
  Kingdom: Bacteria, Phylum: Actinobacteria, Class: Actinobacteria, Order: Streptomycetales, Family: Streptomycetaceae, Genus: Streptomyces
gtgctgctgctcgcgagcagcggctgcggagtgtggccggtgggcggccacgagccggtcgacggcttgcggatcgtcgtgcccaacactccgggcggcggttacgacaccaccgcgcggaccgcggcgcgggtcatggacgagaccggcatcgcctcggacgtacaggtcttcaacctgccgggcgcgggcggcacggtgggtctgcagcggatcgtcaacgagcgcggcaacggcgacctcgccctgcagatggggctcggcgtggtgggggcctcacacgtggcgaaggcgaaggtgaccgtcgcccggaccaccccgatcgcgcgcctcatcgaggaggcgggcgcggtggtcgtgcgcaaggactcgccgtaccggacgatccagcagctcatcaccgcctggcgcacggctccgggccggctgcgggtcggtggcggctcctctcccggcggccccgatcatctgctggccatggaactcgccaaggcggtcggcatcgacccgaagcgggtcggatacgtggcctacgacggcggcggcggcaacctcctgccggccctcctcgacggcaaggtcgacttcgccaccagcgggttcggtgagttcctcgaccagatcggcagtgggcaactccgggtcctcgccatgaccggggaccggccggtcaagcctctcccgggggttccgacgctcaagtcgtccggcatcgacctggtgttcgccaactggcgcggcgtcgtcgcgccgcccggcatcagcgacgccgacaggaagcgctggaccgacgtcctgaccgcgttgcacaactccccgcgctggaaggccgaactcgtccggcacggctggacggacgtgttcgccaccggcgacacattccgctcatatcttgtccaacaggacaaacgggtcgccgatctggtcgcgcagctcggtctggagtagtcggagcagtcgcgcggctcggtctcgcgtgtccgagcggtcgcttcgccgcggcggtccgaggaccgtcccgcagccgaaccatgcccaccccagcgggccgtgccctcggtggcctgccctgtgccctcggtggccgggcccccgtgctcgaagggctctgtcagtcgtacccactcacccggccccctcgcggccggccgtcgaaaggtgtcttccgcgtgacctcacacgcttggttcctgctgatcgtcctcaccgtggcgatcgcggtcctgatctacctcatcaactcacggctgcgcgtccatcccttcgtcgccctcatcgtcgtgagcgtggccaccgggctggtggccggcgagccggtgggcaaactgacggactccctcgaagagggagcgggcggcaccctgggcgatgtcggcctcaccctcgccctgggcgccatgctcggccgcctgctgtcggactccggcgccaccgacgccatagcccacgccgtcgtcgaccggtccagcacccgccggctgccctggctcgtcgcggccgccgcgttcgtcataggcatcccgatgttcttcgaggtcggcctcatcgtgctgctgccgctgatcttcagcgtggcacgccgcctggaggccaacggcggcaccaagggctcgccctacgtgctgctcggcgtcccggccatcgccgcgctgtccaccctgcacggcatgctgcccccgcatccgggcccgctgaccgccgtgaccggcctgcacgccgacctcggcctcaccctcggcgtcggcctcgtctgcgcgatccccaccgtcgtcctggccggaccggtctacgcccgctggatcgcgccccgcatggccgacgtccgtcccgacgccgcgctcgtggcgcagttcaccggccccgacgcgcggcagcccgccgcacagcggacgcgcggtggcgttcccacgggcctggccgtcgcctccgtactcgtgcccgtcgccctgatgctgctgcgcaccctggccgagacggtgctcgacgaatccagcgcactgcggtccgcgctcacgttcatcggcgaaccgctggtggcgatgctggcgggcttcctgttcgccctgggtgtgaccttcctgcgcggcgaccgctccggcgagcagacccgtgcctccctgacggacagcctcaagtccgtcgccgccatcctgctcatcatcggcggcggcggcgcgttcaagcaggtgctccaggactccggcatcggtgacgccatcgcctcggcggccaagggggcacacctcaacgtgatcgtgctcggctggctgatcgcgctgctgctctccctgaccacgggttcggccaccgtgggcatcgtctccgccaccggcatcgtcgccccgctgatcggtaccggcggcggcctggaggcgtccctgctcgtggtcgccatcggcgccggctccatcggcctcaactacgtcaaccacgcgggtttctggctggtcaaggagtccttcggcatggacctcggccaggccgccagaacacagaccgtcgtgcagacgctggtcagcgtgttcggcctcggcatggcccttctgctgtccgtcttcgcctgagagggaggacctctctgacaggacggaggttcctcagggcgtctgcgccggccgggcctgcccgatgaggatggccacgtcgtcgttgtcctcggggtggcgaagggagtgcaggagccactggcaggtttcgtcgagcgggcggcgtggttcgtcgaggacgctcaccagtgtggccaggcgctcgtcgatggggtggtggcgggtctcgacgagaccgtcggtgtagaggacgagccggtcgcccgggtgcaggtcgaaggcggtggtgtcgaagggcaccccgccgacgccgagcggggcaccggtgggcaggtccaggagttcggggcgctcgccggcgcggacgaggacggggggcaggtggcccccgttcgcgatgtgacacaggtggcggtgcgggtcgtagacggcgtagaggcaggtggcgatgtagcgctcgagcccgcaggtgatcttgtcgaggtgtcgcaggacctcgtcggggtccaggccgaggtcggcgtacgcgcaggtcacggtgcgcagccggcccatcgcggcggcggcgtcgatgccgttgcccatcacgtcaccgaccaccagggcggtccggtcgccggccagcgggatgacgtcgtaccagtcgccgccgacctcgcaggacgcctgcgcgggctggtagagcgaggcgacctccaggccggtgagccggggcggggtggcgggcagcaggctgcgctggagggtctcggcggagttgcgcacgctctcgtgccagcgcgcgttgtcgatggcgaccgcggcccgggcggccagctcaccggcgaggatcacgtcgtcgtcgtcgaagggcagcgggttgcgggtgcgcagcaggtcgaaggcgccgaggacctcgttgtgggcgatcagcggcaccgccaggtaggagtgcacaccggcccgggcgaaggcagccgcggcggcggggtcgcgggcgatgcgcagcaggtcgtcccggccggtgcgggcgacgacgaccggctgtcccgtgtggacgcaccgggtgatcagccggtccgggccgtaggcggcgaggtctccgaccgtgtcggcggcggcgacggcctcggtgggatgggccgaggccacggcgagagcccggaacagttccgggccctcgtgcgaggcggtggagcgccggaaggccaggacggcgtcgagcacgtcgaccgccgcgacgtcggccaggtcgggcacggcggcgctcgccagctcctgggcggtctgctccacctccagggtggtcccgacccgcgcggaggcgtcggcgatcagcgccagccggcgccgcgcc

SEQ ID NO: 998 - DNA, 580 bp, Unknown
  Kingdom: Bacteria, Phylum: Actinobacteria, Class: Actinobacteria, Order: Streptomycetales, Family: Streptomycetaceae, Genus: Streptomyces
tcagcacggccgtcgcggcggcgaacaggcccagcacccaccagcgttcaccggcgaaggaccgcaggttctccagccagccgagcggggagagccaggtcagcaccgacgaacctcctgcggcgccccctgcccccgcgtcgcccgccgcgacggccgtgctgagcgtgctcgcccacctgctcgccggacgccgtgacctcggcatgagcttcctgcccacccggccggggcccgccgagggccggctcggcaccgcgggcgcgctggcctggcgtctgcaacggggctccctgctcggctggagcgccgggttcctgctcgccggagtcgtcttcggcgggatgacggacggcgcggccgacctggtcggcggcaacgaccggacccgcgagatcttccagcggatgggcggccactcgggcctggcggacgccttcctcgcgtccatgacccagatcctcggcctcgtcgccgcgctgtacgtcgtctcgtccgtgctgcggctgagcggcgaggagggctcgggccgcgcggagccggtcctcgcgggcgcggtggggcgggcgaagtcctgatc

SEQ ID NO: 999 - DNA, 1046 bp, Unknown
  Kingdom: Bacteria, Phylum: Actinobacteria, Class: Actinobacteria, Order: Streptomycetales, Family: Streptomycetaceae, Genus: Streptomyces
cggcgatgctgctgcgggtgctgcgggaggccgacgaccgggcagcgccgggcctcgaacggctcgtcgccacctggagcacggccttcgcggaccgcttccgcgcccgctgggtgccgctggagcaccaggtcgagcaccagtcccgcacggtggtggagacggcccgccatgcccgtgacgcgggcgtctgaggtgaggggcaggggcgcggtcgggtgtgcccgcgcccctcgacggtgcgggcgctcacccgtccagcgcgaacacgtcccccgtccgggcgttcatctcgcacccgttggcgaaggtctccgtgtagtcgaccgcgcgtccctgccactcgccgcgcgcctggacggtcacgggcgcgtagatcatcgagcagaagacgtccttgcgcggaataccgcggatgtcgccgcgcgccgaccgcagctcggcgcaggcctgggccgcgtgggagtggccgtgcggcgggtcgcagagcagcagggtgccgcgcgtgtcgccgcccgagcgggtgtcgccatgggtgacggtgacgtagagccagtcgccgcggtcggccggccgcagggacgtctgggccgcctgggccgcctgggccgggaccgcaccggcgatgaggagggccgcggcggccggcagaccgcggcgcagccaccgggtcgtcgccttcgtgatggagtggttcatggccggtgtatcggcacgccgccgcgcgggccgcagtccggctcacccgaacgggagcacggccgtgcctccacctgccccgtccgggcgtctcagtcggccgagagccggtacgtcacctgtccgaagccgacctggtcgccctcgcggacgacggccgcgccggtcacgcgccggccgttgacggtggtgccgttggtcgagcccaggtcacgcaggatccacaggccgccctggtggcgcagctcggcgtgggcccgggagaccgtctcgtggttcagcctgaggccgctcgccgggtcgcggcctatgcgcagcgggtggccgctgcccgggtgcggcagcag

SEQ ID NO: 1000 - DNA, 2128 bp, Unknown
  Kingdom: Bacteria, Phylum: Actinobacteria, Class: Actinobacteria, Order: Streptomycetales, Family: Streptomycetaceae, Genus: Streptomyces
atcatttcggtgcgcgggcgggcctgcgccaccgcccgcgcaccgaaatgatcgccgacgccctggagttcgagcgtgcgcagggactcgaacgcgagcgcggcgccggtctgagcccggcccgggagcgcgagctcatcgccctgctgcctaccgaccgctgatcagctcgggttccagcggcccgccgggcgaccggcgggtcatgatcatctccttgtggggatccccgtcgaggatggcgtgcaggatgttcctgggcccctcgccggtgccgagcagcgtcgggctgcggtacaggccgcgcagctcgtgcggttcgagtccgctgacctcgcacagctcatcggccacgccatcgccgtcgccgcccgccaggaagtcgtggacgtcggcgaggcgcggcagcaggtgcggccgttccgcggacaggtacgcggacaggcgctcgcccttgcccgagaagggtgagtggaccatgcagatcagctgtttctcgctgagtccgtacgcctcggcggcgaaccggcccgcccgctcccgcatcagcgcggacgcgtccggtccggcgtagcgctggcggacccggtcgatcagccactcggggaactccttggcacgcatcagcttcgtggcgaaggcgacgtactcggccagtccgtcgccgtagtcccggccgtacaggcgctcgcacttgagggcccgcaggtgggccatcagcgtggggttggcacagtcggactcggtgaagctgaaggcgatctcgtcgaactcgaagccgaggaagtcggtgagcagcggccagtggttcgacgagctgtagcccgtgtcctcgaagatcgagaagaaccgcagcgcctccggcacgtcggagacgaccctgcgggcggccacctcggcgggtgcgtcgggaccgaagatctcggtgaagtaggcccccgctatcgcgtcggcggaacgcaggaaaccgccgaacccggaggcgccgcgctgtcgtacggtgcggccgtggtcgtgggccagccggttgacccacaggtggtaggcccgctgctcggccggtgagtcgccggtgatgacgaggtcgacaccgccgtcgtacgccgcggcgatgccgaacgagttgaccatgctcaggttgcaggagttgcagaacgtcgggcgggcctcggccatcgtccggtgcccggtcatcagcaggtccaggcggttgcgggccagcacccgcggcaggatcggctcctgccggcggaagggccgcaccacctcgtcgtcgatcaacagcgccgtgcagtccgggtcgtcggcgaggctcagcgcgcggtaggcgcggtcgatgttgtccatgacggcttgtgtcatgccgccctggcggttggtcgccgaccggagccggaaggtgctgccgtggcgctcgcgaaggagcagctgcaccatccgtacgaacgccagggtgtaagtgctgtccttgccgccgccgtaggcgacgagcacgacgttgtcgccgagccggtcgggggcgggcagcgcggcgtgcagccgccgcgcgcagttctcggcgcccgcgaggtcctcggcggacatcgcgtcgcgcagaccggcgagcgtacgcgcgcgtgccgccgcgaggtcgggccggacggatctggtcgtgggcatggtggggtgtctcctgaggtcggggcgcgaaggaggacgggattcagggcgtggcgccccgccgtcgggccagggcgagatgggccgcacgccgggccgtgccgcgttcgctgccctccgcggcggttacggaggcggcctcgccgtcgagaaaactcgccatggcacgcacggtcgggtgccggaacaggtcgacgacgtgcacgtcgcggtcgaactcggcacgcaaggtctcgcgcaggcggatgaggagcagcgagttgccgcccgcgtcgaagaagttgtcggtcgcccctgcctcggtgccgagcactgccttccagcacgcggcgacccggtgctccgcctcgcccgcggccgcctccttggagcgcgtcaccggctcggccgccagcagggagcagcgagttgccgcccgcgtcgaagaagttgtcggtcgcccctgcctcggtgccgagcactgccttcc

SEQ ID NO: 1001 - DNA, 1976 bp, Unknown
  Kingdom: Bacteria, Phylum: Actinobacteria, Class: Actinobacteria, Order: Streptomycetales, Family: Streptomycetaceae, Genus: Streptomyces
gggggaggcgggggtcggcgatacgggacgaccggcgtgggtggcctgcgtggtgccgcaggcggcgagcgaggcgagaccgacgctcagcgcacaggccgtggcgagaccggtaatacgtcgtacaagtgggatcacctgacgaacgtaggacggtctccgatcatatgagcggcaacggggccgcgcggtcacccggccggacgccacccgtggcgtacggccccgccctcatcgctcccgccgctccagcgggtgggtcgccggcccctggaggacgttgccctcggtgtcgaaacgcgagccgtggcacgggcactcccaggcccgctcggcggagtcgaaggcgaccaggcagccgagatgcgtgcagcgggcggacagggtgtgcaggtcgccctcgtcgtcccggtacacggcgaggtggtcgagcccgctccggacgacggcgccctcgcccggcgggacggcgtccacgggcggcgtggaccgcagccggtcgcccacgaagtgccgggcgacctcggcctggttcttcaggaacgtcggcgcctcgcgtacggccgtccgcagccggcgcgggtcgtacagctcccgccacgggcagtcccgcccggtgatcagcgccgtgagcagttgccctgccatgatgccgccgctcaggccccagccgccgaagccggtcgccacgtaggtgttccgggcggcctggtgcagcgggccgaccatcgcgacggtgtcggtggggtcgatgtcctgggtggcccaggagtacgtgaggtccgctgcggggaagtgctcgcgcgcccacgccgtcagccggtcgaagcgggcggcggtgtcgccggtgcccggcgtgaagtgttcgccggtcaccacgagcagccgccgaccgctcccgccgccctcctcctcgccgttcccgtcctcgacgttcccgttctcgccgtacggcgcggtgcgtatcgaacgggtgttctcttccggggtgatgtacatgccgtcggggtcctcggcggcgtccaccggcccggccacgaccagttcacggcgcggggccagccgggcgaacagcagcgcccggtcgaagaccgggtagtgcgtggcgaccacgacgtgccgggcccgtaccgtggcgcccgccgcggtcgtcacccggcagggctcaccctccgtcaggccctgcacgacggtgttctcgtacacctgcccgccgcgcgccaccaggtccgccgtgagccccagcaggtacttgcgcggatggaactgcgcctgcccggccacccgcaccgcccccgccaccgggaacggcagccccgtctcggtcacgaacgacgccgcaaggcccgcgtcccgcgccgcctccgcctcggcccgcacctcgtccagcaggtccgggtcacggacgtaggtgtaggcgctgcgggtctcccactcgcagtcgatgtccagctcgtccaccagcgcccaggcgcgctcgacggcctccgactgcgaacgtgcgtacaggcgggccgcctgcgcgtcgcgggtccggcgcagcttgtcgtagatcagcgtgtgcagcgcggtcagcttggcggtggtgtgtcccgtgacgcccgccgccacccgccgcgcctccagcaccgccacgccgagccccgcccgcgtcagctcgtacgccgtgctcagcccggccatgcccgcaccgatcacgacgacgtcgacgtccaggtcctcggtcagggccggacgtgccggccccggtgccgtctcgacccagtacgagccggtcacgcggcgccgcccgtggccctgctcctgccgctcctggcgctgccgatgttcgctcatggcggccgggtaccccgtcggggccggcctgatctcggactcgctgccgggcgcgtgagggcggcccgacccggccccggatccgtgggcccggggccgggtcggggccgggtcagcgttcgggtgcggccgaggcggcg

SEQ ID NO: 1002 - DNA, 7410 bp, Unknown
  Kingdom: Bacteria, Phylum: Actinobacteria, Class: Actinobacteria, Order: Streptomycetales, Family: Streptomycetaceae, Genus: Streptomyces
gcggtgaaggtggggcgggtcgcccgacccgccccccttcaccgcgtggagcattcgctggtgcggagcctcaccggttcagcacgtcagccgggcggcggcccagtcgccgtggtcggagtcggtgttgtcgccgccgttggtgacgacgagccggacgacctgggcgccggtgacgtcggcggtgatcggctgggccggcatggcgttggtgaggacgccggtcgaggcgaccttggcgccgtccgcccagatctcgaaggagacggtgcccttggcgcccttctcgtcgtcgacgccgacgtccgcggcgaccttcgtgcacgccttgccggtgtagtacgtgacctcgctcggcgcatgggtgccgagccccttggcgtacacgaccccgccgatggtgatcgggtggccgtcgcccgcggcgctctccccgttgctggtgttgcgctccaccgggccgtagccgttggtggccgacatccagggcaggtcaccgaggtacgacgtcccggcgggcggtggcacgaccaccgacgccgtgacggtcagggtgccggtggcgcgggccgtgccggaagagcggtagcccgccctgagcgtcaggtcgtacgacccggtcggcgtgcccggcggtgccgtcaccgtccaccgcgtcgtcagggcgctcccgctgggaacggcgtgggcgcgcgcggacgaaccggcccgcaccgtccagccctcggggccggacagggacactgagaggtcgcgggccggggtgcggccgaggtcggtcaccgtgctcgtcagcgtggccggcctgcccgccacgaccagcggcgagccgtccgtggcgagttcgacggcgggcgggttctcgctccagtgccggtcggcccggacccgtacgagcacggtgccgtgggccggtaccgtcgccgagatggtgcccgccgtgttgtagtcccggtgctgccacaggtcgcgcagggtgtaggcggcggcctgcggcaggccgacggcgcgggcggtggtggcgatgcgccgcggggtgccggtctcgttgaacagggccaccgcgcggctgccgtccttcatctccttggcgacgacccagcgtccgtcctgcgaggagaccaccgtgccctgcttgcccagcgggtcctggtccacggcgatgacgtcccggttggccaggatgtcgaaagtcgcgggggacgccttgcgcaggtcggagccgatgaggagcggcgaggccatgatcgaccacatcgagaagtgcgtgcggtactcggtgtccgtcatgccgccgttgccgacctccagcatgtcggggtcgttccagtggccgggtccggcgtacgcggccagcggcaggttctgtttcaggatcgacagcatcgaggaccacttgtcctggatgtcgtgggtcgtgcgccacagctgtccgaggcccgcggcccactcccagggcttgttgtcgccccattcgcagatgctgtagacgatgggccggccggtcttcccggtggcctgctccagggcgtcgtgcatggtgcggtagcgctgctgcgcgtccacgccctggttgttgcagttgtcgtacttgaggtaatcgatgccccagtcggcgaactgctgggcgtcgctgtactcgtggccgagcgcgcccggaaagccggtgctgctgcaggtcttggtgcccgcgctggtgtagatgcccagcttgaggcccttggcgtgcacgtagtccgcgaccgctttgatgccgtcggggaaacggacgggatcggggacgagtctgccgtccgcgtcgcgggcgggcagggcccagcagtcgtccaggttgacgtactggtagccggcggacttcaggcccttctcgatgaacaggtcggcgatcccctcgaccatggacgcgttgaactccgggccgcagtgggtggagttccagttgttgaagcccatcggcggggtgagagcgagcccttcggccggggcgggtgaggcgggccgctgctcctgggccacggcgaccgagggggccgcgcccccgagggcgagcagcgaggccgtgagtactccgacgactcttcgacgggaggtgcgcgtgtgcgggtgacgcatcgtgaacgttcctccgaactcccgagagatgggatgacttcatgtccgcgtcatcgtgtgcgtttacggtaggacgtgtcggactctgtcggaagggagcgccacgcttgttcagcggttgttcgatatgccgtcacggcctcggcgcaccaaggcgtgaccaacggcgccgtccggcgttgagcaggcatgaagaagcgcagcatgctcgccctcgcctccctcgcgaccggtttcgtcgtggccgccgtcaccccgtcgcacgccgctgatcgcgacgcgctcggcgatctgggcgtgaaggacaccgtgggcgccgtggaccacctggtcagccacgagagcctcgccatggacgacgacgccctggggcagaagggctgaggcggcgaaccggccgggacggcgccgcagtcctcctcgcggggtccgcggcgcggtcctgcgccgccctcaactgggcctggtttccgtggcatggtgaagcgggcaagccacagggggccaacagaagagggggaccagtgaccgtcgtctggatcaacggcacgttcggtgcgggaaagaccaccaccgcacgggaactgatcgacctgatcccgcacagcacgctcttcgaccccgagatcatcggcggcctgctcacgcaccacctcctgccgcccaagcacctcgccgaggccggtgacttccaggacctgccgatctggcggcgcatggtgatcgacacggccgccgccatgctcgccgaactgggcggcaccctcgtgattccgatgaccctgctccgccaggactaccgcgacgagatcttcggcggcctcgccgcccgtcgcatcggcgtccggcatctgctcctcgccccggcggaaacgatcctgcgcgagcggatagcgagccgtgaggtcccgcccggcctgcccgacggcgacctgcgcgtacgccagtgggcctcagaccacatcgagccctaccgcaccgccctggccggctggctcaccgccgacgcccacctcatcgacaccagcgcgctcaccccgtacgagacggccgtccgcatagccgaggccgtcggcagcgacgcggtgcccgcctgcgacatcgtgcagacgcccgagcccaccgccgagaccgtcgcctccggtgtgctcctcttcgacgagcgggaccgggtgctgctcgtcgaccccacctacaagcccggctgggagttccccggcggcgtcgtcgaacccggcgaggccccggcacgcgccgggatgcgcgaggtcgcggaggagaccgggatacggatggaggaggtgccccggctgctcgtcgtggactgggaacggcccgtgccgcccggcttcggcggactgcgcctcctcttcgacggcggccggctcgactccgccacggccggccggctgctgctgcccggtcccgagctgcgcgactgccgcttcgtcaccgaacgggaggccgcccggctgctgcctccggtccgctacgaacggctgcgctgggcgctgcgggcccgtgagcggggcgcggcggtctatctggaagcgggtgtgccggtggggtgagcgcccgcgagggcaggtggacggcgtcccctgtgaagcgcggctcaggcggacgcgcggtatccgtccgccgagcggcgaagtgcctctccggcccgctcggtcaccggagcaccgtgcccgaagcaggccacgtccgcatccagcgccgccagccgccggaaggaggcgacggcccggtcccggtcggtgttgaacacgccgaggatgaccgtgccgtccaccggtgaggcggcgaccgcgtcccccgtgaacagcacgccgtggcgcggcagatgcagaccgatgctgccgtcggtgtgacccggcgcgggcacgacgtgggcgccgccgccgaagcagaggacatcggtgtcggacacctcggtgacctgcggcggccggaccggctcacccgccgggagctgagcgagggccgccgcgtgcagggggcgctcccagtcctcgtagaccggcgggacagcgggcgtctcgcccctgacgaccggggcgtccaggcggtgggccagcacctcggtgccgtacgccccggccagttcaccggcgccgcccatgtggtcctcgtgggaatgggtgagcacgatccgccgcagctcggcgggggcgcgtcccagggacctgatcgcctcggcgatcggggcgcccgcgcccttgggtccggcgtcgacgagcgtcagcccgtcgtcgtcggaccacaggtaggcctggcccacgggaaagcgcagcaggtgcagccgggggaggatctccactacgtccatggcacgaccgtagggagatcccggccccggggcgagggtcctctgctcatggcagagcggacgctccaggacgcccggctcagcccgcgtagttgcgcaggaacagggcctcggcgaccgacaggcgctccagctcctcgggcgagacgctctcgttcaccgcgtggatctgggcctcgggctcgctcaggccgatgagcaggatctcggcccgcgggtacagcgcggcgagcgtgttgcacagcgggatggagccgccctgaccggcgtactgcagctcctcgccggggtaggcgaccgccatggcgtcggccatcgcctggtacgccgggctggtggtgtcggcgcggaagggctggccctggccgatctgttcggtgctcacccgggcgccccacggcgtgtgcgcctccaggtgggcctggagcagcttggtcgcctcgccggcgtcgacgcccggcggcacccgcaggctcaccagcgcacgggcaccggcctgcacggacggcgtggcgccgaccaccggcgggcagtcgatgccgaggacggtgacggccggccgggcccagacacggtcggcgaccgtacccgaaccgatcagctcgaccccgtccagcaccttggcgtccttgcggaactgcgcctcgtcgtaggccagaccgtcccacacggagtcggcggccaggccgtccacggtcgtcgaaccgtcctgcgcgcgcagcgagtccaggacgcggatgagcgcggcgagcgcgtcgggggcggcgccgccgaactggcccgagtgcaggttgccttcgagcgtgtcgacctggacgcggaccagggtcatgccgcgcagggtgctggtgacggtgggcagcccgacgcggaagttgccggtgtcaccgatcacgacggtgtcggccgccagcagctccgggtgctgctcggcgtagcgctccagaccgccggtgccctgctcctccgagccctcggcgatcaccttgacgtggaccggtatgccgccgttcgccttcagggcgcgcagcgcgagcaggtgcatgatgaccccgcccttgcagtcggcggcaccgcgcccgtaccagcggccgtcgcgctcggtcagctcgaagggcggcgtggcccaggcggcctcgtccagcggcggctgcacgtcgtagtgggcgtacagcagcaccgtcttggcgccctcggggccggccaggtagccgtagaccgactgggtgccgtccggggtgtcgagcagggccacgtccgtgaagccctcggcgcgcagcgcgtcggcgatccagttcgccgcgccctcgctctcgctcttcggatactggtcgaagtccgccaccgacttgaaggccaccagctcggccagctccgccctggccccgggcagcagggaggcgacggtctcggcgaccggattcgacgacatgggcacgctccttgtgggtgcgacattgcactcgtgagcaccttgccggtgctctgtgagcacttctgtgttccggatgatcgtgtcagcgcgggcgcgtcctcgtgcgcgggcgcgtccgctgccgatcctcccacagcggacctgggggaaagccgccgtaggatgccagggacagcagcggcagccggcttgatctggagcggtagaccatcgtgagcagcgagaactcttcggcggacgacgtgcagcaggtgtgggacgtcgtcgtggtgggcgcgggacccgcgggggcctcggccgcctacgcggcggccgtcgcggggcggcgcgtgctgctgctggagaaagcggaactgccacggtacaaaacgtgcggcggcggcatcatcggtccctcgcgcgactcgctgccgcccggcttcgaccttccgctgaaggaccgggtgcacgcggtgacgttctcccacaacggccgcttcacccgcacccgccgctccaagcagatgctgttcgggctgatcaaccggcccgagttcgaccagcagctcgtcgagcacgcgcagaaggcgggcgccgaactgcgcaccggcgccaccgtgtcccgggtcgagcagcacggctcggcggtgcccgaccggcggacggtcgccgtggtgctccagggcggcgagaccgtcctggcccgcgccgtggtcggcgccgacggcagcgcgagccgcataggggcccacgtcggggtcaagctcgaccaggtggacctcggcctggaggcggagatcccggtccccgagaccgtggccgccgactggcgcgggcgcgtcctgatcgactgggggccgctgcccggcagttacggctgggtgttccccaaggacgacacgctgacggtcggggtgatctcggcgcgcggcgaaggcgccgccaccaagcggtacctggaggacttcatcgcccgcctgggcctggccggcttcgagccgagcatctcctccgggcacctgacccgctgccgcgccgacgactcgccgctctcgcgcggacgcgtcctggtgtgcggggacgcggccgggatgctggagccgtggacacgtgagggcatctccttcgcgctcaggtccgggcggctcgcgggcgaatgggcggtgcggatcgcggaggcgcacgacgcggtggacgcgcggcgccaggcgctgaactacgcgttcgcggtcaaggcgggcctcggggtcgagatggccgtcggcaagcggatgctggcggtcttcgagcgccgccccggcctcttccacgccgccctcaccggcttccgtccggcctggaaggcgttcagggacatcacgcaggggtcgacgacactgggcgagctcgtccgcaaccatccggtggcccagcgcgccctgagcatgatggaccggcgtcccaccgcggtcgacgagccgaccgccgcgcagaccgaggacgacgcggaggaagcggcggtcggccggcgaccgtgaggccctggccgaagggagcgcggacggcccggagc

SEQ ID NO: 1003 - DNA, 4079 bp, Unknown
  Kingdom: Bacteria, Phylum: Actinobacteria, Class: Actinobacteria, Order: Streptomycetales, Family: Streptomycetaceae, Genus: Streptomyces
  misc_feature (3579)..(3580): n is a, c, g, or t
gtgcctggccggcttcaccgcctggggcgcgacggcctacccggtccccctggcctggggcgcgagcttcgacgcgccgctggtggaggcgatggccgagcgcatcggccgtgacatgcgctccctcggcgtgcaccaggggctcgcgccggtcctggacgtggtccgcgacccgcgctggggccgggtcgaggagaccatcggcgaggacccctacctggtcggcacgatcggcaccgcctacgtgcgcggcctgcagtcggcgggcgtcctcgccacgctcaagcacttcgccggatacgcctcctcgtgcggcgcccgcaacctcgccccggtccgcgcgggcacccgcgagttcgccgacgtcaccctgatgccgttcgagatggcactgcgcgagggcggcgcccgctcggtgatggcggcctacaccgagaccgacggcgtgcccgcctcggccgaccccgccctgctcaccggggtcctgcgcgaacagtgggggttcacgggcacggtggtcgccgactacttcggcatcgacttcctgcagaccctgcaccgggtggccgccggccccgccgagtccgcgcacctggcgctcgccgccggcgtcgacgtcgaactgcccaccgtcaagtgctacggcaccggcctggtcgccgccgtccgcgcgggcgccgtccccgaggacctcgtggaccgcgccgcccgccgggtcctgctccagaagtgcgagctgggcctcctggacgccgactgggaccccggggtgcccgccggtcccgtcgacctcgactcggccggcaaccgggccgtggcccgccgcctggccgaggagtcggtggtactcctggccaaccccgacggggtgctgcccctggcccccggcgcgcggatcgcggtcgtcgggccccgcgccgccgacccgctggcgatgctcggctgctactccttcccctcccacgtgggcacccagcaccccgaggtacccctgggcatcgagatccccaccgtcctcgacgcgctgcgcggcgaactgcccggcgccgaggtgacgttcaccgagggctgcggggtctcggagccggacacctcgggtttcccggaggcggtggcgcgcgcggctcaggccgatgtgtgcgtggcggtgctcggcgaccgctccgggctgttcggccgcggcacctccggcgagggctgcgacgtggcggacctggcgctgcccggcgtacagggcgaactgctggacgcgctgaccgccaccggcgtccccgtagtcctggtcctgctcaccggccgcccctacgccctgggccgctgggagggccggctcggcgcggtcgtccaggcgttcttccccggcgaggagggcggccccgcggtcgcgggtgtgctctcgggccgggtgaacccctcgggccggctcccggtgagcgtgccgcgcgggcccgggggccagccctggacctacctccagccgccgctgggcctggccgacgaggtgagcagcctggacccgaccccgctgtaccccttcgggcacggccgctcgtacacgacgttcgcctgggacgacttcaccggtgaccaggccaccgtcatcggcacggacggcacgtacgacctctcgctgaccgtccgcaacacgggcggacgggcgggcgccgaggtggtccagctctacctgcacgatccggtcgccgccgtgacccgcccggacatgcggctgatcggctaccagcggctggagctggacgcgggcgggtcggcccgggtgacgttccgcttccacgcggacctgtcggcgttcaccgaccggaccggccgccggatcgtcgaaccgggcgacctggaactgcggctggccgcctccagcgcggacgtccgccacacgacccggctgaccctgaccggaccggtgcgggaggcgggaacggagcggcagctgcgctgcgggacacgggtggcggaggagggctgagcagcgggctccggtcgcccgccgccggggaagggccaggatccgctcccggcccgcccggacacgcacaagaccccgccccggagaaccggggcggggtctggtcgagcgccgggcaggccttgcacctgcatctccccgcaggaagcgggacgtctttccttggaccaccaacgcactgctcgcgggccgttgttccggccgcttgctgtgtgatgatcatagcccatcggcggggccgcgcaccactcgtcgccgccggcctccgcgtcccggctagccgggcgccggtgcgtcgtccacctgctcgaaccgccagcggtggacggcccgggtcaccaacgagccgtcgggctcgggcagttcgggcagctcggcgtcataggacgcgtcccaccaggtgatgaccagcacccggtcctgaggggcgctgaacatctcgcggcgcagcggctcctgagggagcgtctggcgccgtgcccagtcgaggagttcgccgccccggcccgtgaccgcgcgggcctcccacatcaacgcgacggtcacgagtacaggttctccttgctggcctcgtgcacgtggtcgtgactgtggccgtggccgtggccgtgcgcgtggcggtgggcctcacccgggacgtgcgggtccgtcaccggcagggaggagtccgccgacagttcccagtcggaggccgcgcggttgcgggcgaccatctccgcgccgagggccgccaccatcgcgccgttgtccgtgcacagcttggggcggggcacgcgcagccggacaccggccgcctcgcagcgttcctgggcgagcgcgcgcagccgggagttggcggccacgccgccgccgatcatcaggtggtcgacgcccgcgtccttgcaggcgcgcacggccttgcgggtcaggacgtccacgaccgcctcctggaaggaggccgccacgtcgcgcaccgggacctcctcccccgccgcccgcttggcctcgatccagcgggccaccgccgtcttcaggccggagaaggagaagtcgtaggcggcgtcgcgcgggccggtcaggccgcgcgggaaggcgatcgcggtcgggtcgccctcgcgggcgtaccggtcgatgaccgggccgccggggaagcccaggttcagcacgcgggccaccttgtcgaaggcctcgcccgccgcgtcgtcgatggtcgcgccgagcgggcgtacgtccgaggtgatgtccgtggacagcagcagcgaggagtggccgccggagaccagcagcgccatcgtgggctcgggcagcgggccgtgctccagctggtccacgcagatgtgcgaggcgaggtggttgacgccgtagaggggtttaccgagcgcgtaggcgtacgccttggccgccgacacgccgaccagcagggcgccggccaggccgggcccggcggtgaccgcgatgccgtccaggtccttcgcgctcaccccggcttccttcagcgcgcggtcgatggtggggaccatcgcctccaggtgcgcccgggaggcgacctcggggacgacgccgccgaagcgggcgtgctcgtcgacgctggaggcgacggcgtcggccagcagggtggnngccgacgccggtctcgtcgcaggaggtctcgatgccgagtacgagaggctcgtcgcgtgagtcagccatgggtcttcaggttccttgtacggagacggaggggtcggacaggcgcatcaccagggcgtccacgttccccggctggtagtagccccgtctgacgccgatgggggtgaagccgaagcgctcgtagagcttctgcgcgcggaggttgtccacgcggcactccagcatcacctcggtgcactcgaaggcggtcgcggcccgcagcagctcggtcagcagccgggcgccgagcccgctgccccacaggtcgcgggcgaccgcgatggtctggacgtcgccctggtcaccggaggcgacgaggccggcgtagccgacgatccggccgttctcctcggcgacgacgtaccgccgggtcgcctgggggccgcgcgagtgggccagctcggaccagaacatgccccgtgaccaggcgtcctcggggaagaggtccttc

SEQ ID NO: 1004 - DNA, 3683 bp, Unknown
  Kingdom: Bacteria, Phylum: Actinobacteria, Class: Actinobacteria, Order: Streptomycetales, Family: Streptomycetaceae, Genus: Streptomyces
cgtctgctcaccggcgccacgtcgtggcgccggtgagcagacgcaccttctgcgccaggctcagcttgtcgaccagccggtcgagcatgtcatcgctcatgtcacaggagccgtccgcgtcgccggcgtcgttcacgcgatggttcatgtcgcggtgcatgtcgccgttcgtgtcgtcgttcatctcgtcgttcatccccacccctgggtgtgccgtggagaccgtctcccgtggtgggagcaggccgagggcccggccggtcccgcggtggcgcacgggaccggccgggccgggcggaccgggccggccgtcagggcagccggtagttctcgtcgagggccgcaccggcctccgggtgcgtctggtcgtagccacgggcgtcgcactgcaggccgcccacgatgcagtggtcgaccatcgccttgagcgtcgcgtcgtcccaggcgtcgaagaagtcgtagtggaaggagtagccgcggccactggccaggcgcacctggctcatgtcaccgttgaccgggaacgccatcttgaactcgatcatcggcaccgccaccgggtgatccgcgggacacacgttgtcgttggtgcccggtttgacgaccggataggccatgtggctcttgtggtccggtgtgtccaggtacttgccgtcccagcaactgggcgcctggagacggatgttgagctggacgtcggcccggttcgggcagctcgccgggaagtccacgttgaagtagctgtcgccgcactcccagccctcgacgaagcccgggtggtggcggaactcgtcggcgctctgcatcgggctgcccacgacgaaccgcagccccttggggaacggccgcacactggtgtagtcggtgacaccggacttgtagtagatcgtctgctgtccgacgggcaggaccttctggtcgccgttgaacagcgagggcatccagtatcccgaggcgtcaccgggcgccttgcaggtggtggcgccgccgtccagggaggcggtggtgctgctggcgtccgtcgaggtgttgcccatgaaggtgtggtcgtgggacttgccgggccggcccgggtagacgatcgggtcgtccggagcggtgtgggtgaccgagcagttggcctggaactcgtggaagtagcggtgcggcggatcggccgaggacggtgtcacaccggtgacctgcggaactgccggtatgtagccgtcagcgtccggatcgtcggcggacgcctgggtggacacggccatcgtgtgcccgctgtgggcgacggcagccgtgacgggcacctcacgaccgctgtcgccggaggcggcggcggaggcgatggtgccggcgccgagggcaccggccaggagcgcggtgccgaggagcagtgcggggagccgtttcggactcgatctcatggggtctcctgcctgtggggtgcgaagagggcccgcgcgcacacgtgtcacgcgggtggtgcgatcggtgcggcggtggcgtaagcccgcgcgggccgcgccaccgccggccggggcacagcggtcagccgtagatccccagttcgtggagcgagtagccccagctcgtgccgcgcgccgtcaggttcaggcgcacgtagcgggcggtggccgacacgtccagggtgtcgacgtcaccgtcgccggcggtggtggagtacaccgagcgccaggtgctgccgtcgtcggacacctgcacctcgtaggacttggcgtaggcggggtcccagacgagctggagcttgcgcacggccttggacgcgccgaggtcgacctggatccactgggggtcgctccagtcgctggcccagcgggtgtcggtgtttccgtccacggccatcgccggggtgcaggggcagtcgccgtaggactgctggaaggaggaggcggtcacgggccggttcagcgccaggtcggtcccgccgaccggcggggcgacgaccttcacggacttggtctcgataccggcgttgccgtgcccgtcctccgcctggacgtagaccttccagacaccgagcttctgcggtgcggtgacggcgaaggtgccgttgcccgtcgaacgccactgcgcgtcgacgagccgcttgtcgccgcctgcgtagttgccgctcaggtagatcttgtaggtgaccggatcgccgtccgggtcacggacgtcggcgtgcaccgtgaactcactgccggccggggcggcggaggccggtgagacggtcatgccgctgatgaccggcggggtgttgtcaccggccgtcgagccggtgtacgccttcttgacggcgtagtacgacagccgcttgagcccgtcgggtacgaggttgaaccagacgcctccgaagtcgtgctcggtgccgtagtggaagagggtggcgcccagggccacgccctggtgtccggtcacgcagttccacgccttcgtgtagccgtccgccttctgcacgtcggtcggctcgtcggggatgccgttggcgtcgttcggcacctcccactcaccggccggcccggtctcggtgatgatgtacggcttggtgtagccgccgtcgatccagtcctggcggaccttgcacacgttgctgtacgagttcatcgcgtacaggtcgaggtcgggcgcgttgcgcttgtagtacggccaggcgccggtccacgcgtcggtggaggtgaccgggtggtcggggtcgatgctgtggatcttcttcgccacgtcgtcgacgaagctggtgtaggcgttgcgctcggcctccagccggctgccgctgtagcagttctgcagaccgaggacggactcgttgccgacgttccacatcagcgtcgcgggatggctcttgtaggcgtccacccacttggcgaactcggtgagcatgttgttcttgtacgtcgtgtcggtcacgtagtcgacgcagccgccggcgccgggtccgccgcccggctggagccagaatccgttgatgacgtggacgccgttggccgccgcggcgtccaggagcgccttgctggagccgtcggtgccccaggtgcggatggtgttggcacccatcgccttcacgtccggcaggtacttgggtgcgtcggagatcgccgggccccaggtgactcccttgacggtgtacggctggccgcgcacggtcagccgccagttgccctgggtgccctcgaccttcacggcgccggtggccggcggcggtgtggtgccgcccgccgagccgtacacctggaactcccacagcgagtacccgtacccgccggagcgggccaggccctgcatccggacgtagcggccggtcccggacacggcgaggtcgtcggtgccgccgtcgccgccggtcaccttcttcagggtgtgccagtcggtgccgtcgtcggacgcctggatctcgtagtccttgccgtaggcgctctcccaggtgaggacgacccggctgaggtcggcttcctgtccgaggtcgacctggagccactgctggtcgctccactggctggcccagcgggtcccggtgaggtcgccgtccaccgctgctgcggcggagtagccgtctccctcctgcgaggaggcggtggcggtcttgccctgggacagcaggttgtcggccgcgtgcgcgctcggcgcgacggcgacggtgagcgaggacgtgaggagggcgccgagcgcgagcagcgggacgccggcgcggcgagggcgccggg

SEQ ID NO: 1005 - DNA, 1691 bp, Unknown
  Kingdom: Bacteria, Phylum: Actinobacteria, Class: Actinobacteria, Order: Streptomycetales, Family: Streptomycetaceae, Genus: Streptomyces
ggcatcccggcgggagggtgcgggggcggtcgatcgtcttgctctgcgggcggacatccgcagcagggacggcccggcatgagccggctcataccggagccggaccgcttcggatcacaggagtccgagctgggcgacgagcatggcgatcaccacgacgagggtccagccgaggatgtgctcaagggccttggggccgtcaccgtcgtcccggggaccgccggtgcgggttcgtgcgggtgcggcggtggccgaaggagcggtcatggtctctcgcaggggtcggacgtgcggtgcggactcccccgcgggcgctgcgcccgcctcgtgtccaccttgccaccggtgccgcctcacgcggcggagagcttggtcacagggcttggccacaggtgttggtcacgggccttggtcgcgggtggggctccggtcgcccggggccccacccgcggtcgccgccggtccggtcagcgcacgcccaccgcttcgagcgccgcgcgctggcggagcgtggggcgcgccgggaagtacaggtagcagacgccgccgctgccggagacgaccttgccggaggcgttgtaccgcttcgtcctgagccagatgttctcgaactcttggcgccggtagacgcgccggaccgcctcgtcgctcggcgaggccgggtcgttggcgatcacgtcgccgtcggcggtgaaaccgatgaccgtcatcaggtggccggaagtgccgtatcccgctccggtcagctcggtcttgaggaacgactgtgacgttatggccgggatgccggccgcgatcagcgtctccaggtcggtgagcgagccgagccgggtgatgacgccctgcaggtccttgaacgtggccgcgtaggccgcgttgaagggccagttgccgcagcccgcgtactggtagtcgtacgtggaccgggccgcatggcagacctgcgggtcggcgtaggacgggtcgacccacgagagttgggcgggggtgagccggccgccccagtactcgacgatcatctgcgaggaggtgggactgcaccaggcctcgccgccgttgtcgtactgggggtactggcccgcgtggatctcctgcgaatagcgcggaacggtgagttccgcgcccacgcgtccgggggtggaggcggggacggtgaagcggtcggggatgtcggagcccatggcgccgatgcgccagaccgtcggcgtgagcttggtgcccggcctgcggtagagggtgaggcgcagccggtacgcggcgagacgcagcccggaggccgggtcgtcgacggagaaggtgtccgtccagatcgtgctccggccgtcgctctggccgtccacggaggtgcgcttgatgtcctggtcgccggccgcccagcggcccatcacgtaccagggggtgtcggtgccgtcggagtacgtgccccgcagctccacctggagccaggtgccggccggcgtgtgcgcgttccaggaggcgatcgcttccgtcgcgggcacggggagccggtggaccgggccggtccaggtggcgtactcccacgcggcggtggtgccggtgtgcgggtcggtgtagtcggtggtgccctgcggggcggcgatctccagccccgggcgggcaccagccaccgcgcgggtgccctggcgggcgcctgcgagccagtcgacgtacgtggtccaggaacggtagtc

SEQ ID NO: 1006 - DNA, 4726 bp, Unknown
  Kingdom: Bacteria, Phylum: Actinobacteria, Class: Actinobacteria, Order: Streptomycetales, Family: Streptomycetaceae, Genus: Streptomyces
gagcgcgcggcaccggccgcgccgggccgggggcgccgcggccggtgccgcgcgctcttcgggaggactgtcgaccaacacgtagttaggttagcctaccctcgccaagccctcgacagtgccgtcactgcgtccccgaccgcgcgtcacaaccccagccgcgccagcgccttccctccatccagcgcgcacgcgctctcgccgcccgccgtccacgccaccgcgcacagcgcgcgcagcccgtccatcggctgcccttcgccgctcagcgccaacgcgtcggcgcccgccgtcgccgtccacccaccgcaccggaaaccgtcaccctcccgggtgatttccggctgcccggtgagcaggccgcgcagatcggcgtcgacgtacgtcggccggtgctcgggcttcgcggccagcagccgcgccccgtcggtcaccccggtcagcacgagcagcgagtccaccccgccgttgaacgcgccctcgatgtccgtgtccagccggtccccgaccaccagcggccgccgcgcgccggtgcgcaggatcgtctcgcggtgcatgggcggcagcggcttgcccgccacctgcggctccgcgcccgtggcgatccggacgacctccaccgccgcgccgttgcccggcgcgataccgcgcgcgctcgggatcgtcagatccgtgttggaggcgaaccagggcaccccgcggtgcagggcgtagcacgcctccgcgaaccgcccccacgccatctcgggaccgccgtacccctgagccacggccaccgggccgtcctccgccgactccaccggctccaggccgcgctcgcgcagcgccacccgcagcccctcaccaccgacgaccagcacccgcgcacccggcggcacctgatccgcgatcagccgggccaccgcctgcgccgaggtgacgacgtccgacgcctcggcccgtatcccgaggtcggtgaggtgctcggccaccgcgtccggcgtgcgcagggcgttgttggtgacgtacgccagccgcatgccgcccgcgcgggcggtggccagggagtccacggcgtgcgcgatcgcctcaccccccgcatacaccaccccgtccaggtcgagcagggccgtgtcgtacgcctcgctcagggcccgtccactgccctcgggcctcgtcctgacgccctggctcattccgcatcgctcctcgtggtaccggttttccctcgatcatcccccatgccactgacacacgtacgatgccgggatgaacacagcaggtcactcgccggcaactccgcgccgcggcctcgacctcaccccgttccgaggcctccgctacgaccccgaccgggtcggcagtctggccgccgtgacatctcctccgtacgacgtcgtcgtacgccccgacggcctgcaccacctccagtccgccgacccgtacaacatcgtccgtctgatcctgccccaggccggcacccccaccgcccgcaacgaacaggcggccgacaccttgcgccgctggctcgccgagggcgtcctggccgccgacccggagcctggcctgtacgtctacgagcagcgggacggcgacggcatgctgcaacgcggcctgatcggcgcgctgcgcgtgtcggaccccgccgagggcgtggtgctgccgcacgaggacgtgatgccgcacgtcgtcgccgaccgcgccgccctgatgcgcgcgaccagcgccaacctcgagccgctcctgctcacctaccgcggcaacggctcgacggccgcgacgaccgtggtcgtcgaacgcgccgccgaacagccgccgctgctgtgcacgaccaccgaggacggtttcagccaccgtctgtgggccgtcaccgaccccgacgacctggccgggatccgggaggacctgtcccagcaccaggccctgatcgccgacggccaccaccgctgggcgacctaccggcgcctgcgcgcggaacatccctcccccagcgcctgggactacggtctcgtcctcctggtcgacaccgcccgttaccccctgcgggtccgcgccatccaccgcctgctgcacggcctcccggtcgcggacgcgctgtcggcgctgggcggcctgttccgggtgcgccacctggacggcgtacggctgcccgaggcgctggagaccctggcggacgccgcctgcgcgggcaacgccttcctgctggccggcgacggctccttccacctggtggaccgccccgacgccgctctcctggcccgtacggtccccgccgaccacccggcggcctggcgcacgctcgacgcgacggtcctgcacgccacgctcctggagcacgtctggcacatccccgaggacgatccgacccgcatcgcctacatccacgacaccgccgccaccgtggccaaggccgagcgggacggcgggacggccgtcctgctgcacccggtccgcgaggacgtggtgcgcgagctggcccgccagggcgtcaccatgccccgcaagtcgacgtcgttcgggccgaaaccggcgtcgggtctggtgctgcgggcgctggatctgtgacacgccggaggaaaagacgcgggacgaaaaaaggggcgggccccgaccggcttacggtcggggcccgcccctcttctctgtctctcgcgacaggactcagtccttgtcctcgtcctcgtccttgtcctcgaccttgtcctcgtccttgtcgcgctccggggagacgctgccggactcgccgtccgtaccctccgcgccgtccacgccgttctcgtcgagcgcgtcgttctcgtcgagcgcgtcggtgaactccacgccgtccagctcggccaggcggtccgaggcgtcggtgctgccgtcccggtcggcctcgacggccttggcgaaccactctcgcgcctcggcctcacggccgacggcgagcagcgcgtcggcgtacgcgtaccgcaggcgggcggtccacggctggacggagtgggaggccagctcggggctctgcagcgtcacgatggccgcctccagctgccccatgtcgcgccgggcaccggccgcgacgagccgcatctccacctgcccggccttgtcgagcttgtgcacctcgggcgcaccggccatgtccagcgccttctccggccggccgagcccgcgctcgcagtcggccatgacgggccacagttccgtgttgccggtcatccgccgggcggcacggaactccgcgagcgcctcgctgtacttctggctggcgtacgcggcgaatccggccgcctcccgtacggcggcgacgcgggacgccagacggagggcgaccctggagtagccgtacgcggcctcggggtcctcgtcgatgagccgggccaccatcaccaggttcctggcgacgtcctcggcgagcgtcttgggcaggctctggagttcctgccgtacgtccttgtcgatctcgtcgccggtgacctcctcggggatcggcagccgcttgatcggctcgcggtcccggtcacggtcacgctcgtcgcggaaccggccgccaccacggcggtcgtcgcgccggtcgtccctgcggtcatcgcggcggtcatcgcggcggtcgtcgcggcggtaggacggacggtcgccctcacggcggaacccgccgggacgcccaccacggtcaccctcacggcggtcgtcgcggcgacccgcgtaaccaccacggtcacggtcaccctcacgccggtcatcccgccggtcatcacggcggaagccgccacggtcgggacgctccgaccggtcgtcacggccccggaaacctccgcggtcgtcacgctggccgtagccgccccggtcgtcacgccggtcgtccctgcggtcgtcgcggcggtacgtgggtcggtcgccctcgcggcggaaaccacctcggtcgccctcgcgccggtcatcgcggcggtcgtcacgccggtcgtcacggcggtcgtcgcggcggtaggacgggcggtcgccctcacggcggaacccgccgggacgcccaccacggtcaccgtcacggcggtcgtcacggcgacccgcgtaaccaccacggtcacggtcaccctcacgccggtcatcccgccagtcgtcacgacggtcatcacgacggaagccgccacggtccggacgctccgaccggtcatcacggcgcccgaaaccaccacggtcgtcacgccggccgtagccgccccggtcatcacgccggtcgtccctgcggtcgtcgcgacggtcgtcgtcgcgacgaccgtatcccgcacggtcgttgctgcggcgcgggctgccccggaagccgccacggtcaccgcgttcaccgcggtcaccaacgtcccggcggcgctgatcgcgctccggacgctcgtcgggagagttggtggacatcggtgactcctgtctgctgtaccgcaaagtcattctcacgcagccgggtacccggcgcgctgcaagctgtgttcggtgaaaaaacgaaaggacccctggtcccagctgaacgctggtgaccaggggtcctccaaagattgttcggcggtgtcctactctcccacagggtcccccctgcagtaccatcggcgctgtgaggcttagcttccgggttcggaatgtaaccgggcgtttccctcacgctatgaccaccgaaaccctaatggtttcgagcgaacaagcacactctttaattgtgagttcggctcaaagccggcaactgttcgttgcctcagaacttacacagtggacgcgagcaact

SEQ ID NO: 1007 - DNA, 1936 bp, Unknown
  Kingdom: Bacteria, Phylum: Actinobacteria, Class: Actinobacteria, Order: Streptomycetales, Family: Streptomycetaceae, Genus: Streptomyces
gcgtcgggggccgcgggccaggcccggccgagccgcggcggtgcgacggaccacggcatgaggtccgccagcagcggggcgtcgtcgtgcgtcacgccgggcatcgtacgacgcggcgacggcggacaggtcacgtcgcgtcgagcgtgaccgtgaaggagaagcggtccccgcggtagtggatgaccaccacgtccagcggccggcccgcctcgtcgtaggtgatccccgtgtagtgcaggatcgggctgaggagcggcacttggagcagccgcgccgtctccgggtcggccagccgcgcctgcacggtgtccgtgatccggctgatgccggcgcccaccacgtcccgcagcaccttggtcatcggccagcgcaccaggtcgtccggcgatatccgctccgccagctccggacggacgtagttgcgggcgtggttggtgggctcgcccgtcttctcgtcgctgcgcagccggtggtaggccgccacctcctccaggtccgggaagaactcggcgagttcaccggtcacggccgtcgtgccgtggtccagcagctcggtcgtcatgccggactgctgggccacgatcgcgtccaccgagccgagcagccgcaccggggcgccccggtgggccgtcggcgcgatgaacgtgccgcgccgccggtgccgggtgatcagaccctcgtcctccagctccttcagcgcctgccgcatggtcagcacgctcacgccgtagtgcccggcgagttgttcctcggtgggcaggcgcagcgggtcccggggcgagcggccgaggatggaggcgcgcagcgactgcgacacctggtaccacagcggcagcttgcggttcaggacgatcgaatccggagcgaaggaggtcacgggctatccgtaccggtcgatcccgttcagtgcaacggcctgaagtgcttctccaggccctgccagacgtcgtcgtagcgctgctgcaggtggtccgcgcgggccgcgtgcggcgtgagcgtcaccggccagcgcgtctcgaacatgaacgccagcccgtcgtcgaccttctgcggcttcagctcggccgcgctcgcccgctcgaaggtctcccggtccgggccgtgcgccgacatcatgttgtgcagcgaaccgccgcccggcacgaagccctccgccttcgcgtcgtaggcgccctcgatcaggcccatgtactcgctcatcacgttccggtggaagtacggcggccggaaggtgtcctcgcccaccagccagcgcggcgcgaacacgacgaagtccacgccggccaggccgggggtgtcgctcggcgaggtcagcacggtgaagacggacgggtccgggtggtcgtacgagatcgtcccgatgacgttgaagcggcgcaggtcgtagacgtacggcacatggttgccgtgccaggcgacgacgtcgagcggggagtggtcgtaggtggccgtccagaggttgccgcagaacttgttcaccacctccaccgggccgtccacgtcctcgtacgcggcgaccggcgcgcggaagtcacgtgcgttggcgagcccgttggcgccgatcgggccgaggtcggggaggcggaagggggcgccgtagttctcgcagacgtagccgcgggccgtcccgtccagcagctccacccggaagcgcaccccgcgcgggaccagcgccacatggccgggctccacgtgcagcaggccgaactccgtgcgcagcagcagagcgccgcgctccggcacgatcagcagctcgccgtccgcgtcgctgaagacgcgctccatcgaggagttggcgtgatacaggtgcaccgccatgccggtgcgctgggtgacgtcaccgttgccgccgagggtccacaggccggccaggaagtccgtctccggccccggctgcgctgggacccgctgccgcagccggggccggagacgg

SEQ ID NO: 1008 - DNA, 1689 bp, Unknown
  Kingdom: Bacteria, Phylum: Actinobacteria, Class: Actinobacteria, Order: Streptomycetales, Family: Streptomycetaceae, Genus: Streptomyces
ccgctgcccactgcggcgaccacgcggcgaccggtcccggcggggctgccccggctgctgctgaagaagcggcggcggaagtgacgtgacgcggtcgggacgaccgcggtgggcgccttggccggcggaggcgccctgagggcctctcaggacgccgggagctgcttgccgtagtcgaccgtctcgtgcgcgtccggctcggtcagcgggaagtccttgccccactccgagaagctgagggtgcccgcgtcgccggcgcggaccagccgcagcgggtagggggtgccttccagggcgacgtccagggtgccgccggtgcccttgccgccggtgacgcggatggtgcggacgccggactgctcgtggtggccgtccgtcgccagggtgccgtgcagcgtcagcaggctctccaggagcacgtccttgtccgtgaagccgctgaagcgctggtaggcggggtcgcgccgcggcaccttcacgtacttgccgtcgagcttgtccgccgccccgccgtccgcgccgctcgtcccgctcccgtcaccgttcttcgcgctcccgccgccctcgccgtcggcgttgttccagaactgcgcgtccgccttcaggtacagctgctcgccgatccgcagcagcccgaacgtgaccccctgcgaggtgaccgagccggtgccgccgtcggacttcagacgcatgtcgagccggtacgtccggccgttgctgacgacgtccccggacaggtgcacggcgccggcggacccggcggcagccctggtcctggcctggatccggtcggccggcagcttgccgacgccgttggtgcccgcgtcgggatcgcccgaggagcaccccgcgagccccgcgcccgtgacgacgacgagcgcgcacagcgcgctcgtcagcgcggccctgcgggtacggcggcacgggggaatcgcagtcacgggcggcactgcctttctgctcgcaagcggcgggtgcggggaaacggcgggcgctgcgaggcgtacgcggggtgcatgccgggcaggcggcgcgacgggcaggcccgagggcagcgtaccgggggcggcgcggcccggcggagccagtccgtccgcaccgctcaccagggcgtatccgaacgggacgggctagcctgaagcccacttgagcgggcagggggaaaggacaccccggcatccaccacatccacggatgcctcggacaggcaccgagagcacgtacgtcaccgagcatgcaaaggaggcgcggtcatggcagcgggcgccccccggatcttcgtctcgcacctcgccggtgtcgccgtcttcgatccgacgggcgaccaggtggggcgcgtgcgcgatctggtcgtcatgctgcgcgtcggccgccggccgccccgcctgctcggcctggtcgtcgaactggccacccggcgccgcatcttcctgccgatgacccggatcacgagcatcgagtcgggtcaggtcatctccaccggcgtcctcaacgtacggcggttcgagcagcggcccaccgagcggctggtcttcggcgaactgctggaccggcgggtcacgctcgtggagagcggcgaggaggtcaccgtgctggatctgtcggtgcatcagctgccggcgcgccgggactgggaggtcgaccgcgtcttcgtccgcaagggacgcaagaccggcgcgttccggcgcg

SEQ ID NO: 1009 - DNA, 559 bp, Unknown
  Kingdom: Bacteria, Phylum: Actinobacteria, Class: Actinobacteria, Order: Streptomycetales, Family: Streptomycetaceae, Genus: Streptomyces
cgcgccggaacctggtggtgccgcgctgctgttcggcgagtgtgtcactgctgaccccccgtggtcatccgtcgccgcaagtatccctgccgggaccgacattcgcaccggccttcactggatcttgatcaggccgcagcgaggtcgcccggcggcgcacacgacgaacgccctgcaccaccccttgcccatgaacacgccgcacggatcggttcggttccctcggcggacatccgttcgcaccacgcgcacggctgatcgcacttgccgcgtgatcgaacaggcctccgtaccggacggcttcccccccggctacccggaccgcccgtgagctcgacggtccgctgtacgccgcggtgacggactggccggcgacgtcctggccgttcgagaaggccgcctaccggatcggacaaccctgacgcttcggcgcgttcagccaccgaagtacgcgcgcaccctgtcctggacctccgccggcgcccccacacggtccaggcccagcagggccgcgcccagcaccgggcgggccgtcaccacctgcgggacggccttcggg

SEQ ID NO: 1010 - DNA, 1427 bp, Unknown
  Kingdom: Bacteria, Phylum: Actinobacteria, Class: Actinobacteria, Order: Streptomycetales, Family: Streptomycetaceae, Genus: Streptomyces
gctgacggctgccgccgaccgctacctcgcgggcggcgacctggaccggacgacgacgtccggcgcaccgggccgctacgtaccgctgcccgcctacccctggcagacccggcggtactgggcgggcgaggagcagcacggcgaccacgctgcgcaggacgggccgggcggcggcgacctggcgtcctgggtgctgcgcgagcacgcccgcaccggcttcgacgacacctccagcctgaccgacatcggcatcgactcgctcgccaagctgcggatcgtcgtggaactggccaaacggtgcgggcaggagatcgaccccgaggaactcggcgggctgcgtacggtcggtgagctgcggcagtggacgctgacgctcgaggcggccggccgatgaaccctccgtccaccctctacggctggttcgcccgctcggccgccgcccgtcccgacgcgcccgcgctggaggtcgccggggctcacctgacctaccgggaactgcgcgaggccgccgaatggcacggcgccctggtcggcaagtcgctgcccggcggaaccgtcaccgccgccgcctggaccgcgctcaccgacgagctgatcgaacgcctcgccgcgctcccggagttggacggcctgtggtacgacatccacggcgccatgacggtggaggggatcgacgacgccgaggccgtgctgctggagcgcatccgcgccaccgtcggccccgacgtgatcgtctccacctcaatggacctgcacggcaacgtctcgcgcgaactcgcccaccgcagcgacctgatcacctgctaccgcatggccccgcacgaggaccacatggagaccaaggagcgtgccgtacgcaacctggtcgagctgctggtgtccggcgcgccccgcccggtcaaggcatgggtgccggtcccggtgctgctggccggcgagcagacctcgacccggatcgaacccgcgaagagcgtgtacgcggcggtcgacgaggtcgaggccgccgacggcgtgacggacgccgcgatctgggtcggctacgcctgggcggacgagccccgcaaccgcgccgtcgtggtcgtcaccggcgaggacacggcagccgtctcggccggcgccgaacgcctcgcccggggcttctgggacgcccgccacgacttcgacttcgtcgccccgaccggcacctacgacgaactcctcgacgaggccctggcctgcgaccagcggccgtacttcatcagcgacaccggcgacaaccccaccgcgggcggcgcgggcgacgtcacctggggcctgacccggctgctggagcgccccgagttccagaaggaggacgggccgaccgtcatctacgcctcggtgcccggccccgccgcgatcgagaccgccgtcgccgccggggtcggcgcgaccgtcaccgtcaccgc

SEQ ID NO: 1011 - DNA, 6548 bp, Unknown
  Kingdom: Bacteria, Phylum: Actinobacteria, Class: Actinobacteria, Order: Streptomycetales, Family: Streptomycetaceae, Genus: Streptomyces
gacggactgcgcgggcggggctggccccgcccgcgcagtccgtccaccccgacatccgcgatctggaggggctggcggcctcctgcgcgcacggtcgcgcgttgggcttcctcggccgggcggccatccatccccggcagttgccgatcatcgaacgcgcctacctgccgaccgaccgcgagctggaggaagccgagacggtcgtcaaggcggccaccatggaccggggtgcccatgccctcgccgacggccgtttcatcgacgcggcggtggtcgcggcggcacggcggaccctggcgctggcccgcaggtactgacccggcgtgcgcggagggcgcccaccgagaacgggggcgccctccctgcacgtacggccgtcggcggtcagcccttcttggccgagcccgcctcgtccttcacaccggccgtctccggggcgtcgtcctcggtgccggcaccggcgtccgccgcaccgggagccgcatcggcggctttcgtgtcggcagtcttcgtgtcggcggccttcgtgccgctcgccttggtgacgctcaccttgccgtcgctcgccttgccggcggcgggctgcggcgccgcgtccgcaggggcggcggcgtccttgccctccggcgccttgccctcggcctcggcctcggtctcggcaccgtccgggccggtgttctcaccgacggcgggcatgccccgctcgacctggacctcacggcccggccgcttcttcgacgagacccagatgtaggccaccgcgagcaggaagacgaccagggccgtccagtcattcagacgcagaccgaggatgtggtgggcgtcgtcgacgcgcatgtactcgatccagccgcggcccacgcagtacgccgccacgtacagggcgaacgcccggccgtggcccagcttgaagcggcggtcggcccagatgaccaggatgccgacgccgacgcaccacagggactcgtagaggaaggtcgggtggtagtaccccggcacccggccgtccgccgacgaggtgatgtgcagcgcccacgggacgtgcgtctcccgcccgtacagctcctggttgaaccagttgccccagcggccgatggcctgcgcgaaggcgatgcccggtgcgaccgcgtcggcgtacgcgggcatcgggacgccccggcggcgggcgccgatccacgcgcccagcgcgccgagcgcgatcgcgccccagatgccgaggccgccctgccacaccttgaaggcgtccacccagtcacggccctcgctgaagtacagctcgtagtccgtgatcacgtggtagagccggccgcccaccaggccgaacggcacggcccagaccgcgatgtcggccaccgtgccggcccggccgccgcgggcgagccagcgcttgttgccgagccagaccgcgacgaagacgccgatgatgatgcagaacgcgtagccgcgcagcggaatgggaccgaggtacaccactccgtgcgacgggctgggaatgtaggcaagttccatggcagggtcgacgctaccgcagccggagcgggcccaggacgagcatcccggatacgggtccgtaacgggcgctcgccccagggcggtgcggcccgcggacgcacgcgccccttaccgagcccttgctcatcccttggctgccgcttccacctgctgcttgagcttggccggggtcatcgaacggtcctcgatgatgttcttgccgttcagcaggaccgtcggggtgcccgagaagccgccggcctggaaggcctggtgggacttgtcgacccagctgtcgtgcgtgccgttcttgacgcagctctcgaaggacggggtgtccaggcccggcaccttgcgggcgagctggatcagcttggcgttgtccgcgtaggcgtcgtccgtctccttgggctggttctcgtagagcacgtcgtggtaggcggggaacttgccggcgtcctgggcgcaggccgcggcgttggccgcgcgcagcgaaccgctgccgccgaggttgccgtcgatcagccgcgccaggtggtactcgaccctgagcttgcctgcggcggtcagctcgtggatggtcggccggtacgccgcctcgaaggcctggcaggccgggcagcggaagtcctcccacacggtgagcgtcgacttggcgctgtccttgccgaccgggatcgcgagactgtccttgccctgcgcgcccgagggtgccgcgaccgggcccgtactggcgctcttcttcttgccggagttcgcggcaagcacgccgatcaccgtcgccagggccagcacgcagaccacactggtggcgacgatcagcgtgcggcgccgccgctccgaggccttctgcttctcgcgctcggccgccagccgctggcgggcggggcgctttccgtcatggttcttctcgctcacacccccagaacgaaccggggaggcgcattgcgcctccccggtctcaggtccacccgttcgagtgaccgaatgtcctgctgtgcccggctatgcctgtacggccgtgccggtccggtctgtgcccacccggctacgcctgtccgcgcaccccgcgggccagttccccggcgagcgtgcggacggcctcgacaccggccgccgcgtccggggcgtccagcatccgcttgacgaacgccgaaccgacgatcacgccgtcggcgaagcccgcgacctcggcggcctgggccggggtcgagacgcccaggccgacgcagacgggcagtcctgtgccggtggcccgggtgcgttccaccaggtcctgggcctgcgcgcccaccgactcgcgggtgccggtgacgcccatcagcgaggcggcgtagacgaagccggaaccggccgcggtgatctcggcgagccgttcgtccttgctgctgggcgccacgacgaagacggtccccagagagtgcttctcggcgtgctcacgccacagggcggactcctggacgggcaggtccggcaggatgcacccggcgccgcccgcttccgcgagttcggcggtgaaccgctcgacgccgtagcggtcgatggggttccagtaggtcatgaccagcaccggcttgccggtggccgcgtgggcctcgcggacggtccgcatcacgtcggcgatccggacgccaccgcgcagcgcgatgtcgtcggcggtctggatgacgggcccgtcgaggaccgggtcgctgtgcggcaggcccacctcgacgacgtcggcgccgccgtcgaagacggccttgatcgcctcgatgccgccgtcgacggtcgggaagccggccgggaggtaggcgatgagcgccgagcggccctccgccttggcggcggcgagggtctcggtcagcagctggacgttcccgctcacttggcgtccccctcgatctcggcggtgtcggcggcgtcggcggccacctcggcgtcggtgtcgtacaggccgaagtagcgggcggcggtgtccatgtccttgtcaccgcggccggagaggttgaccacgagcaggccgtccgggcccagctcgcggccgacctccagggcaccggccagcgcgtgggcgctctcgatggccgggatgatgccctcggtgcgcgacagcaggcgcagcgcctgcatggcggcgtcgtcggtgacggcgcggtactcgccgcggcccgagtccttgaggtaggagtgctcggggccgatgcccgggtagtccaggccggccgagatggagtacggctcggtgatctggccctcgtcgtcctggaggacgtacgaacgggagccgtgcaggacgccgggctcgcccgcggtgagggtcgccgcgtgctcaccggtctccacgccgtgcccggcgggctcgcagccgatcaggcggacgccctcgtcggggatgaaggcgtggaagaggccgatggcgttggagccgccgccgacgcaggcgatcgccgcgtccggcaggcgtccggcgcgctccaggagctggcggcgggcctcgacgccgatgacccggtggaagtcgcggaccatggccgggaacgggtgggggccggcgaccgtgccgaacaggtagtgggtgcggtcgacgttggcgacccagtcgcggaacgcctcgttgatggcgtccttcagggtgcggctgccggacttcacggccacgacctcggcgccgagcatgcgcatccgggccacgttgagcgcctggcgctgcgtgtcgatctcgcccatgtagatcgtgcagtcgaggccgaacagggcacaggcggtggcggtggcgacgccgtgctgtccggcgccggtctccgcgatcacccgcgtcttgcccatgcgcttggtgagcagcgcctggccgagcacgttgttgatcttgtgggagccggtgtggttgaggtcctcgcgcttgaggaacacccgggcgccgccggcgtgctcggcgaagcggggcacctcggtcagggcgctgggccggccggtgtagtgcacgagcaggtcgtccagctcgcgggcgaaggcggggtcggccttggccttgtcgtactcgacggcgacctcgtccacggcggcgacgagcgcctccgggatgaacttgccgccgtacgcgccgaagtagccctcggcgctggggacctgcccttccgggtcagggaagaagaattcgctgggcatgccggaacctcacggtgagtgcgtgacgtgacgtcgaagaacactgttcgccgtggggcggggggctggctgctccgggccgcggtctactctcggccgcgcaccggatgcggttgctcgcgcagttccccgcgccccttcaggggcgctgccatcgcatgccgttgacctggccgggttcgtcaccgatgacgtaccggacgcggcggccgtgcacccggcgggcgggcgcgcggcagccacggggccggcagccgcgcgccaggcgggcgtagcggtccgtggtcggcacggtggtcagggacgtcatcgcggatgattctacgggtcagccgcgcccgtgccgcagtgccgggtgggcaccggcggccaccatgtcggcgacggcggtcttcgggtcgcggccggtgacgagcgactcgccgaccaggaccgcgtcggcgccggcgttggcgtaggcgatcaggtcgtgcgggccgcggacaccggactcggcgaccttgacgatgtggtcggggatctccggcgcgacctgctcgaaggtgttgcggtcgacttcgagcgtgcgcaagttgcgggcgttgacgccgatcaccttggctccggcgtccaccgcgcgctcgacctcgtcctcgtcgtggacctcgacgagcggggtgagtccgatggacacggcgcgctcgatcagcgactccagggccggctggtcgagggcggcgacgatcagcagggcgaggtcggcgccgtaggcgcgggcctcccacagctggtacgacgtgacgatgaagtccttgcgcagcaccgggatgtccacgcgggcgcggacggcctccaggtcggcgagcgagccgccgaagcggcgctgctcggtcaggaccgagatgacggcggcgccgcctgcctcgtagtccgcggcgagtccggccgggtcggcgatcgcggccagcgcgcccttggacgggctggagcgcttgacctcgcagatgaccttgacgccgtcgccgcgcagtgcggccactccgtcccgggcggggcgggccttggccgcgcgctccttgagctcttcgaggctgacgcgcgcctgccgctccgaaaggtcggcacggactccgtcgatgatctcgtcgagcacactcacgcgagcggcccccttccagacggtgggatgttccagcgggtcgagcggcctccggcgggccgcctgaagcggatcgggcggatctggcggatcaggcgggaggaaccggtggtcactgcgatggtatccgcaggagggacgaggcctcgcatccggccgacctcggtcccattacctggacagacaccggacgatcaagggtggagccagccgccgaagggcaggttccggacaacggtgaaagccacgaacagggcgcccagggtccacaggtgcaccgggcgcggttcgagccgcaggggccgcccgcggatcgtgaggggccgtccgcggaccgtgcggaccacccagagcgtccacacgacggcgaagaccaggcagccggcgacggcgggcgcgttgtcccgcagcgccgcgaggaggtcgccgtggacgagggcgtgcgcgctgcgcagtccgccgcagccggggcagtacaggccggcgtagcgcaggagggggcaggcggggtagtgccccggctggttcgggtcgaccgccccgacgtacgcgaaggcgccggcgacggctgccaggaccgcgcccgggacggcgagccgcccgcacacggtccgggcgtcccgcaccggcgccgccctgtcctcgggcgtgcaccgcgggcggggaacgggcatccgcccggacgccacccgctgcctgtcagcgttcaccccacgcattctgcccggcacacacggcacgcgcgcggggagcgacgggtacggggcgtggg

SEQ ID NO: 1012 - DNA, 1923 bp, Unknown
  Kingdom: Bacteria, Phylum: Actinobacteria, Class: Actinobacteria, Order: Streptomycetales, Family: Streptomycetaceae, Genus: Streptomyces
cgtgacgcccgtgccgaacaccaccgcgtcccccaggtccgaggcgatgcgtacggccgtcgcggtgaccagggcggggccgctgggcgcgagcagcatggccagtccgcaggcggcgtcgcgccacgccagcgggcgcagtgccatggcggtgtgcggacgggtgttcccgtccgggtccaccagacccaccgggcgggccagccagtccggccggtacgccgccacggctccgtacacggccgtcgccgccccgaccgaacgcagcagtcctgtacgcaccgacgcacctccactggaaagagaccctgatgagcgaaaggcccgcaaaaggcccctcatgagcgactggcaccagtcgccctgtttctcgtatctacgtaccctattccgcctttttgggtgcacagtggaggaagtactaccccctacaggaggcggtcatgatcctcctcggcgtcattctgctcatcgtcggtttcgtcaccggcatctcgatcctgtggaccatcggcatcatcctggccgtgatcggcgcggtgctgtggctgctgggctccctggggcacgcggtggccggccaccgccactactggtgaccgacctggaggccgccccacgccacccattcgccccgccgtcacccgctcttcggcgcccggcacaccctcccgccccggttcgatgaacggaggctgtctattccgtgcgggtcggggtaaccggagatgcggaagagcagtaacacaatgtgacagtttgaggcaaccgtatggccatcccgcttaggcagaaggcgtcggatgagccggaccgggacaggaacacgcccgccgcactgcgctgggtcgcccgctgggacagtggggcgatcaccgccgcggaggcgcgcgcggccgtcggcagattcctggaccgggtccgtgtcaccggccgcacccacgtcaccgaccgcgtggcacaggacgcgcaactggtcgtcagtgagctgatcaccaacgcagtacggcatgctccgggtccttgcgggctgcgcctggaagcggagctggagagcgggctcgtccggatcagcgtctgggacgcctcgccccagccgccccggccccgcccgcgcgacggacggcgcgtcggcggacacgggctggagatcgtcggcgcgctcagcggcagcgtgaccgtcacggaccgtgacacaggcaaggagatcaccgcccagctgcggctgcccgccccctcgacgggcgggtgagccgcgtcccctgccggtcggctccgtcacgtcacggatcttgactgcggcgccaccgcggctttagcgttcccgcgtccagcgtgattgaaacgattcaaccacgaccgtacggctggggacggaaagtcatgcacgaatccacatcgcggcgcggcgggacagcgcggcgtacggtcctggcggcggggctggcgaccggtaccctcgccgcgctcggccaggtccccgcggcggcggccaccgccggcccggccacggcaccggcggagggcacgttcgccggcaccctcgcgcacgagcgcctggatgccgcctggttcgcccgtccggcccaagcaatgcgccccaagttccgttggtggtggccggacggactggtcgaccccgacgaggtcgcccgcgagatagaccagatcgccgacgccggtttcggcggcgccgagatcgccgccgtgcaccacagcgtcagcgacaagtccgtcctggacaccgcccggcacggctggggcagccggccgtggcgcgacggggtcgaggcggcgctgcgccgggccgcgcggcgcgggctgaccatcgacatcacgctgggcccgagttggcccgccgccgtccccggtgtcctcccggccgacgaggccgcggccatggcacgcgcccaccgccgcgcc

SEQ ID NO: 1013 - DNA, 6528 bp, Unknown
  Kingdom: Bacteria, Phylum: Actinobacteria, Class: Actinobacteria, Order: Streptomycetales, Family: Streptomycetaceae, Genus: Streptomyces
gagggtccccgaggcgatcgcctcggggaccctctcagccctggcaggagcgttgtgcggagcgtcagcgctcgacgtcgccgcggatgaacttctcgacgttctcccgggcctcgtcgtcgaagtactggaccggcggggacttcatgaagtacgaggacgccgacaggatcgggccgccgatgccgcggtccttggcgatcttcgcggcgcgcagcgcgtcgatgatgacgcccgcggagttcggggagtcccagacctcgagcttgtactccaggttcagcgggacgtcgccgaaggcgcggccctcgagacggacgtaggcccacttgcggtcgtcgagccacgcgacgtagtcggacgggccgatgtggacgttcttctcaccgaggtcccggtcggggatctgggaggtgacggcctgggtcttggagatcttcttggactccaggcgctcacgctcgagcatgttcttgaagtccatgttgccgccgacgttcagctgcatcgtgcggtccaggatgacgccccggtcctcgaacagcttcgccatgacgcggtgcgtgatcgtggcgccgacctgcgacttgatgtcgtcaccgacgatcgggacgcccgcctcggtgaacttgtccgcccactccttggtgccggcgatgaagaccgggagggcgttgacgaaggcgaccttggcgtcgatggcgcactgggcgtagaacttcgccgcgtcctcggagccgacgggcaggtagcagacgaggacgtcgacctgcttgtccttgaggatctggacgacgtcgaccggcgcctcggcggactcctcgatggtctggcggtagtacttgcccaggccgtcgagggtgtggccgcgctgcaccgtcacaccggtgtgggggacgtcgcagatcttgatggtgttgttctcggaggcgccgatggcgtccgcgaggtccaggccgaccttcttcgcgtcgacgtcgaaggcggcgacgaactcgacgtcacgcacgtggtactcgccgaactgcacgtgcatgaggccggggaccttggacgccgggtcggcgtccttgtagtactcgacgccctgcaccagcgatgcggcgcagttgcccacaccgacgatggctacgcgaaccgaacccattccggttgctccctgtgtgtactcggtgaagccccgacgggacctcacgtggcggtgtcgccgggcgtatccggccgggaggagttcccggtccggggcaggccgcccgtcgttccattggtggtgtcctgctgagcgggtcccccgtcggcggaacccttgaggtccctaccggcccgctcgctctcgatgagctcgttcagccagcgcacttcgcgctccacggactccatcccgtggcgctggagctcgagggtgtagtcgtcgaggcgctcccgggtgcgcgtgagggaggcgcgcatcttctccaggcgctcctccagccggctgcggcggccctcgagcacgcgcatgcggacgtcgcgcgaggtctgcccgaagaaggcgaaacgcgcggcgaagtgctcgtcgtcgtaggcgtcggggcccgtctgggagagcagctcctcgaagtgctccttaccttccgccgtcagccggtagacgatcttggcgcggcgcccggcgagcggggcggcgagggcgtcctcggtggtgttccccggttcctcggtcaaccagccgttcgcgaccagcgtcttgaggcagggatagagcgtgccgtagctgaacgcacggaacacgcccagcgatgtattgagccgtttgcgcagctcatagccgtgcatcggggactcgcggagcaggccgagtacggcgaactcaaggatcccggaacgccggcccatcgtcgcctccttcctgccgcgacccggtggcggcggatgccgcaccgggtgccgtgacggtctttatctcaagctgatgtatcgactcgatacatccagacgatagaacggccccgcgcatgcgacaagaggggacagggtgaacgggatcacatccctgtttcggtggagtcaagttgcctgatttggggtgaacttcgggacccggtgggttttggcggtgcgtagtctgtccgccatgcacaacaccgggaaccaagtgacgcctggggacgtccttcgtccccggtgcagtacgggtgaatgcgctaccgaccacatccgtacttcggggggaccggaaaccagccgctgtttccaggcgcgcacgggtgcgcctgcccgaggagtaatcgttcgatgagcgagcaccgtcgcaaaccgccgcagccgcagggaggcggacgtgccgcggcccgacgcggccagtccggttcgtcctccggccgccgtgcggccccgcgaggcgccaccgggtccgccgccgactcctatgggtccgcttccggggccacgtcccatggatcgggttcgtacggcgcgggtcaggaggagcgcccctacggaggccgcgccgaggcccgccgggcggcgcagcgaggcggcggccggcgcagaggaggtgactccggcgggcccccgggcccgacgggacccggccgcggccgcgggcggacggctgcgcccgccaagaagcggttcatcgactacccgcgcgcgggcaagcacggctggcggcgctggacgccgtcctggaagctggtgacgggtctgttcatcggcttcgtcggcagcctggtggcggtcgccggcatcgggtacgcgatggtggccatcccgaacatccaggagaccgcgaccgcccagaacaacgtgtactactgggccgacggcagcgagatggtccggaccggcggtgagatcaaccgccagatcctgaactactcagccattcccaaggacatgcgctacgcggtcatctcgcaggagaacaagaccttcgagaccgacagcggcatcgaccccaagggcatcgcgcgcgccgtgttcaacatggcccggggcggccagacccagggcgggtcgaccatcacccagcagtacgtcaagaacgcgatgctgaacgaccagtcgcagaccgtctcccgcaagttcaaggagatcttcgtctcgatcaaggtcggtgccaagctccgcaaggaagacatcatggcggggtacctcaactcctcctactacggccgcggggcctacggtctccaggcggcttcgcgggcgtacttcaacaaggacgcccaggacctggacgccggcgagtgcgccttcctggcggcggtgctcaagggcgccacgtactacgacccggcgggcgcgacgtccatcgacccggcggcgacccccgaggccaacaccaagcgcgtcacgagccagatgcaggacacgctcgacaagatggtcgagtacggccacctgagccccacggagcggaacaagtacaggtcgctgcccaagtggcagagcccgcggtccaacacccggatgagcggccagatcggctatctcgtcgacctggccaagtcctacgtcatccacaacaccgacgtcagcgcggacaagctgcagcagggcggctaccagattcacacgaccttcgagaaggacaaggtcgagaagctgaggaccgcggtggagaaggtccagaaagccaacatcaagcccaagttgcgtcccaagaccgacacgcacgtgcagttcggcggtgcctcggtggacacgaagacgggtgccatcaaggcgatctacggcggtgaggactggaccaagcacttcaccgacaacgcggacgccaccggtgcccaggtgggctcgaccttcaagccgttcgtcctggcggcggccatgcgcgacggtgtccgcgacccgaacggaggcccggaccagggtgccgacgagcgcaccccggtctctcccaagagccggtacagcggtaagaacaagctcaagatcaagaagtacgacgggagtgtctggaagaacgagcagggcgaggagtggctgcagaccaatgacggcggcgacaacgtcggcaatccgccgaactacatgatcgacctgcgtgaggcgatgcgggagtcggtgaactccgccttcgtgcagctcggcatggacgtgggtctggacaaggtcgaaaaggcggcgctcgacgcgggcctgaagaaggacagcctggccggcaccacgttcccgtcgttctccatcggcatctccgaccccagcgcgatccgcatggcgggcgcgtacgcgacgttcgccaccagcgggaagcagaacgagccgttctccgtctcggaggtcaaggaccgggacgggccggtctacgagcacaagagcgcgcccaagcaggccttcgacgccgcggtcgcggacaacgtcaccgacgtcctgaagaccgtggtcgacaagggcacgggtaccaacgccaagctgcccggacgcgaggtggccggcaagaccggtaccaccgacggcaacaagtccgcctggttcgtgggctacaccccgcagctgtccaccgcgatcggcatgttccggctggacgacaacgagaagaacaagtcgcgcacgttcctggagatgtacgggaccggcggccagaagaagatccacggtgcctcgttcccgtccgagatctggcacgactacatgatggaggccctcaaggggcagccggcggaggacttcccgacgcccgagcccatcggcaagatcctcaacgccgcacccagcccgacgcccacgccgacggccacccagaccgaggagaccagcccgtccccgtcgaccactgccagcaagccggagaacactccggctccgccgtcgcccccgccgtcgcccacgcagacgcactgtggcttctggggctgcgacgacaacggaggacagaacggtaacaacggggccaacggcagcaatggcgccgatggcggccagggacccgatggcggtggcgctggtgggcccggcggcgggggtgagccgggcggaggcgccggcacctcaccgtcacccacgagatcgtcgtggtggccgtagaaaaggtggcgccgaggtcgcctcgtcgccgctgccggccatgagccggcgcgccttcccgccggaccgtttcacgtgaaacacgggccgccgcatccctccggtgcggcggcccacggcgtattcccagtcgcgtacggcaggatgtgcggcatgcccagtgctgaatcgacgcaagcgagcgcgcacgagcccggcctggtccggccgaccgaggaggacgaggtcgccgcggccggcagcgagctgatcggcggtcccgtcgggcggcacgccctgctcgggacgtcctggtggacgccggtgcgggtggtcgccctcgtcgcgatcggcatgtttgccctcggcctggtccagaaggccccctgctaccacagcgcctggttcttcggtgccagctcgcagtacacgaaggcctgctactcggacatcccgcacctgtaccagggacgcgggttcgccgacagcctcgtgccctacttcgacaagctcaccggtgacatgccttacctggagtacccggtgctgaccggcgtcttcatggaggtggcctcctggctgaccccgcacagcggcagcatccagcaccaggaacggtggtactggatggtcaacgccggaatgctcatggtgtgcgcggccgtcatcgccgtctgcgtggtccgcacgcacgcccggcgcccgtgggacggactgctggtcgccctggcgccggccctggcgctgaccgccacgatcaactgggacctgctggccgtcgccctgacggccgccgccatgctgatgtggtcgcgggagcgtcccggcgccttcggtgtcctgctggggctcgccacggcagccaagctctatccggtgctcctgctcggcccgctgctcgtcctgtgctggcgggccggcagatggcgtgagttcggcaaggccctgggcggggcggtcgcagcctggctggtcgtcaacctgccggtgatggccttcgcgtgggacgggtggtggcagttctaccggttcagccacgaccggggcgtcgacttcggctccttctggctgatctgggcccagaactcgaccgacccgcccagcacggacttcgtgaacaccgtggccaccctgctggtggtgctgggctccctcggcatcgcggcactggcgctcatggcaccgcgccggccgcgcttcgcccagctcgcgttcctgatcgtggcggtgttcatcctcaccaacaaggtctactcgccccagtacgtcctgtggctgatcccgctggccgtgctggcccggccgaagtggcgcgacttcctgatctggcaggcctgcgaggtggcgtacttcctcgggatctggctgtacctcgcgtatacgaccagcggagacgcacacaagggtctgccgaccgacggctatcactgggcgatcgcggtacacctggcgggaacggtgtacctgtgcgcggtcgtcgtgcgcgacatcctcatgccggaccgtgacgtggtgcgccggtccggcatgaggatgtcg

SEQ ID NO: 1014 - DNA, 8517 bp, Unknown
  Kingdom: Bacteria, Phylum: Actinobacteria, Class: Actinobacteria, Order: Streptomycetales, Family: Streptomycetaceae, Genus: Streptomyces
acaaccccgccgcgctcggcggcgtcagcgccgagcgcggcggggttgtgccaccagatgcgctcgccgtcggtgtcgatgtcgagcaggtcgccgccgcggaagctggtgccgcacatgggcagcacgtcgaggtcggagaccagctcgtcctcgctgatgccgaaggcgcgtgcgacgtcctcgatccgggcgccgggccgctccctgaggtacgtcaccagggagagcatccgacgggtctggtcgatggcgttcgcgggcctgaccggtttgcctgccacggtgttcctcgctccccctcagcccttggccacggcacgcagccggtccaccacgtcggcccgcagctcggcgggttccaggaccaccacgtccggtccgaactccaccagccaggcgtccagcccgtgcccgtacgggatgtccaactcgtcccagccgtcgccgagttcccgtaccgcggtggccttcgcccgaagggggtacccggcccccgagcgcagccggatccgcgccgagcggtcggcgatctcgccggcccagctcgcgacggtctcccggacggtgacgacgtccggcacgggggcggtgaaccgggcgccgcgcgagcgcaccttgccggtgatccgcgacagccggaacacccgctcggcgccgcggtcgcggtcgaagccggccaggtaccagtggccgcgccagcactccagcgcccacggctccacgtgccggggctcggggcgggcggcgctggccttgcggtagtcgaagagcaccgggcggcggtcgcggcaggccagcatcagcggctcgaacgcggcttcgtgcaccgggatgcgcggctccagggcgctgtgcgcctcgtaggggtcgacgtcctcgggcagaccggcggcgcgcagcttctgcagggcgccgctcgcggctccggcgagccgggcctgctgccagaccttggcggccagccccagggcggcggcctcctcggcgtccagggtgatgggcggcagccggttgctgtcgcggcgggccaggtagccgacctcgccgtccaggctctccacggtctcgatgacgagccccagctcgcgcaggtcgtccttgtcccgctcgaacatgcggttgaaggagtcgtcggagcccggcgcgctcccgcccggcccgccggccgtgccccgccccggcccgaaggcctccacataggcctcgatggactcgcgcagctcgcgcttgctgagcggccgccgtgtcccgagcaggcacagcgcgaggttcatcagccgctcggccttggcaatggccatcgacgcccgtcaccttcctcatggtgcttactgccgatgaccgtaccgccccgcggcgcggtggcaaaagccgagggcccacgcccggtcaggcatgggccccaggtgatcgggtcccgtacggatccaccgccgggcggacggatccgtacgacggtgatcagaccccgagcaggtcgacgacgaagatcagcgtctcgccgggcttgatcgccggggtcgggctctggttgccgtaggccaggtgggccgggatggtcagctggcgacggccgccgaccttcatgccctgcacgccctggtcccagcccttgatgacacggccaccgccgagcgggaagcggaagggagtgccccggttccagctggcgtcgaactcctcgccggtgctgaaggcgacacccacgtagtggacggtgacggtctggcccgcctgcgccaccgcgccgtcgccctcccagatgtccttgatctccaggtccgccgggggctcgccgcccgggaagtcgatctcgggcttgtcgatgctcacgtctctagctcctgcttgtctgcgaaaaggcaacatccacagtcttacatccccggcggctcacatcgcggccaggatgtccacggagaacaccagtgtggagtccttcttgatgccgctgtccggcggcgggttgtctccgtagcccagggacggcgggatgacgatcaggacgcggctgccgaccttcttgccggtcaggccctgcgcccagcccttgacgacctgctgcagcgagaacgacgtcagctggttcctcttgtacgtcgagtcgaactccttgccgccgtcccacagcacgcccttgtactgcacgagcacggtgctgtccgccttgaccaccggcccgtcgccctcgatgacgtactccgccaccagcttcttcggcgccggcttcttgggcacgtcgacggacggggccgcgccgtcggtgttcgtgccgaccttcggcaggttcgcgtcgttgtgcgggaccgtcttgcccttggcggagctcttcgagttgaaggcgtcctgcaggtcggcgacgaacaccagcgtgtcggtgcccttgatgcccgcctgcgcgttgccctgcttgccgtaaccccaggtcggcggcaccgagaactccacccggctgccgaccttcttcccggccagcgcataacgccagccgtcgatgatcgtgccctgagcgagctggatgagcaggggcgtcttgcggtcgtaggagttgtcgaagaccttcgccgtgtcccagacctggcccaggtagtgcgcctggacgtagtcgttctccgccaccgtacggccgccgccggcgatcaccgtcttcaccgccaggtccttggacggagcgccgctgcccttggccacggtcggcttctcaccgaacttcgtgcccgccgtgatcgccggaagcggcccggagacgatcttcggcggcggtgcggcggacgtcgccggggcggtgggcgacggcgacttcgaggaaccgtcaccggcgctgcccgagccggacttgtcattgccgcaggcggccagggtgaccagtcccgcgggagcggaaagaagcagagagcgtcggcgcacggtgggcctcgtaatcggtcgatcttgtggatggcgtgcgcgcaactctacggggcgagaagggcgccgtacgtgaaacgtacggcgcccgtgtggcgttccggcaggcgtacccccgctcgagcgaatcggggaacgcagaaccgtacgggaacgcgcccctcatctcatccggatcacattccggcgatcagcttctccacccggtcgtccaccgaacggaacgggtccttgcacaacaccgtgcgctgggcctggtcgttgagcttcaggtgcacccagtcgaccgtgaaatcacggcgctgctcctgcgcccgccggatgaagtcgccccgcagccgcgcccgagtggtctgcggaggcaccgacttgccctcgaagatcttcaagtcgttgcagatccgcgtggcttggcccttcttctccagcaggtagtacagaccacgacgacggtggatgtcgtggtacgcgaggtctatctgggcgacccgcggatgcgacatggtcatgttgtgcttggcccggtaccgctcgatgagcttgtacttcatcacccagtcgatctcggtaccgatccggtcgaggtcctcgctctcgatcgcgtccagcgtgcggccccacagttccagcacctgctccaccgtgccggtgcggatgccgcggcgctcgcagaagtccacggccttctcgtagtactcccgctgcacctcgagcgcggaggcctcccggccgctggccaggcgcaccttgcggcggcccgtgatgtcgtggctgacctcgcggatcgcccggatcgggttctccagggtcaggtcacgcatcaccgtgccggcctcgatcatgcgcagcaccaggtcggtggcgccgaccttcagcagcatcgtcgtctcggacatgttcgagtcgcccacgatgacgtgcagcctgcggtaacgctccgcgtccgcgtgcggctcgtcgcgcgtgttgatgatcggccgggaccgggtcgtcgccgaggagacgccctcccagatgtgctcggcccgctggctcacgcagtacacggccccgcgcggtgtctgcaggacctttcccgcgccgcacagcaactgcctcgtgaccaggaacggaatgagaatgtccgcgagccgggagaactccccgtgccgtgccaccagatagttctcgtgacagccgtaggagttgcccgccgagtccgtgttgttcttgaagaggtagacgtcgcccgcgattccctcctcgtgcaggcgtcgctccgcgtctaccaggagtccctcgagaatgcgctcgccggccttgtcgtgggtgaccagttcgatcacattgtcacactcgggtgtcgcgtattccggatgtgaccccacgtcgagatagaggcgggcgccgtttcgcagaaacacattgctgctgcggccccatgacacgacacggcggaagaggtaccgcgccacctcgtcaggcgacaggcggcgctgtcccctgaacgtgcacgtgacgccgtactcgttctccagcccgaaaatgcggcggtccatgactgaacattacgcccgatcccccgagctgaaacggggttcgacagcacgatttggatcattttccgatgaagccgcaacgaccgcctgcccagcgggagctgcgaggaccgatccggtggccagcagcaccagcaacgacaccgcccccgccaccgccggcaccgcgaaaccccacagcgcaccgcccgcctgcaccaccggtccggccacccccgtacccaccgacgcacccaccgtgaacatcgtcaccagccacgagaacgcctccgtcaccgtccccctcggcgcatgccggtccacgatgatgaacgcgcaggcgatgcacggcgccaggaacacccccgacaccaccgtcagcagcaccatcgccaccgcacccggcatcagcgtcagcgggaggtaacacaccgccagaagcgcgaccagcacccgcagtcgccgctccggcgcacccgaccactgccgcgccccgtagacggccccgccggccagcgcacccagacccagcgccgccatcagccagccgtacaccgcgtcaccgccgtgctcgtccgcgtacggcaccgccgccaccgtgatggaccccagcgccacccccacgaacaggaacgcccccagcagcgccagcagacccggcgagcgcagcgcacccagccagtgcgcctcacgcggcgccgaacgccacgcccgcgacggcggcgacagcaccaccgacaacgcgcccagcaccccgaccacgttcagcaccaccagggcggcccgcgccgaccacagcgacacgcacagcgtcaccagcaacggccccacggtgaacatgacttcctgcgccaccgcgtccatcgcgtacgccgtgtgcacccgctcctcgccgcgcaggaccgtgggccacaaggcgcgcagaccgccctccagcggcggcgtgaacagccccgccgcggccaccgccgtccaggcgagcacaggcggctccgtaccggtgaacgcgaaggcggtcatcgccagcgccgccgccagcgacgcgggcaactgcacgcgcggctgtccgtacaggtccaccaggcgcccgagcaccggctggcccaccgcgttcgcgaccccgtacaccgccgccaggacaccggccaggctgtacgtaccgccctcggcgcggacgaacagcacgatcgcgatcgccgcggtcgcgttcggcagccggcccacgagcgtgcccgtcagcagccgggcggcgtgccgcgccctgagtatctccaggtatccgccgaatcccgcggccatcgtgtgccctccagcgaacaaggttttacgtataacttctcccgccatacgtaccatgtgcgctgttcaccagtccagacgacggacgtggaccgaaggacccgagcgtcccgcggcacacggccagcaggtaaggagcagccccgcggtggcacgaggaagcacgcgccccaccagccgcgacgtcgcccaggccgccggcgtctcccaggccgccgtctccctcgtcctcggcgacaagtggcgcggccgggtctcggagccgaccgccgagcgtgtacggcaggccgcccaggacctgggctaccggcccaacctcgccgcccgcaacctgcggctcggccacacccggaccgtcctgctcgtcgtccccgccctgaccaccgagttcttcgccggcgtctacaccggcgccgcacgcgtggccgccgaccacggcttcggcgtcgtcctctacccctcccccgaaggcatcggcccggcccggaaccccttcgcctccgcccaggccgccctcgacggcgtcatcgcctcctccatggccgccgacgccctcaccgccatccgcggcgaccagctccccctcgtcatgctggacagcgaccccgcgggcagcctcggcgccgccacggtgaacctggacatcgccgacggcgtacgccaggtcgccgaccacctgctcggcctcggccaccggcacttcctccacctcgcggccgacgtgccctcctggaccttcgaggtacgcgcccgcgaactggccgcacgcctcggcgccgccccggccacgaccctgcgcaccgcccgcgcgcccatcaccatcgaggacgcccgcgccgccaccgaagccgcgctcagcacccccggcccccgccccaccgccctcgtctgcgacgacgacaaactcgccgcgggcgcctacaaagccctgcgccggctcggcctgcgcgtccccgacgacctgtccgtcaccggcctcgacgacctcgccctggccaccgccatcgaccccgagctgaccaccgtgcgcctggacgcggaactcttcggcgaacgcggcatgcacgccctcctggccgtcctggagggccgcgtgccggacggcggcgacatccccgtggaactggtggtccgcggctccaccgccccgccgcgggcctcctgagacgccggagccccggccacgacgtcgacaggacgccggccggggcacccggaacgctcggcgggctacttcccgccctcgtcggaaccggaggtctcctccggctcgtcggtgtccttggacgtgtcggtgctgccaccctccagcagccgggccagctgacggcccacgatccgcttgaacttgcgctgctgcggccgcgtacggtccagcaccgccacctcgagacgctccgcggggatctcccgctcactgccgttggtgtcccgcgacagcgcctgcaccgccagcttcagcgcctcggccagcgtcatcccgtcccggtggcgctggtccaggtaaccgctgatctgctccgcgttgccaccgaccgcgaccgagccgtgctcgtccacgatcgacccgtcgtgcggcagccggtagatctggtcaccctccggcgtcgcccccacctcggcgaccaccagctccacctcgtacggcttctccgccgcactcgagaagatcgtgcccagcgtctgcgcgtacacgttggccagaccgcgcgcggtcacatcgtcccggtcgtaggtgtaaccccgcaggtcggcatagcggacaccaccgatccgcaggttctcgtactcgttgtacttgccggccgcggcgaacccgatccggtcgtagatctcgctgaacttgtgcagcgcacgggacggattctcaccgacgaacacgattccgtcggcgtactgcagcaccaccaggctgcggccacgggcgatgcccttgcgggcgtactccgcccggtcggccatcgcctgctgaggtgagacatagaacggcgtcgacaccggttatccgtccctttctgtagaggtcactcgatcaccctggacaagaaccggccgccgctacagcagcgccgcccgcggaccgtccggctgctccagacgacgctgcagcaccgcgcgggcgatctcggaggactcgtcctcggtgagccggcggaagccgtcatcggtgatcacggtgacgatcggatagatccggcgggcgacgtcgggaccaccggtcgccgagtcgtcgtctgccgcgtcgtacagggcctgcaccaccagcgtggtcgcctcggcctcggtcaggtcgtcacggaagagcttcttcatcgcaccgcgcgcgaagatcgaaccggatcccgtcgccgcgtagccgtgctcctcgctacggccgccggtcacgtcgtaggagaagatgcggcccttgtcgcggtccacgtcgtaccccgcgaagagcggcaccacggccagaccctgcatggccatgccgaggttggaacggatcatggtcgacagccggttcgccttgccctccagcgacagctgcgcgccctcgaccttctcgaagtgctccagctccagctggaacagcttgaccatctccacggccagaccggccgtgccggcgatgccgacggccgagtactcgtccgccgggaacaccttctcgatgtcccgctgcgcgatgacgttgcccatcgtcgcccgccggtcaccggccagcacgacgccgccggggaaggtcacggcgacgatcgtcgtgccgtgcggcgcctccagcaccccctgcgtgggcggcagctgccgc

SEQ ID NO: 1015 - DNA, 1271 bp, Unknown
  Kingdom: Bacteria, Phylum: Actinobacteria, Class: Actinobacteria, Order: Streptomycetales, Family: Streptomycetaceae, Genus: Streptomyces
gccccgacgggcacgtccccgccgcgcacggccagccgggcctgctccagggcgagccgcatcgcgtcccgccagcggtcacggacgggatcggtgggcccgcgacccgtccccggcccaccggcgagggccggagcgtacgcgccagggccggccgggtcgggcgccgcggcgcggccgggcgcgccggcagggcaggccgaggtcccggccgggccgtgcggctcggccgggtgggtcgtgtcgtcgggcaagggcggggtcagcggacggtctccagcacctccgcggcgcccagcacctcggcgatcgcgctcagcgcgtcctccgcgtccagggcgcgcaactccttctcgctgatgccgaggtcgtcgaggatctcgccgtcgcccagcgggctgtgcgtgacggcgtcggcggcaccggactcctcctcgtcgtcctcggcggaggagggctcgccgtcctccgtgccgtcgaggtcgagggcgtcgagatcgggcccgtcgtcaccgggttcccggccgagcaactcgtcggtgagcaggatctctccgtacgaactgcgggccgctgcggcggcgtccgagacgtagatgcgagggtcgtcctcgccgtccacgcggacgacgccgaaccacgcgtcctcctgttcgatcaggacgagcacggtgtcgtcctcggccgagctctcccgggccagatcggccaggtcggacagcgtctccacatcgtcgagctccgtgtcgctcgcttcccacccgtcttcggtgcgcgcgagcagtgcggcgaagtacaccgtgactctcccactggtcataggcgtgccggttgggggtccccccggcggaggttctgggcggggagagctgggctccgagcccacccactcggaatcgtggcagaaacaaggcgctcaggggacgtcttcggcttcctgtgtcctgctgttttgcggctcgtcggtaaaggactcaccagcgcactcgttgccgccacctgcggatcgtacgcggctttggtccacggccacgcagggccacctcggaacgtcggcgcgggtttgctttcatcccttcgtccccggcgtcctctcctgtgtgctgcccggcggtcgtcgcctggcgcggctccggtcccgcccgcccgtcctaccagcggaacgtgcgcatgcgcatcgcgtgtcgcaggcgggcggccttggcccgcctgggctggacgcggtcgcgcagttcgcgggcctcggcgagatcgcgcaggaactgggcccg

SEQ ID NO: 1016 - DNA, 2701 bp, Unknown
  Kingdom: Bacteria, Phylum: Actinobacteria, Class: Actinobacteria, Order: Streptomycetales, Family: Streptomycetaceae, Genus: Streptomyces
cgttgttgacgagcacggcgggcgggccgagttcggcggcgacccgtgcgacggccgactccacgcgtgcaccgtcggcgacgtccacgcccacggccagggcccgcccgccgtgctcgtcaacaacgccggtatcacccgcgacaacctgctgttcaagatggccgaggccgactgggacgcggtcctggccgtccacctgcgcggcgccttcctgatgagcaaggccgcccaggcacacatgaccaaggccggctggggacgcatcgtcaacctgtcctccgtctccgcgctcggcaaccgcggccaggccaactactcggcggccaaggccggtatgcagggcttcaccaagacgctggccgtcgagctcggcaagttcggtgtcaccgtcaacgccgtcgcccccggcttcatcgtcaccgagatgaccgccgccaccgccgagcgcctcggcatacccttcgaggagttcaaggcacagcgggccgccgtcacccccgtgccccgggtgggcgtccccgacgacatcgcccacgccgtctccttcttcgccggcgagggagccggcttcgtgaccggacaggtcctctacgtggcgggcggcccccggggctgagcgggcgccgaccagccgacgagtccaccaacgcacagcagcaagggagagtcatgacagcgcggttcgaccaggccccctgggccacggcgggcatccagaccgttcagcccggggtgcaccgcgtccccctgccgctgcccaacgacggcctgcgcgccgtcaacgtctacctgctggagaacctcaccgacgacggcggcctcgtcatgatcgacggtggatgggcgatccccgagtcccgcaaggcactggaggaaggcctgtccgccatcgggcgcgacctcggcgacatcacgcagatcctggtcacccacatccaccgcgaccactacacgcaggcggtggaactgcgcaggctgctgggcgcccgcgtcagcctcggcgccggggaacgcccgggactgagactgctcaacgaactgcgcggcggactggcgtgctcgctgaggaccctgcggcaggccggggccgccgacctggccgaccacgtccaggcgacctaccccgacctctaccaccgcagcgactgggaggagcccgaccgctggctggacgcggagaccctgcgcttcggcggcggagagctccaggtcatcccgacccccggccacacccggggacacgtggtcttcctggacgaacagcgcgggctgctgttctccggcgaccacgtgctgccgcgcatcacgccgtccatcggcttcgaggcggccgaacccggcggccggccgctcgccgcctacctggactcgctgcgcctgatgacccgctacgccgacgcccgcctgctgcccgcgcacggacccgtcgccgacagcacccacacccgggtcgccgagctgctcgcccaccacgacgacaggctgcacaagacccgcacagcactcggggacgccacgcaggacgctttcgcagtcacgcgccggctcacctggacccgccgcgaggtgcccttcggcgacctgaacgccatgaaccagatgctcgccgtcaacgagacggtcgcccacctggacgtcctcgcgctgcgcggcgacgtggcggtggtgtgcacggacggggtgaaccggtacacgcgcctacgatgacgcacggcgcgcgacaggcagccgtacggacggcgtcgcggtcatgcgcacgggcggcgccggacgccggacaggatgcacgcgccccttgccgacgtactgtgagcatgtgttctcattcgcgggcatcggcacggccgtgctggacgagcacggcaccgtggtgcgctggtcccaggaggcctgcgacctgctggggtggaccgccgacgaggcctgcgggcgaccgttccgggacctgttcgccggcgacgacccgggcggggcgggcggcggccggctccccggacagggccgggccctgctgcggcaccgcaccgggcatccggtcgacgtcacgttccgggtggcgggcctgcccccgtcggacgaatccctcgtgctcctggcgcccacccatctggcgcgggactgggaggagggcgccggcaccctgcgggccctgctcgcccaggaccacatcggagtcggcctgcacgcccggaacatgaccgtcgtccgcagcaacctcacgcccggggtgttcgccggcacgcccctgctgccgggcggccgcctgaaggacgtgccgtcgctgcaggacccggaggccgacgaggccgcgctgcggggcgtcctggacaccggtgagccgctgaccgggagggtcatggacgtacgtccggaccaagggcggtaccggcagcgggtgtccctgtcggccttccggaccgaggacgccgaaggggagccgtcgggcgtcgtggcgctgtacatcgacaccttcgcgctgcagcgggcccgtcgcgaactcaacctgctgcaccaggccgccacccgcatcggcggctccctcgatccccggcgtgccgcgcaggacctggtcgacgtcctggttcccggcttcggggatctcgcgtgcgtcgagctggccgctgccgtgcttggcggggacgagccgccgaagatccacggcgggggagacctgcacctgtgccgggcggccgtggcc

SEQ ID NO: 1017 - DNA, 5290 bp, Unknown
  Kingdom: Bacteria, Phylum: Actinobacteria, Class: Actinobacteria, Order: Streptomycetales, Family: Streptomycetaceae, Genus: Streptomyces
gctgcgcggccgcgcagcttcgcgtagacggtgtcggccacgtacttcacccgcatggtcacctcccccagcgggaggcccgacgcggacacccgcatgcggtacgcgagggcgcgcagggttccggcgacccactgcgcgtcgtgtgtcgcggcctcgacggtcaccgggacggggccgcgcaccgacaggtccgcgacgttgtccgacagcgtcatcgaccactcccgcagcacgaacttcgtgccgagcggcgcaccgaaatgcgtgtgcaccgcgtgggtctccgcctgccggcagcactcgagcagcagcagcgggtcgaggggctggggcgtcgtgtggtcggtgtagtacgcgtgggagggcggcagctgggccgccgcgacgaagcgctcctcgtccacgcgtgcgctgtccgtgaggaacacctcggacagggcatgccggtggacgaggccgcgcggcacggtctgctcgaagccgagggcggtgcgagcgccctccacggcacctggtccggccggctcggtcatcacggtcatccggctcccctttcgctgaactggctgggtctcactggggtggtacgggacactcccggctcgccacactcccagccgcggctaacacccggctcacgcccgcgtcatggcgtacgaccccgccggccaggcgggacggcgcgtcgggaccagacggccgcggtcaccgccgcgcccgaggcagcaggtcggcgtcgcgcgccgcgccgcccacctcgcgcccggaccggccggtgcgttcggtccgggcgcaggggcggctcagccggcgcacggcagcggccggacggcatccccggattccgtagcagcggccggtggtctccgccgttgccgggggtggtcatgagccgggctcgcgctcgcgggactgggcaccttgaccgacagcctcaagtccatcggcggcggtggtgcgtccaagcaggtgcttcaggactccggcctcgcctgagggcatcgcctccgcggccgagggcgcccacttcgacatcccgtccggccgccgcatcggacacaccaccctgtttcacgtgaaaccggcctgtcctgccgggcgtcttgacccgtcccgggagggccggtatacgacaggcgtccgctggtgcgggcaaggtgaacacgcagtgaaccacccggtggcggccgccccctctcacctgcatcgagttgcacgaggcatcgatcgatgcggatttcgcgcttgatcgccccttgagcctgggtgaggatcacgtcagcggcaggacatatgcctgattcaacggggggcgttccgccttgcatgggcgacttcacggcacacgggcgaatccacagctccctgatcgggctctccacccttattcccctgggggaagcatgcctcaccagccctatgcctatcgacgcgaagaactgaccgaaccggactggcgccggattcccggatggcgcgaggtcacctcggagcaatggcgcgacccgcagtggcagcgtgtgcactgcgtcaagaacgtgcggcaactgaaagcggtctacggcggtctgctctccgacgacttctaccgcgatctggaacgggaccaggcggagcgggccacgatgtcgctgctcctgcccccctacgtgctgagcatgatggtgccggacgaggtcccgggcagcgaggcgatgtacgcggacccggtgcgccggcacatgatgccggtgttctccgaccgcgaccccgagtggccgtcgcacccgtacgcgtcccgggactcgctgcacgaggccgagatgtggacggcggagggcctgacccaccgctaccccaccaaggtgctggcggaactggtgtccacctgcccccagtactgcggccattgcacgcgaatggacctggtgggaaattccaccccccagatctcgaaaatgaggttctcggcgaaacagccggaccgttacgaggcgatgctggagtatctccgccgtactcccacggtgcgcgatgtggtggtttccggcggcgatgtggccaacgttccgtggccgcggctggaatccttcgtctcggcgctcctggaactggaccacatacgcgacatccggctggcgtcgaaggcgctgatggaccttccgcagcactggctctccgacgaggcccgccgcaccgtgagcaccctcgccgagacggcgcgcaagcgcggagtgagcctggccgtgcacacgcacgtcaacagtgcccagcaggtcacccagctcaatgccgaggcggcccgcacgctgttcgacctcggagtgcgcgacgtgcgcaaccagggcgtgctgatgcgcggggtgaacgacacctcgcagcggctgctcgacctgtgcttcgcgctgctcgacggcgcgggagtgatgccgtactacttctacctctgcgacatgatcccgaacgccgagcactggcgggtgtcgctgggcgaggcccagcagttgcagcaggcgatcatgggatacctgcccggcttcgcgacgccgcggctggtgtgcgacgtgcccttcgtcggcaagcgctgggtgcaccaggtcgaccactacgaccgcgagcgcggcatctcgtactggaccaagaactacctgacctcgatcgagcaggacgacccctacgcgctcgcgaggacgcacgagtactacgacccgatccagacgctcaggcccgaaggacagcagtggtggcgccggcacggccggtccccggcggcatccgcggccccggcccggccttccgtcgccgtcgcccagggggaggcacagtgaccgggaacagccccgtcgcccccctggccgtgcgcgagaagttcatgaccgaccccgacctgggcgccggcaacttcctggagcacgcgctgcggcacaacccgaacctggacgcgccgctggtgtacgaccaccgcctggacgaccgcggccatgtcgtgctgcgcgggtacagcctgcgggagctggccgcgatccgcgaccggtacgcccgctggtactggaccaacggggtccggccgggcgaaccggtggcgctgtacatcgccgaggggctccagccgatcctgcacttcctggcgctgacctcgctcggtgcgatccccgcgctcgtcaacgacgcgatgccggtcgccaccgcccggcgctatctcgaccatgtgggggtggccggggtggtggcggacgacccgcgtccgatcggcgcgacctaccggccggggcagccgcgcccccggttcatcgtgcccagcgccgagatacgcgcccatgaccccggctccggctcgctgcccgagccgtacccgtaccggcacgcggccgacgaggtggtcgcgctcatccactcctcgggcaccaccggcaccccgaagtcgacgcaggtcgcgcaccaccagttctgggtcggcaaggaggcccggatggtgcgcttcccggccgagccgtacgaccggctgctgtcgctgatgccgcacacgcacgcgggcggtctcagctatctgctgacgaccatcctgctcgggctgccgacgctgaccatggccgactggcggcgcagcgcggtggaaccggtgatggaggtcttccagccgaccatggtcgcctccttcccgcgcacgttcgtggaactggccaccggcgagctgccggtgaagggggccgcgaaggtgcacacctggttcaacaccggggacagcgcgcaccacgggcacatccggcggctggtgagcctcggtgagcggccggtggggctgatccagccgtggctgctgccgaagggggacgccggggccacgtccctgcccgggtcccgctacatcgacgggctcggctcctcggagatgggcatggcgctcttcggccaggtcaccacgccggagtcggaacgcgacgaccgctgtgtcggggtgcccgtcgaggtggtggagaaggcggcggtgctggacgacgacggcaacgaggtgccggacggcaccgtgggcctcctcggcgtgaagacacccacccgcaccccgggctactggaacgaccccgcgctgaccgcgcgcagtgagctggccggctactggctgaccggtgacgtggcggtacgcacgcccgacggccgcttctaccacctggaccggaccgcggacgtgatccacacggccggtggtccggtgcacagcctgccgctggaggaggtgctgatcgccgacctcgccgacgtcgtccaggactgcgcggtgatcggagtgcccgctccctccggcgaggggcaacttcccctggccgtggtccggttgcaggcggacagcccgctcagcgacccggcggggatacgcgaggccgccaaccgggagctcacggccgccgggctgcacccgctggcggccgtgtccgtggcccgcggcggcgaggactaccccacaggcccgaccggcaaggtcctcaagcgcgagctgcgtacgcgccacgcctcggccctggtcaccggtccggccctctgaaggaggcgggtgcacggagtggatgcggcagcaggcggagggacagcagtgacacacgacgaacggcccgggtcgtcagcggtcgtacggacggggcgcacaccacgggtgcgtgcggtggccggcgtatctgcggggcgcacgcctcgggtacgtgcggtggccggcgtgcgggcggggtgcccgcaccgggcacgggtggcggtggtcgttcaggcgcagtgtccgcgccgcgtacgggaggtggccgccgtatgagcgggacgcacggcagggccgggctctcccggccgctcgccttctggctgatcgccacggtccagtgcctgctgctgttcgcgtcgagcgcgccctcgccgctgtacgccgtctaccagggcaagtggcacttctccgcgggcatgctcaccgcgatcttcgcgatgtacgcgttcacactcctcgcggcgctgctggtggtgggcaagctgtccgaccacatcggccgccgcaaggtcctgggcgcagccctggtcgtggaggtggtgagcatgctcctgttcatcaccgccgacggagtcgggccgctgctcgccgcgcgtgccgcgcagggcctcgccaccggcgcggcgaccggggcgaccagctccgcgctgctcgacctgcaaccaccgcaccggccgcggctcggcccgctggtcaacagcctggcgccgatcgccggcctggcgctcggcgccctgggctccggactcctcgtggagtacgcgcccgcgccggagattctggtct

SEQ ID NO: 1018 - DNA, 6119 bp, Unknown
  Kingdom: Bacteria, Phylum: Actinobacteria, Class: Actinobacteria, Order: Streptomycetales, Family: Streptomycetaceae, Genus: Streptomyces
gagggcggcggcgccgaagccgaggcggctgacctcgacgccgctgcggccgagggcggtcaccgtcccgccgggcgcagcggcaggccctgcatgccgccgtcgacggcgagggcggtgccggtggtggcgccggagtgcgggccggccaggtaggcgatggcggcggccacttcggcggcgctcaccaggcggccggtgggctggcgtgcgttcagcgcggcgcgttcggcggccgggtcgggggcggcgtccagcagccggccgacccacggggtgtccacggtcccggggttgacgcagttcacgcggatgccctcgcggacgtgatcggcggccatggccagggtgagggagtacacggcgcccttggtggcgctgtagagcgcgcgctgcggcagtcccgcggtggcggcgatggagcaggtgttgacgatcgcggcgtgggtcgaggcgcgcaggcggggcagggcggcgcgggcggtgcggaccatgccgaggacgttgacgtcgaagacgcggcgccactcctcgtcgtcgttgtcctcgacggtgccctgggcgccgatgccggcgttgttgacgaggatgtccaggccgccgagcgtgccggtggccgactcgaccgccgtgcgcaccgacgcgtcgtcgctcacgtcggcgcggaaggcgtgcagcggcttgtccacggccgacgggtccaggtccagtacggcgacctgggcgccccgctgcgcgaggaggtcggcggtggcccggccgatgccggacgctccgcccgtcaccagggccctcagtccgtcgaagtcgctcatgccgcgtgtcccttctgctgctcatgacgttcttgccggttttgctgcgcgaggtcggcggcccagaaggcaccgtcggggaaggcgtagcgcgcgatggactgcgggagcatcgcggccgagaagcccggtgcggtgggggccgtgtagtgaccgtcgcggatcacgacggggtcgaggaagtggtcgtgcaggtggtcgacgtactcgatgacccggtcctcggtggtgccggacacggcgacgtagtcgaacatcgacaggtgctgtaccagctcgcacaggccgacgccgcccgcgtgcgggcagacggggacgccgtacttggcggcgagcagcaggatcgcgaggttctcgttgacgccgccgacgcgggccgcgtcgatctggaggacgtcgagggcgccggcctggagcatctgcttgaagacgacgcggttgtggacgtgttcgccggtggcgaccttgaccggggccacggcctcgcggatggcggcgtgggcgaggacgtcgtcggggctggtgggctcctcgatccagtacgggtcgaactcggtgagcgccttggtccagcggatcgcctcggcggtgtcccagcgctggttggcgtcgacggcgatgcggatgtccgggccgacgacggcgcgggcgacccggcagcggcgtacgtcgtcgtcgaggtccgcgccgaccttcagcttgatctgcgtgaacccgtcggcgacggcctgcgcggcgagccgggtcagcttctcgtcgtcgtagccgagccagccggctgaggtggtgtaggcggggtaaccgcgttccaggaggcgggccgtgcgctcgggtgcgccctgtctcccccggcgcagcagttccagggcctccgccggggtgagggcgtcggtgatgtagcggaagtcgatctgccgcaccagccattcggggtcggcctcggcgagcagccgccacaggggtttgccggcgcgtttggcggcgaggtcccacacggcgttgacgacggcgccgatcgccatgtgcatcacgcccttctcgggccccagccagcgcagttggctgtcgccgatcaggtcccggaagagcgagccggggtcggcgcacacctggtcgacgggccggccgaccacgtggtggcgcagcgcgtggaccgcggcgacctggacgtcgttgccccgcccgatggtgaaggtgaagccgtgtccctccgtgctgtcctcgctgtccgtgcgcagcaccaggtaggcggcggagtagtcggggtccgggttcatggcgtcggagccgtccagctcgcgcgaggtggggaagcggatgtcgtaggtgtcgacggcggtgatgcgggcgggcgtcggggacacggggggcctttcgttcggtggcggggtgacctgcgcggtcggtgggacctgcacggtcagtcctgggcgcggcccgtcgtcacgcgggcgatcatgagggcgaccaggatgatcccgccgtagatggcctggatccagaacgacggcacctgggcgagggtgagcaggttctgcaccacgccgagcaggaggacgccggtgagcgcgccgaacatggtgccccggccgccgtcgaggctgatgccgccgatgacggccgccgcgaacacggtgaaaatcatgttctggccctggttggcgctgatcgcgccgacgtagccggtctgcatgatgccgccgacggaggcgaggacgccggcgacgacgaagacgccgagcatgacgcgctcgacgcggatgccggcggcgcgggccgcgtccgcgttgccgccgatggcgtacagggcgcggccgacgcggtggtacttgaggaccaggccggtgacggcgaaggccacggcggccagccacaccgacatcgggatggtcaggaaggtggtggtggccagggagtagaagctgtcgggcatgccgaacagcgtcttgcccttggtcgcgccgaccagcaggccgcgcagcacgatcagcatggccagcgtcacgatgaacgcgttgagcttgaacttgacgaccaggacgccgttgaaggcgccgacgaccgcaccggcgacgaggatcgcgagcagggcgagcggtgcggccagttcggtgccccagcccgactgggcggtgggcaggacgagcagggcgccgacggcgggggcgatgcccacgaccgattcgagggacaggtcgaacttgccggtgatcagcaccagtgactcggcgaggaccaccatggcgagggccgcggacgagccgaggatggagatcaggttgcgttcggtgaggaacgagtcgttgacgaccgtgccgagcaccatgagcagcaacagggcgggcacgagggccagttcgcgggcgcggcgcagcaggacggtcctggccgatccggcgccggcggtgtgcgggggcgcgagcggcggggccgccttggtgtcagccatggtccactccttcgatggaggcgatcagctcgtggtcgcgccagcccgcccggtgctcggcgacgatccggccgtggaagaggacgaggacgcggtcgcagcgccgcaggtcgtcgagttcgtcggagacgacgagcacggcggtgccgtcctcgcgggcgctgtccatgcgggcgagcagggactccttggacttcacgtcgacgccggcggtggggttgatgaggacgaggaggcgggggtcggaggcgagggcgcgggccatgacgaccttctgcgcgttgccgccggacaggtcggacacgggttgttcggggccttcggtgtggatgccgaggcggtcgatcagctcgcgggcgaaaccgcgccgcgcgccggtggagacgaagccgtggcggccgaggcggtcgaggacgctgagcgtcgcgttgtcgccgacggtcatgccgggcaccagtccctgctcgtgccggtcgcgcgggacacagccgacgcccgccgccagcgcggcccgcacatcgccgaacggcagtgcccggccgtcgagttgggcggtgccgccggtcggggtgtgcagtccggcgaaggactcggccagttcgatcttgccgctgccgctggagccggccagtccgacgacctcgccaccgcgtacggtcaggtcgatgccctggtacgcgctcgaggtgagcccctgcgcgtcgaggaccaccggggcgtgggcggcgacggcctcgcgtgcgaggtcgccctcgctgaccgtctcccccgccatggcctcgaccagggccgccttgggcaggtcggcgacgggggcggtcgtgatccagcgggcgtcgcgcagcacggtgaccgtctggcagacctggtacacctcctggaggtggtgcgagatgaacaggaaggtgaccccggagtcctgcagggtccgcatgcgggtgaacagccgctcgatctcgcggttgtcgagctgggcggtgggttcgtccaggacgatgaaccgcgcgccgaagctcagcgcccgcgcgatctcgaccatctgccggtcctcgaccttgagttcactggtgcgggcgtcggggtcgacgcgcacgtcccaggtggcgaggaggtcggcggcctcccggcgcagccgccgccagctgatgagtccgccgcgcccggtcggctgccggttgatgaacaggttctccgcgacggtgagttcggggacgacggtcggcttctggtagacgcaggcgaccttgcggcgccaggcgtcgcggtcggtgagcgggggcgcgctctcgccgtcgaagcggacctcgccctcgtcgggagcctggaggccggtgaggagggtgacgagggtggacttgccggcgccgttgcggccgaccagggcgtgggactcgccgctgcgtacggtgagcctgccgtcggcgagggcgacagtgggaccgtagcgcttgctgacgccccgcgcctcgaccagcggggccgtgtcgggagtgctcatttgaccgtgttgccccagagcttggggtcgtcgacgttgtccttggtgaccaggggcgcgggcagctggtcctccagggtgccgttgggcagcttcacgatggtggagtcgtggtcggtcgggccgggcttgaaggtcttgccctgcatggccgccttgacgtagtacatgccgtacttggcgtaggcgtcggcgggctgcgagacggtggcgtcgatctcgcccctgcggatggcgtcgaactcctgcgggatgccgtcgttggagacgatcgcgatgtgcccggccgtaccggccttcttcagcatgtgcttggacttcagggtctgcagggtgggcgcgaggtagacgccgccggcctgcatgtagatgcccttgaggtcggggttggcgttcaggagcgtgtcgagtttggcggcggcggtgtcggactcccacttggcggggatctccaggaccttcagcttcgggaaatccttcttcacacaggcgcggaacgcctccgaacgctcacggccgttgaccgaggcgaggtcgcccatgatctgcacgaccttgcccgagctgatgtgcgcgccgaggtactggcaggccttctcgccgtaggcgacgttgttcgcccgtacgaccatggcgactttgcccttgtccggcgccacgtcgacggcgaccaccgggacgcccttgcgctcggcctggtcgaggccggcctggatggcggcactgtcgagcggggccacgaccaggcccttgacgccctggttcagctcgttgttgatgtcggtgatctgctgcgaggggtcgctgttggagttgaccgtcttcagcgcgtcgacgccttgggacgtggccatcttgggcacgtagtcgttgtacgactgccagaacggtgaggtcagcaggggcaggatcaccccgaccttgccgctgccgtcacccttggcgccggcggcgccggtgtcctcggtgctgccgcacgccgtcagcgccagggcgccgcaggctgctgcggccgtcgcgcgcaccgcccacgccgaggcccgcctgccgtgccgccggctgctgtgccgccgcctgtcttgccgtccgttccgcacttctgtgccggccatctgtcggctcctcatcgagcgagatcgagcagttgcccgcatacttatcagaccacttggcgcgcacaacaccctccggagccgagttttcccgccctgcggccatagtggtccgaccacctcggtggttagactgcggcgcacggcgacaggaggagtggcgtggacgagaccccgaccgggccggcgggacggccggatgagacgcggcccgccgcgagcgccgggccgaagggcacggtgac

SEQ ID NO: 1019 - DNA, 3322 bp, Unknown
  Kingdom: Bacteria, Phylum: Actinobacteria, Class: Actinobacteria, Order: Streptomycetales, Family: Streptomycetaceae, Genus: Streptomyces
gccacggactcggcctgaccatcgccgccgggcaggcccgcgtcctgggcgcccgcctcaccttccgcaacgtgcgtcccgcgggcgccccggaacacgtcccggccgagggcgcggtcgccgtcctctggctcccggaacacgcgccgaccagcacgggcagctatccgacgctgccggactgaggagcaccacgagcaccatgagcatcaggacgaaggcccccggcggcagccgggggccttcgtgtcagtcgtgccggtgtggtggcccggcagggtcagaccgcttccgcgagaccctcgggcgcggccttgtccgggccttcggccttcgccgcggccggacccgcgcccttcagcggcacctccttgacgaacaccgcggcgaccagggcggcgatgccgaccaccgcgccgagcaggaaggccgagtgcgtgccggcggagaccgcgtgctggtaggcctcgcgggcggcggccgggagcttggccaggctggccgcgtccagctgcgcggacttctcggtcatcttggagccggaggcgccggcccgctcggccatgacgtgctggacccggttgttgaacagcgcgcccatgatcgccacgccgaaggacgagccgagcgtacggaagagggtggtggacgaggaggccacgcccatgtccttcatctgcacgctgttctgcgcgaccagcatggtgatctgcatcaggcagcccatgcccgcgccgaggaccgccatgtacaggccggaggtgagccgggtggtcccggtgtccatcagggacagcaggtacaggccgacgaccatgagcacgctgccggccaccgggaacaccttgtaccggccgctgttggtggtgacccggcccgcgatcatcgacacgacgagcatcgcgccgagcatgggcagcagcaggaggcccgagttggtcgccgaggcgccctggaccgactgctggtacagcggcaggaagagcaccgcaccgaacatcacgaagccggtgatgaacccgatgaccgacatcagggtgaagttgcggctgcggaagatgtgcagcggcacgatcggctcggcggccctggtctgccagaacacgaacccgacgagcgcgaccacgccgatcgcggtcagctccatgatccgcgcggacgtccaggcgtactccgaaccgccccaggtggtgacgagcacgatggagctgatgccgagggtgagcagcgcggcgcccaggtagtcgacgcgcgcctgcgaacgcttcttcggcaggtgcagtacggcgctgatcgcgacgagcgccaccgcgccgagcggcaggttgatgtagaaggcccagcgccagccccagttgtcggtgatggtgccgccgaccagcgggccgccgatcatcgccagtgccatgacaccggccatcatgccctggtacttgccgcgctcccggggcgggatcaggtcgccgatgatggccatcacgccgaccatcagaccgccggcgcccaggccctgcagggcgcggaagccgatcagctggcccatgtcctgcgccatgccgctcagcgcggagccggccaggaagatcacgatggaggtcatgaaggcgcccttgcgcccgtacatgtcgccgagcttgccccacagcggggtggccgcggccgtggcgagcgtgtacgcggtcaccacccaggacaggtgctgaagtccgcccagttcaccgacgatcgtcggcatcgcggtgcccacgatcatgttgtcgagcatcgcgagcatcatggcgatcatgagcgcgagcaggacgacccgcacgctcttcggctgttttccggtgtcggcgccggccgccgcctccgctatcgctgtgtccgccatcgttccccagctcccccaggtacctgtcccacttacttgccgcccggcaagtcaatacactcgggaaggtagaggtttactagccgggcgtcaagtaagtttccactggcctgtcggcaggtaagtttcccggacagcgcgaggagtacgaggatgggcgtcacgatggacggcaccaagcagcagcgccgcggcaacacccgccagcgcatccaggacgtggccctcgaactcttcgccgagcagggctacgagaagacgtccctgcgcgagatcgccgagcgcctggacgtcaccaaagcggcgctctactaccacttcagaaccaaggaagagatcatcgtcagcctcttcgaggacctgacgcagccgatcctggacctgatcgagtggggccgggggcagccgcacacgctggagacgaagcgggagatcatccgccgctacagcgacgtgctggcgggcgcttccccgctgttccgcttcatgcaggagaaccaggcgacggtacgggaactgcgcatcggcgacaccttcaaggaccggatgcgcggcctgcgggacatcatcatcgacccggaggcgagcctgaccgaccaggtgcgctgcgtcagcgccctgttcacgctgcacgccggcatgttcgtcatgcaggacctcgaaggcgaccccgaggagcggcgcaaggccgtgctcgaggtctccatcgacctggtgacccaggcccaccggggcgcccacggcgcctgagacgcgcagcgccgtacgggggccacgggacctggcacgcagcaccgcgcggggccctcgggcggccttgcggactgccgggctgccgggctgcgcacacagcactgtgccgcccggctgcgggcggcagcggggcggcacagtggcgaatcgttcggtcaggcttcggccggggtgcgatccggcgtcggcgcggactggcagactcagaccttcacgccgtgggcgcgcaggaagacgaccgggttgacggcggagccgtagttcggggtcgtacggatctcgaagtgcaggtgcgggccggtggtgttgccggtgttgccggacttggctatgtgctgcccggtggtgacgacctgaccgaccttcacgtcgatgcgggagaggtgggcgtactgggagtagagcccgttggcgtgcttgacgacgatggcgttgccgtaggcgggaccgtcaccgccgccgttgggaccggccttgacgaccgtaccgccgtgcgcggcgacgacgtcggtgccgatcggcacggcgaagtcctggccgctgtgcttgtgcatccagtggctgccgccctggtcgaagctggcggtgagggtgtagttcttcaccgggtcgacccaggccgccgccgacttggcgacggtggcggtgggggccgccatctcggcggccgacgcgacgcccgcacccatcgcggcc

SEQ ID NO: 1020 - DNA, 1919 bp, Unknown
  Kingdom: Bacteria, Phylum: Actinobacteria, Class: Actinobacteria, Order: Streptomycetales, Family: Streptomycetaceae, Genus: Streptomyces
gccgacggccgggtcatcagcggtacgcactgcctgatggccgtcggcgccatccccaacagcgcgggcctggggctggagcaggcgggtgtccggctgcgcgagtccggtcacatctggaccgacaaggtgtcgcggacgacggctccgggcgtgtacgcggccggtgacgtgaccggcgtgttcgccctggcgtcggtggcggccatgcaggggcgtatcgccatgtaccacttcctcggcgacgcggtggctccgctgaacctcaagacggtctcctcgaacgtcttcaccgaccccgagatcgccaccgtcggctacagccaggccgacgtcgacgccggcaagatcgacgcccgctgcgtgaagctgccgctgctgcgcaacccgcgcgccaagatgcagggcatccgcgacggcttcgtcaagatcttctgccgtccgggtacgggcatcgtcgtcggcggtgtcgtcgtggcaccgcgcgcctcggaactgatccaccccatctcgatcgccgtcgacaacaatctgaccgtcgaacagatcgcgaacgccttcaccgtgtacccgtctctttcggggtcgatcgccgaggtggcccggcagctgcacgggcgcaaggcgaccggcgaggcgtaggagggccgcggctcccggtggcagcttgtgggtgggggcttctgccgttcacctggcctcggccggctccgactccccgtcgtgcacggggagttgccgaccatgcgtccggcataggcggatggactagggcttataccactccgtgtgccgcggtgcgaacaacttctgttattcggcgcaaactgctgaaagcagacggtcgctggggttactgtcagtttcgtgttcgctgctgaacgtcgccaactcatcctcgaaatggtgcgagcgaacggtgccgtgtcgctccgtgaactcgcccgagtcgtccagacctccgaagtgaccgtacggcgggacgtgcgggcgctggaggcggaaggactcctcgatcgccggcacggcggtgcggtactgccgggcgggttcacccgcgagtccggcttcccgcagaagtcgcacctcgcgaccgcggagaagacggccatcgccgacctcgccgcgggtctcgtcgaagaaggcgaggccatcgtcgtaggggccggtacgaccacccaggagctggcccgccggctggcccggatccccgggctgaccgtcgtcaccaactcgctcctggtcgcccaggccctcgcccacgccaaccgcgtcgaggtcgtgatgaccggcggcacgctgcgcggctccaactacgccctcgtcgggtccggagccgagcagtcgctgcaggggctgcgggtgtcccgggcgttcctctcggggagcgggctgaccgccgagcgcgggctgtccacctccaacatgctgtcggcctccgtcgaccgcgccctcgtccaggccgcagcggaggtcgtcgtcctcgccgaccacaccaagctgggcgcggacaccatgttccagaccgtgccgaccgagttcatcacccgtctggtgacggacgagccgcccgctcacgacgaccgcgcgggcaccgaactgcaggccctggccgaccagggcgtccagatcgccgtggccgggccgaccgggaacctcgtgggtgagcaggctccggcccgtggcgagcggcgccgggacgtgccgctccccgggccgcgccgcagccaggtcgcaggcccggccgctgccctgcgggccacgagcctgggcggccaggacccgtcggcgggggccgagcgggcggcccgggtggcggatctgcggcgacggtgatcacccactaagcggggcaggcgcgtcggcgccagtgagtacgcccggcgccggggcaggagccgggctccgcggggctgcgg

SEQ ID NO: 1021 - DNA, 4099 bp, Unknown
  Kingdom: Bacteria, Phylum: Actinobacteria, Class: Actinobacteria, Order: Streptomycetales, Family: Streptomycetaceae, Genus: Streptomyces
  misc_feature (347)..(348): n is a, c, g, or t
accgtgggctggagcagggccgtgatgagcagcgccgcgacgaaggccagcaccaccagttgcacggcgctgatgaccttcatcagcacccacacggtgccggcgaggacgaggacgcgccagccggcctcggcggccacgcgcactccccagggcacggcctgggcggggtcggggcgggcggggacgatcgtcacgtggtcggcggccaccaccgtgtccgcgtgcggttccggttctgccccggtgtgttccttctccacctcggcacggcgctcgtccaaccgctcacccatctcggtcagtccggcgccgagccggccgagccaccctggaactcgcgacanncccctaggacggggaggggctgcgccaggttgagctcggcgggcggctcagtagttgtggttcacctgccagtacgcccaggcgtcgcacggactgccgtagcggacgttcatgtagttgaggccccacttgatctgggtggccgggttggtctgccagtcggcgcccgcggacgccatcttcccgcccggcagcgcctggacgaggccgtaggcacccgaggaggggttgaccgcccggtagttccaggtggactcgtggttcacgatgttgctgaagcactggtactggccgctcggcacgatctgccgggcgatcgcctgcacctgggccacggtgtaggagccctggacggggaagtcggaggcgtcgcgggtgctgcggctggccgccttcttctgctcctcccgctccttcgcctccttggccgccttctcggcggcctccttcttcgcgatcgcggtctcggcggctgccttgcgggccgcctcctcggcgtccttcttggcgctcgcgtccgcggcgatcgcctgggcgtccgcctgctgcgtgagggacgcggtctgcacgggggcctgctggcccaccgggaggtccgcgaggagtgtggtgttggctgccgtcgcttcggcgtcgttgttctgcgcggtgctgcccgaggcaacgccgacgacgcttccgacagcggtgaccgcggtggcggaggccactgcgaatccccggaccgagatccggctcacacggtttccttccagcatcgcccgcttcggtgaccctggcggacgcgatcgtgcccctggcactggcctcccaactgcgggtcacggaggcgcgggcccggtgggcaactcccgtcacgggagagccgcgtggtgctgcgggcggcatacgacgccgttatggagttgaaggtggtgctcatggggcgctacgccgctgggggcacagctgtgtcgtatgcggggcctgacaggaaggagactctgccgtaaccgaacgcgccgaggcaattctccgttgcgtgggaaagctcacaccacgttcggcccacgggatttcaggaaagggccacgcgcgaaggcgccgcccggctaggctctcggcctttgccggacggcgccaactcccgcacacatgccccgaatggagcagatgtgcgaacgacggtcagatgtggccgtcctccagcatctcggtcaccagggccgcgatctgcgacctctcggaccgcgtcagcgtcacgtgcgcgaagagcggatgccccttcagcttctccaccacggcgacgacaccgtcgtagcggccgacccgcaggttgtcccgctgcgccacgtcatgggtgagcaccacccgcgagtcggcgccgatccgggacagcaccgtcagcaggacgttgcgctccagggactgcgcctcgtccacgatgacgaacgcgtcgtgcagcgaccggccgcggatgtgcgtgagcggcaggacctccagcatcccgcgcgccgtgacctcctcgatgacctcgcgcgaggtgaccgccgagagcgtgtcgaagacggcctgcgcccacgggctcatcttctccgcctcggtgccgggcaggtagcccagttcctggccgccgaccgcgtacagcgggcggaagaccatcaccttctggtgctgacggcgctccagcaccgcctccaggcccgcgcacagcgccagcgccgacttgccggtgccggcccggccgcccatcgacacgatcccgacgtccgggtcgagcagcaggtcgagcgcgatccgctgctcggcgctgcggcccttgatgccgaacacctcccggtcgccgcgcaccaggcggacgttcccgtcggcggtgacccggcccagggccttgccgcgctccgaatggatcgtcagcccggtgtgcacgggcagtgcggcggcttcgggcacatggacgtgcccctcctcgaaaaggaggtccacctgctctgcgggcagggtgagttcggacatcccggtccagccggaggcgtcggtgatggcgagttccgcccggtactcctcggcgaggagtcccacggaggacgccttgatgcgcagcggcaggtccttcgagacgacggtgacgtcgtacccctcggcctgcaggttgcgggcgaccgcgaggatgcgcgagtcgttgtcccccaggcggtagccggtgggcagcacgctggggtccgagtggttcagctcgacccggaccgtcccgccgaggtccccgatcgggatgggggcgtcgagacgaccgtgccggacccggtagtcgtccagcaggcgcagggcctgccgggcgaagtagccgagttcgggatggtgccgcttggcctccagttccgtgaccacgacgatggggagcacgacttcgtgctcgtcgaagcgggtcagggcgttcgggtccgccagcaggacgctggtgtcgagaacgtaggtgcgccggtctggcttgtggcgctttgtgctggtcaccacggaaggacgtaccccctcggatgaggtcggggagcgacgaagtggatgccgggccgggagggcgggggcatcggggccggtggccgacgaagacgcggagggccggcgaccggccctccgcgtcttcgtccgcacagtgaccgcacggtcgcgctggtgcaacgggcctcccgggcggacggccccgagccgcccgctgagatccgacacccgtggttcgggtgtcgacctgtctggcttatgccctcgaacatgcaccgccatgcagaagcggggcacggcgcgcggatgaactccgcgtgaagacaggtacgggcccggcgggccgtccggccgggtcagcccccgtagcggcggtggcgggccgcgtagtcgcgcagcgcgcgcaggaagtcgaccttgcggaaggccggccagaagacctcgcagaagtagtactcggagtgcgcggtctgccagagcatgaacccggacagccgctgctcgccgctggtgcggatgacgaggtcggggtcgggctgggcccgggtgtagaggtggcggccgatcatctcgacgtcgacggcctcggcgaggtcctccatgctcacgccccggtcgtgggcgtcgtgcagcatggagcgcacggcgtcggcgatctcctggcgcccgccgtacccgatggcgacgttgaccactatcccctggacgtcggcggtggcctcctcggcctccttcaggacggcctgcatgccgggcggcagcaggtccatggtgccgacgtggtgcacgcgccagcggccgtcggcggccagggtacgcacgacgtcctcgatgatgccgagcagcgggaccagctcgtcctgagggcggtcgaagttgtccgtggacagcagccagagggtgacgacctcgacgtccgtctcggtgcaccagccgaggaactcctcgatcttgtcggcaccggcccggtgtccgtgcacggtggtggaacccgaggccttcgcccagcggcggttgccgtccatgatgacgccgatgtgcttgggcacctgagcgtggtccaggtggccttccacccggcgcgcgtacagcctgaccagcaggctgcgcagcttgtcgcgcaggttcacgtgttcgtcagcccctccgtatggatcggacaggcgcggccgggggcgttccctgtccgtgcggcggcctcgtccgtatggcggtccccggggcgaagcctacccccggcaccctcagggtccccccatgggccgtcacgcgcgcc

SEQ ID NO: 1022 - DNA, 4260 bp, Unknown
  Kingdom: Bacteria, Phylum: Actinobacteria, Class: Actinobacteria, Order: Streptomycetales, Family: Streptomycetaceae, Genus: Streptomyces
ggacggagaagtcgtcccggagggggaagtcgtcaaggacccccggcccgtgacccgccaccaggacgcaggacgccgtaccggacgcggcccgggggcgcctctttgagtacgcctactcatgcccgcccgtgccgggccggggaccatgggtgtgtcggcgtgcggaggggagacggggcatgggcaggtttctcggggcggcggcggtcgccgtggccgcggtcgcggcactggtcttctcctacgcggcgggagcgccgctcgccgtggtgctcgccgtcggcgcgggcatggcgagcctgctgtggctgctgctcctgctcacactcccctggaacctgtacttccgcgcgcacacggtgctcgccgagatcgcggtgagccgcgagaagggcatgaacgtgtccccggcccgcgacgccgaggccgcgcgcatcgcccgcgtcacgctccgggcggccgtcgcgggccacgtgctgaccgcggtggtggtgtgcgcggtcgcctgggcgaccggtgagtccaccggttactggttcgccgcggtcttcctgctcagcaccttcttccggccggccggcgcgtacttccgccagctccggcggcgtcttggcaccctcctcgaggacgtcacgtatccgcgggacgacgtcgtcgagctgcacgcccggctgaaccacgtcgaggccgggacacgggtcctggaggagaaggcggaggaacagtaccgggccctcgccgaactgcgccgcgccatggacgccctggccatgagcacgcacgaacgggccgaggggatcgaccgcaggatcgccgcgctgggcagggagttcgaatccacggtgaaccgcctcaccgacaacgaggaaatcatcgcgggggtcaaggcgttcctgcgcctgctgcgcacccccgacacggcggacggcgccgtcgccccctgacgcgcgccaccggtcgccgacgggttcaacgggttcagaagcccgggcggaccggaccggtgcgtttggcggtggccagggccggggtggtctcgatggcggtggtctgtgccatggcgccgatgagtgtgctgccacggacggcttcgacgggcaccgggtggccctgacctcagtcgctggcggcgaggtggccggtgaagaaggaggcgagcttgtcgacggccggggcgatgtactccttcttgtcgtagaggtcgacgtggctggcgccctcgatgcggtgcagttccgcggggccggtggcccggcggtgggcctcgacggccatccaggcggtgacggcgcgttccccgatgatctgcaggatcggccgggggccgatcagcgggacggcgtggaaggcgtcactggaggccatcttgtcgatgctctcccaggcgaggaacttcgcggaccgctcgtgttcgccccgggaggtgcagtagtactcgaagccctccatgccgtgctcgccgccgagcgcgccggcctgttcggcggtctcggggaacatggtcatcacacccgggtcctcgccgcgggcggcccgggtacgggcctgggcggcggcgtcgaggagggcctggaagacggccgggtcctgggagccctccgcgccgtagcggaactggcgggcgggttcggcggtggacacggtggccaccgccctgacccgctggtcgccgccggcggcggccagcgagtaaccgccggaggcgcagatgccgagcaggccgatgcggtcggcgtcgacctcctcgcgggcggtgaggaaggagacggcggccttgaagtcctccacccgctgggccgggtcttccagtccgcgcggcagaccgccggactcgccctggtgagcggcgtcgaaggcgagggtgacgaacccgcgctcggccatcagctgcgcgtacgtgccggaggtctgctccttcacgccggtaccggggtggccgaccacgagggccggacgcgggcccggtgtcgaggtgtcgggggtgtagaggtgggcggcgatggtgatgcccgcgctgtcgaagctgacgtcggtcctggccatggagatctccttgtcgactggctgtggcgtgcttgtcggaacggtcccgggacgacgggaccgttccttcccttcactgttcgttcactgctcacggcggacacgggccgcgcatcagtcacttgacggtgcggccactcgtcggacacctcggaaggagcccggcctccgccgtgccggggagggatgtttctacgatcacgccccgtccacagggggaaaagagacaggttcctgccggggaagaaaccttccccccaccccacacacagacgtgtgccaccgcggcggcgacggcatgagactggaagacatgcatgccaaacccggccccgctccgggccttcctcgaagcccgccgggcgcggctcgcgccgcaccagtgctgcctgtccgccacggccgccgcccggagggtcgcggggctgcgccgcgaagagctcgcccgcctagagcctgtccggacgatcaggccgcagacacggggctgatccgcactgctgttcaccgacgcggtggtccgggacctgcaccagcggtggaccgcgacgcccgcgacgccgtcgccgcccggcgcagggaagccgcggccgatcccgacgagcccgcgctcacccgcatcgtggacgaactaccgtcccgggaccacgacttccgcagccggcgggccgatcaccaagtcagcggcgccaggcactaccgtcacccggcggcgggcgacctggccctcgactgcgacacgtacggagcggccgcggctgccgccggcgcctcccccggggcccgcgccgccacgatccgtatccaccggcacccacgcgccccatctgacgcttcgccccctgacatcaatcaggaattgcgtcgttcactcgaaagatgatccccgcagggatggattcacccgatcgcccgaccgtattctcaccatcggatcgactgagggaattcacacctggaggtcttcgtgagcgaactactgaaccagaagtatgaaaggctgttttccttactggacgcgaatggcgacggagtcatcgccgaggacgacttcacgttgatggcgggccggtgtgtcaccgcgttcggtggggagcagaccgcgaagggccaggcctacgccgccgagatgctgaactactggcgggcgctgcgggagaccgccgacgccgacggtgacggccggatcgacagggaggagttccgtcaggcactgcgccatgtgagcggcgacttcgacacgctgatcggcccgctctacgcggccggcttccacctggccgaccgggacgacgacggccgtgtgaacagggaggacttcgtcacggtcctcaccgccatcggtgtccccgccgacggcgcgggaccggccttcgacagcctggccgggcccgacggacagctgacgaaggaccagctgatgaccgccgccaccgggtactaccgcgacgacgacccggcgaacaccacgagccatctcctcttcggggcgctgtgaggtaaccctgtggtggacgcgaccacggcggaggcgagtgtcacgacggccgacgaaacacacgtacgacggctgaccgacgtgctcttcgaggggcgtttcgacgcacttcacagaccctggacggaaatcctgggccgcgaggtattccattaccgcgacggattgtcgtcctcggagcagtccgaactcgcctaccgccggctgcgcgttctcaacgagggcatcgattccgtcgaagaactggtcacggagacggaccggctcgtttccctgcacgagtggctgggtgccgtcgacggcaccctgaccaccctgacgaccgtccactacaacctgttcctcggcagtctcctgcgtctcggcacccggcgcacgacagacctgtcccccttcgtgcggctgcgtcggtacggcaccgtactgatcaccgaactcggctacgggaacaacgccgccgcgttggagaccacggcgacccaccggccggagaccgacaccttcctcctgcacaccccctcggccggcgcccagaagttcatgcccaacaccggccccttcgggggcccgaagagcggcctggtcgcggcccggctgatcgtccgcgaccaggactgcggcgtgttcctgttcctcgtgcccctgcgcgacgagggcgggccgctgccgggcatccgggtacggcccctgtcgcagacacccggatccgcggtcga

SEQ ID NO: 1023 - DNA, 3806 bp, Unknown
  Kingdom: Bacteria, Phylum: Actinobacteria, Class: Actinobacteria, Order: Streptomycetales, Family: Streptomycetaceae, Genus: Streptomyces
cccttgtcactgccgttgccggagtcgccgcccttgctgccgtcgcccgtggcggtgccgccggtgctgtccgagggggtcgcggagttctcggcggcgggggaggaggcgctgtcctgcgacggagcggcgtcgatgtcgccgtcctggcaggccgtcagcgtcaagcccgcgaggacggccacggtggcgagggtcagcttcggctggacgtgcatcgggacttccttgctgtggttcgggacggtggtgcactactgatgatcatttagacacaacctgcgcctgtcccgtgccgataccgcctgctgggacgtgtccctgacagaactgttacacgcggggccggcactcagcccgccgcactcagcccgccgtacgcaaccgctggagcgccgcgcggatctgggcgacgacgtgcgcctggcgtgcgaacacgtcgacggcggtgaaccgcaccagcgacctggcctcggggcacgcctggatgcgattgaaacagtcgatgtcgcgccggtgctgctcccggctcccgtgatacgcgtacccctcgatctcggcagcgagcccctccgcccggaacaggaagtcgagaaacacctgccgcccgtcggccgcgtccacctcggcctggctcgccgggcacagcccgacgaacccgcaccgactcccgccccggccccccaatctgctcctcgtacacggcatgtccgcgaaccggcacctcggccgacccacgctcgcctggttcccgtcgcgggcctgccgcgaccactactgccgcctcacagctcgaccaccgcgagccggtgccggccgccggcggcgacccgggccagctcgggcagcaggtcctcgcgcactatcctggaaggcggccgggcacgtggcaaagaccggatcgctgaacaccagctccaggccgtgggcatacgagatgtcgtgcccggcgcccagacgcaaccgcccgggatcccaggcgacaatgccccagtcccaccatgacccttcgggaagctcgatcacggctcgttgcccgccctggaccgcgccatcaatcgggaatcaccaaaccaagctcacgcagccgcggaaggcagatctccaggcacgcctccagagagacagcgtccgtgcgaaccaggagatcatcccgaagcggagccccgctcgcgacgaaggtccaaggcttcatcgcatcgcgcatgcgttcggcgtcgaccttgaacaacaccgtcacaccctgccctgccaacgactccatgacccgcgccacgtccatcgcatccccacccccgcctgaattcgaacagcccgaaggctacaccggcctctcacgaccccggcttgaccgcttggcaacgtgaggcgtctaccgcctcgcgagcacccgagcgcgagccgaagaacctgccaaggccggctgattcactggaagccgactcggcccaacggtgcatctggccggggatagggtcggcggatgcgccagttcacggatagtgaagccttgtcagggatcgtgcagcaggcactgggggccaaggcccgtgttgtcggagtggaccggttgcgcggcgggagcaagaagggggtctaccgggttcacacgagcggatcacgtgcagcgagtgtgatcgtctacagctgggccgaggccgagaacttctggccggctgcggaagccgtcgacccggcccacccgttcgctcccgcctccgggctggcccccttcctagcggcccagcggagactggacggccttggagtccgggttccaggggtgcttctcgctgacgacggccgacgccgctacccggcggatgtggcagttgtcgaggacgttgccggcggcactctggaagcgctcctgaagacggatcccgcacgcgcatccaatgccttgagcgagctggccgccatgctcgacgtgatgcaccagcagcacagtcagcactatggcagggtggacgtgctcgaacggggcgacagagcgagtggcgattcatgcgagcaactggtgctggaacgtgccatcgaggatctcgctgaggccgccgaacgcgaccccagcatcggatcagccgcagcttctttgcgtgatcgcttgcaggagctggccgcacgagtggctccgcgcacgcagcacggactgatccacggcgaactcgggcccgaccacgtcctggtcgatgcctccggccaccccgtcctcatcgacatcgagggcctgatgttcttcgatgtcgagtgggagcacgtgttcctgcagcttcgtttcggcgatcactactcagccttgtcccgccccggactcgatccggcacggctcgacctctacatgctcgcgatgcgtctctcactggtggctggcccccttcgcctgctcgacggcgacttcccgcaccgcacggcgatgcaggagatcgccgagcacaacgcgaaggaagcgctggctctgttggtctcatagcaccgcgtccgccacacacgcatcgcttaacgagctggtgcgtgattgtggttgaggtgtgatcgagtgggggtgggatgatccagtccgtggcgatcacgatcaaccggaacgtccttgcgcatcagttgttcacaggggtctcccggcagcatctggctggtctggtcgatgagttggccgattcttgggaggccctggtcgagggacgtcgtcacaaggcacgtggcgggcccaggaaacgcgaggcgggggcaggtgcccggcaccgactggtgttcgtcgaccggctggtcgtcacgctgatccacctgcgacacgatctaccgcactctgtcctcgccctgttgttcgatgccgaccgctccaccgtcacccgcgcgatcggagagatacgcaggctcctggcagaacgaggatgcgcggtccccgaccggcccggcctgcggctgcggaccctggcggatgtattcgcttatgcccaggccgagggcatcgagctgcggctggatgccaccgaggttcaggtccgacgtcccgcagccggtcgcggcggacgccgggcattcgtctcgggcaagaagaagcagattcccaacgaagttgtcaagcgaagttggtggcagtccgctagtgcgtcatgccgctgcggtttcgggtgcgagaggctccacttcgaagttgcgtccgtcgcgtatgagggcccacagcacgttgagccggcgcctggcgagggcgaggatcgcctgcttgtggcccttgccttcggctctcttgcggtcgtagaacgccttggagaccgggcagtatcgggcggcgacctgggcagagaggtagaagacccgcaggaggcggcggctgtagcggcgtgggcggtgcaggttgccgctgatgcgtccggaatcccggggcaccggggccaggcccgcgacgccagcgagacggtcggggttgccgaaggcagccatgtcgccgccggtcagagcgatgaactcggcgccgagcagtgtgccgatgccgggcagactggtgatcaccggggcgagggaggcgtacgcggggaaggcatcgatcccggcctgcccggcgccgccgtagggggagagtagtttgcatgtcggttggctcacgcggcgcagtccaggagcacccccgggatcgacgatgaggtgttgtgccccccggtgtcgtggcccgctggctgcgttcgacggtgaccaggcagcggtatccagggcgcccgctgagggtgggcgcccggcgcggatctgcggccggtgcgcagtcgacgatccgtgcgccaggccgctggcctcccgctgctccctgtcgg

SEQ ID NO: 1024 - DNA, 3538 bp, Unknown
  Kingdom: Bacteria, Phylum: Actinobacteria, Class: Actinobacteria, Order: Streptomycetales, Family: Streptomycetaceae, Genus: Streptomyces
ggccccgccgggcacggaccttctgcaccacccagccggtgggccggcgctcgccgaggatctcgcggacggccgacggcggcgccggcaccttcaaccggtcggtggggacctggtcgtagtcgacgccgtcgaccggccgcacatgctgcggggcgcggacccatacccggtactccgcggcctgcacggtcccgtcctcgctgtcctcgtacgagggcaggcccaccaggaacacccagccggtctcggtctgcctccgcctccacaaccgcgccacgatctcctgctcgggatgttccagcagcgggtcggcaggcagcacgacccgcaccggcacaggaccgggcgcagcagggtcagggggcgtcgtcacgttcccaccgtacgcagcgggcatcggcctcggagggctgcccaccgtgccgtctcgcgcaggagcgaccgtccggcgaatctgcgggccgccgcgggatgagccacgtcctacggtgcgaagagggccggatgtccgccgcgcgggtggccgcggctgcccatgcggcgaggcaggggcgcgaaatgcgccgggccgggggatgcgtgatgcatgagcactcaccatgacggcccggacggtgcgcaccggcggccgccgggtgtctcggacactctcgtgcaggccctgggggcgttgtcggaggcgctggagacgaccgaacgcgcccgcggtcacctctacgccttccaccagctcaccgggggcgccgacttcacactggaccgtgcggtggcgttgctgcgggaggccggccaccagccatgggcggagcgggtgcagcgggagatcctgggccgcaacgtgattcccgggcactggacgttccagatcatcgaggcctacaacgccacctactaccagccgttcaaagacattgaggcccaggcccggaaggcgctggtcgcgggcgcggatcacctgtatgaggcggagctgaaagagcagcgccgcacgcgaggccacccggaccacaccgcccgcccggactctgtccgcctgcccggcgagtaggcgccggcctacgcgccggaagggggcgcctcgtctccggtgtggtcgccgcgcagcagcggggcgaccggccaggagcacgacgacgtccacggccctgaccatgctgcagaacaacggcacagacaagtagtcggcgccggacgtcgccagcgatcccgcctgctgcgcaggtcgcagggcccttcgaggcctcgccgagaggacaccgatgcgacccaggacgcgacccaggatgcgacccgggtcggcacctaggacgagaccgagggcgcgacccaggacgcgacttcgggacggcctaccgccataggggtccccgtagagcgcgcaccgcacaggttgactcggctcacctgcctccccgggaaggcgcaagagaagggggcggcccggtcaccacagtcaccaggccgcccccttcgccgtgagggcctacagcagttccacgggcggcacgcgccgggcggaggtcatccacccggcccgcgcgttcagggccgctcccatctcggggccggtgggatggcgcaggtgggggaaccagaccacggcgatctgcgcgcgctgccgggccatatcccaccacagggccgggggctcggccagctccatgacgacgtgtaccgccccgtcctcgccgggcttgttgagcgccaggaccaccgagccggccgcgtcctgccagaagtgccacggccccccgtccgcaggggcctcgccgctgagcggggcgagggaggcgtacgcggggaaggcgtcgatctcggcctgcccggcgccgccgtagggggagaggaccaccgccgccatcagagcaccgcccacggggaacgcggtcggctgagcgatcaactgcggtaccttgcgtgtctgttggctcacaccgcgcagtctaggagcaccccgggcatggaccatgcgaagttgtgcccccgctgccacggcccgctcgccgcgttcgacggagaccaggccggactgtcccgggcacccgcggacggcaggcgcgcggtgcgggtctgcggccggtgcacagtcgacgaagccgtccgggaggccgtcggcctcccgctgctccctgtcggccgcaagctggtgctggagcacctgacatggcgagacctgccgcgcctcctggtccgcaggtactgaagagcctgttcctgaactccccggaggaaatggaggacgctggacccatggccagtgacaacagtccgaacccccgccctcaactgaccatcgagtcgttctctccggacccgatccgagagacagtgtgtaactgcgtgtgtcaactccaccatgccgggtgggccttccgtgagggcgcgtgcgccggtgttgctcaggagcgggaagtagaggtcacctgggtctccgtcatgaccggagaccctgccccgccccgcgtagagccggtgtgtgtcccctgccatgacgccgtcgtggcgttcctcgctcggcgtcgctccttttaccgcgcctgacctgcccttcctgcccttctgtcacacgagcctcagagcttccgtcccgctgacaaacgagagcgggccgttcaccaccagatggtgaacggccccctccgtagcatctgacatggcgcgacctgccgcggctgctggtcagcgcgcactgacaaacgagagggggccggtcaccaccaggtggtgaccggccccctccctcatgcgtcggtccgtctcccagccctacagtccggcggaggttaggtcactcggtgacgtcaagcttctgcgcgagcttctgccccatcaggtagtgctcgcgtagcgttggcagggagtccagggcggcctgcttcagcgacggggtctcgccgtccctggcttccttctcgtgcgcggcgatgccgatccgggatgcctcctgaccgacctggcgtgcgtaggcgcggtcgaagtcggcgtcggtcagagggcgcagtgagtccaggagggcgaggtcgctgttgtccttggggacggtcacgccttgaggagcgacggccttcagctgcacgatcagccgcatgcagtcggcgatcatgttccgtgcgaaggaccgcacgtcggcgttgctcgtgttcttgtgtgccatcttccccgcgtcgatctgcgtgctgtacagcatcgtcgcggcgtggatgaagtcctggtcgacgggcgacagcgcggtggtggcggcatcctcggtggtcatgatgtgctcccttactcggtgatgcgccgcacacgaccggacagccggcgcggcggtgacggcagtcgtcgacgcttacctgccagcacgcggactcagtgccgccgctgccgtgtcgatcttgcgcgataccaccacggcccgtacgccgcggcacacgaaaaccacccaaccgtgggcattaactgcgctcccacccccaacagcgaaagcgaactgatagccatcccccgcccaacgcagtggtggtcaccaccaggtggtgaccaccactgcgtt

SEQ ID NO: 1025 - DNA, 3561 bp, Unknown
  Kingdom: Bacteria, Phylum: Actinobacteria, Class: Actinobacteria, Order: Streptomycetales, Family: Streptomycetaceae, Genus: Streptomyces
gctgggcgtgcacgcccagcatctcgccgacctgctcggcgggcgcccgtgtggagacgtgcacccgcagcgtctccacgagccggtcgcggcggccggcgggcaggccgtcgagcggggcgagttccctggccgccagctgggacacgagcgacgggtcggacagcagccacagcgtcaccaggtggtcctcgcagcggaccaggggcgcgtcgggcacgacgccctcgtcgatgagctggagcacgcggcgcgcccagcggatcgagtcggcggcctgggtcagcggcacggtcaggcccgtcacggcgtgcgcgccggtcagggcggtgtcgagcatggcctgccgctgcggggtcagctcgcccgggacgagcaggtgcggctgggggatgtccaggtcggcgaggacgtccgccgccaggcccgcctccacgtggtcgggggcgggcgagcgcagcgcgacgagggtgacgtgggagggcagcggccaggcggcggcctcgcacaggtgggacacggtcgactggggcagcggaggggcggccaggatcaggtgcagcaactgtcttcgcagggccgacacctccgacgagccccgcgactgcacctcgacgtagccctcccgggagatcgcctccagctcctcgacgtaggcgaacagcgcgtccgcgaaggcgaggatgatggtgggggagaggttgtactggcggccgacggccttggcgcggcgcagcgcgatccgcgccccgagccggtaggccccctggagggtgtcgagttcgcggccctcgtaggcctcgacgcggccgaacctgcggagcagctcgtcgcggaccgccgagttcttgccggggtcggcgacgcggtctacgaacgcggacagcgcctgttcgacgccctggcggatggcgtccgcgttcggcccgttcagcaggcggccgtagaccgggtaggcgcgggtgacctcgatgcgtatctccttcatcagaccgggtaactccggtcgcatgaaggccgcgaactccttgggcagggggtcgagcggttctccgacctccggcgtccgtacggttgaaggcatgagttggtcgtcccttgctcttccgacgcgcccggtgggggaccggccgcccgccgcccgccgccgcggtggcggacggcgggcggcagacggccggtcgtcaggtgcagacctgtgtgaaaggtgaagctaaatcaacttccgctgtacgtacacaggttggacacactttggtgccgtggggcgggtgcggccggacgggacggctgataatcgccgccgtgcggccattacttgacggcggagttccagttctgcgagaggatcttgcccgcgtcggggacgacggtgccgggggcgttcagaccggccagggaggtctgggtgtcgttgagggtgatgttgttcttcccggcggcggagggcagacccgtcttgaggttgaccgccgcgtcgatcagtccgaacaggcccagcccgcagccgctggcgccgggcacggcgaaggtgctgtcgttctgcgtggcgccggtgaggttgatccggctcatgtcgccgtcgtcggcgagcgtgccgtcgcccttgaagaacgtcatgccgaactcggggtagttcaggttctgcgggcgcagcacgatcgggttcgacttggtgccgatgtagcagttgctgccgaggaacgggttctgcaggtggatgcggaccgggatggagacgatcggctctccggtgacgatgcccgcggtctggtcgaagccggtgggggtgcccacggactccacggtggccgtgatcttgttgaggctgctgttggtgatctgctggcagatcaccgtgacggcgggcacgttgctcgggcacatcaggccgagcaggccgcccggcaccgtcgcggagtcggcgatgatcgctcccgaggacgggggcaccaccgtgctggtgccgtcggagttctgtatgacgcccatctggaggtcggtgcggcccgtcgtcacggtcgtgttgcccagcttgatggagccgccggccgaggtggagaccacgcactgcggcgtcctggccacgccgtccgcggccagcatcgccggggcgtccacggggcagcgggtgaacggcgcccactcgccgttgagttgcgcggtcgcggcggtcgccgtgcccatggccgcgagggagccgagggcggtgccgagcacggtgacggtggtggcggcgagtctggtacggcgggagaaccggttcatgggggaccttccgggagggtgacgggagttgaggggatcagcgctcggcgacggggatcttgatcggttgcttgtcgtcggtgcactcggtgccgtagtggggctcggcctggccgcacgtctggccctggatctgcttgatgtagttgtcggagccggagaccgaggccgtcagcagggggtcgaggtcctcgccgccggtaccgcagccggtgaaggcggggatggaggccccgcccatgagcgcaccgccgctcagcagcagatagcctgtggcgtcctggcccgcgtccatcacgcctctgccgtgcaacacgaggtggtctccggggtggtccgccggttctggttcggctgagcggagcggcgtgcgcgtccggcaggacggccccacgtccaggggcgtgccgttgaccgtgagggacgtgacccgcagtaccagcgggactcggatatagctgtccagggacatcgggaaagtgtccaggtagccgagggaatcgacggccagcggacccgcctgctccaaaaccatggtggctgtcgccgggacgaaaccgaaggtcagaagagtccccttgaagggcgggctctgggccttgccctggtagtagagctggccctcggagtgctgccagaagatgagacggccgtccggtgacatgccgatctgcgggtcgccctgttcgatgagagtgcaggacggcgggagcagcgtcgcggctttctgcttccgcacgttcgagtaaccggtgatgtacgtggccagggacctcgacgtcgccggatggtgcttgccgaagcggcaggggggcacgtcgcggcggtcggtggtggcgccgggcgtgataccggcgatcttcggagcccgttcgctctgcgggtccccggggtgcggctgcggctgtccgggcgccgaagaggatgccgccggggtgcctgagtccgtgccgctcgatgaagccgacggggagctccctggcttcgaggtggtggacccgaccgccacggtggccagcagcccgtggccaggagcgtccttgtccagggtgcactggacggtggccggggtgttgcccgcggtcgtgtccgcggagggggccgcggagctgccggacgcggtgaccgcgagatcgatggccaggtcttcggcggagagcgtcaggtcccccgtgctctgcgcggtcaccgacgggacgtcgccggtcgcggtcagggtgagcggcccggattccgggagggcgacgggctgtgccgtgccgcgccaggtcgcctcggccgtggccttgttct

SEQ ID NO: 1026 - DNA, 885 bp, Unknown
  Kingdom: Bacteria, Phylum: Actinobacteria, Class: Actinobacteria, Order: Streptomycetales, Family: Streptomycetaceae, Genus: Streptomyces
gtccccggggcccgggccgaccggctgcccgaccggctcgccccgcgccccggggacctgctggtcgccaagcagggcctcgacgcgttcgcgggcacggatctggacgagcggctcggcgccctgggcgtcaccggcctggtgatcgccggtctctcgacggcgcacggagtcgccgccacggccgggacggcgctggcgtcgggctaccgggtcaccgtcgtctccgacgccaccgccaccgtctcggccgccgaacaggagcgcgtactcggtcagctggcgcgcgcgggcgccgccgtacgcaccatcgacgaggtcctgtccgccgccgtcactggcagctgacggccgtcggccggacgacgtacaccacccggtgggcgacgtccgacggcagccggccgcccagctccctgccgtaccggtcggccagttggacgaagaaggtgcccgaggagtcgtcgtcgatacgctcgacgaccccgcggatctccaggtagcggtacggctggtcggggtcgttgacggagacggagacccgcggatcggacgtcacattgcggtacttgtagcgggtcctggtgctggtgaaacgcaggtgggtgccgtcccaggagcaccacatggggttgacctgcgggccgccgccgtccgcccgcacggtcgccaggtgggcgaagagcggccgccgcagcaggtcgaggtgggttgcggggatgagactcatcaactgccttcgttcgtacgtccatggggccgggcgccggtcgggcgcgccgggactcgtcagcgcgcggggccgaaccacgccgtgagggcgtcggagaggtccacgtcggtcggtgcggcccaggccacgtagccgtcggggcgcaccagcac

SEQ ID NO: 1027 - DNA, 3040 bp, Unknown
  Kingdom: Bacteria, Phylum: Actinobacteria, Class: Actinobacteria, Order: Streptomycetales, Family: Streptomycetaceae, Genus: Streptomyces
  misc_feature (2576)..(2577): n is a, c, g, or t
gcgccaaggcgtgctcttcggcctccgggtacgaccgggcggcgcggcgtgcgagccccgcgagcccggcaggcctgtccgtgtccgaacgttcctccgcccgctcccggttcccgcgccacgcgccggtcatccggcgcagccgtgagtgcggggcggcgctctcggtcggttccattcccgtccctctcacagccggcggtgcactcgccgcgcggcccgctgcccggcgtcccctggacacggccgcgctggaaaacccttccacgtacccgacaggagcacggggacgccccgaccccagccgggcacggcgggcgcactcctcaacagtaggccgcggaaggcttcctcgggcagcggtcgtcgacggttgcccgaatgcgccccggccgcccgtatgcctctggtatgcgccgaaccggtgcccttcaaccgctactcgccggtcgggagggcgacttcggccgccgcgtccggtccctgttccaacaggaccgtgaaaccctcctcgttcaggacggggaccttcagctgcatcgccttgtcgtacttcgaaccggggttgtcccccaccaccacgaaagcggtcttcttcgacaccgaaccggtcaccttcgcgccccggctctgcagggcctccttggcgccgtcgcgggtgaagtgctccagggtgccggtgaccacgaccgtcaggccctccagcgggcgcggcccttcgtcctcaccggaggactggtcctccagcgggacgccggcggccttccacttgcgcacgatctcgcggtgccagtcctcggtgaaccactccttgagcgcggcggcgatgatcgggccgaccccgtcggtgttggcgagttcctcctcactggcctgctcaatacggtcgatggaacggaactcgcgcgccagcgcctgggcggcgaccgggccgacatggcggatggagagcccgttcaggaaccgggccagcggacggtccttggccgcctcgatgttctgcagcagcgcgagggtgttcttcttcggctcgcccttctggttggcgaagaccgtgacgaccttctcctcgccggtcttggggtcgcgcttgggcaggccgctgtccgggtcgaggacgtacgccttgatgggcagcagcttgtccaccgtcaggtcgaacaggtcgccctcgtcggccagcggcggttcggccggttccagcgggcgggtgagcgcggcggcggccacctcgccgaagtgctcgatgtccaggcactgacgtcccgcgaggtaggagacgcgctcgcgcaactgggccgggcaggtacgggcgttggggcagcggaggtcgatgtcgccctccttcatggcccgcagcggcgtaccgcactcggggcactcggcgggcatcacgaactcccgctcactgccgtcgcgcaggtcggcgaccgggccgaggatctccgggatcacgtcaccggccttgcgcagcaccaccgtgtccccgatgagcacgcccttggccttgaccacctcctggttgtgcagggtggcgaactcgacctcggaaccggccacggtgaccggctccacctgggcgtacggcgtgacgcggccggtgcggccgacgcccaccttgatgtcgatcagcttggtgttgacctcctcgggcgcgtacttgtacgcgatcgcccagcgcggcgcgcgggccgtggagccgagccggccctggaggcggatctcgtcgagcttgatgacggcgccgtcgatctcgtgcgccacggagtgccggttctcgccgaagtacgcgatgaactcccgtacgcccgcgaggtcgtcgaccacccggttgtgcggggaggtgggcaggccccaggcgtgcagcaggtcgtaggcctgcgagaggcgggtgaggccttcgtagccctccagggcgccgatgccgtggaccaccatgtgcagggggcgggtggcggtgacgcgcgggtccttctggcgcagtgaaccggccgccgcgttgcgcgggttggcgaagggcttgtcgccggcggcgaccagccgggcgttcagctcctcgaacttctccatcgggaagtagacctcgccgcggatctccacgaggtccgggacccgctcgccgtgcagccggtcggggatctccgcgatcgtacggacgttgggggtgatgtcctcgccggtgcggccgtcgccgcgggtggcggcgcgggtgagccggccgtgctcgtaggtgaggttgacggccaggccgtcgaccttcagctcgcacaggaagtggtactcctgctcgcccagttccctggcgatgcggtccacccaggcggcgaggtcgtcgtcgttgaaggtgttgtcgagggagagcatgcgctcgcggtgctcgaccgcggtgaactccgtggcgtacgagcccgcgaccttctgggtcggcgagtcgggcgtgcgcagctcggggtacttctcctccagcgcctccagggaccgcagcaaccggtcgaagtcggcgtcgctgatgacgggggcgtccttgacgtagtaccggaagcggtgctcctcgacctgctccgcgagccggacgnntacgcgggggaagcgcccgcgaggccgcacgccggggtgagggtgaccgaccgggcgagcagccccggtcgcagccccagcctgcgccacagcgttctgacacccatgacgctaccggcagggtctgacaatgggccgtccgtggtcgggacgacaccggcgaagaggtgcgtgccgccttccaccgcttccccgatcacctcgtcatcacgctcggtgagcagcgagaagtcgaaggagataccggccgcgcccgcccggcgcagcagcgcgaacggcacgtccggcgcgcaggagtggacgacgacgggcccgtcggagtgcgctgcgaacacggcccgcaaggtggcctccacgacctgccggtcgacggcgcggtggctgcggtagccgctggcggtccgcacctgtccgcgcaggacggcggtcagcgacggttcgtcgagctggaggacgaggcggg

SEQ ID NO: 1028 - DNA, 2587 bp, Unknown
  Kingdom: Bacteria, Phylum: Actinobacteria, Class: Actinobacteria, Order: Streptomycetales, Family: Streptomycetaceae, Genus: Streptomyces
ccaggtcgggggcggccgcgcggaccgcgtcccgcagcgcgtcgagggacgtggcgaagacgcaggggagttcggcggcggtgaccgtgagcccggcgggcggctcggcggccagcagggaggccgcctgccaggacggattcacgctctcgccgccgaagggggcgaaaccggtgacgagcacacgggtcatgggacttccttcacggttcgcgggagggatgtcctccacagggaagggcggtggggcggcgcgggcacagggaagggcggtggggtggggcgtgccgggcggctcagaaggcgaacaccgccatgatcacggtgcagcagaccaggagcggcagcgccgtcggtatctgcgccttgatcggcccgtactggtccttcagttcgagcagggtggccgggacgatgttgaagttggcggccatcggtgtgcagagcgtgccggcgaaaccggccagcatgccgagcgcgaggacggcggcctcgttgccgtgcatctgctggatgaggatcggccagccgatcgccgcggtcatcacggggaaggcggcgaaggcgttgcccatgatcaccgtgaacaggaacatgcccacgcagtacgcgatcacggcgaggtacttggagttgtccggcagcacatcgttgacgatcttgccgacctgggtgccgacaccggccagcgcgaagatcgacccgagcacggcgaggagctggggcagcagcagcgcggagcccatcgcctccagcatggagcggccggagtgcagcggcacggagagcttcttctcgccggtgacgagcatgccgacgaccagggcgacgatgcagccgacgccgaggccgagcagcgtggccttgcccttctcgaacaggccggagtcgtcgagcacggaggcgcagacgatcgcgacgaccgggatcgtcagggcggggatgaagatcttgctgccgagccgggaggctgaggcctcgcgctgctcggcggtggtggtcaccgggacgcccttgccgaggaagttgaacccggcgagcacgatcaggacgaggaccgccacaccgagcggttcggcgggcagggtccagccgccgttgcccgcttcggcgttggcgacgccggtgccgtaggggaaggtgagcccgagcaggccccagaaggccgcggacgtccaccgcctcgggttgctgcggtcggccgccatctgcacggccatgacgacgaagacgaggcccaccagccagtagagccattcgaccttgatcacttggcggttcccttcggcagcggcaggtcgtgctccgcgacggcgagcgccatgtcgcgctccagttgccggtccaggagcagcagccgggcgccgtggatgaggaaggcgcagacggcgagcgggatcgcccacagcgccagctgggtcggttcgagttcctggtggtacgtcgagttcacgaaaccggtgatcagcaggatcgagccgatcgcgatgaagcagtcctcgccgaagaagacgccgacggtgtcggccgaggcggcgtaggagcgcaccttctcgcgcatgcggtcgggcagcgccgcgcccgtggtgcgttcggccgcggcctcggccatgggcgcgacgagcggccgtacggtctgcgcggggccgccgatgttgttgaggccgaaggccgccgtgacctgccggaccagcaggtagacggcgaggaagcggccggcgctgaggctgccgaggcggctgatgaggttgcgggcctgctcacgcaggccgtagcgctccagcaggccgatcacggggagcacgatggcgaagacggtgaccgagcggctgtcggcgaaggaccggccgaaggccgcgaggacctccagcgggttcatcctgccgagcagtccggtgacgatcccggcgacgcccacgaccaggacgggattgcggcgcgtgacgaatccgaggatcaccacgaccacaccgaggagaacgatcatgcgcggccttcttcaggcgttggggacaggggcgccccgcagggcgcggagccgggcttccggttccgtggggatgcacggaccctaggcgatcgttgaacgatcgaacaaggggcaagttcacgccgccgccatcggacgtcatcgagagggtcccatcaggcccttgtgggatcgttcaacaatcgtctactttcgagacgtgatcgatctcaacgcggacctcggtgaaggcttcggacgctggaccctcaccgacgacgaagccctcctgtcggtcgtcaccagcgccaacgtcgcctgcggattccacgccggcgacccctcggtgatgcgccgtgtctgcgacctcgccgccgagcgcggagtacgcatcggggcccaggtgtcctaccgcgacctggccggcttcggacggcgcgccatggacgtgccccccgaggaactggcggccgagaccgcctaccagatcggcgcgctgcgcgtcttcgcgcaggccgcgggcgccgacgtggcctacgtcaaaccgcacggcgccctgtacaaccgtaccgtccacgacgccgggcaggccgccgccgtcgtggccggagtgcggct

SEQ ID NO: 1029 - DNA, 1256 bp, Unknown
  Kingdom: Bacteria, Phylum: Actinobacteria, Class: Actinobacteria, Order: Streptomycetales, Family: Streptomycetaceae, Genus: Streptomyces
ccgccgccgctggacccgaaggacttcatatccagtgtgaagaaggacaccgccccgctcggcccggacaccttcttcgcgggcacccggctcaccatgaacggggccgcctacaagaagggccccacggccgacaccaaggactgcgcctccgccgtccagggcaccctcgccaaggtcctcaccggcaacggctgcacccgcctgatccgcgcgacctacacccagagcggcctggcggtcaccgtcggcgtcgccgtcttcgacaccgaggccgaggccgccaaggccaagggccaggccgacaagaagagcatcgtcaagccgctcaccggcagcggcgtcaaggccttctgcgacggcgcggtctgccgctccaccaccaactcctacggccgctacgcctacttcaccctcaccggcttccccggcggcaagaacgtgaccaccaaggacaccaaggcgttccgcaccggcgacgacctcgccgagtacacgttccgccagatccgccggcgcggcgaggcccaggcctccgcggcggccaaccagtgacgaggcgcacggcccccgccgctaccgccgcttcaggcgcagcctgaccggcaccaccgccgactccagctgcgtacgcaacgtcatcttcgacacaccctcggtgcgctccccgaaccggatcggcacctccacggcgcggtgtcccgcccgcaccgcccggtacttcagctccacctggaagctgtagcccgcgctgtccagggtcgacaggtccacgtcccgcagcgtggccgccgaccacaggttgaagcccgcggtgatgtccttgatctccgtgcccagcacggcccgcgcgtaggcgttggcgaaccgggacagcagcacccggtgcacgccccaccgctcgtccagcgagccgcccgccacataccggctgcccaccacgagaccggcccccgacgacagcgccgcatcgagcatgcgcggcaccgcctccaccggatggctgccgtcggcgtccatctgcgcgacgtagtcggcgccgtccgccagcgcggccgtcatgcccgccgcgtacgcccgcccgagaccgtccttgcgggtgcggtgcagcacgctcatccggcggcgccccggcgcacccccgtccacgccgccaccgccctcggcgcccctgccgtacttcctcacgccgtacttctcggccagttcgtcggcgatccgtccggtgccgtccgggctgtcgtcgtcgacgacga

SEQ ID NO: 1030 - DNA, 542 bp, Unknown
  Kingdom: Bacteria, Phylum: Actinobacteria, Class: Actinobacteria, Order: Streptomycetales, Family: Streptomycetaceae, Genus: Streptomyces
gggccgtcggctcgacgccgctcagcccgacgccgctccgctgctgtgcgcgatgcaggccacgtcgatccggtcggcgagcttggccagttcgatggtcagggcggccaccgtgtcctcgtcgagcccctcctgcccggcctccaccagccgcagccaccggccgcccaccgtccgcagcagcttgctcacatcggccgcggccacctgcaaggtaccgcggtcgtcgacgatcagagggagtgtcacttcgcggttcacaaaggcgatcgtagccgcggaagcctcacgctccgtgccataccgtggtgatgttgcagaactcgcggattccgtgcccggacagctcacgcccgtaccccgaccgcttcaccccgccgaacgggaacgccgggtgcgaggcggtcatcccgttcacgtacaccccgcccgcctccaggtcccgtacgaaccggtccacctcgtcctcgtcccgggtccacacgttcgaactgagcccgaacggcgagtcgttggcgatgagcaccgcctcgtccaggtcg

SEQ ID NO: 1031 - DNA, 2900 bp, Unknown
  Kingdom: Bacteria, Phylum: Actinobacteria, Class: Actinobacteria, Order: Streptomycetales, Family: Streptomycetaceae, Genus: Streptomyces
gcggccaccgccacgttctcgacgttcgccgtcgccgaggccgccaccacggccgactccaccaccgccggctcggccgccgtggaccggcacgacccgcagtcgcccgggcagcacgagcacaacctcgacggcccgttgagcaagacccaggaggcccagcgccaggaggccctcaaccaggtcatctccggcaaggccaaggtccaggaccgcaacggttccaaggtcgtcggcctcaagggcaagaagggcgacaccaagtacgtcgagctgggccgcgagaagaccgacaagatcttcaccatcctggtcgagttcggcgacaagacggacccgaagttcggcggcacccccgggccgctgcacaaccagatagccgcgccggaccgcaagaaggacaactcgacggcctggcagaaggactacgaccagaagcacttccaggacctgtacttcggcaccggcaaggacaccgagtcggtcaagaagtactacgagaagcagtcctcgggccgctactcggtcgacggcgaggtcgccgactgggtcaaggtcccctacaacgaggcccgttacggctccaactactgcggctccaccaactgctccagcgtgtggaacgtcgtcagcgacggcgtcaacgcctgggcggcgcagcagaaggcggccggcaagtccgacgccgcgatcaaggcggacctggcccagtacgaccagtgggaccgctacgactacgacggcgacggcaacttcaacgagcccgacggctacatcgaccacttccagatcgtgcacgccggtgaggacgagtccgcgggcggcggcgtccagggcaccgacgcgatctgggcgcaccgctggtacgccttcggcaccgacgccggctccaccggcccctcggacaacaagctcggcggcacgcagatcggcgacaccggcatgtgggtcggcgactacacgatccagccggagaacggcggactcggcgtcttcgcccacgagtacggccacgacctcggtctgcccgacgagtacgacaccgcgggcggcgagaactccaccggcttctggacgctgatgtcctccggttcctggctcggccgcggtgaggacgccatcggcgacctgcccggcgacatgaacgcctgggacaagatgcgtctgggctggctgaacttcgacaccgccaaggccggtgtgaagtcctggcacaagctgggcctgtccgagtacaacaccaagtaccgccaggccgtggtggtcacgctgcccgacaaggcggtcaccaccaccgtggtcaccccggcccagggcgccacgcagtggtggagcggcagcggcgacgacctgaagaacaccctgacccggtccgtcgacctcaccggcaagaagtcggccacgctctcgctcgacggctggtacgacatcgaggccaactacgacttcctctacaccgaggtctcgaccgacggcggcgccaactggaccgccctggacggcaccgtggacggccaggccatcccgcgtgacggcagcgacaagccggccctgaccggttccgtcgacgcctacaagaagctgtcgtacccgctggacgcctacgcgggcaagaagatccagctccgcttccgctaccagacggacggcggcgccgcgctcaagggcttcgcggccgacgagatcacggtgaccgccgacggctcggcgctcttctcggacaacgccgagaccgcggacccggcctggacggcgaacggcttctcccgcatcggcgcgtccttcaccaaggactacgagcagtactacatcgcggagaaccgccagtacgcctcgtacgacaccacgctgaagaccggcccgtacaacttcggttcggccaagcgccccgactgggtcgagcactacccgtaccagaacggcctgctgatctggaagtacgacacctcccaggcggacaacaacaccagcgtccacccgggcaccggtctgatcctcccgatcgactcgcacccgggcgtcctgaagtggtccgacggcaccctgatgcgcaaccgcgtgcaggcctacgactcgccgttcagccgctaccccaccgacggcatcaccctgcacaaggcggacgtcaccacccggatcaagtcgtcgaagggcgtgccggtcttcaacgaccacaccagcacgtactacgacccggcgaacccggccggcggtgtcaagatcactgacaccaacacccggatcgagatcaccaaggaggcccacgacggctccacgatcgagctcgaagtcggcagcgcggtgaagtaaaggtaaaaagcgcaggtcaaacaggtatcggcggcaaccccctggcgggttgccgccgatcgtgtttaggtgcctgctgtggctctcttattgacaccgaccggaacggggaagtgaccgcatggccgcaggaggtttcagcaagctgccgaacggcaccgtcgtggtggccctcaacctgcccagccccgcccccgacggccccggcggcgtccgcgtgctcatccacgcgcacaaccgcgcccgcgccctgacccggctgcggaacctgggcctgcgcgccgtctacctgcggggcaacacggccccgcccagcccggacgagatcaccgcggtcctgcaccaccccgacggcctcatctggcgcacgtcccccgacaacgctgtcggcgccgtccccgtcggccccccggagctgtggcacccgatcagagccctcctgcgccgccgcaccccggcgcaggcgtgagcagccggatgtcctgcgcgcgagggcgctgcgtgcgtgtccgcctcaggcgacgacgggcttgcccgtcagctcgacgcccgcctgccgcagctcctcgagcgcccgctcggtgctctgc

SEQ ID NO: 1032 - DNA, 6445 bp, Unknown
  Kingdom: Bacteria, Phylum: Actinobacteria, Class: Actinobacteria, Order: Streptomycetales, Family: Streptomycetaceae, Genus: Streptomyces
gagacgtgcatctgcgagatgccgagccggtcggcgatgcggctctgggtcatgtcctcgaagaagcgcatgtagaggatggcgcgttcgcgttcgggaagccggcgcagtcccgccttggccgactcgcggtcgacgacgacgtcgtacgaggagtccgcctcacccagcgtgtccgcgaggctgtagccgtcggccccggacgacatctccgcgtccagggagagcgtgctgaagctgtcgagcgcctccatcccggtgctgacctcttcctccgtcagcccggtgtgcgcggcgaccgccgcgatcgagggctcggggctgccgggactctgggtgagttcgcggcgcgcgacacgcaccttgttgcgcagttcctggacccggcggggcacgcgcagcgcccacatccggtcccggaagtgccgcttcacctcgccggtgatggtcggtacggcgtagctctcgaaggcgccgcggtccgggtcgaaccggtcgatcgccttgaccaggcccagcgccgccacctgccgcagatcctcgatcgactcgccgcggtcgcggaatcggcccgcgatgcggtgggccatcgggagccaggcggtcacgagctcgtcgcggaccgagtcccgttccggcccctccgggagcgccgccaggcgccggaagagggcctcggtctcgggtgcgtcgtcgtgctgccgccgggtgggagcggcctgttcctcgggggaaccggaacggcttgtcgatatgtcgatcagcatgcggaatcgctcctgaacggtggtgtcagggatgtaccgcgggaggcggggcactgctcagggcgatccggagagcctccggagcacccgtgccgctcccgctggcgcgcctccggtccgaagcacgagattccgtctgcccgggggtgggaggaacaaactccgcttcaccgacttctttgcagcgggcaacgctccccggcgttcgcaggtgttttcgcctcacgcctcatgtcgacgcctcacgtcaggggcactacggcgctgatgcatttcccgccggtgggcagatcgcggacctgcacgtcacgcgccagccggcacacgatcggccagccgtgaccgccgcagcggaagcggccctgcgggcccgccgggggccgggccaccgggaggcggtcgctgcggtcgctcacgcagacacggacgtcgggtccgacgacgtcgacgtggaagtcggtcactccgccgccgtgcaggatggcgttggtcgtgagttcggaggcgacgagctgcgcgtcggagacggcgtgcgcgtcgcacggcggatgaccggtgcggcagcattcggtgatcacgtccgccaccgcccgccgcgcgtcggccggcctgcacgacccgggccgggccgcggcgggcggcgcctccacgaccggagtggtcctgtggttctcgggcatctcctcgctccctgctcctcgctcggtgctcgtcacctggtgcgtggtgagggttcccggtacggaacggactccgccggcctctcccgtcccggctagccctcgcgggcccggccaaacatccgcaggcgacggccggctcggcgcggtgggcattcacgcggcggcgtccagacggcgagaactgcgcggagcaggcgatcggagcgcgcgcagtgggtacgcggtgcgtacggccgatgcaacgggccgacgatgcacggcagggtgcgtacgggttcgccgcgtcggctgccgcgcatcctccgcggggtgaaagcgagtgaaaccggtcactcacccccttctcgaccgaggagaacgaccgaaaatggtttacggttcactcatacgcggcgacggggtcgacccgacagcagtcccctggacgccgccgcatacggccctggctggtctcccccgtccagccagggctctttcacgccctcgcccgtcttcagaccctcgactgtcgaggtgcctcacgggcccgcaaccgctgaaatgggcgtaggcagatgtgcggaatcgaacgccggtgaggagtcccggtcatgaccaaagcgataaaactgctcaccgccctcccgcacaagcagcgcgaccgcctgatggaagccgcgcgggaggtgtccttcccggaggacaccaggatcttcgaggcggggggcaccgccgaccgcttctgggtgatccgttccggcgccgtccacctcgaccagcaggtgacgccgatccgccgggtcaccgtggccagcctgggcgcgggtgacctgctcggctggtcctggctcttcccgccctacgagtgggacttcggcgccgaggccttcagccaggtccgcgcctacgagttcgacggctcggcggtactggccctgtgcgtcgaggatcccctgctgggcctgtccctggtgcggaccgtcgcggagatcctcgccaaccggctggagacgacccgcggcaggctgctggagcagtacacgatcccccggcggaacatgtagggccgccgccccggaagcggcggcggtctcggacgcagaggcgcctcagatgcggtagcggcgcagcgccggcacggcggtcgccagcccgagcatcaggacgacgaccagcagaccgccgcccgcgacggccgcgcgcggtccgaacgcggagccggcggtgccgtgcaggacgtcggccaggcggggcccgcccgccacgacgactgtgaagacgccctgcatccggccgcgcatctcgtccgtggcggcggacagcaggatcgcgccgcggaacaccatggagaccatgtcggcgaccccggcggcggccaggaacgccaccgcgatccacaggttgcggctcaggccggctccggcgacggccacgccccaggccgtgaccgcgccgatcaccatccagccgtgccggcgtgcccgggagaaggtgccggagaacaggccgccgaccacggcgccgatggggacggccgcgaacagcagtcccagtgcgaggccctcgccgtagggtgcgaaggtctcggcggcgagctgcgggaacagggcgcgcggcatgccgaagaccatggcgatgatgtccgcgaggaacgacagcagcagcaccttgtgcccggagatgtagcggaaccctgcggcgatctcgcgcaccccggcacgccgccggtccgcgcccgtcagcggcggcagcgacggcaggcgccacaccgcccacaccgtgacgcacagggccacggcgtcgatgaggtacagctcgggcagtccgatgacggggatcagcgcaccggccagcagcggtcccgccaccagtccggtctgcatgaccgtggagctgagggcgttggcggcgggcagttcctcctcggggaccagccgggcgatggaggcgttgcgggccggcgagttgaggccgaagaacgcctgctggagggcgaggagcaccatgagcaccgccaccgagtccagccgggtcagggcctgcacccagaacagcagcgaggtgacggcgatgccgcagttggtcacgagcagcagcttgcgacggtccacggtgtcggcgaccgcgccgccccacagcgcgaacacgaccatcgggaccaggccggcgaggctcgcgtagccgacccatgccgaggagcccgtgatgtcgtagatctgcttgggcacggcgacggccgtgagctggctgccgaccgcggtgacgatggtggaggaccacagcctgcggtaggcggggatgcgcagcggacgggtgtccatggcccagcggcgccagccccggcgggcctcgcctgccgggtccgggccgccacccgtctgtgccggactgctgctgtcggtgctctcgctggtgtccacgggtttcctggttgctcgttacatctttctgtggggcttcactatcgcagtaccggccgcacccttcgcacacgcgttccggacggcggacggttccggaccgggtccgggccgggcccggccgattcctgctcggctcctgcccgtccgggtgtgtgcggattgtgcaaaggtccgccgtggggccgcgcgcgttgtttcacggcgcggcggcgggtgacccgacggcgagcacgtacttgacgaggcacggacgactttcgatcgcaggtgacatttcatggagaactggcgcgaacacgccgcgtgccgccacgaggacccggacctcttcttcccgatcggcacgaccggtccggcgctggtgcagaccgagcaggccaaggccgtgtgccggcgctgccccgtccgcgaacagtgcctggagtgggcactggacacggcccagaccatcggagtgtggggcgggacgaacgagaacgagcggcgcgcgctgcggcggcgccgcgccacggcacggcaccgcttcggctgaccggcgggggtcttaccggcccgagcggcggagcgtgccccagcgggcctcctgccgggacacctccgcccgcgcggcgtcgatgacctcggcgtcgatccagcacagcggctcgacgtcgacgaccagcggctcgttgtcggggccccggcccgtctcccggcccttgaggacccagggacggacgccggggcccttgtcgtgcggcaggtgcgcgtagtcgtggaggcggcgtgccacccacagttcgacggaccggtcctgccaccagtcctccacgtcgagagggttggccgacagaccgggcatgcggacgccggtcagctcgtcggtgctggaggtggcgcccagatcggtctgcgggccgcgcgaccagcggacgtacagccccgtgtgccgctcgacgagggtggcgaggctggtcagtgagtgcacgaccggcaggtcgtccggtgcgctcatgccgtgatctccctcctggctcacctcggtgagcccttccgcctcacctcagtaggccggggtacccgcgatcaaccgcccgaatcgggctgtgcgtcggcagccgcacgcaccacaccccgctcacctgggcacacagggcgccgtgtctttcctgcgacttgatccgccggacaggccctgagcgctctgggggccggggacggcacggcggtggcgagtgatcatgtgccgaccctcgccggcacatgtgaggaactcgtcagggccggggtgtcagggcgtggcgggctttccgcgggtgtgcagccaggtgcggaacagtccgtcgaggtccttgcctgcgacgtgctcggcgagggcggtgaactgtgcggtggtgccgtgtccgtcgcggtggtgggcggcccaggcgcgcaggatccggaagaacgccgggtcgccgacggcccggcgcagctcgtgcagggtcatggcgccgcgggcgtagacggggccggcgaagatgttcttgccgctgccggggtcgccgggcgggaaggcccacagtccgtcgctcgccgggcgggcgtacagcgcgtcgaactcctgctgggcgctcgtgccgccgtgctgctcggtgtagagccactcggcgtaggtggcgaagccctcgttgagccagatgtcctgccagcgggtgagggagacggagtcgccgaaccactggtgggcgctctcgtggacgagggtgctcaggtcgggtgcggagtcgtagagggggcgggtctgggtctccagggcgtagccgacgtccggtgcgtggtcgacgatcgatccggcggccctgaacgggtagggcccgaagagccggctctcccattccaggacggacggcagcttcttcagcacgggtgcggcggcggccgcctcgcgcgggtcgacggcgttgtagaccttgaggccgtcgcgggtcgtgtactgctcgatgcggaacttgccgacggtggcggtggccaggtaggcggccatgggctcgctctggcgccagcggtaggtggtgcggtggtgggcggtgcggctgccgaggtagacgccgttggcgacggcggtgtggccctgggggacggtgatggtgaagtcgtaggacgccttgtccagggggtggttgttcgccgggaaccaggtcatggcgccctgcggttccccggcgacgaaggctccgtcgtcggtggggatccagccgtccggggagccgtcggggtcggtgaccggggcgggggtgccgctgtaggtgacggtgacctggaagcggtggcccgcgcgcagggcggtgcgcggggtgacgacgagttcctggccgtcgcgccggtggcctgcctgggcgtggtcgacggtgacgccggtgacgttcaggcccttgaggtcgaggtcgaagcgggtgagcggccgggtggcccgggcggtgaggacggcggtgccgtcgaggtggcgggtgccggggtcgtaacgcagcgtcaggtcgtagtgggagacgtggtatccgccgttgccggcgagcgggaagtaggggtcgccggcgccgggggcaccggccgctgcggggcgggcggacgtgtc

SEQ ID NO: 1033 - DNA, 675 bp, Unknown
  Kingdom: Bacteria, Phylum: Actinobacteria, Class: Actinobacteria, Order: Streptomycetales, Family: Streptomycetaceae, Genus: Streptomyces
gcgccgagcaggtcggccagcgcctcgcgggcccgcgtgacgatgtcgtccgcgttgcgctcaccctccgtggtccggccccggttggccagcgggccggacagggcctcggcgacggcgtcgatgaccggctggggcgtctgtgtgccgccgggcgcgtcgaagcgtgccgaaccggatttcagggcgggaacctgcgagcggatcgcgtcgacgtcgagggacatgcgacctcctggtgggcacggacggttccgggcggcgtcggccgacgcggtcgtgcacatgatcgcagctccggtgggcggagggcagggcccacgacgcgaaaaaatggtattccatttctccggaagtcttgacggtgctcgcgggcgctcattacgttctgggccaacggaagcgctcttccgccttgtggaaatcccgagttccctcctccccctcacccaggagtcctgcatgactgccctggaagaccggtcgtccgtggagaccggcggcaccgccaccagctccgccctctacacctacgacctcgccccgacgaaacgggaagggcgtcgctggggcgcctacaacgtcttcaccctctgggccaacgacgtgcacagtctcggcaactacgccttcgccatcggtctgttcgcgctcggcctgaacgtgtggggcatc

SEQ ID NO: 1034 - DNA, 3866 bp, Unknown
  Kingdom: Bacteria, Phylum: Actinobacteria, Class: Actinobacteria, Order: Streptomycetales, Family: Streptomycetaceae, Genus: Streptomyces
gcctccgccgcctcagccatgggaggccccgaacgtgggggagtgcagggtggtgagggtcttgccgttgccggtgtacatgtggacgccgcacggcaggcacgggtcgaagctgcggacggtgcgcatgatgtcgacgcccttgaagtcgtcggggccgttctcctcgaagatcggctgcccctggacggcgtcctcgtaggggcccggtgtgccgtactggtcgcgggggctggcgttccagggggtgggcgggtaggggtggtagttggcgatcttcttgtccttgatgacgaggtggtgggagaggacaccgcggaccgcctcgtggaagccgcagccgatcgcctcctcgggcacctcgaagttctcgaagaccttcgtctcgccggcccgcaccagtcccatggcctcgtccaggaactgcagggccatggcggcggcgtacgcgatgaagtaggggcgggcgcggtcgcgttcgagggtgttggaccactgggggatcttccactccagggtcgtctccggcagcctgtcgccccggggcagggtgatgcgcacgctgtggccggtggccttgacgtacggggtgtcgacgaggccgttgagtgcggtggaccacaggcgggcgagcgggccgccgccggtgtccagggccaggtggtcgccgctgccctggtcgtaccagcgcgggctcatgacccagctgtagttgccgtcgaagtcgcgcttctgcggaacggggacggtggtctggttccacgggtggcgcatgtccaccgggttgccgagcgggtcgtgggtgacgaagggccgctcgccggtccagtcgtcgtagtacgacgagccgagcaggacccgcaggccgaggttgatgtcgacgaggtcgctggtgaccagccggccgtcgacgatgatgcccggggtgacgtacatcgcccggccccaggtgttcatggtctcgtagcggtagtcgcacacgtccgggttctggaacgcgccccagcagccgagcaggatgcggcggcggccgacctcctcgtagccgggcagcgcctcgtagaagaagtcgaagacgtcgtcgttcatcgcgacggcctgcttgacgaagtcgatgacgtgcaggagccgggagaggtagtcggtgaaggcggtcggtgagggcacggtgccgacgccgcccgggtagagcgtggaggggtggacgtgccggccctccatcaggcagaacatctcccgcgtcacccgggagaccttcagcgcctccttgtacacctcgccctcgaacgggttgaaggcgcgcatgatgtccgcgatggtgcggtagccgtggatgtcgccgcggggcgcctgggtgcgttccgcgcgggccaggacggtggggttggtcgccttgaccatggcttcgcagaagtcgacgaagacgaggttgtcctggaagatcgtgtggtcgaacatgtactcggcggcttcgccgaggttggtgatgtgctcggccagcggcggcggcttcacgccgtacgccatctgctgggcgtagttggagcaggtggtgtggttgtcgccgcagatgccgcagatccgcgaggtgatgaacccggcgtcccgcgggtccttgcccttcatgaacaccgagtacccgcggaacagcgacgaggtcgaacggcagtccaccacctccctgttcgcgaagtcgatcttcgtgtagatgcccaggttcccgatgatccgggtgatcgggtcccaggacatgtccacgatctgggcgggtttgcggcccgccgcgtgcgcatcggtcgccgtcatgtcagtgaacctcgttcctcgtcgtcagtgggccgcggctcgacctcgtcggggcggaagtagtggaagcggccgtaccaggagtgcagttcggccgcgggatcgtcgtcgacggtgacggcgaggtgcacgctgccgtccacgtcgtggaagagtgcggcgacacgggcggtgcgccccaccaggaacatgtcctgcgcgtcggagccccggccgcgcggccgcagccgcacccggctgccggcgcccaccggcaccccgtcgaccagcacgatgtcggtcgccggcgacagcgacagttcgtcgtcaccgccctcccgccaccaggcgggccgggccgcaccgggccgcggggcgtcggtggtggccccgggcgacgcggtcgtggccgctgcgtgcccgtctcctgcgggggccagtgagcggatggcgccgtgcagacgggagaagacctccgggggcatggtgtcgacccggtcgaggatgtccgccgcgcgcggatccgtggcgcgcgcctcggccttctccgcgtccgtcagcagcatcgtgcgcagcgtgaggatctcgtcgatctccgcggcgtcgtgcaggtcgcccgggctctcgggagccacctgcggccggtcgggcaggatgatcggcgcggagagcatgacgtccgcgacgccgtcagcgccgtggccgccctggtccgcgccgccgaggacggggaaggtgaacgcgttgcggcacccggccgcgaggtccgccagctccgcgggcggatcgatcagcgacatgaactccacacccgtaccgccgatgagcgtgtgcgcggcgacgagcgcgccccgcagcgcctcgtctcgggacgtccccgggtccggggccgctcccgtgttctcggtgcgcacccggaggcggaccagaccggggccgagccgctcggccgtgagcgtggcgcgcgcccgcacctcctcgcaccggcgcacgacccggccggcgtgcccgggcagcgtctcggtctccgtaccggccggcgcacccaccgaggcggtgaactcgccgccgtcgagcagctcggccgccgcgacgctcatgtcggtctcgcgcggcaccgcctcgtcgaaggtcaggtgcaccgctccgtcgtccgtgcgcagcgaggcgaccgggcggtgccggccgtccgggcctgccgcctccacctgcttgtgccgcacctggaggtagcgcacgcgcacccgcacggcggcgtccggccgccggatccgcagcaggcactccgtgcgctggtaccaggagtccgcggaacccgacggcccgggcgtgaccggcccgtcgcgttccgcccactcgcgcggcagcagcacgccgaactgccagcggacccggttcttcggggaggagcggcggtacgggtagagcaggtagccctcgtacaggacggcgtcggcgaccgcactcagccgcgcgaaaccggagggggcggcgggaccggagcccgcgccggcggcgccggcgggatgggaagccgccacggcagcgtcggcgggaccgtgggccgccacggcgacgtcgacggctgagccgtcgcgggcagcgccgttctcggcgacggcatcgggcatccggcctcctcgattcgcgtgtgcgccatcccttccaccacgcaagcccgcctcacccggcctccgccctgcggtcctgcgggttgcgccgtccggcggaaccggcggccccgaaggcgccgggaggcggcagactgcccggacgaggaggaagccacgaccacccgcggacggtgccatgcagaccttcctgccgtacccggacttcaccgagtcggcgcgggcgctcgaccgccgcaggctgggcaagcagcgcgtcgaggcgctgcaggtgctgcgcggcctcaccgtccccggctacggctggcgccggcatccggccgtgcgcatgtgggccgggtacgaggaggcactggtgcgctacggcctggacgtctgccgtgtctggcgcgagtacggccaccaggacagctgtgccgccacgctcgtcgccgacctggccgcgtaccg

SEQ ID NO: 1035 - DNA, 8375 bp, Unknown
  Kingdom: Bacteria, Phylum: Actinobacteria, Class: Actinobacteria, Order: Streptomycetales, Family: Streptomycetaceae, Genus: Streptomyces
ggtatcggtagcccgcgcccggaaccgatcaggaatcgagaagcgtgcccgcgcgggacacggttaccgttgcggcgacggacagcacggcgggacgcgccgacgagcggcaacggatggagcgacgatgagcatggccacgaggacggacggcacccccggcgcccagcccgccgagcctgcccaccccacccggccgtccgagccgcacgcgccgtccgcgtcgcacaccgccgacagccacgacctgatccgcgtgcacggtgcgcgcgagaacaacctcaaggacgtgagcgtagagatccccaagcgccgcctgaccgtgttcaccggcgtctcgggatccggcaagagctccctggtgttcggcaccatcgccgcggagtcgcagcggctgatcaacgagacctacagcacattcgtgcagggcttcatgcccacgctcgcgcggcccgaggtcgacgtgctcgacgggctgacgaccgcgatcatcgtcgaccagcagcggatgggcgccgacccgcgctccaccgtcggcaccgccacggacgccaacgcgatgctgcgcatcctcttcagccggctcggcacgccgcacatcggctcgcccaaggcgttctcgttcaacgtcgcctcgatcagcggcgcgggcgcggtcaccgtgcagcgcggcgggcagaccgtgaaggagcgccgcagcttcagcgtcaccggcggcatgtgcccgcgctgcgagggccggggcaccgtctccgacctcgacctcagccagctctacgacgactccaagtccctctccggcggcgcgctcaccgtccccggctacaagtcgggcggctggaaccaccgcctctacagcgagtccggcttctacgacccggacaagccgatccgcgacttcaccgagacggaactgcacgacttcctgcaccgcgagccgacccggatgaagatcgcgggcatcaacatgacctacgaaggtctcatcccgcggatccagaagtcgatgctggccaaggacaaggagggcatgcagccgcacatccgggagttcgtggaccgggcggtggccttcacgtcctgcccggagtgcgacggcacgcggctcagcgaggcggcccgctcctcccgtatcggcggggtgagcatcgcggacgcctgcgcgatgcagatcagcgacctggccgcgtgggtccgtggcctcggcgaaccgacggttgcgccgctgctgaccgcgctccagggcaccctggactcgttcgtggagatcggtctcggctacctctccctggaccgcccggcgggcacgctctccggcggcgaggcgcagcgcgtcaagatgatccgccatctcggctcctcgctcaccgacgtcacgtacgtcttcgacgagcccaccacgggtctgcacccgcacgacatccagcggatgaacaacctgctgctccggctgcgggacaagggcaacacggtgctggtcgtggagcacaagccggaggtcatcgcgatcgccgaccatgtcgtggacctcggtcccggcgcgggcgcggcgggcggtgcggtctgcttcgagggcacggtggaggggctgcgggcggccggcacggtcaccggacgtcacctcgacgaccgggccgcgctgaagaagacggtgcgcaagcccaccggcacgctcccggtccgcggcgcgaacgcgcacaacctgcgcgacgtcgacgtggacatcccgctcggcgtgctctgcgtggtcacgggtgtggcgggctccggcaagagttcgctggtgcacggttcgatcccggccggggcgggcgtgatctcggtcgaccagaccccgatccgcggctcgcgccgcagcaacccggcgacgtacacaggcctgctcgacccgatccgcaaggcgttcgccaaggccaacggcgtcaagccggccctgttcagcgcgaactcggagggcgcctgtccgacctgcaacggcgccggcgtcatctacaccgacctcgccgtgatggccggggtcgccaccacctgcgaggagtgcgagggcaagcgcttcgaggcgtccgtcctcgaccaccacctcggcggacgcgacatcagcgaggtgctcgcgatgccggtcgacgaggcggaggagttcttcgccacgggcgaggcccgcaccccggccgcccaccggatcctccagcggatgtccgacgtgggcctcggctacctcacgctcggccagcccctcaccaccctctccggcggcgagcgccagcgcctcaaactggccacccacatggccgacaagggcggcatctacgtcctcgacgagccgaccgccggcctccacctggccgacgtcgaacaactcctcgtcctgctcgaccgcctcgtcgactccggcaagtcggtcatcgtcgtcgaacaccaccaggcggtcatggcccacgccgactggctcatcgacctcggcccgggcgcgggccacgacggcggccgcgtggtcttcgagggcacgccgagcgacctggtcgcagcgcggtcgacgctcacgggggagcatctggcggggtatgtgggggcgtgagccggggcatgagccgggggcgcgcgatcgggagaccccctgggccacgccctccagcccccagccgccatcagcggagtggtcagggctgcgtcgtggcgaccttgatgccgaacccgaccagtacgacaccggtgacacggtccatgacccgccgtacgacaggcctctcgaagaacgctcgggctttggccagcaacagcacgtagctgccgagccagacgagtgtgagcacagcatgcaggagaacgagaacggccatccctgtgtgcggcgccatgccggaaggcgcgagcgtaggcagcaggcccgtatagaagacagcgatcttcgggttgaagacgttgctcacgaagcccgtccgccaagggttccccttcggggcggcacttgcctgtgagtgaccagcagtacggtcgcgtcgactctggcgcagcgcctggactccgaggaagacaaggtagacggcaccggtcagcttgaccaccgtgtaggcggtggccgatgcggccagaacggcagccagcccgaccacggtcaacacgccccaggtgagcaggccggctgtgatgcccccgaccgagcgcagcccgtcccgccagccgcacgccacggcccgtttcgtcacgaccgccatgtccggaccgggaaccatggtcaggacagcgagcacgccggctgcggcaaggaactgcacgaacatgcgtttcatcatgccactcggccgcctgcaccaggtcggccatgcccggctgacggcttgcgcagcgtccgccggattcaggtggtcacggcgtcggcttcacgacggggcccagcgcgatgaaaccggccccggccacggccaacgacggatgtgcgaatccgccgcacgctacgagccgcgcccacacccaagagtcgtggctgtcgaacatggcactgcagccatgcgccgggcatacgcccgagcgacaagctgtgcacaccgagaacagcacatacgagccagagcgcacccaccagccacgaacggtttcttctctggcatcgttggcgcaacaaaccgtcgagtcaggaaggctcggacggccccgcggacggccactttgccagccgggcacgggcctcctgcgcaatgaccggccacgggtcgtcgaccaaacgcgcgactgccgatcgcggcgagcgtggatggccggcaacgagcctccgcacagagtcatgcggatcgtcggccaaccgttccagaagctcaggcgggcagttgcgcttgctcgccacccggtcgcggacccgccagtccggatccgcgatcagctcggccaggacctccggcggcaccgtcctgttgtgcgcagcccagaaccgcatatcgggatggccgcgcaccaggtcccaccagacgggcagcgggagagtcgcccgcgccgaacggtcgtactccgccgggtcctcgctctgccgcagccggatgaactcctccacggaggtgatctcagggaaacggtccgccacggcagccagtaagccacgatgtccaggtcagacgtcaagcatcaaccgagacctgacatgtcgcgcccggcagttctcggagtggcgtcgaagtcgtactccaggacgtacgaggcggcgtccagggtcatttcgttgacctcgacggagtcgccctcggccgtgaaagcggtgcggcagatgaggatgaccggggtgcctgcggacatgctcagctgggtcgcctcgtccttcgacggcatgcgggagcggatctcttcgcggaagtgcaccggctcgtatccgagttccgcgagtctggcgtacgtcccgcccgggccggtgtccttctgggtgatcgcggatccggccaccagggacatggggagatagctcgtcgcgagcaggaccggcttgtcgtccaggacgaagcgccggcgcctcacacacgtcgtcccgtcgtcggagaggttcagtactgccctgatgcgatcgggcgccgcttcctcggacacggtgatctggtcgacctccagagcccggttctcgatgtccgctgaccagacggaacggccgatgccccactgatcacgggtcagccggtcgatgccccggcggcggatcgggcggaaagccctgacgaacacgccggcgccctggcgggcttcggcgacgccttcctcccggaggacgctcagggcttgacgggccgtcatgcgagccacgccgtacgtggtcatgaggtcgttctctcccggaagccgatcaccgggaccgtactcgcccgaccggatcgcctcgcgcagggagtccgcgatccgctggtacttgggccgacggtcgtcgtcggtagtggccattccggaaccctcctcgcttctctagagaccctaggccataggtcgtggggtcgcttgctgcgcgtagtcacggtcgcaggtacccgaccccttgagaggccacctaggcgttctggctgacatctctagagatgtaccggatcttagatgtctagagaggtcgctttgacctctctggtcgaggagcctgggtgccttcgttcgcgcatccgtccctcgccgtggtgggcggccacgccgtcatcgaaatctgcggatgccgaacgtgacgctccgacgaccggaaccggcgctggtgggatcacggcggcagtggcaaggagtgagcgcaagtgactcttgttatcgaccggcatccctgtgagcagtcaccgcggctcggcatgatggccttacgcccgactcccgaggccgtgccccgagcccgcagctggttccggaggttcatcgccccctaccgcccgctctgctcgatcgacgactgcgtgctgatgatctcggagctggtgaccaacgccgtcctccacggacaggccgacggggcgtggctcgtgcgggtcgagtggttccgggaggaagcctcgctccgtgtggtggtgcacagtccagggctccctgcgagcgtgtgcctccgccgaccgggcttcgacgatccgcacggatgtggtctgatcctcgtcgactcactcgccgcatcctggcgatccaccccgagccctttcggaggtacggccgtctccttcgtcatggccgacgcctggcctcccgggccccctggtcccgagaccgacgctccgtgcgaacgcgttccggatgccgttcgacagggaacggactcataaggcggtggccggctgcggggcaacctggtcggcgcgccggggcagttgaggagccgtacgctcctgccgggaggggaaggcacgcagtggcgggctccctccggacctgagaacgacgcgcctcggtcgaacggccgagggcctggcgagggccccagcgcagcaacaagccccctgctcgcggaaaaccgcaggcagggggcttactcgtgggcgcttacttcttcttgccctggttcttcaccgcttcgatcgccgccgctgccgcgtccgggtcgaggtaggtgccgcctggggtggtggggcggaagtcggcgtcgagttcgtaggagagggggatgcctgtggggatgttcaggcccgcgatgtcggcgtccgagatctggtcgaggtgcttgaccagggcgcgcaggctgttgccgtgggcggcgatcaggaccgtgcggccggtgaggaggtcggggacgatgctgtcgaaccagtacggcagcatgcggacgacgacgtccttcaggcactccgtctgcgggcgcagctccggcgggagggtcgcgtagcgcgcgtcgttgaactgggagaactccgcgtcgcgggccagcgggggcggcggggtgtcgtaggagcggcgccagagcatgaactgctcctcgccgaactcctccagcgtctgggccttgtccttgccctggagggcgccgtagtggcgctcgttcaggcgccaggagcggtggaccgggatccagtggcggtcggcggcctccagggcgagctgggccgtgcggatcgcgcgcttctggacggacgtgtggaccacgtcgggcagcaggccggcgtccttgagcagctcaccgccgcggaccgcctccttctcacccttctcgttgaggttgacgtccacccagccggtgaacaggttcttcgcgttccactcgctctcgccgtggcggaggaggatcagcttgtacggtgcgtcggccatgcatccgagcctaatccacgcattcggcaccccgcccgcgcgcccggcaggcggacaggacggacggctgtgcgccgacagttgactggttctgttaattgagtggttgggtctcgggtcggcctcgtaacttgtgcttacggcccgcgcgtaagtcgcgcttgccgttccagccgcttacattcgggggtcgtccatgtccgtcgccagtctcagacgtgccgcccgcgagaccgtctccgggctcccccgcgagttctggtggctgtggacgagcaccctggtcaaccggctcggcgccttcgtcgccacgttcatggcgctgtacctcacgctcgaccgcggctactccgcctcctacgccggtctcgtcgcctcgctgcacgggctcggcggtgtcgtctcctccctcggcggcggcgtgatggccgaccggctcgggcggcggccgaccctgctggtcgcgcaggcgtccaccgccgtcttcgtcgcgctgctcggcttcgtgcgcgacccggtctccatcgccggcgtcgccttcctcgtcggtatggcctccaacgcctcacgccccgccgtgcaggcgatgatggcggacatcgtgcggcccgaggaccgcgtccgggccttctcgctgaactactgggcgatcaacctcggcttcgccgtctcctccatggcggccggtttcatcgccgagttcagctatctcgccgggttcctcatcgaggccgcgatgaccatggcctgcgcggtcgtcgtgttcctgaagctgcccgagtcccggccccaggggggcgagcagggcggcaaggcgggcgcggacacgtccgtcgggctcgtgaccgttctgcgcgaccggcgcttcatgagcgtcgtcgggctgtccttcctggtcgcggtggtcttccagcaggggtcggtcggtctgccggtggccatggggcgggccgggttcacgcccgccgactacggtctggccatcgccgtcaacggcatcctcatcgtcgccctccagatcccggtcacgcggctcatcgagcaccgggacgccaagcggctgctcgtcgtctcgtccctgctggccgggtacgggttcgggctgaccgccttcgccggttcggtcggcgtgttcgcgctgacggtgtgcgtctggaccctgggcgagatgatcaacgcgccgacgcagaccggcctcgtcgtccggctctcccccgtgcacgggcgcggtcgctaccagggcgtctacacgctgtcctggtcgctcgccgccctggtcgccccgctgatgtccggcgcggtcatcgaccggctcggtgcggagtggctgtgggggatgtgcgcggtcgtcgggacggtcgccgccttcggttacggggcactgatgcggcgcctgcccacggagaacgacgaggccctcgcgatcacgggggacggcgaaggttccgggaagcgggcctccgaggtcagcgcggcctgaggggtcggacggggcgccggggccgggccgccccgccgttccacgttccgcgccccgctcacggatgcatccgcgcacccttcagtaccttgtccaccgcgttccgcgggccgtacaccgcgagtcccaccaggtccagcgcggcggtcgcgaccgcccgtac

SEQ ID NO: 1036 - DNA, 1119 bp, Unknown
  Kingdom: Bacteria, Phylum: Actinobacteria, Class: Actinobacteria, Order: Streptomycetales, Family: Streptomycetaceae, Genus: Streptomyces
atctttccctggtccgcgaggtcgctcaggagcacgcggaccacaccgagcggcatcttcagcagcgcggcgatctcggccaccgtacgcatccggcggcacagttcgacgatggcccgaatctccggcatgacccggggtgcgagcggatcgcttgtcagttccctgcgctgctccaccaccaggatgagcacgacccgcatgccgatcgccagccacgtggaccagttctgctcgacccagctcgcggcctggttcgcgctctcctgggcgtcctggagcgtgggcaccgtcacggaccgtgactccgagggggacggcgacggcggcgaaccggcggctgccagcaggacggcggacaaggacacggcaggtacctccaggtgcgtccgcccgtcggcgccgcgatccgatcgcggcggtcggcatcgtctggtcgatgtcgtctgggtcacgaaggggtcaccggacgggcagggcaaccacactaacggggcacggtgtgggggttcgcgggaagttccgaggaggaccccgtgggcggcgcgcccaccccgctctgaacaggccgtgtgggccggccgcgatccgggggatgtatgaggtgtggtcgaaaacactcccagcccgttaccgggacatggtggcgcgttcaccaggcatgaggggagactgactgcagatcgtcccggcgcgagccacgcgccgccggcgtacaaggaggcccctgtgccgcatgtcctggtcctcaacgcgtcgtacgagcctctcggcgtcgtaccgctccgccgcgcgctcgtcctcgtgctggagaacaaggcagtctgcctcgaggagtccggcgcccatctgcacagcgcgaccgtcaccgtccccgcacccagcgtggtccggctcaagcgattcgtgcgggttccctaccgggggcccgttcccctgacccgcagggcgctgttcgcgcgggacggcggccggtgcatgtactgcggcggcgtcgccaccagcgtcgaccacgtcatcccgcgctcccgcggcggccagcacgcctgggacaacgtggtggcctcctgccgccgctgcaaccacgtcaaggccgaccggcacctcgtcgaactgggc

SEQ ID NO: 1037 - DNA, 1031 bp, Unknown
  Kingdom: Bacteria, Phylum: Actinobacteria, Class: Actinobacteria, Order: Streptomycetales, Family: Streptomycetaceae, Genus: Streptomyces
tgacgccgtcggtgtagagcagcagctggtcgccgggccggaacggctcgacgtccaggtggtagccgtcgccgatcagcacgcccaggttgatcggcggggacggggcgctcgcgtgcagctcggcgaccccgccctccttgatgatcagcggcggcggatgaccgcagttgacgatgcggatgacgggctcgtggtcggggatctccgcgaacacggcggtgacgaagcgttccgccgcctcgccgcccggcaactgcgcggcgtgccggctcatgctccgctcgatgcggcgggcgacgccggtgaggtccggctcgtcgtgggcggcctcccggaaggcgcccagcatcgtcgccgccgtctccacggcgaccagccccttgccgcggacgtcaccgaccagcagccgtacgccgaacgccgtcggcaccgcctcgtacaggtcaccgccgatgcgcgcctcggccgccgcggacaggtagagggtctccacggagacctggccgagccggcgggggaccgggcgcagtaacacccgctgcgcggtctccgccacgaaacgcacggtggccagcgtgcgttcccggcgggtgcggtgcaccgccaggatcgtccccagcacaccgaccagggcggtgcaggcgtagttggccacgtagtggcggtcccagaggtaggccacgggacggccggcgcagcacggggtgcccgccagcacgccttcgaacacgatggcgaagacggtgacgacggcgaccgcccggggcccgtaggcgtaggccgcgacgagcggcagcgcgatgagcaggaaactcaccggccagtccaccggagtgaccggttcgatggccagcaccaccgcgaggtagccgaccggcagccacagcagccagggcggtggcgcgggcacacgcggctcctccgtcttccggtgcgccgcgccggaggagtcgcgctggacgcggacgggtcgcctcaccgtacgctcccgcacggcgccgccgccgcgcgggagcgtacggtgaggc

SEQ ID NO: 1038 - DNA, 1109 bp, Unknown
  Kingdom: Bacteria, Phylum: Actinobacteria, Class: Actinobacteria, Order: Streptomycetales, Family: Streptomycetaceae, Genus: Streptomyces
ttcctgcgccggctggccgccgccgccgacgacctgcacgactacgtgagcggcgaccgctggtaccaggcgcagcccgccgggctgcccgcgggcgtcgcctacttctcacccgagttcggcgtcaccgccgccctgccgcagtactccggtggcctcggcatcctcgccggtgaccacctcaaggccgccagtgacctgggcgtaccgctgatcggggtcgggctgctgtaccggcacggctacttccgccagtccctgtcccgggacggctggcagcaggagcactacccggtcctcgaccccaacgagctgccggtcacccaggtccgcgaggccgacggcagccctgccagggtctccctcgcgctgcctcgcggcaaggccctgcacgccaggatctggctcgcccaagttggccggatcccgctgctgatgctggactccgacgtcgaggagaacgacctcggcgagcgccaggtgaccgaccggctgtacgggggaggcagcgagcaccggctgctgcaggagatgctgctgggcataggaggtgtgcgtgcggtgcggacgtactgccggctcaccgggcatcccgagccggaggtcttccacaccaacgagggacacgccggcttcctcggtctcgagcggatcgccgagctgggcgagcggggcctggacttcgacgcggccctggaggcggtgcgcgcggggacggtcttcaccacgcacacgcccgtcccggccggcatcgaccgcttcgaccgggaactggtcgcccgccacttcggtcccgacgcagagctgccccgcatcgacgtcgagcgcatcctgcggctcggcatggagacctacccgggcggcgagccgaacctgttcaacatggccgtgatggggctcaggctcgcccagcgcgccaacggggtgtcgctgctgcacggcagggtcagccgggagatgttcgccgggctgtggccgggcttcggccccgaggaggtgccgatcacctcggtcaccaacggcgtgcacgccccgacctgggtggccccggaggtgttccggctcggcgcccggcagatcggcgcgcagcgcgccgatctgccgggcgc

SEQ ID NO: 1039 - DNA, 732 bp, Unknown
  Kingdom: Bacteria, Phylum: Actinobacteria, Class: Actinobacteria, Order: Streptomycetales, Family: Streptomycetaceae, Genus: Streptomyces
gcgcgccgcgtaccaccgttcgagcaccgggaagatgtcacgcacgttcccgcacctccctgtcttcgccgttgccttcgctcttgccttcgctcttgtccccgttcttgccttcgttcctgctctcgccctcggccgttccttccggcaccgccggtgcgccgcgcaccaccgccgccagccgctccagcgcggccaggctgtgtccctcgacgaaggcgtccacgctcggcagggccgcggccatgccggcggcgagcggcgcgtaaccggggcgtgccttgcgcgggttggcccagaccacccggtgggccaggcggtgcaggcggcgcatctgagcggcgagcaaccgcgggtcgtcccgctcccagccgtccgacagcagcaccacgaccgccccgcgcgccatgccgcgctgcccgaagcggtccaggaaatcccgcagcagttccccgagccgtgtgccgccgcgccagtcgggcaccgcctcggcgaccgccgccatcgccaggtccgggtcgcggtgggacagctccctggtcactctggtcagccgggtgccgatggtgaacacctccgtgcgccggccccgggccgccgcgtgcgcgaaccgcagcagcgcgtcggcgtacggtgccatggagccgctcacgtcgacgagcagcaccacccgccggggccgctcgacccgtgcgtaccgccgcagcagcgcgggctctccgccgcgccgca

SEQ ID NO: 1040 - DNA, 2353 bp, Unknown
  Kingdom: Bacteria, Phylum: Actinobacteria, Class: Actinobacteria, Order: Streptomycetales, Family: Streptomycetaceae, Genus: Streptomyces
ggcgaggaagaagccgaagaggcagacggcgatgcccggcatgatccgctggtagccggtgcgcacgaggatgacgacgatgatgccgagcaggaggaccagggagatcgacagggccacgggtatcggttccttcggtgagtgggtggtgggtgggggtcagctgtcggcgagctgccagtggccgcgcttgagcgacttggccaggcctttcgacttgagctgggtgcaggcgttgctgacgctggagggctggaagctgggcagggcctcgcgcagctgcttgaggctcttgggcccgtcggcgagcaggtcgaggatctggtcttggaggccgggctcctccccgatgtcggggccgctgtcgccgaacgggatgccgaacggcgtctcgaacggggcgggtgcctcgccgctgtcgccgtcggcgtccggggccggggtgccggcggccggcttactgccgggggcgtcggagaacgcctgggcgagggtgtcgcagtcggcgtacgggttggtgtgccgcacgccgtagatcgcggccccggcctgggcggccttggcctcgccctcggtcagcccggtgggcggttcgtcgccatacagggcgatcaggtcggggtagaccccgtccttcttctccgcgaagaaggtgcgcatgaacttcgcccggccgtcgaggaacatgtacgccatgcccgcggtggactcgccgtcctcgtcgtcctggccggagaacagcgcctcgatctgcccgttctcgtagatccgggcggggatgttctccatctggaaaccggccggggcgatgccgtccaggcccatctccttggtggaggaggaggcggtgcgcatcaggaacagcgcgccgaccttgccctgctggcggatcgcgtcgtcgtcgcccaggtccttgaggtgcagggactgcacggcgagccggatgccgatgccgaccttgcggccggtcttctggatgtcggcgatgaggtaggcggtggccttgcgcatcgcttcgtccgggtgggacagcagccggttgatctcgtccagtgtgatgttgatgagcggccacggccggttcagggcgaagtcgccgcggcccatctcgttggagatccgctcgcggtacttcatgaccgcgtgcgcggccgtgagcatcaggagcgtctcgactgggcccttggcgaaccagtcgacgcggccttctgcctcgggcagggacatgccgccctggacgtcgccgacccaggagacgacgccggagcgcttctccgcggcgaggatcaggttctgcaggacggacttgccagctcccgtgacgccggcggtgatgccgcgcagcgcgccctgtccggggtcccacaggcgcatccgggcgggcttgccgtcgtggcagacgccgatggtgacgcggcccttggagtccatcgtcaggtcttcgacggtggccttgcggaccttcatcagcgggttcgtcttgtagacggagatgacgccctgccggatgccgtccgtttcgatgactaggcgggaggggtcgtcgatgccgaaggcggagcagatcgccgtgtgcggcaggtggatctccttgccgggaggggaggcgaccagcagcacgatgcggtgcggttcggcccggtagtcgagcaggtcgacgccgggggcggccttgcccggcgcggcgaccgccgtctcccacagcccccggatgccttcggcgacagcctcaacatcctcggaggtggggcgggcgaccagccgcatccggccgggcccggagccctggatagggcggatcttcacggtgccgaccgggaagtcgaacgcggcggcgagctgcacctcggtgaaggtgggcaccgccttcccggcctgggcgacgacgacggcctcgaagtcggggcggtcggcgcggaacggggtgatggacaccaggcgggttccgtcgccggtggcctgctgccacttcgcggcgaggaactcggtgtagatcagcggctccccgggtccggcgccgtgctgcgcctggtgctcggtgagctccaggaccaggccggcgctgcgggtgagcggcgccatccagcccatcagggacgcccacgcggccggggcgacgacctcccaccagttgaagccgggggtgatcaggttcgccacgtaggtgccggcggccgtcaggaaggggatcgcccgctgcgcccgggccagcagcccggggccctgttcggggtccttcgtcttggcgtacagccaggcgagggtgcccaggccgatcccgccggaggcgaggtaggaccaggcgctgtcgtcgagctgcgggccgacggccatcccggccgccgcgagggcg

SEQ ID NO: 1041 - DNA, 2712 bp, Unknown
  Kingdom: Bacteria, Phylum: Actinobacteria, Class: Actinobacteria, Order: Streptomycetales, Family: Streptomycetaceae, Genus: Streptomyces
tcgacctcgccgaccgcctcgatcttcgcggcgtactcctcgtcgctgatctcgaacggtgtgcgcatgggagtgcgcaggccgccaccgacgaagccgaagacgcggccgccgatctcgacgcgttcgccgtcgaggacggtggtgccctcgcgggcgtactccggccacaggggcggcatgtcgacattgccgtaggtggcgtacgtcggggtggggaaggcggcgaagagttcggcgtactgcttgcgcaccgccgcctcgacgacctgggcgcggtcgccgtccaggccggcccagagccgggcgcccagttcgcgggcctcggtgaagcggcgggcggtgcgcagctcgacgatgcggtcggcgttctccacgccgaacaggtcggggaagatgccgcgcgagtggtcggcgtagtcgaggaagaggatgaggtcgccgaggcagatcagggcgtcggcaccctcgccggcccgggccaggtcacgggcgttgccgtgcacgtcgctgaccacatggacacgtgtgccgctgcggcggggaggtgtgggcgccatggagagaaagggtatgcggtgaacaccggcggccggacctgcggttactggccagtcgttcagcgggtcgactactgtgcgcgaggagagatccatcgtgtgacgcagcgaacatctcacggggaccccctgtcgaaaaaggcataccgacgggtaacgtccgggcagtccagtcgtgctctggatttcaaccaccggacccgaagcggccccctggcgaagccctgggcacccgaccgagccttggaccgcaccgtcgcatcacacaccgtcgtggcgccggcgccctatgaggagcagcagtcttgcgcgagttcagccttccggctttgtacgaggtccccgcggacgggaacctgaccgacatcgtccgcagaaacgccgcgcagcatcccgaggtcgccgtgatcgcccgcaaggtcggcggcgtctggcaggacgtcaccgcacgggacttcctcgccgaggtgcacaccgccgccaagggcctcatcgcctccggcgtccagccgggcgaccgggtcggcctgatgtcccgcacgcgctacgagtggacgctgctggacttcgcgatctggagcgcgggcgccgtcaccgtgccggtgtacgagaccagctcgcccgaacaggtgcggtggatcctcggcgactcgggcgcgacggcctgcctggtggagacggacgcacacgccgccgccgtggagtcggtgcgcgagagcctgcccgcgctgaagaacgtctggcagatcgaggccgacgcggtggcggaactgggccgggccggacagggcatcagcgacgccacggtcgaggagcgcggttcgctggccaaggccgacgacccggcgaccatcgtgtacaccagcggcaccaccggccgccccaagggctgtgtgctctcgcaccgcagcttcttcgccgagtgcggcaacgtggtggaacggctgcgtccgctgttccgcaccggcgagtgctcggtactgctgttcctgcccctcgcgcacgtcttcggccggctggtgcagatcgcaccgatgatggcgccgatcaagctgggctgcgtcccggacatcaagaacctcaccgacgagctggccgcgttccgcccgacgctgatactgggcgtcccgcgcgtgttcgagaaggtctacaactcggcgcgcgccaaggcgcaggcggacggcaaggggaagatcttcgacaaggcggcggacacggcgatcgcgtacagcagggcgctggacatggcgtccggtccctcgttcggcctcaagctcaggcacaaggcgttcgacaagctggtctacagcaagctgcgcgcggtgctcggcgggcgcggcgagtacgcgatctccggcggcgccccgctcggtgagcggctcggccacttcttccgcggcatcgggttcacggtcctggagggctacgggctcaccgagtcctgcgcggccaccgcgttcaacccgtgggaccggccgaagatcggcacggtcgggcagccgctgcccggttcggtgatccggatcgcggacgacggggaagtgctgctgcacggcgagcacctgttcaaggagtactggaacaacccggccgcgaccgccgaggcgctggccgacggctggttccacaccggtgacatcggcaccctcgacgaggacgggtacctgcggatcaccggccgcaagaaggagatcatcgtcaccgcgggcggcaagaacgtcgcgcccgccgtgatcgaggaccgcatccgtgcgcacgcgctggtcgcggagtgcatggtggtcggagacgggcggccgttcgtgggcgcgctggtcacgctggacgaggagttcctggaccgctggtgcgccgagcacggcaagccggcggggtccacggtggcgtcactgcgcgaggacgccgacctgctcgcggcgatccagagcgcggtggacgacggcaacgcggcggtctcgaaggcggagtccgtacggaagttccgtgtgctgtcggcccagttcacggaggagtccgggcatctgactccgtcgctgaagctgaagcggaacgtggtggctgaggatttcgcggacgagatcgaggcgatttacgcgaagtaggtcgcgggggtgtgcctgggaacaaggtgccccggggctccgccccggac

SEQ ID NO: 1042 - DNA, 4679 bp, Unknown
  Kingdom: Bacteria, Phylum: Actinobacteria, Class: Actinobacteria, Order: Streptomycetales, Family: Streptomycetaceae, Genus: Streptomyces
  misc_feature (232)..(306): n is a, c, g, or t
ggcctgcatcgccgtccccgcgctcgcgggcgcagcgatcgcctggcgcaagcggcaccatctgcgcggacgttgagatcacccgctgccgcgagggaccggcagaccgcgggaacagttgggcggcgccgccggtgcggtcggggaggcgaacgacacgcgggtgaccgactccatacggttcctgtagccgtccggtagcgcagcgtcagtgcttgcccctacgcttgtnnnnnnnnnnnnnnnnnnnnnnnnnnnnnnnnnnnnnnnnnnnnnnnnnnnnnnnnnnnnnnnnnnnnnnnnnnnagccgggtgatcgcggcggcctgaaccctgttgcggacgtgccgtcttcagcgtccgccggagacccgcagcaccgctcccgacgcgtaggaggcgtccggtgacatcagccaggcgacggctgcggcgatctcctcagcccgtccggggcggcgcagcggaatggtgtcggcggcgcgacgggcccggtccgggtcgcccatcgccgcgtgcatctcggtgtcgatcatgccgggtgcgaccgcgttgacgcggatgccctccgggccgagttccttggccagccccagggtcagggcgtcgacggcggccttcgtcgccgcgtagtggacgtagtcgccggggctgccgagggtggcggcggcggacgacacgttcacgatcacgccatttccgcgcggacccatcagctgggccgcacggcgtgaacacagcagggtaccgagcaggttgacgtccacgacgcggcgcaggtcggcggtgtccgtctcggcgagacggcccagcggcccggtcacgccggcgttgttcaccagccccgtcaccggccccagccgctcctccgccgcggcgaagagccgctcgacgtcggcctccacggaggtgtccacgcgcacggtgacactgcgtgcccccgcctccagcacctcgtccgcgacggcttccgcggcgccggtgtcacggacgtagccgaccaccacgtcgtggccgtcggccgccagccgccggcagacggcggcaccgatgccccggctaccgccggtgacgaccgtcacgagacgcttcatgccgacctccggtctcctcgcccgctccgcgcaccgttcccgcaccgcccacggcacatccggacggcgctcaggacaccggcccggatgtgatcatcctaggcccgcagaggcgcgagcacctcgtcggcgagtggatagggccgttcgtccggcagcagcgcggcggcccgttccacgtcacccgaccggaccaacgcgtggacgtcggccgcgagcgcggtgacgtcctcgatgccgacgatccactcgtccgcgtaccgcgcggcggcctgtccggcgaggccgagctggagggagcggtacggaagcgggctgagccgcagatcacgctccgggtcccactgcacgcgcgcgggcgcctgccgcagccggctccgccacgcggcacggtcgccgtgcagatccggcacgtggtgcgagaggcaggcgttgcgcagcgcccactcgaagccctcgcgccggatctcgacggcgagaacggtctcctgcccttccttggtgccccagccgcagcggtacatcatccagaggaacgacggcttgatccacgtcatcctgtcgcgtttccaggtcgccgggaagcggccggtgcgggaggcgggcaggccgatgcccgggtggtaggcctggtagacggtgagcgtggactcggtgtggcgggctcggacgcggaagcggggctcctgggcggcgttctggtcgttcactcgaccaggatcaccgggcgccggttgtccgggccaccgaatattccggagcatgggccaccggatatccggacatcgaacatccggaaggggcgggccaggcctctgtccggctgtggtgtccgggccgtcggccgcctgggcgggagtgcggggggcgcgcagactgggaggcgttcggggatcgtcgggtaagcggaggcgtgcgcgggtaggagggcgccctatggagacgttcggccgctggctcggctcgccgtggcggcgttcggtgctcgccgttctcgccggtgcgctgccgatgttcgcctttcccgcgccggcgctgtggtggttcgcgtacggcgcgctggtgccgtggatcctgctggcccgctctgcgccgaccggaaggcgggcggcgtacgacgggtggtgcggcgggctggggttcatgctggccgtgcaccactggctgctgccgagcctgcacgtgttcaccgtggtgctggcggcgttgctgggtgcgctgtgggcgccctgggggtggctggtgcggcggttcctcggcggcaggccgtccgccgggcgcggcgcggcggccctcgtcgtgctgccctcgggctggctggccgtggaactcgtccggtcctggcagggcctcggcggcccctggggcatgctgggcgccagccagtggcaggtggcgccggcgctgcgcctggcctcggtcggcggtgtgtggctgctgagcttcctggtggtggccgtcaacgtggccatcgcggtcctcgtggcggtgcacggggtccgcgcgcccgcggtggccggtctcgccgccaccgcagcggtgacctccggcgcctgggcgtgggcgccgcgccccgatgtcgacggtcaggtccgtatcgccgtggtccagccgggcatggtgggcggcaccgagagcgggcagcggcgcttcgaccgcgaggagcagctgacccggagcctggcggggcaccacgtcgacctggtcgtgtggggtgagagcagcgtcgggttcgacctcgcccagcggccggacctcgcgcggcggatcgcggccctctcccgggaggtcggcgcggacgtcctcgtcaacgtggacgcccggcgctccgaccggcccggcatctacaagagttccgtgctggtcggcccggacggccctaccggtgagcgctacgacaagatgcggctggtcccgttcggcgagtacgtcccggcccgctcggtgctcggctgggcgacctccgtcggcaaggccgcgggcgaggaccgcggacggggcaccgagcaggtggtcatggatgtcggccacggcctgcgcgtcggtccgctgatctgcttcgagaccgcgttcccggacatgagccggcacctggcgcgcgatggcgccgcggtgctgctggcccagtcgtcgacgtccaccttccagcacagctgggcgcccgagcagcacgcctcgctcggtgcgctgcgcgccgccgagaccgggcgccccatggtgcacgccacgctgaccggcgtgtccgccgtctacggtccgggcgggcagcgtgtcggctcctggctcggcacggacgcgagcgcggcgcgggtgtacgacgtgccgaccgcgcacggtgtcaccccgtacgtccgctacggcgactggccggtgcgtgccgcgctgctcgtgctggtcgcggtgtgtgcgacggagggggcgcgggcggtgctcaggccgcgccggaacgctccagcaccgtccgcaggacgcgctcgcacaggtcgtgggtctccagcgcgtcccgggcgctgagcggccggcccgtccgtacggcgtcgaggaaggtcagtacggcctgttcgatgccgcgctgccgggcgaccggcacccagtcgccgcgcctgcgtaccgtcggctgtcccttgtggtcgatcgtctcggcgaggttgaccacctggcgcttggtgtcctgcccggagacctccaggatctcctcggcggagccgctgagccggttcatcacgccgagcgcggtgaacccgtccccggcgagctgcagcacgacgtggtgcagcagcccgtcacgcatccggccgcgcacggtgacgtcgtcgaccggtcccggcaccaggaaccgcagggtgtccacgacgtggatgaagtcgtcgaggatcatcgtgcggggctcctcgggcagcccggcacggttcttctgcaggaggatcagttcgcgcgggtgctcggcgcactgcgcgtatccgggcgcgtaccgccggttgaaaccgaccatgagcgagacgccgcgttcctcggcgagcgccaccaggcgtgcggagtcggcgagttcgtaggcgagcggtttgtcgacgtacgtgggtacgcctgcttccaggagccgggtgacgatctccgggtgggcggcggtgggggcgtgcacgaaggccgcgtcgagaccctgggcgagcagcgcgtccaggtccgtgtggcgctgcccggccggcaggtgcaggctgtcggcgacccgctggagcgtggcgggcgtccgggtctgcaggtggaggtcgattccgggctgggtgccgagcaccggcaggtacgccttctgcgcgatgtcgcccagtccgatgcagccgaccttcacgtgttctccctcgtcgttggtctcatggtccggtggttcggcctcagccttcgcccgcgtccgcggttcccgtccgcacggcagcatacgggcgctgcgggggccgccagtcggcgatcccgtcgaagccgcgcagcagcgcctccggccgggcccgggacagcacggtgatcacggcgtcgcgcacggcgcagccggcccggttgcgcatcatgttgacgcgcgcgacgcggaccgcctgc

SEQ ID NO: 1043 - DNA, 2367 bp, Unknown
  Kingdom: Bacteria, Phylum: Actinobacteria, Class: Actinobacteria, Order: Streptomycetales, Family: Streptomycetaceae, Genus: Streptomyces
ggacgcggtccgcttcgcggcgggcaccggcccggaactgccgatgctctccggagtcctgttcgacatcgacggcgggacgcttcgcgtcgtggccaccgaccgctaccggatggccgccgcgcaggcacgcaccaccggtcacggaggcccccgcacccaggtcatcgcgcccctccccctcgtggacgcgatgcgtgcgctgctcggcggcggcgaacccgcccacctcggcgtggacgcgggccgcgtgacactggagacgggcgaccgccagacggccggccagtgcctcgaccacgacttccccgactaccgccgcctggtcgacctgcccgccgggcgtcgcgccgtcgtcgacgtggcggatttccggaaggcgctggagaccgggccggtccacgcgagcgaggtccgcgagcaggacggcgcgacctgcgacctcagcgtgctcgacgtgacggacgacggcaaggtgaccgtctgcgaggacggcgacgacggccgcgaccgcatcgccttcgaccgcgagttcctgctccacgccctggccgcgggcgcccgggacgaactgctcctggagttcggcgcccccacggcccccctcgtgatccgccgccccgacgacgaggacacgttctccctgctgatgccggtccggctggaggactgacggttcttgttcgtctccgccgggggcgggaccggcggccgtaccggtcccgcccccgggccgtctcagcggctgccgcggtagtaggtgacgtcccagtgcgagccctcgcgggcgtacacgttccccgacggggactcgtactgtttcgcgcggtcgcccttgcgctcacccacgtacttcaacttgtgggtgatgtacgagttcacgcacgacgacagcttgatgtcgaccttgtagccgttccagtggctgtacgtgccggaggcgtgccccttctccgtgccggcggtgagggtcaccgcgcacttgctcgccttcttgaagtcgatcaccccggcgaccgtgctcctgttgatctgctcgaacgaggtgcacttgctgttcttccggttgctgcacctgcccgacgacacccacgtgacacccgcccgcttcagcgccttctcggccgccgcctgcgagtacttcgccggggcggcgccggcggtgggcacggccgccgccagcaggccgccggtcaacagagcggcggaggcggcgagtgcggcgggacgggccatacgtcgactcatgagcagtcgatcctctcgtacggggttgagttacgcctgagtcactgcccgtccggcatttccggcatccctccgcaatggggcgcacggtggtgttcccgcgtaccgtgatcaccaccgcgcgcggtccctcacgattcggtcgtggtggtacggggccgggcgtccgaccggtgaggtctggggtgtccgcgtagaatcgcggggtttgagtccgccccgtcgcctctccttgccggagccccgccatgcacaccccccacgaccagtacgtccgcgtccgcggggctcgcgaacacaatctcaaaggggtggacgtcgatgtgccgcgggacgcgctggtggtgttcaccggggtgtcggggtcggggaagtcgtccctggcgttcgggacgatctacgcggaggcgcagcggcggtacttcgagtcggtggcgccgtatgcgcgcaggctgatccatcaggtcggggcgccgaaggtcggggagatcagcgggctgccgcccgccgtgtcgctgcagcagcggcgctcggcgccgacctcgcggtcgtcggtgggtaccgtgacgaacctgtccaactcgctgcggatgctgttctcgcgggccggtgactacccaccgggtgccgagcggctggactcggacgcgttctcgccgaacacggcggccggggcctgcccggagtgccacgggctggggcgggtgcaccggacgagcgaggagctgctggtccccgatccgtcgctgtcggtgcgcgagggggcgatcgcggcgtggccgggggcctggcagggcaagaacctgcgggacgtcctggacgcgctcgggcacgacgtggaccggccctggcgcgaactgcccgccgagcagcgggagtggatcctgttcacggacgagcagccggtggtgaccgtgcatccggtgcgggacgccgaccggatccaacggccgtaccagggtacgtacatgagcgcccgccggtatgtgatgaagacgttcgccgagtcgaagagcccggcgctgcgcgcgaaggcggagcgcttcctcacctccgcgccctgcccggcctgcggtggcagcaggctgcggcccgaggcgctcgcggtcaccgtcgccg

SEQ ID NO: 1044 - DNA, 1839 bp, Unknown
  Kingdom: Bacteria, Phylum: Actinobacteria, Class: Actinobacteria, Order: Streptomycetales, Family: Streptomycetaceae, Genus: Streptomyces
cggcggcctccttggccttggcggcggcctcgacggcgcgggcggcggcctcctgggcctccttcgtcttcgcgtcggccttcttgccctcgcgctcgacgaccgcgaccagttcctcgatcttggcggactcctggtcccgggcgcgggcgatgtgctggccggtgtcgaggaaccactcgacgtcgtcggcggtgccgtccagcgcccgggtggcgtacttctgcacctcgggaccggcgttcatggtcagcgcggtcacctcgaagcgcatgtcctccaggcgggcgctgtactgcccgtcggtcaggaagtcctcgagggcgtcctgcgtgcccgcgttcagggcggcgtcgccgtcccggcgcacggccttggcgccggtggccatcacggtggaggtggcgacgcgcaggtcctccacgatcgcggtcttgaaaccggtgccgaggtagtcggcgatggcggcgtcgcccccgtcgagcgcggcggacgcggcgcgccgggtgccggtgccgcccgccgccagggacgtcaggacggcgacgcggttgtcctcggccgtggccgcgggcagttcgccggtcaggaaggtctggatgtcggcgtcggtgccgctcaacgccagttccgcggcggcgcgcacggccgggccgcccagcagccacgccttcacggccttggccctgtcggtgtcgggcaggtcgagcgggtcgccgtcgtcgtccgccgggggcgtgtcggcggcccaggcggcgacggggttgaggacgagactcgacgtggcggtgacggccgcggtggccgcgagggtgccgagaacgcgtcgtctgctccagtaggtggtgtccaaagcggtccttcgttatcggtgcccgacggctgcgcgaagacggcggaaggccgccggacagactggtgtccgccgcgcgcatgtccccccgttgctgcggaagttgagcagggacacgacagagcgccacgtgaagatacgcacttcggagaacttgttgaacacctgtgaaggtctggttggccgaatgaggacgcccgcagacgcttttgcgtcaacttccggtcaacgcgcccttgtcacagagggcttgagcgacgcatgagaaagagatcacgtttcagacccgccgcggtgcgcgaggggcacaccgcggggtgcgatccggtcattcgtccgcgtactggacgaacgagcggtggccggccggctcgcgtagattgcgaggcggatcaccggacggacgggatcaccgcaccacggaggggacgggcagcaaggtggcaggggcaaggcaggccgtgcgcgaggcccgcaggatcgtcgtcaaggtgggctcctcgtcgctgaccaccgccgcgggcggcctggacgccgaccgggtggacgccctcgtcgacgccctcgccaagagcagcggccccggccacaaggaggtcgtcctggtctcctccggcgccatcgccgccggcctcgccccgctcggcctgcgccgccgccccaaggacctcgcccgccagcaggccgccgccagcgtcggccagggtctgctcgtggcccgctacaccgcctccttcgcccgctacggcatccgcgtcggccaggtcctgctgaccggcgacgacaccagccgccgcgcccaccaccgcaacgcctcccgcaccctcgacaaactgctggccatgggcgccctgccgatcgtcaacgagaacgacaccgtcgccaccgacgagatccgcttcggcgacaacgaccgcctcgccgccctcgtcgcccacctggtccgcgccgacctgctcgtcctgctctccgacgtcgacggcgtc

SEQ ID NO: 1045 - DNA, 4597 bp, Unknown
  Kingdom: Bacteria, Phylum: Actinobacteria, Class: Actinobacteria, Order: Streptomycetales, Family: Streptomycetaceae, Genus: Streptomyces
gctgagggcgcttccggcgcaggtccaggcccgccggaagcgccctcagctgtccggccgggacggccatgcgcgccgcgaaaccgccctggacgtgcgggaaacgggcggcgctgccgaggtagcgggtgtcccggcagacgttccgccgtccgtccgcgcactcgggacaggatccgcatggggtcgccgggtgcaccgcgaccgccgtgcccggggccggaccggcgccaccggggccgtaggagacgaccgtgccgaccacctcgtgcccgagcaccatcggctccctcagccggaagtcgccgaccccgccgtggcgccagtagtgcaggtcggagccgcacaccccgccgtagcggacggcgaccagggcctgccccgggccgggctcgggctccggcgcctcctcgatgcgcaggtcgccctgaccgtggatcacacaagcgcgcaccgcgggcctcctagagaacgctggtcatgccgccgtcgacgtacagcacctgcccggagacgaagtccgcggccggggaggcgaggaacagcaccccgcccaccaggtccccggtacgtccccagcggccggccggggtgcggcggcgcacccacccgctgaactcctcgtcctcgacgaggggacgggtcagctcggtctcgatgtagccgggcccgagcccgttgacctggagcccgtacgggccccagtcggcgcacatgcccttggtgagcatcttcagcgcgcccttggtggccgcgtagggcgcgatgccggggcggaccacctcgctctgcagcgagcagatgttgatgatcttgccgtggccccggcccgtcatccgccgggcggcctcccggccgaccaggaaggcgctggtgaggttggtgtccaggatgcggtgccagtccgtgtccgtgaactccagcaagggtgcgcgcagttgcatgcccgcgttgttgaccaggatgtcgagcgggcccacccgctcctcgatgtccgctatcccggcggccaccgaggcgccgtcggtcacgtcgaacgccgccgtgtgcacccggtcgccgggcagtgcggcagccgccttcgcgagcgtgccgccgtcgcggccgttgagcacgaccgtgcagccggcctcggccaggccgcgggccagggccagtccgatgccccgagaggagccggtgaccagggcggtccggccgccgatgtcgaagagagggtgagccgtcatcgccgtacccctacaagatcagggagaggacgaggaccagggcgccggccaccacggagaggatcgtctccatcagcgaccaggtcttgatcgtctggccgacgttcagcccgaagtactccttcaccagccagaagccggcgtcgttgacatggctgaagaagagcgaaccggcgccgatcgccagcaccagcagggcagcgtgggtggtcgacatgtcggccgccagcggcgcgaccagaccggccgccgagaccgtcgccacggtcgccgaaccggtcgcgagccggatcaccaccgcgatcagccaggccagcagcaccgccgggatcgaccagctcttggagatgtccaggatcatctggcccacaccgcagtcgatcagcgtctgcttgaagccgccgcccgcaccgacgatgagcatgacgcccgcgatgggcatgaggcccttctcgacggtggagttgatccgctccttggtgaacccggccggacggcccagcgtgaagatgccgacgatcacggcggcgagcagcgcgatcagcggcgagccgatcacgtcgaagacccgctgggtcatgttcgccgggtcgtccacgacgatgtcgaccagtgccttggccagcatcagcacgaccggcagcagcaccgtggccagcgtggcgccgaagcccggccgccgctccagctgctccgaggcgcgctccgggagcatgcggtccggggcggggacgtccacccagcgggcggcgaccttggagaacagcggaccggcgatgatcacggtcggtatcgccacgacgatgccgagcgccagcgtcacgcccaggttggccttgaccgcgtcgatcgcgaccagcgggccggggtgcggcgggatcagcccgtgcatcacggacagaccggccagcgccgggatgccgatgcgcatcagggagtagttgccgcgcttggccaccatcaggaccaccgggatcagcagcacgatgccgacctcgaagaacagcggcagaccgatcacggaggcgatcagcaccatcgcccacggcatcgcccggccgccggccttcgccaggatcgtgtcgacgacctggtccgcgccgcccgagtcggcgagcagcttgccgaggatcgcacccagcgcgatcagcacgccgacaccggcgaccgtcgaaccgaggccggtggtgaagctgctgatcgccttgtccagcggcgcgccggcgaccgcgccgagcaccagtgacccgatggtcagcgacaggaaggcgtgcagcttgaacttggtgatgagcaggacgatgacggcgatgcccgccaggacggcgattcccagctgggcgtgtccggccgaggtgatcggcgggggcgcgtccgctgccagcatctcgacgctgagtctggtcacggggagttcccttggaggtgtgaagagggacggtgggtgtcagaagtgccgcggtcggcgactgtgggggagggcctcggctctaccgtggggacggcttcgccgggacggaccgcgtggtgctctcgaggtcgtccagcgcggccacggcgcgcgcggtgatctcctccggcgaaccggagacgtccaccgcgacgccccgctcgtccgcctggagcggctggagcgtggcgaactgggagtccagcagcgcggtcggcatgaagtgaccctggcggtgcgtcatccggtcctcgatgagctgccgggagcccgtcagatggacgaagacgaccccgggggcctccgccctgagccggtcgcggtacgaccgcttcagcgccgagctgctcaccactccgccgagccccgcacgcccgtgcgcccaggcgccgatggcatcgagccacggccaccggtcgtcgtcgtcgagcgggatcccggccgacatcttgtcgatgttggcctgcgggtggaagtcgtcgccctcggcgtacgggacgccgagccgggccgcgagcaggggaccgatcgtggtcttgcccgtgccggcgacgcccatcaccacgacgacgtggggggtgcgcatcactgcctcgctgtcttcctcgacatgggacgccgacatccggcgtccgccacactgaaacctattaggtacgacgaattcaagagactgtgacatataagtctgactttttgattccgtgacccgccccgtacgctgagtgcatgagcacaccgggccgggggttgcacggccgcgtactggacaccctcggccccgccatcaccgcgggcgagtaccctccgggcagtgtcctgcggaccgacgaactcgcacagcgtttcgacgtctcacgctccgtgatgcgcgaggcggtccgcgtcctggaatccatgcacctggtcgagtcacgccgccgtgtcggcgtgaccgtcctgcccgagaaccagtggaacgtctacgacccgcaggtcatccgctggcgcctggccggcgccgagcggccgcggcaactgcgctcgctgaccgtgctgcgctcggcggtcgaaccggtcgcggccgcactggccgcccggcacgccggacccgagcagtgcgccgaactcaccgagtgcgccctcggcatggtcgccaactcacgcggtcaccgcctggagcagtacctcttccacgacatggccttccaccgcgtgatcctgaccgcgtcgggcaacgagatgttcgcgcgcctgggcgacgtggtcgccgaggtgctggcgggccgcacccaccacgaggtcatgttcgaggacccagaccccgccgccgtcaccctccacgtccaggtcgccgaggccgtccgcgagcgcgacgcggaacgcgccgaacggctgacccgcgagatcaccgtcggcgcgctccaggaactggacatcctggcgccgtagagcaccaagtcctgcggtcctacgaaagtcctgcggtgctacggaagtccgcggtcctacgaaagtcctgcggtgctgcggaagtccgcggtcctacggaagtcctgcggtgctgcggaagtccgcggtcctacggaagtcctgcggtgctgcggaagtccgcggtcctacggaagtcctgcggtcccacgtcctacggcagaaactcgccgtccacgtacacccacgccccgtccacccgctcgaaacggctgcgctcgtgcagcgacccgccccggtaggacgcccggaacgtcacggtcccggtggtgtggaaggaggaaccgtccgccgtccccaggatctccagtcccgtccagcgcagccgcggatccagctcaagccgcgcgggccgcgtccgcgggtgccaggtgcgcagcaggtacccggcgtcctgccgcacgaaggcgctgtaccgcgacctcatcagcgccttcgtgcggcagga

SEQ ID NO: 1046 - DNA, 3876 bp, Unknown
  Kingdom: Bacteria, Phylum: Actinobacteria, Class: Actinobacteria, Order: Streptomycetales, Family: Streptomycetaceae, Genus: Streptomyces
gctgacgccacgccgagggcggggccccggcaacccgcccgggccccgccctcagccgaccgtcagtcctcgcccgcggagcccgcggcctcggcgtcgttctcggagttcgccgactcggccttctgcgccgcctcggccttctccgtctccccgtcctcgaagtacgcgtccagtaccgcgtccagctccgtctcccagacgctgaagcgggaccgggccggggcctcgatctcgatggggtaccagcggcggtccggggtgtggacgaccacggtgaaccgcttgccgaagcgggaggtcgccgtctcgaccgcaccgatctcgtcccagcggaactcgcagtcctggtcgtccagggcgaggcgtacgccccggtggtcggcgacgatccgggcgcggcggtcggcggcctcgaagaccgggccgtcgggggtctcctccccggcggcggactcctcggcggtgtccgggaccggcgccccggcgtcggaggcggtcccgtccgccacaggcgtccgctccggctcctccggtgccgtgtcctcctccggtgccgcgtcctcggcggacgcgggtgaggtgaggccggggacgaacgccgggtcgaatccggcgcccttcacgggctcgctcttcaggggctggctgctcgaacctatgcgctgctccacagcgggcagtatggtcgacgatcctgtgccggggacagccagcccctacttcgttatcagacccctacaaccggcctgccgacgcgggccggacgggcgtacgtccgtccggcgaccgctcacacgaacagactcagcaccgccgccaccgcgaagcccgcgagcgacagcacgctctccaggaccgtccacgtcttcagcgtgtcccgttcgctgatgccgaagtacttcgccaccatccagaagccgccgtcgttgacgtgcgaggcgaagatcgaacccgcggagatcgccatgatgaccagggccacgaaggcctgtgagtggtgcccctcggacagcagcggggcgacgatgcccgccgtcgtcacgatggccacggtcgccgagccctgcgcgacccgcagcaccaccgagatcaggtaggccagcacgatcaccggcagcccgacgccgttgaaggtgtccgagagcgcctgggcgacgccgctcgccttgaggacggcgccgaagaccccgcccgcgccgacgaccagcaggatgttgccgaccggcttcagcgacgccgtcgagacggtctccagcgacttgcgcgaccagccgcggcggacgcccagcaggtagtaggcgagcaccagggcgatggtgagcgccacgaacgggtggccgaagaactcgatcaccgaccgtccggtggacgggtccagggcgatggaggagaaggtggccgcgaggatgaggatcagcggggtgccgatgatgccgaggaccgcgccgagcggcaccggtgcctcccgcggctccatgccggaggcccgctgctcggcgaggaccgcccgcttggcctcctcggccgcctcgaccatgtcctgcggcacctcgacgaagacgcgcttgccgatccaggcggcgtacgcccaggcggccagcaccgccgggatgccgcagacgacgcccatgaggatgatccagccgagctgtacgtgcagcagtccggcggcggccaccgggccggggtgcggcggcaggaaggcgtgggtcatggacaggccggccagcagcggcatgcagtacaggacgaccgacttgccgccccgcttggcggcggcgtagacgagcggggccaggacgaagatgcccacgtcgaagaagaccgggatgccgaagatcagaccggtcaggcccatggcgagcggggcgcgcttctcgccgaagagtccgagcagccgggaggccagtacttccgctccgccgctgacctcgaggatggcgccgagcatggtgcccaggccgatgatgatggcgacgtggccgaggatgccgcccatgccggactcgatggtggagacggcgtcggagcgctgcacggtgccgaagagttcggtgaccgacaggccggccagcaggccgacggctatggagacggccagcagcgcgacgaacggctgcagccgcgccttgatgatcaggaacagcagcagcgcgatgccgatcccggccacgagcagcaggccggtcgtgccgtcgacgaggaggagcagaccgccggtgtgcgggggtgactgcggggctgccgcggcgagcgggagggacatacgggggtcctctgggtaagtacatacagctttcgggcagggaggatcgcggcgcggcgcccgaaggggtgggggcgccgcgccgtgaagggtgtgcggtggtgcgaagggggaggtgaggcgtcagccgaggacggcgagcgcgtcgatctcgatgaggagtcccgcgggcaggccgacgtagaccgtggtgcgcgcggcgggcggctgggtgaggccctgctcctcgaagtaggcgttgtagatgtcgttcatctcggcgaagtggtccacgtcggtgaggtagacgcggatcatcatcacgtcgtcccagctcgcgccgccctcttcgaggatcgccttgacgttggcgagggtctggagggtctgctcgcgcagggtggggccggccggcgtgggggccttgccctcctcgtggggcaggaagccgacctggccggcgacctggaggatgttgcccttcttcaccccgtgggagaacttggcgggcggcacggtgtgggtcttcggggtgagcgcggtcttgtcggtcatgcggtgtccctgtccggtgtggttgcgggggtgggtacgggggttctcccggagtactcgccgctgatggcgtccgcggtacggcgcaccagcgggagcagggtgaggagttcgtcggcggtgacgacgacgttcggcgcggagaccgacatcgcggccaccacccggccgtcggcgccccggatgggggcgcccacgcagttgatggactcctcgtggccgccgaggtcggtggcccaaccctgttcgcgcacggtcgccagctccttgaggaaggcggcggcgtggggggtcgaacgggccgtgtacagcgggtagtcgagcttctcggcgatcgcgcgccgttcggtctcgggcaggtcggcgagcagcagtttggcgaccgcggcgacggtgatcgcgacgggtttgccgatccgcgagtacatgcgcacggggtagcggctctccaccttgtcgatgtagagcacctcgttctcctcgtagacggcgaggtgcacggtgtggccgcaggtctcgttgaggcgcagcaggtgggggtgggcgatctcgcggatgtcgaggttctccatcgcctcctgggcgagggagaagaggcgggcgccgagccggtagcgctggtcggactggcggtagaccaggccgtgttcgtgcagggtgcgcagcagcctgagcgcggtggacttgtggacgccgaggcggtcggcgacccgtccgaggtcggcggggccctcggcgagcagcggcaggatgctcagcgcgcggtcgacggtctggctcatggcgtacgtacctccttgtcggccccttcagcggtgcgtgtccagccggggccgagtcgaagtctcccccacgcggcctcgtcgagggcggccagccggtcggcgtggtcgcgggcggcgggcacggcgaggtcgccggggacggtgagcgcggcggcggccatgaggtggccgtgccggaggcggtcgcgtacgggcaagtcgcgcagggtggcggagaggaacccggcggcgaaggcgtcccctgcgccgaccggcgcgacgacgtcgacgcggagggagggcacgaag

SEQ ID NO: 1047 - DNA, 2268 bp, Unknown
  Kingdom: Bacteria, Phylum: Actinobacteria, Class: Actinobacteria, Order: Streptomycetales, Family: Streptomycetaceae, Genus: Streptomyces
gaccgtgctgcaggggtcgctgcgcggactcgttccgatggccgggccggcgctggcagggcgaccggcatccccgtcaaccgctgtgattacctggacgatctgctggatcagcaggcccagggacggcagcaggaccgcggctgcggccgcgtgtcccagcacgatcatgaccgtgctccacgtgaggaccgccaccagcacggcagcggtcaccaccttcttcgacatcgcactcgatttctgtgaacgaagaactgcaaggacccatccctgacagcggtgctgagacgccatcaggtagggaacgccagcatgaacccaccgcacgccgccacgccacgtgatcacagagttacggaacaaagatccgggagcgccacctcgcgctacctctcgccaccctcaccacggaacagaacatcgaggattcagcactttgaggcggatacgtcgcttccgcctcccggcacaacggcttccgccatcatggacagcacaggcgccgttcgacgccgcactcaccgtgcggcccccgtgctgaagaaacacctgagggggccgcacggccaacccaccccaccgcgtccacatacctggagccagcaccccccggggccacgcgaagttgaggttccgtcagtaaccggacgaccaaggggagtgccagatcacggcagccggtcgagacgaccgaatgcgctatctattcgcacctgtctgcatatgtaagacgcgcccgtcggtggcaacccgccaccgacctagtaatgttcggcgcatgagcattccaagccctcggggagaacgagagaagctaattactgctctcactcccaggttgcgcagacatctgaagatccgggctttcgagcacggaatggacattcaggacgcagctgaacatgccatcaaggcctggtacgaagccgacagactccccgaggtggagaccgacggcgcgaagacctggggaaccttcctccctgtcggagagccggaccagttcaaaacggtgtgctcgcagcgcggcgtcacctacgttcaggggctcgcccaggcgctgacactctggctcgacgcccatccctcgccgtcgacgcctttggtcaagcagccggtcgtgcgggtgatagtcgccaaccagaagggcggcgtgggcaagacgttcatctcctcaggcgtcgctcaggctctcgcggaggccggccaccgtgtcctgctcgtggactacgaccctcagggccacctcacagcagaactcggcttcgaagacctcatgtacgaggacgacgtcgagaccttgatgatgcacatggacggcaccgccaagggcgacatccatgacctgctcgtcgccctggaccaggacgtcttcggagaccggctgcacctgctgccggcgagcgacgacgcattcctgcgcgacgtcgccctgtcgaaggtgtccttcagcgaggccgccctggagcgggcgctggagccgctggaggacgactacgacgtcatcatcatcgacggaccgcccagcctcggtctgaacatggacaccgccctgtactacgtacggcgccgggaaggggaactcgaggaccgctccggtgtgatcacccccgtgtgggcgaaccgggcctcgcaccgggctgtccggctgctgaaggcgcagaaggacgacctgtgcaagaagggccgaatccaggtcgactacctcggtctggtcatcaacgcctacgacagccgccgcggcaagctcgtccaggagaacaagaacgagtgggagaagagcagctccccgccggtcctggccgtgatcggtgacctcaaggaaggccgtgaggcctcagacggagagatccctctgctggtgtacgccccggacagcgaacacgcgcaggtgatgcgcgatctggcgaaggagcttgccgtatgacacccgcccagcgagtcactcgcggtttctccatggacagcgacgagagcgaagccaagcagccgccacgccgaatccgtacccgccagcagatcatgaacggtgagggcaaacgaccgccggccaaggtcgaactgcggctcctcgcgagcaacccgttcaaccctcgtgacgaactcaccgagatcgaagaaaccgcggaatcgctgcgcgccaagggacagatccagcccgtcaccgtggcacgccgcgcggccttcctgaacgcccaccccggacaggaagagcggatcggagacgacgccgagtacgtcgtcatcgacggcaaccggcgcctg

SEQ ID NO: 1048 - DNA, 2038 bp, Unknown
  Kingdom: Bacteria, Phylum: Actinobacteria, Class: Actinobacteria, Order: Streptomycetales, Family: Streptomycetaceae, Genus: Streptomyces
gcgaacggttccgcgggggtgagccacccggcggcggcgtacgcgggcagctcctcgcggatggtgcgcagttcccgctgccgggtccagacgaccagccaggtgagcagcccgaaggcgggcaccatgaagccgccgtagaccgcgaagaacccgaacctgccgaaggtcgacgagccgttccagaacgcgtgcatgcccatcgcgagcagcagcccggccggtggcagcagcaggcgccgccggcgccgacgtcctgccgcgaccgcggccaggccgaagccgatgccggtgcagaccgtgaacagcgggtgcgcgaacggcgacatgatcacgcgcacgaagaacgtcgccgcggtgacggaggcgatgccctggccgccggtcatctggtcggtgccgaaggcggtgccgaggtagaggatgttctcggtgaaggcgaagccggtggccgtggtcccggcgatgaccacaccgtcgacgatgccggtgaagtcgcgtctgcggaagaggaagagcagcaggacggcggcggccttcgcggactcctcgacgatcggcgctatcaccgtcgcgcccagggtgtccgcaccggccgggtcggcggtcgcggtcgcgatccatttggtggcgaagctgttggcgacgatcgcgatgagcgccgccgcgcaggcgccccaggcgaaggcgaagatcatgttccgccagggtccggggtcgacccggtccagccagcggaaggcggccgtcagcagcgggaccggcagtacggccaggccgaggcccaccaggaagccctcggtgccggtctgacggcggaccagggcgaggatgaccagcccggacagcgcgagcagcgcggcgagagcgccgtagcgcacccaccgcctgtgccaccagtgcgcgtgccgcggccggccgtcggctatgggcggaggaccgctcggatacgtcgggtacgggggactggtggccacgtcattgaccctaacgaggggagggggcgatcgcgacggtgcctcgtgggacgagaccgcggacaggatgcgtgctggtgtgtcagccgaggccgaggccggggccgtccccggggcgctgggcggtgtggccggtgccgtccgcctccacgtgcggtgcgcggtcctcgtgcgctacgcggtcctcgtgcggtacgcgccggaagagcaggtcgttcacgacgtggcccttgtccaggccctggccctcgaaacgggtcagcggacggaaggcggggcggggcgcgtagccgccgtcgggccgcgtgttctcgaaggcggggtgcgcgctcagcacctccagcatctgttcggcgtacggctcccagtcggtcgcgcagtgcacgatcgcaccgggccggagccggtcggcggccagcgtcaggaactccggctggatcagccgccgcttgtggtgccgcttcttgggccacgggtcggggaagtagacgcgcagtccgtcgagggagtcgggggtgagcatctcgcgcagcaggatgatcgcgtcgccgttggcgacccggacgttggtgagcccgccccggtcggcgaggctcagcagattgccctggccgggggtgtgcacgtcgacggcgaggatgttggtgtcggggtccgcggcggccatctgcgcggtggcctcgcccatgccgaagccgatctccaggacgacgggccgggcgttcccgaacagctcggccaggtcgagcacctgccggccgtcgacgtccagcccccactggggccacagccgctgcagcgcgtccgcctgtccggcggtcacccggctgcgccgcggctggaagctgcggatccggcgctcgaagtgcgacccggccgggtcggcctgcggcccgtcgggaaaccgcggctctcccttggtccgggtgtgccggacggccacaccggaggcgtgcggggcagtgggggccgcgggggcgttcaaggagtcagacacagtgccatccagtttacgggccgggtgggaccggccgagggaccggccgagggaccggccgagg

SEQ ID NO: 1049 - DNA, 8291 bp, Unknown
  Kingdom: Bacteria, Phylum: Actinobacteria, Class: Actinobacteria, Order: Streptomycetales, Family: Streptomycetaceae, Genus: Streptomyces
gtgccggggtgggagtcggggtcggagtcggtgacggcatgttgtcgtcggtggtgccgcccaggtagaccttgtcgctgtcccggtaggtcacctccgcctgctgcgaggtcttggtggtggtgtccagaccggggtggcgggtggtgaactcggtgcggctcatgttgcggcgcggtgccttggagaagtcgacgccgcccaccgacaggatccacaccttgccgtcgtaggtgcgctcgaacttgtagtcaccgtgctggaacgagtacaggtacttgtcgtagacggtcttcttgtcccagttcttgttctcgccccgcagcggccaccgcttcacgtcgttgctgttgatgatcttgtggtagtcggtcggggagatcgcgtcctggcggcgcacgtactcggcggcgacccgggaggagtagacgcggcgcaggtcggcgtaggcggcgtcctcgttgacgcgccgctccagctccggctggatcatcgaccggaccagcgcctcggcccgcttcgtctccgcctggctgacgtggcacgcgctcggcggcacgtccgggccggtgggcacctccatgttgaccttcagcggggcgtccaggatgtagatgccgccgtcctgctcacgcacctgcgcggtcttcggggtgatccactgccggatgatcggcaggcagggctggccgctcgccgtgcgcggcagggcctgccagaagcgttcgccccgctgggacttgtcggggttcatcgcgtccgcgtagtcgtgcttgagggtcaggtccgcctccagcagcacgcgtcccgcgtcggtcttcgcgaactccttgtccaggatcaggtccgggcgcaccgggttgaggttgacccagaacttgtccggcgtgagcgccagccaggtgaagaacgagtcggaggcgagcgtgagcttggcctcgccgccccagccgggcttgttgtccgggtcggccgcgtagtcggccttcagggagtagcgcagcccctggcccttgacgggcttgccgacgaagttcatctccagcgtggagaagtcgatgccgccgggcccccggttgaagtagccgcccgtgttgctctgctggtacctgcgctggatgctgtacgcctcctgcggcgtcttccccgagcgcagcgcctggtcgaacagcggcccgcgcataccggacttgagcgggtcggcgttgaagcgcttgtcgtacctggtgtagacgttcggcttgccggtgcgctcgatggcgttggagcggcgctcgtagacacccgcctgcgtacggttggtgccgcgctgcttcttcaggtcgtcgtcgaactgcttgatcgcgtccttcgtggacttctcggtgcgcgcgccggtcaggtacctgtacgtcgacttcggccgctccctggcgagctgccggtccgcgtcgatctggtccctcctgacctcgccgttcgacttcatctccacgttgtggtcgcgcggccggttgcgggcgtcgaccacgcggtagcgcttctcgccggtctccgggtcggtgtactccaggacgtcctggcaccaccagtccgggccgaccatgttgtacttcttgaccatccgcgcctcgaaggcatcgccccgggccgggttgccgtgggcgccgacgtagcgcacgtccaggaagcgctcgaagtccttgtagcccgtcggcgagttgtactgcttgttgtaacgggcgtagatctccatcgcccggtcggccgggttgccgctcttgttgtacttccgctgccaggcacggtagttggtgcccgccttgtcgcgctgctcctgggtcggcgcgggcagaccgtcgtacgccttcgccgggttgtcgtaggtgtagttctcgtcgttcggccaggcttcgtacggcagcgtgtcgggcggacccgaattcggcggcgtggtcgggagcttgcggccgagccacttctcgtcgcaccgctgggtcttcacgttgggccgcttcgccgcgtacgccgcgccctcgaggcccggcaggccaccgcaggtgaccgcggccgccgcggtcacggcgagcgtcgcgcgcagccaggtgcggggcacgcgcggtgccccggctgtccggttcatgtggtgtatccccctgggaacccccgtgcaacccccgtgcctttcaggagagttggtggtgcgcggcgcgtgagggggctccggtccgtggtgtgaacacgccgctggaggcctcactgtaggggcgccggggcggcgacgcccggcggcttgcagagcatgtccccgtcaatacgacactttctccggaccgtcacgggaacctcacgactcgatccaggtctcctccatgtcgccggtggcctcctcggtgtgccggacccggaagacggacgccgaaaggccccgccggtcgagcggggcgacgcgcgcgagcgccagccgcgcgaggccggcccagtggagggtgtccggcgcggcgccggtgtccacgcccttgtcagccaggcgcgcggggtcgatgccgaaggccgcgacgaccgccgccggatccccgaggacggtccagtccgcctcgccgccccagcccgccgcgaagacgttcacgccgctgggatggatgaacttccatgcttcgtaaggtgagttgtggtcgacgaccgcggaggcgacgacgaccgcgccgggaaaccgctcggcgagcgcgtccgcctgctcgtccaccgggaacgtgccggcggtgcaggccagcgcggcgtcgcggatctcggtcacgcctccccagcagccgacccggaccagatcgaggtccgcgcgcacgccgagcggaacggcgtcggtggcggggacggtgccgagatcgtcgagtacggcgtcgacggtgccgaacgcggcggcgaactcccgcgcccgcaccgcgtcatgagcggcgagcggcccttcggggccggggtggggcgcatggacgacggtcagacggaactccccgtgccgcgccaccggttcgtccggagcactgtcccagaagctgttgtcggtcatggggtcaccgtagcggtcccggtcccgcgccccggcgccaccgcccgaggcgccacacgcctccgcccgcgacgccacggcgcgccccggagtacgggacggccgcggcgccgcgggcggacggtcaggcgtgacgccgtcgtgaccggacggtcaggcgtgacgccgtcgcggcgttctgccgctgggcgttcagccgatgcggcctgcagccgatgcggcctgcagtcggtgcggcctgcagtcggtgcggcccgcagccggtgcggcctgcagccgtgtggcgacgggcatcacaggatggtgttgtacgtgttccagccgccgccgacactggacttggtggcgaacggcgcggtggcgctggcctggcccttgtagaaccagagcccgcccgagctgtcccgggcgacgaggtcgggcttgccgtccttgtcgaggtcgcccggtccgaccagcacgttgtacgtgttccagccggggccgacccgggtcttggcggcgtacggcgcggtggcgctggcctggccctggtagagccacagcacgcccgagccgtcccgggcgatcaggtccgccttgccgtcgccggtcacgtcaccggtggcggtcaggttgttgtacgtgttccagccggggccgatacgtgtccgggcggcgaacggcgcggaggcgttgccggtgccctggtagagccacagcacgcccgagctgtcgcggccgatcaggtccgccttgccgtcaccggtgacgtccccggcgccggtcagggagttgtaggtgttccagcccgaaccgaccttggtgcgcgacaggaagggcgccgacggcttgccgctgcccttgtagaaccagagcaccccgctcttgtcgcgggccaccatgtcaccggtgccgtccgcgcgcagcgccgtcagcggcgtcatcatgtcgtacgtgtcccagccgccgccgacgcggtagcgcagcaggaacggaccggaggcgctgccgctgccctggtactgccacagcacacccgaggcgtcccggccgaggatgttgttgcggtcggtggccgggtcgggagcggtgcccttgaccacctggacgtcctcggcacgcacccaggcgatccggtggttgtagcggatggggtagaaggtgttgctgcccacgaccatcacgcgcgaaccggtgccggtgccgtcgatcaggccgctgttgtagtacgagcccttcacggccgcaccggccagcgcgtacttctgcccggccgcgatgctgtacttggtcagcgagtcgctgttgtacttctggaccgagaccccggtgccggcgtagtccgcctccaacgggtacgtgcgcccgtacacggggatcgacgtggcgcccgccttcggcgtgactgtgtccggcgtaccgacggcggtggcgaactgaccgccctggttgtagaaccaggccttctgcccgccgtaccagatggccgtccagtcgcgctgcgcctccgcgacgacgtactcgccgccggccaccaccttgttggcccagttcgggccctcggtggcaatctggctgcccaggtaggggtcggacagcgtgggcgagctggtggacggctcggtgtacaggtaggcgaagttcgcgggctgcttgtcgaccgcggcgccgccgttggtgagggtgggctggttcgccgtggtgaagggcggcacgacccggatcacctgaccggccttgtacagaccgccggaaccgctcgcgccggtcggcgcgcccagcagctgcatgtagtggttccagtcccagaacgggcccgggtcccagtgctgcgtcttcacgttggtgtccaggacgcccggcacctcgtcgtgaccgatgatgtgctcacggtccagcgggatgccgtacttggcggccaggtacttcaccagggtcgccgaggactcgtactcgggctcggtgtaccagctgcccttcttgatcgcgtagccctcgtgctcgatgccgatcgagtgcatgttgacactcttgttggcagcgtgccacgcctcgtccttgttctcgacgacctgggtgacctggccgtcggaggcgcggacgaggtagttggtgctggcgtacgaggccgggttctggaagacgttcagcgaggcgtcgtagctgccctcggtgtcgtggatgacgatggagttgatctcgccgccggccaccggacggttggcgatgttgtagttgccccagtcgtccgggccgctgttctgcttgtacgcggccggcttgaagtcgcacttcagggtcggcgggcagtcggcggtcgccgcggtggtgacggtggcgacggtcgccttggcgagcttcaggtccgcctgctgcgcgggtttcaccgccggatcggccgggagcgtgacgtgctcgccgtccgcggtgacgcgctgctcaccggtccggatcgagtcgtacacgcggttcgcgaagagctgcgcgcccttggtgtcggtcgcctggctggcccgggccacggccggataccaggcaccggggtccttcggcagcgaaccggccgcgtccttctggtacttggcgagcagggcggcgcccgcccggatgctctgccgggcgtcgtcgcgcaccgcctcgggcgaggcgtcgatgagaccggccgcctcgttcagcgtgtgcagccgcgggtcgctcgtgtcgacggcctgcttgcccgcgcccttgagcgccttcgccggatcgaagtgcttctccacggccgggtcgccgctgcggttcatgcggtcgagctgctgcgcgcgcgacgcggtgtcgtcctggaggctgccggggtcgacgtccgtgagccccatgacgttgtaggcgcccgtggtgctcggcagcccgtcgtggtcctcccacagcgtctgccggtacgagaccgccatcagtacgctcaccgggacgtcgaactcctcggcggccttctcgaactcggcctgcagccgggcaccgggacgggcggccggggagccgtccgagcccaggagcccgggggaggccacggccagcgagccggccgtggcggccacggcgacggctgacgccgcggcgtaggcgagcagtctcttcttcttgttcttgcggcctctgcgatggtccgcgctcaaaatccacccctggtcagtgctcgatgtgcaacgtgaggtcgttgcagttcacacttcaacggggtggacgctaccaacgccgatcacgatcccggcaccggggcggcgcccggcaggcgaaccggggcgcaatcgcccgataacgcctcggtgtcgggccgcgagcggccccggccggcggaatcgcgcccacccgggcgaggacaccccgggccgggagggccgccgcggtggacagcgcgccggaagccggcctcagtgccgtcgtcctccaccagtgcggcggccgcggaccggacgacctcgcggcgctgtacggggtcggtgaggtccacagccgtctccggcttcaatgaccggcgtcggcgttgtccgtctgtaaggacgcgggaccgggcgcctgagacccggcaggtgtcgtcgtgcgcgatgcggtcctggtgctcgccgttggtcacccgcgagctgtgcggccggtgtcgtggccgggggccgttcactcgtcgtcggccagttccagctcgatcacgggcagcaggacgtcgggccgggtgatgggcagggtcagggtgagcgtccctgcgggctgcccgggcggtgccatgttcacgtgctcgtgatcggcgccgtccagctcgtggtaccggatctccgaaccgtcgtgcagcagttgggcgtaacgcacccggcccgccagccccggcaggtggaggtggtggagcggccaggcgagcaggtgcacgtagaggtggcgccccgagcgggtgtacagcgcgttcgcgggcgccggcaggccgctcggcccggcaccgcgcacggaccgctcgtgcagggacatccagtctccgatcgcccccagggtgtcccgggcgcgcgggtccagcgcgccccggccggtgggccccacgttgagcagcaggttgcccccgcacgccacggactccaccagcatccgtaccagcagcgccgggtccttgtacgcgtggttgtcccggtcgtacccccatgagccgttcagcgtgtggcaggcctcccaccgcaccgggacgccgccccgctccaccggccggtcgggctggtactgctccggggtcacgtagtcaccggggacgccgagccggtcgttgacgaggatgtccggctgcagttcgcggaccatggcgagcaactcgggcgcgccccactcccgcggccccttgccggggtaggtgaagtcgaagaagagcaggtcgagcgggccgtaaccggtcaggagctcgcgcacctgaccgtgcaggtaggcgcggtagcgggccatgtcacgcggctcctcggcggccggggtgtcgcgcagcgggtggtgggcgtcgacggtgaagtccgggtgctgccagtccagcagcgagtagtacaggccgactctcagcccctcggcgcgcatcgcctcggtgaactcgcgtaccaggtcacggccgaccgcgcgctgggaggtgtacgaggtcagcgacgagtcgtagaggcagaagccgtcgtggtgcttggcggtcagcacggcgtagcgcattccggcggccttcgccgcgcgggccagctcgcgcgcgtcgaacaggtccgggtcgaaccgctccaggtaacggtcgtactcctcctgcgacatggcttcccggctgcgcacccactcgtgccgggcggcgaggctgtacaggccgaagtggacgaacagcccgaagcgcgcggtgtcgaaccactccgcagacgcagtggacacgggcacggaggtggggacagacatgggtacagaggcggggacagacatgggtacagaagcgggctcgggtgcgggcacggcaactctcctggcgctgtagacagctctcaccggtccgctgtatctaccaccggcagtcgcgcatgtcactcgacgccggcacccgcccgcctccgcgatgcgtcatctgactggagggggcgggcctgttccggccgccgcacggggcgggtcgtgccaggaagtcatgagtcatcagacggatacggccggcgccgcggacggccatcctcggagtacgccccggctcggcgcgggacggaaccgtcgacggagccgggccgcagccggcacgcagccggggcgg

SEQ ID NO: 1050 - DNA, 991 bp, Unknown
  Kingdom: Bacteria, Phylum: Actinobacteria, Class: Actinobacteria, Order: Streptomycetales, Family: Streptomycetaceae, Genus: Streptomyces
ggccggcgcgacgccctcgggcaggtcggccgggctctcgggcaggtcggccgggccgtggccgggaagggccacggcggcgcccgcctcctgccgctgggccgggctgatcggcaggagcttgcgccggtcgcgcggggtgtgcgcggcgtggatgccgccgctcaggatggtctgcagtcggtcggagatgtccgcgtagtcgtcgaagccgagcacgccgtcggcctcggggagggcttcggcgagttccttgccgtacctctcggccatgcagccgaccgcgacgacggcctgcgttctgccgtggtccttgaggtcgttggcctccaggagggcgtcgacggagtccttcttggcggcttccacgaagccacaggtgttgacgacggcgacgtcggcgtccgcggcgtcctcgacgagctgccagccgtccgcctccaaacggcctgcgagctcctccgagtccacctcgttacgggcgcagccgagagtgacgagtgcgacggtacggcgttcaggcatgggctcaagactactttgtcccgccgacaccccacgtcgaaggggttggccgatcttggccaaccccttcaccacctgtctgcccggccccgcgcgggcggccaccgtgggccgcccggcccgcgggcgccgcatcatccgacctgggggtcgcccttggtgtaggtgaggcgttccacggcgcccggctggaactggtcctcgatcttcttgccgttgacgtagagctggaccgcgccggcgtcgccgaggatcaggttgatcttcgtgctgtcctggaaggtcttggactcgcccttgctcagcagcccgtcgaagagcatgcggccgttgtggtccttggcggagatccagctgcgcccgttcggcgcgctgacctggacggtcaccttgtcctggggcgcggcggcgatggcgctgtcggagggggcgggcttcggggcggcgggcttggtgtgcttcgggc

SEQ ID NO: 1051 - DNA, 2507 bp, Unknown
  Kingdom: Bacteria, Phylum: Actinobacteria, Class: Actinobacteria, Order: Streptomycetales, Family: Streptomycetaceae, Genus: Streptomyces
gccctcggtcaccgccggcagccagcgtgcgcgctgggcgggggtgccgtgggcgtgcaccgggtgggcgccgaggccctgcagggcgagggccgtctcggcctccgtacaggcgtaggccagggactcccgcatcaggcagaggtccagagcgccggaggtgaacagtcgctccaggaggcccagtcggcccagttcggcgaggagcggacggttgacgcggcccggctcgcccttctccgcgagcgggcgcagccggtccgcggccagcgagcgcagctcggcacaccaggcgacctgggccggttcgagcgagaatgcggacattcgccggtcctccctcccccgggacggccggggtccacgaccaccgtatcgcgccccgttgactgccgtcatcaacacgatacgctccctgtgcgagcccaccacgacaagggggcgaaccgccatgaacccgacggatcccaacgggcccacggcccccggcaggcaagagcccggcgaggaagtcaccgggagcgccggacccggcaccccggacgccgtccgcccgccggccgcctccgcccacgtcgacaccttcgcgcgcgatcacctcccgccccctgaccagtggccgcggctgcgtttcgagttgccggagctgcgttaccccgagcggctgaactgcgccgccgaactgctgggccgctccggaccggccgacgcgcgcccggtgttccgcacgctcgccggcaagacctggagctacgccgatctgcgcgcccacgtcgaccgcatcgcgcacgtcctgaccgccggcctcggggtggtgcccggcaaccgcgtcctgctgcgcggtccgaccacgccgtggctggccgcctgctggctcgcggtgctcaaggcgggcgccgtggccgtcaccgtgctggcccagcagcgtgcgcacgagctggccacgatctgcgagatcgcccggatccggcacgcgctgtgcgatgtccgggccgtcgaggacctggtcaaggcggacgtgccgggcctcgcgatcaccaccttcggcggcggcggccccgacgacctgctgcaccgcccggtgcccgaggtccccttccgggcggtggacaccgccgccgacgacgtggcactcatcgcgttcacctccggcaccaccgggcggcccaagggctgtgtgcacttccaccgggacgtgctggcgatcgcggacaccttctcgaagcacgtgctcaggccgcgccccgaggacgtgttcgcgggcagtccgccgctcggtttcaccttcgggctcggtggtctggtggtcttcccgatgcgggccggcgccagcgcgctgctgctcgaggaggcccacccggcgcagctgctggcggcgatcgccgagcaccgcgtgtccgtgctgttcaccgcgcccaccgcctaccgcgcgatgctcgaccggctggacgcccacgacgtctcctcgctcaggcgctgcgtgtcggccggggagaacctgcccgcgaccacctggcacgcctggcacgagcgcaccggtctgcgcatcatcaacggcatcggcgccaccgagctgctgcacatcttcgtctcggcggcggacgaggacatccggcctggcgcgaccggcatgcccgtaccgggctggcacgcgcgcgtgcaggacgagtacggcaggcccgtgcccgacggcgagcccggactgctcgccgtccaggggcccgtcggctgccgctacctcgacgacccgcggcagcacgcgtacgtgcgcgacggctggaacgtcaccggcgacacctacgtccgcgactacgacggctacttccgttacgtcgcccgcgccgacgacatgatcatctcggccgggtacaacatcgccgggcccgaggtcgaggacgcgctgctgcgtcacccggacgtcgtggaggcggcggtcgtggggcggccggacgacgcgcgcggccaggtcgtggtggcgtacgcggtgctgcgcgaaggcgcggcgcgggacgcggaaacgctgcgcgcgtatctgaagtccgagctggcgccgtacaagtgcccgcgcgagatcgtcttcctggacacgctgccgcgcacggccaccggcaagctccagcgcttccgcctgcggtgaccggcagtacgccggccgcctgggacgacctaaaatgatcaacgtgtccgagcagcccgtaccgcacgccccgagaagcccccggtccctcatcgtcacgctctacggggcgtacggccgcttcgcgcccggtccggtgcccgtcgcggagctgatccggctgctggcggcggtcggggtggacgcgccttcggtgcgctcctcggtgtcacggctcaaacggcgcgggctgctgctcccggcgcgaaccccgcagggcgccgccggctacgaactgtccgccgaggcccggcagttgctggaggacggcgaccgccgtgtctacgcgggcgcgccgcctgccgacgagggctgggtgctggccgtgttc

SEQ ID NO: 1052 - DNA, 2645 bp, Unknown
  Kingdom: Bacteria, Phylum: Actinobacteria, Class: Actinobacteria, Order: Streptomycetales, Family: Streptomycetaceae, Genus: Streptomyces
  misc_feature (2367)..(2368): n is a, c, g, or t
ggtgccgccgtgcgcggcggccacggcctgcacgatggccagcccgaggccggtcgaaccggtggcgcgcgtgcgcgccgagtcgccgcgcgcgaaccgctcgaagacgtgcggcagcaactgcggcgggatgccctgcccgtcgtcctcgacgtccacgcacagccacggcccgttgcgccgcacccgcgcggtgacggtcgtcccgggcggtgtgtgcgtacgggcgttggccagcaggttgacgaggacctgctggagccgggccgcgtccgcggacacctggaccggctcgtcgggcaggtcgaggcgccagttgtggtccgggccggccgcccgcgcgtcgctgacggtgtccacgaccagcggtacgaggtcggtctgctcgaactgcaacggccggcccgcgtccagccgggcgagcagcagcaggtcctccaccagcagcgtcatccggtcggcctcggactcgatacggcccagcgcgtgccgcgtgtccgggccgatccgctcgccgccccggcgggtgagttcggcgtacccgcggatcgaggcgagcggtgtgcgcagttcgtgactggcgtccgcgacgaactgccgtacccgcgtctcgctctgctgccgtgcgtgcagcgccccgtggatgtggtcgagcatgcggttgagcgccaggcccacctgcccgacctcggtgtgcgggtcggtctccggttccggcacgcgttcgctgaggttcacctcgcccgcgtgcagcgggagttcggagacgcgggtggcggtggcggcgacccggcgcagcgggcgcagggcgacgccgacgatggcggcaccggccagcgaggccgcgacgagaccggcggcggtgacgctgatctcgacgaggacgagggtgttgacggtgttgtcgacctccttcgtcggtatggccacgtagaaggtgccgttggggccgctcgtgtaggcgacgcggtagtcgcccaggccgggcagtccgacggtgtgcttggcgcggtcccgggagacggagccgagcgcgtcggtctgggccgtggtgaggggggtggcccgcacctgcgggaccccggcgccgtccttggtcttgtcgccgaacacgcccgccgtgatgacgccgttctcggtccgcgcgacgacggtgccgcccggctgcgggcccttgacgaagtcggtgaggctgatgtccttggggaccgacgcgcggccctgctggtcgaggtcccaggacttgcccggccggcccggcggatggaacacgccggacgcccgggcggcgacctcgtccagctgaccgtccagctgctcgtacagatgggaccgcagcgccagcgtcgtcaccgttccgatcacggcgcagaccacggcgatcagaacgacggacgcgacgacgagccgcgtccgcagggtgcgcggctcacggccacgcctgcgcacacgccgccgtcgccgtccgttcacgacacggcgggcttgatcaggtacccggcgccgcgccgggtgtggatcatcggctcgcggcccgcgtcgatcttgcggcgcaggtaggagatgtacagctcgacgacgttggcctggccgccgaagtcgtaggaccacacgcggtccaggatctgcgccttgctcagcacgcgccgcgggttgcgcatgaggaagcgcagcagctcgaactcggtggcggtgaggtggatgttgtcgccgccgcgcgagacctcgtgactgtcctcgtcgagggtgaggtcaccgacgacgaggacggattcggagcgccggtcggtggcgcccgaccggcggatcagcccgcgcagccgcgcgacgacctcctccaggctgaacggcttggtcacatagtcgtccccgccggccgtgagtccggcgatccggtcctcgacggcgtccttggcggtcaggaagaggacgggcacgtcgggcaggtcgcggcgcagccggcccaggacggtgagcccgtccatgtcgggcagcatcatgtcgaggacgacggcgtcgggccggaagtcacgtgcggtctgcagggcaccgaccccgtcccccgcgctgcggatctgccagccctcgtagcgcagggccatggacagcagctcggtgatcgacagctcgtcgtccaccacgagcacccggacggggttcccgtccggcctcagcagttcggtgcgcccctggggcgaagtcgtggtcatgacggtcaccctgtcggcgccctctgagaacacgctttcacgaatctgtgttttccctgagaaacgcacaggcgccgctcagggaacgccggaccggcgccgtgtgcggtgtgggcggtgtctgcggtgtgtgcggtgtgtgcggtgtgtgcggtgnngcgcgcagccagtcggcgccgaggccgaggcgttccagggcgtgcagctgatccacgtagggataggggatgttggggaagtccgagccgagcaggacccggtcaccgagggcggccagccggggcagggcacggcgggggaacggggcgaagcgctcgctgaagtcggtgaacgccatcgtcgtgtccagccgcacctgcgggtaccgctcggccaggcccaggaagtcctcgtactccggcatgcccatgtgcgcgacgaccagccgcagccggg

SEQ ID NO: 1053 - DNA, 2763 bp, Unknown
  Kingdom: Bacteria, Phylum: Actinobacteria, Class: Actinobacteria, Order: Streptomycetales, Family: Streptomycetaceae, Genus: Streptomyces
gacgcacgaccgcaccaccgcggcgggctcgtcgcccggtccgcgcggtgcgcgggacggcccggcggtggtgcggtcgtgcgtcgggtcgaggtgttgcgtcgggtcaaggtgttgctgtgccacgccggcgcctccgggcgtctatgagcgtctcctggacgttgcgcaggggctggccgtccgcgtcggtggcgtgccgggtccagtcgccgtccgggccgaggtgccaggaggcggtggtgtcggccatgccggtctccagcagccggttgagggcggcccggtgggcggggtcggtgacccggaccagggcctcgatacggcggtcgaggttgcggtgcatcatgtcggcgctgccgatccacacctcgggctcgccgcccccgccgaaggcgaagacccgggagtgctccaggaagcggccgaggatcgagcggacgcggatgttctccgacaggcccggtacgccgggacgcagggagcagatgccgcgcacccacacgtcgacggggacgcctgcctgggaggcgctgtagagcgcgtcgacgacggcctcgtcgaccatggagttgaccttgacgcggatgaacgcgggccggccggcgcggtggtgctgtgtctccttgtggatgcgggagaccaggccgtcgcgcagggacttgggggcgaccaggaggcggcggtaggtctcgcggcgggagtagccggagagccggttgaacaggtcggagaggtcggcgccgacctgagggtcggcggtgagcagtccgaggtcctcgtacagccgggcggtcttggggtggtagttgccggtgccgacgtggctgtagcggcgcagcgtgtcgtcgccctcctgacggaccaccagggacagcttgcagtgggtcttcaggccgacgagaccgtagacgacgtggcagcccgcctcttccagcttgcgcgcccacttgatgttggcgtgctcgtcgaagcgggccttgatctcgaccaggacgaggacctgcttgccggactcggcggcgtcgatgagcgcgtcgactatgggggagtcgcccgaggtccggtacagggtctgcttgatggcgaggacgtcggggtcggcggcggcctgttccaggaaggcctgcacggaggtggagaacgagtcgtaggggtggtgcaggagcacgtcgcggctgcgcagcgcggcgaagatgtccggcggcgaggccgactcgacctcggcgaggtcgcggtgggtgccggcgacgaacttgcggtacttcagctcgggccggtccaggctgtggatgcggaagaggccggtgaggtcgagcgggccgggcagcgggtagacctcggcctcgctgatcttcaactcccgtacgagcaggtcgagtacctcgcggtcgatggactcctcgacctccaggcgcaccggcggcccgaaccggcgccgcatcagttccttctccagggcctggaggaggttctcggcgtcgtcctcctcgacctccaggtcctcgttgcgggtgagccggaaggtgtggtgctccaggacctccatgcccgggaacagctcctccaggtgggcggcgatgacgtcctcgagggggacgtagcggccgggggagctttccaggaagcggttgagcagcggcggcaccttgacgcgggcgaagtggcggtggccggtgaccgggttgcgcacgacgacggccaggttgagggagaggccggagatgtacgggaaggggtgcgcggggtcgacggcgagcggggtcagcacggggaagatgcgctgccggaagagggtgaacaggcgggcctgttccttctcggtcagctcgctccagcggaccagctcgatgccctcctcggcgagggcgggggcgacgtcctcctggtagcaggcggcgtgccgggccatgagctcgcgggagcgcgcccagatcatctccagcacctcgcgcggctgcagcccggaggcggaccgcgtggcgacgccggtggcgatacggcgtttgaggccggcgacgcggaccatgaagaactcgtccaggttgctggcgaagatcgcgaggaagttggcccgctccagcagcggggtgtccgggtcctcggccagttccaggacgcgttcgttgaaggcgagccagctgcgctcccggtcgaggaagcggccctgcggcagctggtcctcgccgtcgcgcgcctcctcgtagacgtcgaggtcggcgtcgaggtcggggtccagatcggagacggccgcggccacggtgtgcgggcggtgggccgcgagggagcccacggagggctggaggtgcgggacctgctgcgctgctgcctgggtgtctggctggctcatgaacccattcttccgcgcggcgaggagggcaggcgcgtcggaaggcgcgggcgggagcacggctgcggtcccctccgggggcggcggaggctcgggcacggcgggtttcattgagtgagcgtcgcaagcttgtctgaatcaccggttacggagacatgacgtgcgggatagcggggggcggctcgcggggatcacgcggggcgggccgccgggggcccgcccccgcgctgtgccggcggccaccgggacggtcaggccgtgcggcggcgcaggaccgtgaaggccgtggccgtgaccgcggccgtgacggtgaggacgatgcccgtctccatcaggtgcaggggccagaagtgggacggtgggtggtacgtggtgacgtactgctcgccgttgccgccggtgcggagcaggta

SEQ ID NO: 1054 - DNA, 5669 bp, Unknown
  Kingdom: Bacteria, Phylum: Actinobacteria, Class: Actinobacteria, Order: Streptomycetales, Family: Streptomycetaceae, Genus: Streptomyces
catcccgcccgagcggcaccgccagcggcgttcgcaggctgccgacgaccgggagatcgcgcggctgcgcgccgcgctgcgcgcccacccctgccacggctgcaacgaccgtgaggaccacgcccgttgggccgagcgctaccaccggctggtgcgtgacaccaagcagctggagcaccgcatcgagggccgtacgaacaccatcgcgcgcaccttcgaccggatcgtcgccctcctcaccgagctggactacctgcgcggcgacgaggtgaccgagcacggcaagcggctggcccggctgtacggcgaactcgacctgctcgccagcgaatgcctgcgcgagcgcgtctgggagggtctgggccccgccgaactcgccgcgtgcgtctcggcgctggtctacgaggcccgggtcgctgacgacgccatggcgcccaagctgccctcgggcagtgcgaaggccgcgctcggtgagatggtgcgcatctggggccgcctcgacgccgtggaggaggagttccggatcagccagaccgagggcgtcggccagcgcgagcccgacctaggtttcgcctgggccgcgtacatgtgggcctcgggcaaggggctcgacgaggtgctgcgggaggcggagatgccggccggtgacttcgtgcgctggtgcaagcaggtcatcgacgtcctggggcagatctcggcggcggccccgccggagaactccaccgtggcgaagaacgcgcgcaaggcggtcgacgggctgctcaggggagtggtcgcctactcgtcggtcgggtgaggttcacccgttcgggtcatggggcgtgacggtgtgcggtcgatccgcgcacggtcacgccccatggcgttttctcactcgtcccggtgagtggtcttcgcgtgcccgtacgctgtgacgttcggtgttcgaatgatcgcatggtgtgtaaaaccgctgagggtactcctgtcggccgccctgtttcaggcgcttgcggaatatgacacggcgttgatccggtcggactaagctcgcccgcagcgcaccgagttgatgtgtattcgtgcgcttgttcccaaacatccccaaggtccgacagttccatgacataccccgctggaagctgccccgaaccccagccgattcgtcacagagggcttacatggtgagtgtccaatcgcctcctggcggccgcgaacttccctacgcgcgcgtgctgctgctgccggtcatactgatggcggcggccaccggagccgccgtcgccctggtgaccgacccggcccgcctcgccgtcggctgctgcggcgccgtcgccacccttctcgtgctgctcaccggcgccgaagcggtgcgccgcggccgtaccctgcgcgaggagcgggccgaacacgcccgccgcaccgagcacctccaggcgtgcatcgccggccacgacgaccagatctcctacctcgccacggagatcctcccggccgccgtcgagtacctccgcgccagccacaccccgcgcgaggtcatgcgcgacctcatcgacggcgaccccgagtggtgccgcatccccgaaccgcagcgcgcggtggtccgcatgatcctcaagatcgtggaccaggaggagtcgatgcgcgactccacgcagcgctccttcgtcagcatcgcccgccgcgtccaggccatcgtgcaccaacaggccaaggaactgcgggagatggaggaggaccacggccgcagccccgaggtcttcgacgacctgctgcgcatcgaccacggcaccgcgctgatcggccgcctcgccgactccatctccgtcctcggcggcggccgccccggccgccagtggcccaacccggtcacgctctacagcgtgctgcgcggcgccatgtcccggatcctggagtaccgccggatcgagctgcactccatcgccaaggtcaacatcaagggcaccgacgtcgagccggtcatccacgccgccgccgaactcctcgacaacgccacccgctactcgccgccccagaccaaggtgcacgtcaccgccgtcgaggtgcagaccggcgtcgccatcgagatcgaggacggcggcgtcagcctcaacgaggagtcgcgcggccggatcgagaagatggtcgaggcggccaaggccggcgtcgacctccaggaactgggcgagagcccgcgcctcggcctcgccgtcgtgggccgcctgtgcacggcctacaagatgcaggtctccctgcgggcctccgcctacggaggcgtccgcgccgtcctcgtcgtgcccagcgacatgatgaccaccgaccccgcaccgggactcgcccacggcatcggcgccacctccatcccccggcccggcgaggacgccgtggagggccccaagcgcgcccccaagaagcgccgccccaccagcccgcgcatccccgcctccgtgccgatggaggacgaggtccccgaggtgaccgagtggaccgcgaacggtctgccgcagcgccgcagccgggtcaagatcccgctcagccagcgcatcgccgaacaggtcgccgccgaacgcgccgagcaggagggcgactccgtgtggagcaggccccgtcccgcccccgagcccgccgagaaggaacccgaaccgggcctgtgggtcgaggcgttctgggacggcctgaagaaggacaatcccggcccggacccgaccgcgttcacccaggacccgaccgcattcctgcacctgatcgagaagccggcccgggacggggccgacgacgagggggacctcaagtgatccagcagcgcgccaacttcgactggatgctcaaggagctgaacgacggcgtaccgggcatcgagatgatcgtggtgctctcggccgacggtctgcgcatcgcccgctacggcggcgacccggacgcggccgaccgggtcgcggcggcctgcgcgggactgcagagcctggcgagcgccgtcgccgtcgagatccccgacagcgacggccggatgaagctggtcatcatcgagatcggcggcggctacttctacctgatgtccgcgggagccaacgcctacctcgccgtgctcgccgacatccgtaccgaacccggcatgatgagcgcccgcatgcgcgacctcgtggtgcgcatcggcgcccacctgaccagtccgccccggcacggtgggcagaccgtatgacgcctccgcgacgccagaggcgctttcccgcgcacgagccgccgcccccgaaacccgccaagcagggcgaggagaagaacccggagcggctgtacgtcgtcgccggcgcgggcgaggacggcgcccgtgccgccctcgacctggtcaccctcgtggtggcgcgcgccgaaccaccaccgtccgccacccccgagcaggcggcactgctgcggctgtgcaccgccccgctgtccgtggccgaactctcggcctacctcaacctgccgttcagcgcgatgacggtcctgatcaccgagctgctgacggccgaactggtacaggcgcgcgccccgatcgtgcgccaggcggtccccgaccgttccctcctcgaagcggtgatgcatggacttcaacggctctgacaccctccccggcccgcgcaccgaggaccatctgccgcacacggcccaggccgcggtgaagatcgtcatcgtcggcggtttcggggtcggcaagacgacgatggtcggctcggtcagcgagatcaggccgctgaccaccgaggagaccatgacccaggccggtatcggcgtcgacgacaactacggctccgagtccaagacggccaccaccgtggcgatggacttcggccgcatcagcatcaccgaccaactggtgctctacctcttcggcaccccgggccaggaacgcttctggttcctgtggaacgggctgttcgagggagcgctcggcgcggtcgtcctcgtcgacacccgccgcctggaggtcagcttcgacgtcatgggacggctggaggaacgcggtgtgcccttcgtggtggccatcaactccttcccggacgcgccccgttacccgatcgccgagctgcgcaccgcgctcgacctgtccgaggacatcccgatggtcgagtgcgacgtacggcggcgggcctccagccgggacgtgctgatgacgttgatgcgcttcctgcactccctagcgctggccggctcgcccacctgagccggacggcaccgccgcccctcccacttgccccccttcctgtcctttccgttccgaaagcgaccgctgtgacgcctgaaccccagcccctgaccggtccggacgaccgcaccgccgccccgccccccggctgccccgcgcacggcatcggcgccggcgggctgcaccggctccacgaggcgctcgacctcggtgacctctacgagcaactgcgcgagcagcacggcccggtggcccccgtgctgctgcacgacgacgtccccatgtgggtggtcctcggccacgccgagaacctgcacatggtgcgcacgccctcgcagttcacccgggacagccgcatctggacgccgctcaaggaggggatggtcaagcccgaccacccgctcatgccgcacatcgcctggcagcccatctgctcgcacgccgagggcgacgagcacaagcggctgcgcggcgcggtcaccgcctccatggccaccatcgaccaccgcggactgcgccgccacatcggccgcgccacccagcgcctggtcaaccggttctgcgagacgggccgcgccgacctggtcgaccagttcgccgagcacctgccgatggcggtgatgtgcgaagtcctcggcatgcccgaggagtacaacgaccggctcgtgcagagcgcccgcgacatgctcaagggcaccgagaccgcgatcgccagcaacgagtacatcatgggctgtctgcgacggctcgccgcccgccgccgcgcgcaggccgaggacgacttcaccagccacctcatcgccgacccggcgggcctgaacgacgacgaggtcggccagcacctgcgtctcgtgctcatcgccgcctacgaggccaccgcgaacctgctggccaacaccatccgccgggtcctcaccgacccgggcttccgcgcgcagctcaacggcggccagatgacggtgccggaggcggtcgagcagtccctgtgggacgagccgcccttcagcacgatcttcgcctacttcgccaaacaggacacggagctgggcggccggcgcatccgccgcggtgacggcctgctgctcggtatcgcgccgggcaacgtggacccgcgggtccggcccgacctggacgccgacatgcagggcaaccgctcccacctcgccttcagcggcgggccgcacgagtgcccggggcaggacatcggccgtgccatcgccgacgtgggcgtcgacaagctgctgatgcggctgccggacatccagctcgactgccccgaggaggagctgcgctggaccgagtcgatcgcctcgcagcacctggtggagctgccggtgcggttcacgccgcgtccgcagcaggacgtgctggcccagccgagccacaccccgatgccggtgccgcagccgcgcgccgcctgggagatcagcaccgtacggtccacgccgccggtgccgcctgccgagcccgtccccgccggtgccgcggccggtgaggcgacctccgc

SEQ ID NO: 1055 - DNA, 2894 bp, Unknown
  Kingdom: Bacteria, Phylum: Actinobacteria, Class: Actinobacteria, Order: Streptomycetales, Family: Streptomycetaceae, Genus: Streptomyces
gccggtgaggcgggccacctccgcctccacccacagcttcaggagccgctggtgcaggtcgtgggtgcgcagttcgggacgttcgcgccaggtcttcacgaccgggccgatcatgccgccctcgcggggcaggcgcatgccgccgatggagacgcgttcgttcatcagcgtggtctgcgcgacccgccagccgtcgccgacctcaccgaggcggtgggcgtccgggatgcggacgtcggtcaggaagacctcgttgaactcggcctcgccggtgatctggcgcagcggcctgacctcgacgccggggtcggtcatgtcgcacaggaagtagctgatgccctggtgtttgggcaggtcggggtcggtgcgggcgatgaggatggcccagcgggcgaggtgggcgctggaggtccacaccttctgcccgttgacgacccagtcccccgcgtcgtcgcggacggcgcgggtgccgagggcggccaggtcggacccggcgccgggctcgctgaacagctggcaccagacctcctcaccggtccacaggggccgcaggaagcgccgcttctgctcgtcggttccgtagcgcaggatggtcggggcggccatgccgaggccgatgccgatgcgccgcgggtcgttgtcgggggcgccggcggcttccagtccggcgtcgacgacggcctggagcgagcggggggcgccgaggccgccgaggccctcggggaagtgcacccaggccaggccggcgtcgaaccgggcccggaggaagtcgagccggtcggtgctccgcggcggatgcgccgcgagcagctcgcgggtgcggcggctcagtccgtccgcgtcgaggggactgccggcgtcgagggggctgccggtcatacggcggctccgttctccactgcgggcaccacggcgacgcgtccggtggtgagaccgtcggcgacgcgctgcacggcgtccgcggcggcgtccagcggcacccgctcgctgaccagcggcttgatcgcgccccgggcggcgagttcggtgagctgttcgtggcagtgctggacgagtttcgggttcttggtgttgtacaggccccagtgcaggccgaggatcgagtagttcttgacgagggcgtggttcagcgccgggctggggacggtcccgccggcgaagcccacgacgacgatcctgccctcgaaggcgacgaccttggcggactgcgcgtacgcctcgccgccgaccgggtcgtagaccacgtcggcgccccggccgccggtggcctccttgacggcggcgatgacgtcctcgcgccgccggtcgacgaccacgtcgcagccgagctcccgcgccacggcagccttggcggggccgccgacgacaccgatgacggtggcaccggccgccttgccgagctggacggccgcgctgccgacaccgccggccgcggcgtgcacgagcagggtctcaccggcctcgatacgggcccggcggtgcaggccgaaccagcccgtctggtagccgatgtgcagggccgcggcctcggcgtcgtcgagcgcctccggggcgggcagcagcgcggcggcgtcggcgacggcgtactcggcgaaaccgccgtagggcagggccgggttggcgaggaccctgcggccgtcctcggtctcgccgcagatctccacgccaggggtgaagggcagcggcggccggacctggtactggccgcggcacagcagggcgtccgggaagttgatgttggcggcccggaccgcgagcaggacctgaccgtcaccgggtacgggccggccggtctcctccaggcgcatcacctcgcccggctcgccgttctcgtgcactcgccatgcccgcatgcgccgcctccacaggtactgagtcaggaaccgcgtcctttgaccggcgtcgtcgtccggccggacgacggcatactaagcggtcgcttgccctaggggaacctctcaggggatctcacggaggaacctcacagaggaacctctcaggggaatctctcggggaaccctctcaggggaacagggaacttcagtcgccctcgccgcccgtgccgcgctgtgacggccgcgcccgtacgtgcatccgctctccctgcgggccgaacaggctcaggaactccaccggcccctcccccgtcgacccgaaccagtgcggcacgcgcgtgtcgaactccgccgcctcccccgccgagagcaccacgtcgtggtccccgagcacgatccgcagcttcccggagagcacgtacagccactcgtagccctcgtgggtccgcgggaccggttcctccttgcgctgcggttcgagcaccttgtacgcctgcagaccgcccggctgccgggtcaggggccagtgcgtgcgtcccccgcgcacgatcggcttggcgcgtacccggggatccccgaccggtggcgcgccgaccagctcgtcgagcggcacctgatgggcctgcgcgatcggcagcagcagctccaggctgggcttgcgcaggccggactccagccgcgagagggtgctgacggagatgccggtcgtctccgacagcgccgccagggtcacctcccgctccttgcggatccgccgcagtctcggtcccacgcccgccagtacgtcgtccgtcgtcatgacgccattgcagaatcagcaaacgcatttgtcaatccggcagggtgcgggcgaccgtcgtgcacgaggcgcgaggcgcgaggcgcgagacacaagacacgagacgcgtgcagcgcgagacgagacggaggtggtcaccgtgaccgggaccgaagcggcggtcggggccgacgggtacgaagacgggtacgaagtggtcgtcgtcgggggcggcgcggccgggctgtccgccgcgctggtgctcggccgggcccggccga

SEQ ID NO: 1056 - DNA, 1787 bp, Unknown
  Kingdom: Bacteria, Phylum: Actinobacteria, Class: Actinobacteria, Order: Streptomycetales, Family: Streptomycetaceae, Genus: Streptomyces
cctcggccgccgccacctgggagtctgcccgctgggccctgcgcagcaaggccgcggccagcaggccgccgagcagcaccgcgacggccccgaccagctggctggtcgacagccccgacgagtaggcgtccaggatccgctccttctcggccggcccgtgcgccgaggccagcgccgccggcagggaggtcgcggccaccggcaccagcgccgcgaaccgcgagctgagcaccgctcccagcacggccacgcccagcccgttgccgaactccgacagcgtgccgttgacgcccgcgccgacgcccgccttggccggcgggatcgcgctcatgatggcgtgcgccatggccgggccggcgaccgcggtaccggcgccgatcagcagcaggcccaggagcgtaccggcgtaaccgtgcccggcgagcgtggcgatcgacaccaggccgccggagagcagcaccatgcccagcaggatcgacaccggcgtaccgagccgcaccgtcgccttggccgccagccccgagaagttgaggaccacgaccgtgagggcgagcggcgcggtgcgcaggccggcctccagcgggccgtagccgagcacgaactgcaggtgctgggtgagcaggaacagcgagccgcccatgccgaaggcgatcagcaccgccccggagaccgcgcccgtgaagcggcggtcccggaagaagtgcatgtcgagcatcgggtacgggatccggctctcgtagaacgcgaaggcggccagcaccacgacggccacggccgccgtgaccagtacccgcgccgacgcccagccgtgcgcggggcccgagatgatcgcgtagaccagcgcggccatgccgatcgtggacagcagcgcgccgagcaggtcgggacggtcgccgcgcgggctcttggactcggggacgagggcgacggccgcgaccaggcccagtgccgcgaccggcaggttgaccaggaagatcgcgccccaccagaagtggtcgagcatgaacccgccgatcagcgggccggtggcgaagcccagcgcgctgaccgcgctccagatgccgatggccttgggatgctcctccggcgtgaagatctgcatcacgacggcgagcgtcgtggtcagcagcagcgcgccgccgacgcccatgcccgcgcgggcggcgatcagctgcgcggtggagtgagcgagtccggccgccagcgagccgaggccgaacagggccagtcctgcgatcagcatcttcttgcggccgtaccggtcggccgcgctgcccgcggtcagcagcagtccggactggacgagcgagtaggcgttgatcatccactggatgtcggaggtggccgcgtgcagctcgcgggtgagcgaggggatcgcgacgttcagcacggtgttgtcgagcagcacggtgagctgcgcgagacagatgacgcccaggatcagccagcgacgggagtggccctggggctgcggccgggtcggtgccccggtcaggtccggggaggcggttgacatgccatacagcgtagaacgcctcccgtacggtgtacaagaacatttccccgcgggtacgggtgaggggcggcggcctcgtcggccaccgcccctctgccttgcctctcggtctcttgcctctcggtctcttgcctctcggtctcttgcttctcggttctcttgcctctcggccgtcagctggtgctggtcttctgggtcaggtcgtagaaggtggccgaaccggccgtgaccttcttgaagttcttctcgacccaggaggctgtctctttta

SEQ ID NO: 1057 - DNA, 769 bp, Unknown
  Kingdom: Bacteria, Phylum: Actinobacteria, Class: Actinobacteria, Order: Streptomycetales, Family: Streptomycetaceae, Genus: Streptomyces
ccgggcctgcgccgcgaggaggtcgcgcacctctcggcggtcggcgtcacctggtacacctggctcgaacaggcccgcgacatccaggtctccgcgcaggtcctggacgcgctcgcccgcaccctgctgctcgaccccagcgagcgcgcccacctcttccagctcgccggtgccaccgacccggcgccgacgaccacgtgcccctcggtcaccccggccctgcgggccctgctggaacagatcgagccctacccggcctgcctgcagaacagcaggtacgacatcctcgcccacaaccgcacctacggcctgctcctgtgcgacctggaggcggtgccgcccgaggaccgcaactgcatgatcctgtcctacacgaacccgcagtggcggtcctcgatcgtgcacctggaggaggtgacccggaccatggccgcccggttccgcgccgcgatggccggccacctcgcggagcccgcctggaagacgctgctcaagcggctgcgcgactcgtcgccggacttccaggaggcctgggaccggcacgaggtggtcgccccgaccagcaagcgcaaggagttccgcaacgcctacgtcggccgcctcaccgtcgaccacaccgacctgtggctcagccccggggtgggcccgccgtgcagctacgcctgcgcctgccgctccagcgcgatggcgtgcagtttctccagccgctgccgcgtctcctcgtccgccgggacgtacgtcaccatgcgcgggcccaccccggggctga

SEQ ID NO: 1058 - DNA, 3268 bp, Unknown
  Kingdom: Bacteria, Phylum: Actinobacteria, Class: Actinobacteria, Order: Streptomycetales, Family: Streptomycetaceae, Genus: Streptomyces
gcccaggccgagcgcctgggcggcggccgcgaggacctccgaggaggcctccttgcggccgcgctcgatctccgacaggtagggcatggagatccgtgccgcctcggcgacgtccttgagcgtccgctcctgggcgagccgttcgcggcgcaggacgtcgccgacgaggtcacgccagaggggttcgcggacggtgacgggggcggccggggctggacggtccggcgccgggcggcccggggatgcgtgcccttggggtctccgggcttgcggggagtgggcggacgctgggcgcgcggcctgcgggcgcagcgggatgacgcgggcgtggttcggcgcttggttgctcacttcttcagcctaggagtcgtgcgcgcccgcgccagagcgcggcattccgccctgggcgaagcacccaagcacaccaactgggcggtcacccactaccccttcgtgctcccgccgaagctcgctcgtctgatcgacgatcaccctcagccccagcacgccccggaacagcaccacggctgggcgaaggtacctcgtgcctggacaaagccctgggcgcccgcgtaactccctctacctcgccgccgcattgagacaccacggtccgcccgcccgcgcggcacggaacaccgccatgacggacgccttggccgacctgccgcccatggtcatcgccgacctgctcgcatccaccccgagacagccgaacgccgggccaccctcgccagcggaaaccggtccgcatacttgactgtgcgacgggccgcaccgcagggtcagggtctgtccggcggatcttgtccggctcgtgtattcgccctcgttcgcgccgctgtcagaagcctcggctagctttcacggcatggaatccgccttccttctctctcacctgcgccacgaactcgatgcgttccgggcctgcttggcaggcgacttgtctgcctccgtcgagcactgcggcgactggtcgctgcacgatctggccgagcacttgggcagctcgaacctgtgggcggcgacggccgtgaccgagaagcacggtcgtcacacggctgcgccggcaccacgagatccggctgagctggcccggtggttcgatgagacgtccgcgacgttgctggacgcgctggacacggacccgtcgaccgaagcctggacgttccaccctccgtccacggtcgcgttctggcaacgtcgtcgttgcttggaggcgctcgtgcacaggtgggatgccgagcacgcgctcggcacaacccgccccctcgacgcggaactggccgcagagggcgtggccgaggtgttcgacacgatggcaccgcgtcagatagcacgcggccgcgcgagcttgccccggttcgcgcttcgtcttgacgccaccgacaccggagcctcgtggacctacggtccaggcgtccccgtcgccgcggtctccgccaccgcggaacaactcctgctcctgctctggggccgtgccttgagcaccgatgaggcatttgtgtgggagggcgaccggcaggccggccaaggcgtcctggacgcccccttggtggcgtgagtcgttcgcgagccggtcatccccgaagccggagccggagccggaccgcggcgagggtgacggtgccgtgaaagacgtaggcactcttgccctgtcccgtggcgaaggcgcgggagtgcttcaacgcgttgagcgtccgctcgaccccgttcctgctcttgtagaccgtcacgtcttttccggcacccgtaagcggtcagcgcgcacacgcgagccgcgcagggccacatccaaggcaagatcgtgctgacggtggtctcgtgatcgccgaactccagcaggcggtggcgaactacgcccatgccttggacgagctgaatacgccccagctggaagcggtcctgaccgaggacaccgcgtggacctggccgggcacagggagatgatcagccggtcgaaccggaacgggctaaaagggatgaaaccggcgcggacagaaggggacgcacccggcgcccggttccgtcagtcacgtccgaggtgcaccacggcacgtacccgcttgcccaccgggacccgttccgcgccgacctcggccgcgagcgcgtggacgatctccaggccgtgccgcccgatccgttcgggatcgcgcgggaagcgcagcggcagtgcgacgctgctgtcgtacacgcagacgctcacctcgccgtccgtgccctccagttcgaggatgtacggtccctggctgtgccggtcggcgttggtgaccagttcgctcacgaccaggagcagggcctcttcggagcggctgccgatctcggcgcaccactcggtcctgagccggtcgaggaagtgcgcggcgaacgaacgcgcgtcggcgatgcagccgggttcaccggtgtagtgggtcgcacgccgcagcggctgtacggggatgtcgacaccagtgggtatcactgccccgcccgggtcatcgatcatgcgtttctctctcggaagccggtacgaccggacgctactgcatcagtgctgttacccactggcacggccgccagtcccccgtgggcaggacggtgcggagggggcgtgccggcggccggtgcgcgtgcggggcggcgtggcgctgcttagcgtgacagcgtgagcccaccgcgtccgtccacctcgccggctaccgccgccctgcgccgctgggcgcaggccctcgccacggtgctggccgccatggtcgtcatgtatgtggtcgccgcgctgggtctgtgggcggccggggcggcggacctgcccgacaacgcctttccccgggtggccgccgccaccgtggtgaccgcggtcggcgggagcatgcgactggcgggcaacgcgggggtgctggccgagacgcacgccggtgtcacggtgatgccgttgtcggtctcgctcgccggtgcgctcgtggtcggcgccggcttcctgcgtcccctgcggcaccgggcggtggccggggcgcgggagttgagcgggtgggccgtgcggatcgccgtgctgtggctggcggcgctgaccgggctggcgttcgccgcccgtcagcggttcgccgtcgacctgggtgacggcgtgctcggcgccatcggcgggctcttcggcgccgaaccggaggtcggcttcaccacggaggtggggcagagcgtcggtttcgggctgctgtggctggtgggggtgctggcgctggccctgttgtcggcccggacggcggcggtgccggcgcgcctgccgtggatcggg

SEQ ID NO: 1059 - DNA, 7048 bp, Unknown
  Kingdom: Bacteria, Phylum: Actinobacteria, Class: Actinobacteria, Order: Streptomycetales, Family: Streptomycetaceae, Genus: Streptomyces
cggcggcggtgcaggcacgcctcccgcacccgtccgccccggcgccggccggcggtccgcaagagctgacggcaccggccgggctcgcccgcggcgcccgccgccgaggacgagcacgacgcgctgctgcgacggctgcgggagctgggcgagctgcaccgcgaaggcgtgctgaccggcgaggagttcgcgttggccaagcaggcggtcctcaagcgcatgtgagaaccgccgctcccctcccccggggctacttggcccggcgggacaccgtgaagtggtcgacctgcgcgccggtctcggcgatgccgcgcacggtcagcgtggcctggcggccccgagcggccggggtgacgtccacgcgcaggaaggagtagtcgaggtagcgcacgcgcgaccagtcggcggtctccttctgccggacgccgtcccccaggcacacgaacgacgagacggcgtcgatgtccttctcgtggccctcgtaggtctggtcggcgctgaaggcgtacaggctcttgccggccgcgccggcggtgacgtagacgacgccgtcggtctcggggtaggcggtgccgccgatcggcagcttcttggtgacctggccgcccttgagcacgtcggtgcgctcgtagacgtggttgtggccgttgatgaccaggtccacggtgtacttctcgaacagcggcacccactcctggcgtacgcccccttcggaggcgtgcgcggtggaggtgcagtaggcgcagtggtggaagaagacgacgatgaagtcgacgtcgcgggcggcccggtacctcttcagctgggtctccagccacttggtctgggtgccgccggagatgccgaggttggccgggatctcgaaggagatgtcgttggcgtccagcgagatgacggcggtgttgccgtagacgaaggagtagacgcccggcaggttctcggcgtcggggccgttgtccgggagggtccagcgggcttcctcgccgccgtagccgttgggcgagtaccaggcctccatgtcgtggttgccgtacgagaccatccacgggacctgcttggcgacggactcggtctggtacaggaactggtcccagacgcgggagtcgaagccgctgtcgctggtcttgccctgcccggccgggtcgccgtaggcgatgtcgcccgcgtgcaggtggaaggccgggtcctggccgaggatcagcgcgtcgttggccaggccgtggtagctgacgccctggtcgccgaaggcggtgaaggtgaacggcgccttgtccgcgggggcggtggtgaaggtgccgagggtgccggtcaggtggcgctcggccgggtcgaagccctggtggccgacgccgtagtagtaggtgcggccggggcgcaggtgggtgagcttggcgtgcaggtagtactgggtgcggtcgccgctcgcgccgacaccggccggggtgtacagggtgcggacctcggcgggtatcttccgcgacaggtcccaggggtgcgcgccgacgcggatgaacggcttcctgacggcgaccgggacctgccaggagacggtgatctcggtgcgcgggtcgttgccgaaggcgaggtggcggccgaagggggcgaccagggcaccgtcgaccgcgttcgccgaggaggcgggggccgtggtggcggcggtgcgctgggcgggcacggcggcctgcgcggcggtgcccgtcacgaacgcgccacccgctacggcaccgagggtgaccgcgccgcctcggatcatcgtgcgccgcgagaaccgggaacgcaggtactcgtgctgctcggccatgctcatgcgctcggccagcttctcgggtacgcccatgcgaggaatgtccatggggtctgaaaatggccgaccggtgcgaccgctcgcgggacgccgggtggacggcgtacgaacagcgcctcaccagcagctgaacaggcgcttgcccgaaatcgggcaggattcttgcgaaagtgatcgcggtaccccaggatctaccgggtgcacgacgaactggttgatcatctgacgcggtccacgcccctgaaccggggcgaggcactgcgggtgatccaggacgtgctcgcctggttcgacgagacgaccgaggagttcgtccgtcgccgccaccgcgaactgcaggcacagggcctggtgaacgcggagatcttcgaacggatcgcggcggagctgaagtaccgcgcggtggcgccgccggagctgtcactgcggcagctgcggcgcatcgtctacggctgaggccggcggcggtactgggacagcaccgacggcagtatcaacagcagcgtcaactcggggaaaagggacgggacttgtatgtgcggaatcgtcggatacatcgggaagcgtgacgtcgccccgctgctcctggagggcctgcagcgcctggagtaccgcggctacgactccgcgggcatcgtcgtcacctcgccgaagaccccgggcctgcggatggtcaaggccaagggccgggtccgcgacctggaggcgaaggtcccggcgcgcttcaagggcaccgccggcatcgcccacacccgctgggccacccacggcgccccctccgacgtcaacgcccacccgcacatgtcggccgacaacaaggtcgccgtcgtgcacaacggcatcatcgacaacgccgccgacctgcgccgcaagctggaggcggacggcgtggagttcctctccgagaccgacaccgaggtcctcgtccacctcatcgcccgctcggaggccgagaagctggaggacagggtccgcgagaccctgcgcctgatcgagggcacctacggcatcgccgtcatgcacgccgacttccccgaccgcatcgtggtggcccgcaacggctccccggtcgtcctcggcatcggcgagaaggagatgttcgtcgcctcggacatcgccgcgctggtcgcccacacccggcagatagtcaccctcgacgacggcgagatggccaccctcaaggccgacgacttccgtacgtacaccacggagggcacccggaccaccgccgagccgaccaccgtggagtgggaggcggcctcctacgacatgggcggccacgacacctacatgcacaaggagatccacgagcaggccgaggccgtggaccgggtgctgcgcggccggatcgacgaccggttcgccaccgtgcacctgggcggcatcaacctggacgcccgtgaggcgcgcgcggtgcgccgggtgaagatcctcggctgcggcacctcgtaccacgcgggcatgatcggcgcccagatgatcgaggagctggcccgcatccccgccgacgccgagcccgcctccgagttccgctaccgcaacgcggtcgtggaccccgacaccctgtacatcgcggtctcgcagtccggtgagacctacgacgtgctggcggccgtgcaggagctgaagcgcaagggcgcgcgggtcctcggtgtcgtcaacgtggtcggctcggccatcgcccgcgaggcggacggcggcatctacgtgcacgccgggccggaggtctgcgtcgtctccaccaagtgcttcaccaacacctgtgtcgccttcgcgctgctcgccctgcacctcgggcgcatccgcgacctgtcggtgcgcgacggcaagcggatcatcgaaggcctgcggaagctgccggagcagatctcccagatcatgaagcaggaggcggagatcgaggagctggccaagggctacgccgacgcccgctcgatgctcttcatcggccgcgtccggggctacccggtggcccgcgaggcctccctgaagctcaaggaggtctcctacatccacgccgaggcctacccggcctccgagctgaagcacggtccgctggccctgatcgagcccgcgctgcccacggtggcgatcgtgccggacgacgacctgctggagaagaaccgcgcggccatggaggagatcaaggcccgcagcggcaagatcctcgccgtcgcccaccaggagcaggagaaggccgaccagacgatcgtcgtgccgaagaacgaggacgagctggacccgatcctcatgggcatccccctccaactcctctcctaccacacggccttggccctcggccgcgacatcgacaagccgcggaacctcgcgaagtcggtgacggtggagtaagcgaccccgagggggcgccccgcaggggcgcggggccgcacagacgcgcggccccgccgcgtgggcgcgaccggcccccacgcacccgcagcggccggacaacgcgaaacggccccccacgtgctgccacagccacgtggggggccgccccgactccggggaggaaatccgccccaactcgcgcagctaccccgcgacgggcgctccccgcccggcagcgcgtcgcggcagcgacgtgggccagtgcgcgagcgcggccgtcgccgcgtaccagaccgccgctcccgccgccacggcgaaccagccgcccgccttcgccagggcgccgttgtccgcgaagcgcgcgacggccagcagcaccagggagacgaggaagagcccgtagccggcctgggtgagcgggtcgccgcccgccagggtgagggtgaggaccaccgcggcgaacagcaccaggaagagccccgaaccgttggcggagaccgggccgcccgacgagagcgcccaggtgaaccagagggcgccgagtgcggtgaacgccgtaccggagccggtgtcgcggtcgtggaaggccagcagtccgacgacgaacagcgccacgccgcccacgtagtgagcgaccgtcacggcgtcgtcggccgtgactccgtggacgaccctcgtgtacccgaggccgaaggccatcagggtgacgaagagggcgagtcgtccggcgatcgtggtggtggtgcttcccgcagagacgtcgttggccacggcgggctcccttcatgcctgtgcagttgtacggtgaccggtatatgcccttcacaaaggcacaaacactctctacgcacgggtaatgtgcgtcgacccaagggagtcaagggagttgacggttgggccgatgggccgaggggagccggggcgtcagggaatgacgacgaccggccgctgcgcccgcttggccagccggccggccacggacccgaagatgcggcccacgatgccgtgcgtggagccgacgacgatggcgtccgccgcgtactccttgccgacctcttccagttcgtggcagatgtcgccgccgcgctcgaccaggatccagggcacctcggtgaggtactccgcgcacgcgagttccaggccgaggacctcggtgcggtggtccggcacgtccacgaagaccgggggttcgcagcccgcccagacggtggtcggcagccggttggccacatgcacgatgatcagaccggaccgggtgcggtgcgccatcccgatcgcgtaggcgagggctcgctcgctggagtccgatccgtcgaagccgacgacgacgccgtgcttgaacgccggatcgcagggatggcgtagctcttgtgccgccaggggttcggccgccgtggggtcggcgaccggccgcttgcggtccgcgtgttcgaagaattcgtgaccggccatggctgtctcggcgatgtgatcctttgtcggggacggcaatctgcggcggagctgtgtccgggaatcgtcttcccgtccccatacccgcaagggtacggccgcactcctccttggcccagatcccgcacactctccgtggcggttcaccggagcatgcacgaccgccgcccgtaacgcaatggttgctgccccgtacaggcggtttgcacaggatccacttgccccggccctacgcggacccgtatggccggtgccccgcacccggccgggagccgccgtaccggtggcctccggctccgtacagtgaccggtggatcgaacacgcgttgaacccgtcgagccaccgccgcagggagcaccgtagggagcacgccgttgtccggaccccgtaccgtccccgggaggcactccgcgccgccgcacgccccagggccggtgtccgactcgcccggctcgcccggcacgtccggcgggacaccggcggggccgggcggccgggcgggagccgccagcgacagtgcgggcgacgtggtccgctgggccgtcttcagctgcgccctcgtcccggtggtcctgctctggtacggcacctcgccggccggcgccgtcggcaccgcgctgggcctggcggccgtcaccggggtctgccgggtgctgctgcgccagtccgagcgcggggcggcccggctgcgcgccgaggagcgggcaccgcaccgcggccggcaccagcggacgggcacgggcacgcaccggggcggccggcaccccgggtgaacgacaccggtcaactgaccggtttccgcgcacgtgaacgtagcttttcagccaacttcctgaacgcgcgcatcccccggtccgccaccccctcaacccacgtttgacctgcacggaaaggctctcgggggcagtgcgcaccctacggggattggccaccgccacaaggcgcacttccctgcacgccgtgggagtgcaacgcttcgtgatcgaatgcttcacgccaagttgccatgtcgacaatgtgccgggtgtcgaactggtcaccgcggcacggcgggacacagtagattcgatcttgactgtcttacggcgggggactcgtgcaggaccgaggggaaacgtgcaggagcgacacaaccgaggagccgcgaccaccgaggggggcttagcagtatgagccacgactccactgccgcgccggaaaacgcggcccggaagctgtccgggcgccgccgcaaggagatcgtcgcggtgctgctgttcagcggcggccccatcttcgagagttccataccgctctcggtgttcggaatcgaccgccaggacgccggagtaccgcgctaccgcctgctggtggcggccggcgaggaaggcccgctgcggaccacagggggcctggagctcaccgcgccgcatggcctggaggcgatctcccgggcgggcaccgtcgtcgtgcccgcc

SEQ ID NO: 1060 - DNA, 2375 bp, Unknown
  Kingdom: Bacteria, Phylum: Actinobacteria, Class: Actinobacteria, Order: Streptomycetales, Family: Streptomycetaceae, Genus: Streptomyces
ccgccgcaccttcgcgggcggcccgcgtgccgtacgcaacgccgccgcgccgcaggccgcgctgggccatgcgggcggcgatcacggtctccgtggtggtgctcgcctccgccgggatcggacacgcggtggtctccagcctggacgccgacatcgcccgggtcgaccccttcaaggacatgaagaaccggccgccggcgggccacggcatgaacgtgctgctggtcggcaccgacggccgcgacaagatcagcgagcaggagcggcagcgttaccggctcggcggccagccctgccactgcaccgacacgatgatgatcgtgcacctctcgcaggaccgggaacgggccagcgtcgtcagcctgccccgcgactcctacgtcgacctgcccgcccacgtcgaccagaacaccggcaagcagcacccgccgcacccggtcaagctgaacgcggcgtacgcggagggcggcccgaacctcaccgtgcgcacggtcgagagcatgacccacctgaagatcgaccactacctggaggtggacttcaccaccttcatgcggaccgtggacgtcctcggcggcgtggagatctgcaccgcgctcccgatgaaggacgccttcaccggcctggacctgcccgccggcgtccacaccctcaccggcggccaggcgctgcagtacgtccgctcccggcacatcgacggggccagcgacttcggcaggatgaaacgccagcagctcttcctggccgcgctgatcgagcgggcgacctcctcgcgggtgctgctgaaccccatgaagttccgggacgtgacccgggccgtgctcggctcggtccgggccgaccagggcttccacaccgacgaactgctcgacctcggccgggcgatgcggaacttctcgccgtcctcgtccgagttcaccaccgtcccggtcgcccagacctccttccccgtcaagggactcggctcgaccgtgaaatgggaccaggcgcaggcggaccggctcttccgcacactgcgcgacgaccgtccgctggccgtgcgcaaaccggcccgcaagccggacggcacggccgccgtggaggtaccgccgcagcggatccgggtccaggtggagaacggcaccggcacggcggggctcgcccggcgggtggacaccgcgctggccggtgccgggttcagcaccaccaaggcgcccgtcgacgcgaaggaacgcggagtgaagcggacagtcgtgctctacgacccccggtgggaccgctcggccaggtcgctcgccgccgcactgccgggcagcgagctgcggtccgtacccgcgcagggcgccacgctgcgggtgatcgccggcagcgacttccgcgaggtccggaaagtgcgcgtgcggaccacggcgcagaacgccaacgaggtggtacgcggcgaccaggtggcgtgcgactgagcgcgaggtcctgagaccggccggggccgcggctccggctcagtcctcgaagccctctgccgcccgctgctcccgcagctccttgatggcgcggcggcgggccagacggtgggtccggcggatctgggcctcctggtagcggcgcttgtcctgttccgtctcgggcagcaccggcggcaccgcgcggggcttgccgtccgcgtccacggcggcgaagacgaggtaggcggagccgacctgggtggccggggcggactcgttccagcgttcggcgagcactcggacgcctacctccatggaggtccggccggtccagttgacctgggctttcacatggaccagatcaccgacgcggaccggttcgaggaacgccatctcgtccatggacgcggtgacggcgggaccgccgctgtgccgtccggccaccgcgcccgcggcgtcgtcgaccagcttcatgatcaccccgccgtgcaccgtacccaggaggttggtgtcgctgtgggtcatgatgtggctgagggtggtgcgggacgccgatgtcggcttgcccggtatctccggggtgccggattccgcgacggtggcctggtctgtcatgggctccaccttatgccgcgtcgacatcgggggaatttgtgtcagcttggcaacagccgtgaccttattttccgacggcccttgtaaggcacaccccgcggcccggcacactgggccacatgaatgattggcccgaggagtggtccgacgacaaccgcggacccggttacggacgcggcagcgccggcgcgcagccggagggcgcacgggtgatgcgccaggtgcggcgcggcggcccggacgcgcccgggctggcccgccgggtgcagcgcggagccgcccggtcggtcgacgcggcctgggtggcggcggtcggccaggacgtctggtacccgggca

SEQ ID NO: 1061 - DNA, 1427 bp, Unknown
  Kingdom: Bacteria, Phylum: Actinobacteria, Class: Actinobacteria, Order: Streptomycetales, Family: Streptomycetaceae, Genus: Streptomyces
ggcctggagggtccacacggccgggttctccgcgaggtcctcgtgcaggtcgcacaggtcggcgatcaggtcgtgcaggaagtcgcgtgcctcgcggcgcagttcggcgtgggagaaggagagcgggggctcgtcggccggcatccagtcggcctcgacgtccacccagccgaagcggcgttcgaagagcatgcggtcggtggactcggtgaagtccagttccgcccgctgcggccgggccgcccgggagccggccgggtcccggtccacctgttccacgatgtcgcacagcgcccacgcgaagtcgagtaccggcacccagccccaggacgtggccagctcccggtccgacttggtgtccgccaggtagacgtcgccgcagaacaggtcgtggcgcagggcgtggacgtccgcccgccggtagtcggtctgcggagggtcggggaagcggttggagagggcgtagccgatgtcgagcacgtaggggatggtgtcacggccgccgcataagatcgcacccgtgtcccgaacagcactgtttgtccgagccgccggtgcgttactgctgtgcgccctcccgctgaccgcctgcgacggcggcgtccacggccgtccgggtggctacggcctgcgcgacccgtacttccccagggcgggcaacggcgggtacgacgtgacccactacgacctcaccctcgcctacgacccggaccaccgcagcctcaccggcacggccgtcgtcaccgcccgtgccaccgaggacctgtccgccttcgacctcgacctgcaggggatggaggtggggagcgtgagcgtcgaggggaaggacgcccgtttccaccgggccggccaggagctgaccgtccggccgcacgacgacctggacaagggggagaccttcagcaccacggtccgctactccggcaccccgcgcaccctcaccgaaggcgacgggtcgaaggagggctggctgcccacggccgacggcgccgtgaccctcggcgagccggtgggctccatggcctggttcccgggcaacgaccatccctccgacaaggccacctacgacatctccgtcaccgtgcccgcgaaccggaagctgaccgccgtctccaacggcgagctgaggagcacgaccaccagcggcggccggacgacgttccactggcacaccggcgagccgatggcgacctacctcgccacggtcgcgatcggcgagttcgacgtgcggcgctccacgctgaagagcggcctgccggtgtacacggccgtcgaccccgcgctggcccggacgagcgacccggtgctcgcgcggctgcccgagatcacggagtgggcggagtacaacttcggcccgtaccccttctcctccaccggggtgatcgtcgaccgcgtccccggcgtcggctacgccctggagacccaga

SEQ ID NO: 1062 - DNA, 3050 bp, Unknown
  Kingdom: Bacteria, Phylum: Actinobacteria, Class: Actinobacteria, Order: Streptomycetales, Family: Streptomycetaceae, Genus: Streptomyces
ccagggcctgatcgcccgcgcgctgcgcgaccccgcccccgggctcgcctggctgctgccggccctcgcggtggccgccgcgggcctctggctggcccgccgggcacccgaggagcggtggggtgtcctgctgaccgccttcaccgcgctgctggtctcaccgatcagctggtcccaccactgggtgtggtgcgtcccgctgaccgccgtgctcctggccgagggtcaccgcgcctgggcagcgctcaccgcggccgtcttcacggcccgcacgctgtggctcgtgccgcacgcgggcgacctggacctgcgcctgccgtggtggcagcagccgctcgccgcgccctaccccctcctggggctggccctgctgacggcggtcgccctgggacgtctcggacgggccggcgaagaccccgccccggtcaggcttccccggccagcagctcgtccgcgtccatgatccggtaggcgtagccctgttcggccaggaaacgctggcggtgcgcggcgaagtcctggtcgatcgtgtcgcgggcgaccaccgagtagaagtgggcctggtgcccgtcggccttggggcgcagcacgcggcccaggcgctgggcctcctcctggcgggagccgaaggtgcccgagacctggatcgcgaccgtcgcctccggcaggtcgatggagaagttcgccaccttcgacaccacgagcacgttgatctcgccctcgcggaaggcgtcgaagagcttctcccgctgggcgttggacgtctcgcccttgatgaccggcgcgttcaggtgctcgcccagttcgtcgagctggtcgatgtactggccgatcacgaggatctgctgcccggcgaagcggcgcacgatcgcctccgtgaccttccgcttggtcgcggtggtggcacagaagcggtacttctcctcggtctcggcggtggcgtaggcgagccgctcggagtcggtcaggttcaccctgacctcgacgcagtcggcgggcgcgatgtagccctgcgcctcgatctccttccagggcgcgtcgaaccgcttcgggccgatcagggagaacacgtcggactcgcggccgtcctcgcgcaccagcgtcgcggtcagcccgagccgccgtcgggcctgcagatcggcggtgaacttgaagaccggcgcgggcagcaggtgcacctcgtcgtagacgatcagcccccagtcccgggagtcgaacagctccaggtgggggtagacacccttccgtttggtggtgaggacttggtacgtggcgatggtgaccggccggatctccttcttcgtcccgctgtactcgccgatctcgtcctcggtcagcgaggtccgcttcaccagctcgtgcttccactgccgggcggagacggtgttggtgacgaggatcagcgtggtggacttggcctgcgccatcgagcccgcgccgaccagggtcttgccggccccgcagggcaggacgacgacaccgctgccgccgtgccagaagttctccacggcctgcttctggtagggccgcagcgtccagccgtcctcggccagctcgatcgggtgcgcctcgccgtcgacgtacccggccaggtcctccgccggccagcccagcttcagcagcgtctgcttgatctgcccgcgctcggaggggtgcacggccacggtgtccgcgtcgatgcgggtcccgaccagcggggcgatccgcttggacttcaggacctcctccagcaccggccggtccgtcgtggtcagcaccaggccgtgcgccgggtgcttgctgagggtcagccgtccgtagcggtccatcgtctcggcgatgtcgacgagcagcgcgtgcggtaccgggtagcggctgtactgcaccagcgcgtccaccacctgctcggcgtcgtgacccgccgcccgcgcgttccacaggcccagcggcgtcacccggtaggtgtggatgtgctcgggcgcccgctccagctcggcgaagggcgcgatggcgcgacggcagtcgtcggcctgctcgtggtcgacttccaggagcagggttttgtcggactggacgatcaacggaccattcacgcgcggcaccctttcgctgacgcggccggacggctcggccaaaactccagtgtgcaccaccggccgcgcgggccggacccctcagccggcgtcctgctccagctccgccaccccggtgatccggtgcagggggtaggtgcgcacctcgtccgccgtgtggtcgtacgccgtcacgaagccgccctcgacgcggatgggcgcgatgacgtgctgaccggcggtgccctcggcgttgacgtagccgatccacagggcctcgccggtgaggacggcggcctgcatggtggccagggtctccgcggagctggtgcggggcaggtcgccgtcggccgcgggcgtcgcggtcggcttgcgcggcgcggtggaggccaggtcaccggcgcggatcgcgcgtacggccgccgacagcagcgtggcatcgggcgcgggcggaccgtcggggaccggctcgggggcggtgcgcggcggggtgcggtgggaatcggcgcgggcgatcaggacgtcgccctcggcggactcggccgccggggcgtagcccatcgcgcgcaggccgtccaggagagtggccgggtcggccggggtggccagcacggtcggggcgaggcggcgcaggcgcagccccgcggagcgcttgtcggcgaggatctcgttcagcagcgcgtcgtcgtcgcaccgcacgtaggccgacgcgacgccgacccgcaggtggccgtggcgccgggccacgtcgtcgatcaggtaggcgagcggttgcgggaccggcgtacgggagtgctgggcgaggaaggcgtgcaggtcggaggcggtgcggccggcgtccagggcgcgtcgcaccgaggccggcgtgaaccggtagaccgtggcgccgcccttggactccacgttcgcgagcacgctcagcacctcggccagcggccgttgcagcggaccgggcgccaccgccgtcaggtccgcctggaggaggacgtggtccagcgg

SEQ ID NO: 1063 - DNA, 3470 bp, Unknown
  Kingdom: Bacteria, Phylum: Actinobacteria, Class: Actinobacteria, Order: Streptomycetales, Family: Streptomycetaceae, Genus: Streptomyces
actcggggtcctccgcctcgtagccgagagcctgccacaccgcctccgcgacccggcggtgcccctcgtccgtcagatgcagccggtccacgccccacaggcgcgggtcggcgagcgacggcgccccgtacaggtcgacgacgaccgcgccgtgcttcgcggccagctcgtccacgcaggcgtacagctcctccatgcgcggccggaaccgctccaggacggggccgctgcggcccgggctgcgcatcagcaccagctgccggcacgacggcgccagccgctccaccgcctgcgtcagcagcccgcgcacccggcccatgtcgcacttgggccgcagggtgtcgttcagcccgccgaccagggtgacgacgtcggcccgcatggccgccgccacctcgatctgctcgtcgacgatctgcccgatgagcttgccgcgcacggcgaggttggcgtaccggaagccgggggcgcgggccgccatccgggccgccagcaggtcggcccagccccggtaggagccgtcgggcagcaggtccgacatgccctcggtgaaggagtcgccgaccgcgaccaggctggagtaaggggggttcgtctgcatggcgtgagcgatggtaacccgccgccgcgcacgcataccaagcggtcggtcccgctccggccgcccggtcccggccccgctccttcctcaaggagtctccctcgcgccttcctcggggctccttcctcagacccgctgcccgaacagctcccgcagcacgtcctccatcgtcaccagcccggccagccgcccgtccgtgcccagcacggccgcgaggtgcgtccggctgccgcgcatggcggtgagcacgtcgtccagcggggtgctctccctgacccgggcgatggggcgcatgtcgcgcggccggaacggctcggtgcgaggcgaggcgtccagggcgtccttcacatgcaggtagccgatgatccggcgctgctcgtcgaccaccgggaagcgggagaagccggactcggccgacagccgctccaactgctccggggtgacgccgagacgggcgtagaccacccgctccagcggcagtacgacgtcgcgcaccggccggctgcccagctccagcgcgtcgtgcagccgttcctgcgcccggtcgtcgatgaggccggcctcgctggcgtccttgacgatctcggccagctccgtgtccgtgaaggtggccgagacctcgttcttggcctccacccgcaacagcttgagcagcccgttggcgaacgtgttcaccgtgaagatcaccggccgcagtgcgcgggagagcgcgaccagcggcggaccgagcagcagcgcgctgtgcaccggctccgcgagcgcgacgttcttcggcaccatctcgccgagcagcatgtgcagatacgtcgccagcgccagcgcgatgacgaacgacaccgcgtggcccgcgccggccggcaccccgaccgcgtggaacaccggctccagcaggtgcgcgatcgccggttcggcgacgacgccgaggaccagcgtgcacagggtgatgccgagctgggccgccgcgagcagtgcggacacgtgctccaggccccacagcacgctccgggcgcgccggtcgtcctccccgccttcctcgacgtactgctcgatctggctgcggcgcaccgagatcagcgcgaactcggcgcccacgaagaaggcgttgacgaccagggtcgccaggccgatcaggatctgtactgcggtcaccggccggccctcttcccgtcgctcaggtgcttgcccgggtgcccggcgcgcgccgcggaggcggtgtggccggtgtcgccgagcggcgcgtgcagcagcacgcgggccgcgcggcgcccgctcgcgtcgacgacgtccagccgccagccggcgacgtccaggacgtcgcccgtctccggtatccggcccagttccgcggcgaccagaccggccagggtctcgtagggcccgtcgggcacccgccagcccacgcgggccagctggtccacccgggccgagccgtcggccgagtacagggcgcggccctccgtgtcggcgccggccggggcgaggtcgggtgtctcgtgcgggtcgtgttcgtcgcggacctcgccgacgacctcctcgacgatgtcctccagggtcgccaccccggcggtgccgccgtactcgtcgatgacgaccgccatcgtccgcctgccggacagccggtccaggagccggtcgacggtcagcgactcggggacgagcatcggttcgcgcatgatctcggagacccgcagatgggtgcggcgctcggcgggcaccgcgaggacgtccttgacgtgggccgtgcccaccaccgagtccaggtttccgcggtacaccgggaagcgggacaggccggtcgcccgggtcgcgttcgccacgtcctcgcaggtcgcctgggcctccagggcgacgacctggacccgcggcgtcatcacgttctccgcggtgaggtcggcgaggttgagggtgcggacgaacagctcggcggtgtccgcctccagggcgccctgcttggccgagtgccgggccagcgccgccagttcctgcgggccgcgcgccgaggccagttcctcggcgggctccacgccgagccggcgcaccacacggttcgccgtgctgttgagatgggtgatgaacgggcggaaggcgccgctgaaccagcgctgcggggtggcgacgtgccgggccaccgcgagcggtgaggagatcgcccagttcttgggcaccagttcgcccacgaccatcaggaacacggtggaaagggcggtgcccacgaccagcgccacggtggtcgcgacggaccgcgagacgccgagcgactggagcggtcccgcgaggagcttggcgatcgagggctcggcgagcatgccgacgaccaggttggtgacggtgatgccgagttgcgcgccggacagctggaacgtcaggttccgtacggccttgagggcaccggcggccccgcgctcaccgcgctcggccgcccgttccagcatgccgcggtcgacggtggtgagcgagaactcggccgcgacgaacgcgccgcagaccagcgacagcaggaccgccacgagcaggagcagcacttcggtcatcgggtcacccccctcccatggtcgggcaggacgcgggggatcgctcggtggtgcgtacggctactgggaggctcgcccatggatggacgctcacaacctttcatggaggaacgggtgtccctccatggtaaaggacaggcaaaaaacctttccggatccctgccgtccccgtcctccccggttcagtccgcgcggtccgcgagcggcttcacccagcgccgccagtgctcctccggcgcgtagcccgccgcgcgccaggcgtggtgtgcccgctcgttgcgcctgagcaccatcgcgtccccgcgccgcccaccgagccgtacgaaccgctcctcggc

SEQ ID NO: 1064 - DNA, 688 bp, Unknown
  Kingdom: Bacteria, Phylum: Actinobacteria, Class: Actinobacteria, Order: Streptomycetales, Family: Streptomycetaceae, Genus: Streptomyces
cgtcccccgagcagccgcagcagccctcggcgccgcaggacaccggccagcccaagaacgacggcggtggcggtggcggtggcggcggtggcggcgagcagaagaagaagcccaagccggtggtgcccgccgagaacgtgctgctgcgcaacaccaccacccacaagtgcgcggacatcccgggctacgacaacggctcgaaggccgggccggtgcgcgagtacacctgcgacggcacctcgcacgacaaccagttgtgggacctggacgtgacggacgacaagggcggccccggcggcaccccgctcttcctgatccgcaacgtcaaggacaggttctgcatggacgtgaccggctacgacgccgcgcccgtcaggtcgccggtcatggagtacatgtgcaaccccacccaggccgacaaccagctgtggtgggtggacaagcagaagaacggggcctactggatccgcaacttcgtcagccagaacctgtgcctcgacgtggcgggcaatggcgacggcgtcaacgacaccaatctcacgatcttctactgctccacgagcgacgaccaggaatggcacatcctcccgcagaagaaggacgacggcgcgtgaggaacgcgccggccggacggtagcccggaaggggctcggtggcagacccgcgggtctgccaccgagccccttcc

SEQ ID NO: 1065 - DNA, 1360 bp, Unknown
  Kingdom: Bacteria, Phylum: Actinobacteria, Class: Actinobacteria, Order: Streptomycetales, Family: Streptomycetaceae, Genus: Streptomyces
ggccgcggatggagccggtgccgatccagcatcccgggccgatgtgcaccggctccatccgcggccactgcctgccgatgggctggtgcgggtcgtcgtaggagtggttggtggaggtgacgtagacgtagggaccgaagtagcagtcgctgccgatggtgaccgtggtgtcggcgatgacgtggctgccgcgaccgaggacgacaccgtcgccgatgcgcaggatcgggtccggccccaggtcgaggtcgggcatcaggccggcggtcagcgtgacctgctcgccgatgatgcagtgggcgccgaggtggatccagggctcgccgaagaccgtaccgagcggaaaggccagtctggtacctgttcccatcgcgccgaagcgcagccgccccgggtgctccgccgtgacggaacccgtgcgctgcacccatgcccagcccgcgtggacggcgcgctgcgcgaggcggcgcgaccatgaggaggaccatgacgagaacgtgttcttgcgctggggcacccgcacaccgtactcagcccgtgtcaccgccatccggccggacacctgtgatcttcaccccaccggatgacgtacggtgccgtggtaccgggcccggacgaggccgtggacggcagtggaaggcgggacgatgatgacgcagaaggcgctgatcacgggcatcggcggccgggagccgcaggtggacgcggaggcgttcgtggcacccacggcgacggtgatcggcgacgtggcgctcggggcggccgcgagtgtctggtacggcgcggtgctgcgcggtgacgtggaacggatttccgtcggcgcccacagcaatgtgcaggacaactgcacgctgcacgccgaccccggcttccccgtgagcgtcggcgagcgcgtctccatcggccacaacgcggtggtgcacggggcgacggtcgaggacgactgcctggtcgggatgggcgcgacggtgttgaacggggcggtgatcggggcggagtcgctggtggccgcgcaggcgctggtaccgcaggggatgcaggtcccgccgggctccctggtcgcgggcgtcccggccaaggtcaggcgtgagctgaccgaggaggagcgtcaggggatcacgctcaacggcacgatgtacgcggaactggcgaagacgcacggcgccctccacgcgtaggaacgcgtggcggccgaggaccggtagcggacacggccggaggcgggtccgacgggacccggccgacgagcctttggccggtgagccctttggtcggtgagccctttgatcggggcgggttccggtcggaaagctcccggccgcgcgggactgaccgacgcctcccggccgggaggcgtcgg

SEQ ID NO: 1066 - DNA, 758 bp, Unknown
  Kingdom: Bacteria, Phylum: Actinobacteria, Class: Actinobacteria, Order: Streptomycetales, Family: Streptomycetaceae, Genus: Streptomyces
ccgccaactgcacaccctgtgcgagaccgccaccgccactcttaccgccgacacaatggacttcctcaccgaccagattccggacctccacaccgcctggctcttaggctgcgcactccacctcgccggcctacacgacggcgcccgcttctggtggcagtacgccgctggtgaccgtcaccggcccgcctgctactccctcttcctctaccaccaggcccgcggcgaacagcacgccgccggcttctaccaacaccaggcacacctggaaccccatgcccacgcagccgacaccgctggcactctcaccgtgcgcggcacggctcgttcctccgaggagatcagcttcgacgccagcgtctccaccctcctgcgcaccctcgcccggctcgccgccgcacccgacgtgcgtccgcggcgccgacgtcaccgcgtcgtcgcagtgacgaactacgtcgccgataccgtcgcccgccactacacccgccaccccggcgtcgaactacccgtccccgaaccccgcttcgccggccgcgtcgaatggctcttgaccgtcccactgccctgggcaccacgcccccgcgcacccgaacctgcgctgccggctcgccatccggcacgacacgactacgaccggccggtaccagccggcagggggtggccgtcggccgcgccaccttggccagcccagtgacgcaaggccagcacgcaggggcggcgtggtgggcagtcctccactcgctctctgctatcgcagg

SEQ ID NO: 1067 - DNA, 1713 bp, Unknown
  Kingdom: Bacteria, Phylum: Actinobacteria, Class: Actinobacteria, Order: Streptomycetales, Family: Streptomycetaceae, Genus: Streptomyces
cacggtccgggactttggccccggaccgtgacgtatctcgcaggtgacgtgaactactcacagcacctcaaatgggcaggatgcgaccggtgcggtcagatcgcccccgccgtcggccgggccgccaccgacctcggcatcaagccaccaccggctgcttgcggttcgccgacgcgttctgcgcgccctcgtcgtcaccgtccgccgagccctgccccgcaccgcccggcgcggacgagcgcagcgtcttcagggcgaccaccagcgccgtcgtgacgccgacaccggccgccacggcgatcaggtagaagaacgggttgccgatcagcgggaccacgaagatgccgccgtgcggggcgcgcagcgtggcgccgaaggtcatcgacagggcgccggtgagcgcgccgccgaccatcgaggcggggatgacgcgcagcgggtcggccgcggcgaacgggatggcgccctcggagatgaaggaggcgcccagcacccaggcggccttgccgttctcacgctcggtgcgggtgaagagccggccgcgcacggtcgtggccagcgccatcgacagcggcggcaccatgcccgccgccatcaccgccgccatgatcttcatggcggagtcgctcggcgcggagaccgcgatcccggcggtggcgaaggtgtaggcgaccttgttgaccggaccgccgaggtcgaagcacatcatcaggccgagcagcgcgccgagcaggacggcgttggtgccggtcaggccgttcagccagtcggtcatgcccttctgcgcggcggcgatgggtttgccgatgaccacgaacatcaggaacccgacgaccgccgaggagatcagagggatcaccaccaccggcatgatgccgcgcagcgccgccgggatgcggaccttctggatggccatcaccacgccgccggagatcagcccggccgcgaggccgcccaggaagcccgcattgatggtgagggcgatcgagccgccgacgaagcccgggacgagtccgggccggtcggccatgccgtaggcgatgtagccggccagcaccggtacgaggaaggcgaacgccacaccgccgatctggaacagcagcgccgcccagctgtcggactgggtccagatgaagtggtccatgaccgacggcgccttgttgatcttgtagccgccgatcgcgaagccgagggcgatcagcagaccgccggccgcgacgaacgggaccatgtaactgacgcctgacatcagccacttgcgcagcttcgtgccgtagccctcgcccgcctcaccggcccgctcgaccggcgtgccaccgggtgccgccgcgctcacctcgccgcgttcggccttccggcgcacctcgccgatcagttcgccgggccggttgatgcccgccttgacgccgacgtcgacggtcggtttcccggcgaagcggtccttgtcccgtacggggacgtcgtgcgcgaagatcacgccgtcggccgccgcgatcacggtcgggtcgagccgggtgaatccggccgagccctgcgtctcgacgaccagttcgacgcccgcctcgcggcccgcgttctccagcgactcggcggccatgtaggtgtgcgcgatgccggtggggcaggaggtgacggcgacgatccggaacgggggtgtggactccctcccggtggcgggtggggcggtggtgcccgtcgcggcaccggcggagg

SEQ ID NO: 1068 - DNA, 735 bp, Unknown
  Kingdom: Bacteria, Phylum: Actinobacteria, Class: Actinobacteria, Order: Streptomycetales, Family: Streptomycetaceae, Genus: Streptomyces
gcccgccggggcctcggccgccttggccggacgcgcctgcgtcacctgtctgacctgcttggccacgattcccgaccgatcctgtcccgtgcctgtgcctgtgccgtacccgtgcccgtgcccgtaccgaggtgtcagcccgtgatcgcgaccggggcgtcccagtagtcgcggtcgacggtgagggtgtaaccgccgcgcgtctccttgctgttcaccttgtactggtgagcgcggctgtggtcggtgaactgggtggagccccacggccagtcggtggtggtggtctccttgccgtcccacagggcgtaccagaggttgcccggcaggtcggtcttgttgctcgcggtggcgatggccttggcgctggagctggtgaagccgtagtagccggcgcggtaggtcttggcccgcagtcccttgtcgaaggcgcggacgtagttcagcacggcgtcgttgcacgacttgttcgtcgtgtcgtacggctccatgtcgaggtagatggcgctgccggccttcatgccgagggcggaggccttggacaccgcgtcgttggcgtcgctggtgccgagggaggaggcggtggaggcggtgagcttctccgggttggagctggtctggcacggcggctgggcgccgacgtagatcgggacgagcctccagcccagggagctgacggacttcacccaggaggccgtgagattgggctggttgcagccgcggttcttgccgccg

SEQ ID NO: 1069 - DNA, 7553 bp, Unknown
  Kingdom: Bacteria, Phylum: Actinobacteria, Class: Actinobacteria, Order: Streptomycetales, Family: Streptomycetaceae, Genus: Streptomyces
gtcggcggcggccgagtcggcggccggggcggcgcccggcaccgcggcggacacgaccaacgcaccggccgccgttcccgccgaggcggtcacgccgctgctgcggggcgtggccgtgctgcgggcgctgacggaggcgggcggaaccctgagcccgagcgccctggaacgcaccacgggcctcgcccgttccaccgtcgaccgcatcaccgcgaccctcgcccgcatggggtacgtacgcctggacggccgggacgccgtcctcacgccccgcctcatggaactgggcaacgcctacctggccgccctgcgcctgcccgcgctgctgggcgcgcgggcggacgccctcgccgacgcgctggacgagtcggtgtcgctggcggtggccgaccgggacggcatccggttcatccaccaggcgacccggcgccgcgccatgtcgctgagcttccgcatcggcgacctgctccccgccgaacgcaccgctccgggcccgctgttcgccgccgagtggacggacggggactggcaccactggcgcgagcgccggtcggccgacccggagaaccggtccttcccggcgatcccaccggcaccgccggcatcggccggcgacttcgaggaacgcgcggccagggcggcccgggagggctgggcaggcgacgaccagctgatcgaaccgggcctggtggccgtctcggtaccggtacggcacccggccaccggccggatcgcctgcgtggcaagcgtggtgagccacaccagccggcactcggcggagcacctgcgcgccaccctgctcccccgcctgcgcgagacggtcacggcgatggaggcggacctgcaagcggcgcagccgacgcctccgcacccggccgcgccgccctctggtctggcgacctggacggcggcgtcgaagcaggaactgggccgggagttcgtcgaatccctggcccgcggcctgacggtcctgaccgccttcggcgaggaccacccgacgctgaccctcacccaggcggcgaacgcgaccggcctggcgagggcgacggcccgcagggccctcatcacctacgagcacctgggcctggtggccccgggccccgaccggaccttcaccctcaccccccgcgtcctctccctcggcttcccgcccctgtcccgcacctcgctttcgaggatcgcccagccccacctggaggacctcgcggcgcaggtgcacgagtcgacgtccctggcggtgctgacccctgccggcgacgagatccagtacacggcccgcgcggccacgcacggcatcatgagcgtcaacttcgcagtcggcacccgcctcccggcccacgccaccgccctgggccgcgccctgacgtcccccacccccctcggctacgccctggccgacgaggaactcgaagagggcctgcgcgcgatcgccgtccccgtgcacgaccgcacgggccgccccgtcgcggcggtcaacatcgccatgcacgcggcccgccacacccgcgaggagtgcaccgacaccctcctccccgccctccgccacaccgccacccgcatcgaaacagacctccacaccgcctcccgcttcacccacgtccccctgatctgactgatccggtacgctgacgccagtggcccacaccgccacgatccgccttcgtagctcaggggatagagcaccgctctcctaaagcgggtgtcgcaggttcgaatcctgccgggggcacagaagaaagggccagctcaggaggggcttcctcccaggctggcccttcgtcgtgttcggggtcgtgccacgcgcgtgtcactcgagtccacgcggagtccacatcttccccgagcgcccggacgatcagtgaccgcatccgtgcttggtggccgctcagtaatggctcgccaccacaacgaagaggcacgcgatgaccgcgactgcacagagaacggcgacggtgatcagcacacagccgagcgctcctgaagtccaggcgatcgctgaccacccgaaccgtgtcgctcgttcggcccgctggaccgcttcgtggtaatcactgtcctcgtgccagccgcgatcagccatgatcccctcctctgacggaccctacagaggccatctcgcccataggccgacggtgtccggtccgtaggcagggtgatggcgtgcgtgatcgtcccgtctcttccaggcgggagtctttcccccacggttgcgggtcgcggtcccgagccgatcaacgatggcccggtcgcggtcgctggtcatgtgctgatagatcagcaaggcccgcgaactgctgtgccccatccgcgtcatcagctcacgcgcactggccccggccgccgaggccagcgtgttgcccatgggccgcagatcagaatcccgccgggggcaccagcggcaaggcccggaccgatcgtggtccggggcctttgacatcctcttctgacatcagcggagacgagacggagcgcacccggcatgacgagcgatgaggccctggaccggttgaggcagctggcacgagctcaggcactcggacgccacgtcggctccgaccggctgatccaagccggactggacgctctcctggccgatgtcgattccccgtcgcttgccctcctggccggcctgggccgccgtgaggagcacgaggcacgggagctgttcgatcatgtggtagacgagctgggactgggattcgaggcgcccacggacccggtcgccgccaagtgggctttggccgagtggttggccgctcagatcgttgacggctccttggacccggcgactggtgccgacctcatctgggtcgaagcagcgacggaactcggctatcccgaccgcctgcagccaatcgtcgggtgtgccatccagctggccgactggaacatcgattggagcattccgctggagcagctcaaggaagaggtcgttgtcgccgcccgcgcgcttgtcgagcgcgcaggacctgagaccaacccctgacggcatgtcaagatgaccccttcttcgcgcgaattggtgcctggtaacttgcaccctgccgcgcgtgcggcacggggagggggacatgaacggggagaccgtgcgtgtcggtggccggagcgtgaccacggaccaggcgacgcagtggatacggcagtacttcgacgctgaggcgaaccgggcggctgcggtcgccgcgaagggcagaccgtatgcgttcccggtctacgaccggatggacacgggaagcgggccgaacgaactcaacgacggggacctgctggcaccggtgctgctgaacgtcacgccgaagctacatgccgttctgaaccttcaggctgtgcgcccggacctggaggcagtgctcgcggcgatcccgccaaagctcacgcttcaggatgcagtcgcctccggcgtgcacgcggagccattgcgccgtatcggcgggctgctcgaccgtcccgccgcgctccgaggcgtgggcggaacgattctgatgaagatcatgcaccgcaagcgtcccttgttcctgccgctctacgacacccgggtctacgcctgctactgcgggcgcggtgctcagtatccgatcaaaaagtcgtcacatcgcacttgggcggagttcctccgacttctcggcgacgccgtggcgcgcgacctggacgagcagccggagacgtggaagatgctgatgggatgcgccccgaacgatgtgagtgtgctgcgcgttctggacgtcatcgcatggaacctcggcggcgggctcggggtgcgtaccgctgagcccgccgacttgagcgacggcccggagcagtaagacatggccgccccctctgcccccgcgacgggaccgccgcccccggtcactgaccagcaggttcacgatgccctctggcaggcgctgggcaccgtctggacacgggagccggatctagtgagcgagggggtgaacgagcgcgccgtcgtcgcccgcatcgcacttgcgctgcaggcggcgatcgcgccctggggcgggcagtggcgagtggacgtcgaatacgaccggtggcatcgccccgacttcggggtgatcaggaaagccctgtacgttgacggttccgacgcagcggaccgcaggcccgtgtaccccgatttgatccttcatgacccgcatggccgcttccaagagcgcaatctgctcgctctggaggccaagcgcgggcgcccccggcctcgtgatcgcgacttcgacctcgccaagctccgcgcctatctgcgtgagctgtattaccgtcaggccgcttacttggagttcgatggctgtggtggaccgcctcggctgcaatggttccagctgcgagacggccaagtctgtgccgctggcgtcgaagacggctggcagcagggcgtcgatccgggatctcagggggccctcccggggctgtgaggggccgcgagcatcgaggaggcctgggcagcccttcggaccaggccgcacccatgccggaacggacggcagctccggggaaccggggcgcctaggaggtcaagccgccgaagcacggccggagcaaggaatcgcagtcgccccggtagccgtcccgactcgctgctgaagagggcattcacatagctgacgttgtctgtatcgggaggacttcgaccggtactgaccgacgacatcgcttcagtctgctcgtggggtcagcatgaggaacttgttcacgccggggtagaaccacgggctatgtcaccggcttcgagtcggtcgatcgcgacgagcgcgtcggccgcggtcttgcagcgcgggtgccgcgtggcgaaagcggtgatgcgggctcgctgagtgggaggcttcttgctgcgcacggccttccagaggtggtggtccggccgagcgcggggccttacgcggaggtgctggtcgcccgcgtacgcagttcggggaggccagcaggccaggatcacgtcgtgggcgccgccgaggtgaggcgctcgtgcagggttgccgcgaactcctccgcccgggcgagttgggtccgcaggtcccgcacgcgttcggcggcagtgcgttcgaaggcgcgtacccgctccaggtgttcctcccgctcttcggcgggcagttcctccgcggcgtcgaggcggtcggtggcgttcaggaggtctcgcatctgctcgagggtgaagccgaggggcttcatgcggcggatgaccatcaggcgggcgacgtcggactccgtgtacaggcggaagccgccctgcgagcgggcggaggggacgacgagaccggcctcctcgtagtgccggatggtgcgcagggacagctcggtccgcgccgcgacctcaccgatgtgcatgtgcttgccgtccacgttcccgctccggtccctgggtctctcccggtggcgccgcacgccctccggccccggcctcaactctaacgttgcggtagagttgccggtggtgaggtcggctgggccggcctctgcctgtgtgcggtaccgggatcgatgccgcccccggtcgagattgccgagtcctgtgggagagacgcgtgcgcgagctgatgacgccccgcgccgacgcctgcccgccgtgatccgccgtccctgacaccggccgggccgcgcgggcagccgccgccggccaccgccgcctcgaagacttccggcccgcgtcgggcgggccgaccgcggcttgccgtacggcccgccgtttccttccgcgcccccgccaggccgccgcccgggtgcgcccgagtacgacaggtaccgcttccttgccttcttctccgccctggtcccgcatcaggcctgcgtggctgtcccccgccgtgttccgtaccgaggccctcgccggtctggtggtcggtctcgctctgatcccggaggcgatctccttctccgtcatcgccggggtcgacccgaaggtggggctgttcgccgcgtgcaccatggccatggtgatcgccttcgtcggcgggcgccccgcgatgatctccgccgccaccggcgccgtcgccctcgtcgtcgcgcccgtcgtccgccagcacggcctgagctatctgatcgccaccgtgatcctcgccggtgtcttccagatcgtcctcggcgcgctgggcgtggccaggctgatgcggttcgtgccgcgcggtgtgatggtcggcttcgtcaacgcgctgggcatcctgctgttcacggcccagatcccgaatctgcgggacgtgccgtgggcggtctatccgctggtcgtcggcggcctggtgctcatggtgctgttcccccggctgaccaaggcggtgcccgcgccgctggtggcgatcgtgatcctcaccgtgatcaccgtcgccgccgggatcgccgtgccgacggtcggcgacaaggggaagctgccgtcctccctgcccgtgccgggcctgccggacgtgccgttcacgctccacaccctcaccgtcatcgcgccgtacgccttcgccatggcactggtggggctgatggagtcgatgatgaccgcgaagctggtcgacgacctcaccgacaccccctccgacaagtcccgcgaggcggtcggtcagggcatcgccaacatcgtcacgggcttcttcggcggcatgggcggctgcggcatgatcggccagaccatgatcaacgtcaagagcggggcccgtacccgcctgtcgacgttcctggccgggttcttcctgctcatcctgtgcatcgtcctcggccccgtcgtctccacgatccccatggccgccctggtcgccgtcatggtcctcgtctccgtcggcaccttcgactggcactcgatcaagccggcgacgctcaggcggatgccggtcggcgagaccgccgtcatggtgatcaccgtcatcgtcgtcgtcgccaccggcaacctgtccatcggcgtcgtcgtgggttcactgaccgccatggtggtcttcgcccgccgcgtcgcccacctcaccgacgtcacctcggtcaccgaccccgacggcacccaggtcgtctacgccgtcaccggtcagctcttcttcgcctcctccaacgacctcgtcacgcagttcgactacgcgaacgaccccgacaaggtcgtcatcgacctcaccggcacccatgtctgggacgcctcctccgtcgccgtcctcgacgccatcgagaacaagtacgcccagcggggcaaacacgtcgagatcatcggcctgaacacttccagcgcccgcctccacggcgaactcagcggcgaactcaccgccggccactgagccgcgggcggcactcactccgggcggcgcccagccacgggcggctccccgcccctggccgaacccggccccgggcggcgccggccccaccgcggcagagggacggcgggcgtcagttccacagcaggtcggccgccgcgcgcagcctcgcgtgccaggtgagggtacggaaggcggggcggcggggctggccaggagccccggcaggatgccgcccgccgctccggagggacgccgacggcgtggtcgcttcacaagccggtggtgcgaggggacctgtgggccgtcagtgcccagatcccccacgcgtccaggccgatggag

SEQ ID NO: 1070 - DNA, 6740 bp, Unknown
  Kingdom: Bacteria, Phylum: Actinobacteria, Class: Actinobacteria, Order: Streptomycetales, Family: Streptomycetaceae, Genus: Streptomyces
ctgccgcaccggagaacacccgggccgcaccggcacgtacgctgccgcaccggagaacacccgggccgcatcggacggcccacgcgccgccgtgccctccccaccccaccggcgccttctccctcgcccctttcatgccgccgtcctgtcgccgtcgtctcaccccatttcgtcccgaggggtcctcgcgccccgtgcgtaaacacaagtgacgctgccacgacagcgacaccgtgaacctcgccgcaggcagcgcccgcgaaccaaggagcaggggacgacatgagattcctggaccgtgaacgcgcggccctcaccaagctgctgccggggctcgacgacagcctgcgagccgtaccgctgatggccttggagcgacccggcagcccgggcatcgcgctcttccgggacagcggcggcccggggctgctcgccccggcgtcgctcgagggccggggcgccaccgcgctcgacgccgtacgggtgcagcgggccctcggcagccgctcgccctcgctcgccgtggcgacgaccatgcaccacttctcgatggcgaccctcgtcggactgagcaacgccggtgagggcctggagtggatgctggtccaggccgtcgccacggagaaccagctgatggcgtccgggttcgccgaggggcgcagcggcgccggcatcctgtcgccgtcgatgtccgccacgccgacaccgcaggggctgcggatcacgggcgtgaagcgcccgtgcagcctggcccgctccatggacctgctcaccgcgagcgtcctcgtgccccgcgaggacggtgccggcgaggagctggccgtggcccttgtccccgccgccagcgaggggctgagtgtcagcggcttctggtccagcggcttcctggcgggcgcggagagcgaccaggtgacgctggacggcgtgctggtgccgcccgatctcatggtgcgcaccgcgtgcccgcccggtgcgcgactggacgaggtgcagacgatcggcctggtctggttcgagatgctgatgaccggcagctacctgggtgcggcgagcggcctggtggaacgggtgctgctcaacgaccgggtgcccgagagcgagcgggtcgcgctgctggtcgcagccgagagcgccgcggcgtccgtcgagggcctcgcccgccgcgtggacgagagcacgcccgacgagtccacgctggccgaatcgctctacgtccgctacggcgtgcaggacgcgctgtcccgcatcgtcccgcgcgcggtggaactcctcggcggcctcaacttcatgacctccgacgaggtcggctacctcgccgcctgttccaacggcctcgcactgcacccgccgtcccggtcacggatgaccggcccgctggccgcgtacctggccgacggaccgctgaccgtggcctgaccgccccgccacgacacccggtcctgccaccgcccctgcaaccgcgcaaccgcccggtcaccgcctgccgatgctctgccgccgtcctgtcctcgacctgtcacggcccggaccggaccgcggtcctccatcaccgtcccgcctccgaccgaggggatcttccgcatgccgcatctaccgccgccccgccgcccggtgctcctgctgaccgggggctccggcgtcctcggccgggcactgatcgaggagctgtcgcccggcttccgcgtcatctgcctgcgccaccgtacgcccgtggacgaccccagggtcgaagaggtgagcgccgatctgctgcaacccggcctcggtctgtcccgtaccgagttcgcacggctggccgacgaggtggacctcgtcgtgcactccgcggccgccaccaactggaaggccgagcccgaggcgatctggcgggccaacctcgacggcaccgcgaccatgctcgacctcgccgtccgcgcgcaggcgcccttccaccacatcagtaccgccttcgtggccaacccgctggccgccgaggagcagcggcgcttccccggcgccgccgcctacctcgcctccaagaccgcggcggaacaagccgtgcgcgaggcgccggtgcccgcgacgatcctgcgcccgtcggtggtgatgggcgactccgtgaccggccggatcgcgggtgcccaggggctgacgcgggccctgggcgccatcgtgaagggccaggtcccggtcctgcccggagagcccggggcacgcatcgacatggtgccccaggacgtcgtcgccggcgccgtcggcgcgttgctgcgcggcggggtcacccagggcgagtactggctgaccgccggcaccgaagccctcctgcagcgcgaagtcgtggacatctgcctggagttcgccgaccgctacggcccccggccgcatcctccgcggctgatcccgctggagtcggtgcaccggctcctgctcccgctgatcgagggcccggccttcccggagtcgctgcgccgccgcttccacacgtacgcggaactgctgctggtcttccagcgcgcgctgcccttcgagtcctccctgggctccgcgcactgcggtacggccgtcgccaaggacgacctgcgccgggcgctgctgagcaacctggccgcctgggcgtcgggccccgccggcctgcgccggcaacggcggggccggcccgccctgcaggagggcaccgcgccccgggaactggcgtcatgaccgcgctccccgccaccgagacggcaccccctccggacggcccgcgagagctacgcgacccggaagcgccgtcggcggacctcccggacgacgacggaacgcacatcgcccgcctctaccgtgagcacctggccaccggccgggcggtactcggtgaggtgctcggcggcatggtggagacggcgtccgagggtgcctgggtgcacaccgccgacggccgccgctacctggacttcggcgggtacggcgtcttcatcctcggccaccggcacccggcggtgacggccgccgtgcaccggcagatcgacgcccacccgctggccacgcgggtgttcctggagcccgtagccgcccgtgccgccgccgcgctggccgcgcacacaccgctcggtctcgaccgggtgcacttcgtcaactccggcgcggaggccaccgaggccggtctcaaactggcccgcgtccacggccgcaccgcgctggtcagcaccgtcggcggctaccacggcaagaccctcggcgcgctcagcgcgaccgccaacccggcctaccaggatcccttccgccccctgctgccggacagcgcggcggtgccgttcggggaccgggaggccctgaaggaggtgctcggccgcttcggcgagcgggcctgcgtgatcgtggagccggtgcagggcgagggcggcgtccgcatcccgccgcccggctacctggcggacgtcgggcggctgtgccggacgcacggcgccttcctgatcgtggacgagatccagaccggcctcggccggctgggttcgtggtggggcgtggacaccgagcacgtccgccccgacgcgctgctcgtgggcaagggcctgagcggcggtgtggtgccggtcgccgcgatggtggccaccgacgaggcctacgcgcccttctcgcgcgacccctacctgcacacctccaccttcgccgcctcaccgctcgcctgcgcggccgcgctggccgccgtgcagaccatggaacgggaggacgtgccggggcgggcacggacgctcggactccggctgctgcacggcgtgcgcgacgcctgtacgccgtacacggggggcctggtccgggacgtgcgcggccgtggcctgctgatcggtctggagttcggcgcggagcaggccgtgggcgagctgatcctcgagctcgtcgcgcgcggcgtcctggtgaaccactccctcaacgcgggccgtgtgctgcgtctgaccccgccggccgtcgtcaccgacgaggagctgcggctcttcctcaccgccctgagcgaggcactgcacgcggtggcggcccgggtccccgcctgacctacgcctgcttcttcaagctgatctcagttctcagttctcagttctcagttctcagttctcaggtctcaggtctcaggtctcaggtctcaggtctctgatctccgatctccgatctcccgtctgcgaaaggtacttccatgcgtcacgtgaccgtacagatgaacgcccaggatgtgagccccgaagccgcctacgaacggatccgggacttccgccgctatccggacgtcaccgagaccgtgcgcgaggtggtggtgcatccgccgggcgccgacggcacggtggtctcggactggaccgtccgtttccgcaacggcctgatgcggtggtcggagcgcgactcgttccatccggaacgcctgaccctcggcttcacccaactgcgcggtgacttcgaggtgttcgaggggacctggcggtgctcgccgaccgggtccggcaccgtcgtgaccttcgacgccgcgttcgacctgggcatccccacactggccgacatgctggacccggtggccgagtccacactgcgcaccaacatcgaactgatcctgggcggactgctcggttccgtcaccgcggcgcccgccgccgcgctgccacggacggcggcccccgtccgtggctgaactcgccctggctccacgccggaccgcggcgccgcgcaccgcgggctgggacacgctgcgcgacgaacccggtcccgacgccgtccgctgcctcggcctctacaccagactggcggccggggtcaccgtggtcaccgcgctcgacgccgccggccggcccgccgggatgaccgtctcggccctgacctccgtgtcggcccggcctccgctgctgctcgcctgcctgcgcggcggttcacagacactgaccgccgtacgggagcgcggtgagttcgccgtcagcttcctgaccgagcggcagcgccgcgtcgccgagcgcttcgccgacccggccctgtcccccgccgcacggttcggcggcgtaccggtacggcaggtgctcggcgtgccggtggtgtccgaggcgctcgcctggtcggtgtgtctcgtcgaggacgtacgccgctacggcgaccacgacgcggtcgtcggccgggtccgggccgtcgaggccggatccggccggccgctgctgtggcacgaccggaccttccacaccctcactccgctcccgtcccaggccgagggaatttgaccgttctcctcctcaaggacgcccggccatcggctccaccggccgggcgtccgcgtatccgctcaccgacatgaccgtccaaggaggtcgtatgtccctgccccccatccccggagtcaacgccgacgacgcgcggaccgaactcacccgcgcgcccgagcggctcacgggcaacaccacggcggcgggccaccgggtcgccgccgctctcgacgccgaggccgccgcggacgactggggccggcccccggacgcccaccacccgtgccccgtcgtcctcgtgcacggcaccctgggcgaccggcagtacgtctggcgggaggcggtgccggtgctcaaggccgccgggcaccgggtcttccggttgaactacggggagatgccgacgctgccacggctgtacggcctcgccgacatccggctctccgcccgcgagctggccgcgttcgtcgaccgggtgctcgcggacaccggcgcggcccaggtggacctcgtcgggcactcgcagggcgggatgatcccgcactactacctgaagttcctcggcggcacgggcaaggtgcgccgcatggtcggcatcgcgcccagcagccacggagtcaccgtggaagggctgacctcgctggtccgtcaggcgatcggggtacgggacatcgtcgaggaggagctgctcttccgggtgagtccggcgttcgtgcagttgctgcacgactcggagttcgtgcgcgagctgacgtcgacgggcgacacggtcgccggggtgcggtacaccgtgatctggtccactcgggacgaggtggtccagccgcccacgtcccagcggctcacgcccaccgagccggaccacgaggtcaccaacctgtgcctgcaggaactctccccggccagccggacgacgcacatggcgatgccgtacgacccggtcgtgctgcgggagatgctccgggccctggacggctgagcgggccggggcacgaagaagtggggtgaggctccctcgggcctcaccccacttccgtgtgttcaggggatcagtacgcggtgcaccggcccttctcaccgttccagaagcacacctggccgaccacgtcgaacccggcgactccgttggggtcgatcttgtcgaaccgtggcacagggatctgcaggccgttgatcccgtctccggcgagcgggccgctggtcaccgtccggtccggtaccgggctccccttcttcagctcgcccttgaagtagagcgtgccctcctcaccggtgttccaggtgccgcggccggtcccctccacggagaacgtcggcaccggcacggcaccgaaccggccggtgccggcgacgtggaagacgatgtcggtcagctcgggggccgcgccgtcgggcgagcggcagtcccggtagccgatgtgcccgctcacctgcgcctcccgggtgagcaggccgagcggcgggctgaagttcacttcggcgtcgaggcggcagacgaggtcggggaccgggcccgggtccgccgcggcggtagtagcggcgaccctcgcc

SEQ ID NO: 1071 - DNA, 2180 bp, Unknown
  Kingdom: Bacteria, Phylum: Actinobacteria, Class: Actinobacteria, Order: Streptomycetales, Family: Streptomycetaceae, Genus: Streptomyces
cccgcacgccacccggttcaccgccaggcacgccgcccggttcaccgccccgcacgccacccggttcaccgccaggcacgccgtccggctcgtcgtccacgtccataccggcaccgtagcccccgccaccgacagcagcggcgcggggccgcatggccgcggggctcagcccgcgttctccttcgcctccgcctccgacgccgaggtctggagctggttgaggacgcccgtggggtcgccgcccggggtgaccgtgccgccgatgcgctgcttgatctcggcgctgacctgggcccaggacgtcttgcccgccgggtagagctgggcgagggagagttcctggaggaagggccacaggttcttgtcctgcgggtccgcggccatcgcctcggaggcggaggtggtgacgggcagcaggtcgtactcgcgggagaagtcgaggacgttctgctcgctgtagacgtagtcgaggaagtcgccgatctccttcttgtggccgttcttcttgaaggccatcatccagtcggtgacgcccatggtggccttgggcgtgccgtccctgcccggcaccggcaccatgccgaacttcatgcccgcctgcgtggccttcttcatcagcgtggggtggccgttgagcatgccgacctggcccttggcgaaggcgtcgaaggcgtcggcacggttgagcttgccgggcgcgacggggccggtcagtcccttgccgaccagttcgtccttgagccaggtgaacgtctcggcgttctgcggcgagttgatggtgtaggtgccgatgtcgtcggtgtagccggcgccgccgctgagcagccactgcatggtctcggcctgcgcctcctcggggccgagcggcagcgcgtacgggtacttcacgcccttggccttgagcgcctcggcgtcggcggcgaggtcgttccacgtcttgggcggggtgaggtccgcctgggagaagagggtcttgttgtagaagaggacgcgggtggaggcggcgaacgggatgccgtactgcaggtggcgcacctgtccggcctcggcgagctggtcgaggaaatcggcctgcacggctatggagagcaggtcgtcggccttgtagagcttgtcctgggcggcgtagtcggcgtacgcgccgatctgggccatgtccggcgggtcgccggcgtcgaccatctccttgaccttgcggtccacgtcggtccaggagtagaccttgacgtcgaccttcactccggagtgctgggactcgtaggcgcgggccagtttgtcccagtacttctgcgagctgttggccgaggagtcaccgtagtcggcggcgaccagcttgagcgtgacgtcggaggagccggtgctcccgcagccgccgagggccgaggtcatgcccagcgcggacaccgccgcgatcattcctgccctacgccgctgcactgcgttcccgccccaaccgtctcgtgttcaccatgtggacacgataggtctacaccagcgcagtggactagacctctcgcgggtccacgggccacactgtcctgcgtgagacacgtcatcgcgctcgatgtgggcggcaccggcatgaaggccgcactggtcgacgaaacgggcgggctgctccatcaggcgcgccggcccaccggccgcgagcgcggcccgggcgccgtcgtcgagggcatcctcggcttcgccgccgaactgcgcgcgtacggcgccgagcgcttcggcgaacccgccgcggcggccggcgtcgccgtccccggcatcgtcgacgacgcacacggcatcgcctcctactccgccaacctcggctggcgcgaggtacccctgcgcgacctgctctccgagcggctcggcacccccgtcgccctcggccacgacgtacgcaccggcgggctcgccgagggccggatcggcgcgggcaagggcgccgaccggttcctgttcgtaccgctgggcaccggcatcgcgggcgccatcggcatcgacggccgggtggaggcgggcgcgcacggcttcgccggcgagatcgggcacatcgtcgtccgccccggcggcaccccctgcccctgcggacagcgcggctgcctggaacggctcgcctccgcctccgcggtcagcctggcgtgggccgaggcgtgcggcgacccgggcgcggacgcggcggactgcgccaaggc

SEQ ID NO: 1072 - DNA, 1031 bp, Unknown
  Kingdom: Bacteria, Phylum: Actinobacteria, Class: Actinobacteria, Order: Streptomycetales, Family: Streptomycetaceae, Genus: Streptomyces
cggtgggcggtgaacgaccagcggtcgcgcgtccaccgctcctgcacgcgcgcgccctcgggcagcgtccgcaacaggtcgaggccgtcccagaccagctcccaggtgggcagggcgacctggcgcaccaggtcgcggatgtgctgctcggccgcgctgagggcgccgagccgctcgtccgcctccagaccgtcctcggcggcggcgagcgccccgcgcgcgcggtcgtagcgctcgatggcgggcgcgagcagcttgttgtcgaaggcggggtcggtggccggtcccgcgggcgggcacagcagttggccggccgcgtcccgctcccgttccgcccgcagggccgcctcggcgcccgagccgccctcagggggcgcgatccacgccagcagcgctcctaggtgctggtcctccaggccggactggccggtggtccagtgccgggccagtacgtcgctgacggccagcagcagcgaggagccgggcacccgggcccgctccccgaagtgggtgagccaccgcccgagcagcggcacgcggggcggcgccgggtgcggggtctcgggatcctgctcggcggtgcgccggaagcgcatggagcgtccgagcaggcgtacgaagtcgatgcccgcgcggctgggcacgatcagctggggcgcgtccgcgcacagctcgacctcgaccttggtgcgcttgccggtctccgggtcggtctcgctgcgctcggcggcctcgaccacgtcggcgtaggagtcgatgtagggcaggacgacgtcggccagctcggccaggaacgcgaacctcaggtcccggtcgcgaggctgcggtacggcgagcagccggggcgcgtgccggtcggtgccgacgagcgcgccgagcggggcgcccgcctcaccggcggtggtgagcggcacgcacaccaggggccgctcggacaggtgccggtgccggacggtcgcggcgggctcggcgcgaccggcccgcacggcctccagccgggcgagggtggtgatcagcgacatacggccccc

SEQ ID NO: 1073 - DNA, 1463 bp, Unknown
  Kingdom: Bacteria, Phylum: Actinobacteria, Class: Actinobacteria, Order: Streptomycetales, Family: Streptomycetaceae, Genus: Streptomyces
gggcgacgccctcgggggcgggaatcctggtcagctcgctcatggccccatagtggaccacgggtctgacaaccggccgccgtccccgcctccgagggcccgtcagtgtggtcagccgcggaagccgaccaggtcgtgcagggccgctccgcgcgccgcgccggtgccgcgcgaggggggtgccgccggggacttggagctgagcggcttcgggtcgggcaccttctggcagacggcgtcggccgcgccggccgggccgcgcggcaccgtgccgttcttcaggtacgccgccaggtgaccgtcgagacaggcgttgccgctcagggtgatgccgtggttgccgccgccctgctcgacgaccaggctggagcccgccagcaggtggtggacgcggaccccgccctcgtacggcgtggcggcgtcgtcggtcgcctggaacagcagcaccggcggcagcttgctgttggcgatgtccaccggatgctcggtcgtggccggccagaacgcgcacggcgcgttgtaccaggcgttgttccaggccatgaacggcgccttgtcgtacaccgcccaggtgtccgcgcgccactgccgccagtcacgcggccaggcggcgtcacggcactgcaccgcggagtagacgctgtagccgttgtcgccggaggagtcgacggcgccgaggtcctcgtaggcctcgacgagcgggccggtcttcccgtccttcgtgtacgcggcgaacgcctgggcgagatagggccagtagccgttgtagtagccgccggggatgaaggtgtcctccagttcggaggcgccgaccttcccggccgccggcttcctcgccagcgccgcccgcatcgcgtaccactcgtcctcgacccgggcggggtcggtgcccagaccgtaggccgcgtcgtgccgggcgacccaggccatgaaggcgcggtggcggtcgttgaaggccacgtcctggcgcacgttgtcgtcgtaccagatcccgcttgggtccacgatcgagtccaggaccaggcggcgcacccgctcggggaacagcttggcgtacaccgcgccgaggtaggtgccgtaggagtagccgaagtagctgatcttcggcgtgccgagggcccggcggatggagtccatgtccttgacggcgtcgacggtgccgatgtgcggcagcacgctcgcgtacttcttcacgcaggcggcggcgtaggagcgcacgcgcgcgaggttggcctgttcgagcgcggcggtggcgggcaccgagtccgggcgcacggtcttgaagtggccgggcgcgcagtccagggccgggctgctctcgcccaccccgcgcgggtcgaaaccgatgacgtcgtactgcgccgcgaccgcctcgggcagcgcggaggcgacgaacccggcgagcgagagcccgctgccgccggggccaccggggttgaccagcagcggcccctgggaggtct

SEQ ID NO: 1074 - DNA, 2336 bp, Unknown
  Kingdom: Bacteria, Phylum: Actinobacteria, Class: Actinobacteria, Order: Streptomycetales, Family: Streptomycetaceae, Genus: Streptomyces
cgccgacgtcggcgccaacatcgaggacacccgcgaggaacacgcgctgcggaccggcgacatcaccgtcgtcgtcaacgcgggcggcggctacacctggtcctgcctggtcctcgaagccgtctcctgacggtctcccgacggcctcctgaccgtcttccggcccatcaccttccaccactcgtcgcaccatcacccttcacgaaaggcagtacacccatgaccaccgtccacgtttccgacgagaccatccgcgagaccactctcgagatcatcgtcgacgaactggagctggacgccgagcccggcgaggtcgacggcgacgccgacctgatcgagttctacggcgccgactccctcggcctgatacaggtcctggcccgcgtcaacaagcagctcgccatccgcgtgccccgcgaacaggccgtggacctgcgcaccgtcgacctgctggtgcagcgcatcatcgacatccgcgacggcaagggcggcgaccagtgacgcgcgcacgcagggtcgtggtgaccggcctcgggtgtgtcagcagcatcggcaccggcgtccaggagttcaccgagggcgtcaaggccggcctgagcggcatctccgagatccaggccttcgacagcagcgacttcccggcccggctcgccggcgaggtgcacggcttcgacccggccgcgatcgtccgcaccatcgacgtcgacgactggggccgtacggcccacttcgcggccgccgcggcgcggctcgcgatggacgactccgggctcgaactcgacgaggagacccgggcgacggcgggcgccatcatcggcaccaccaacggcgaggcgccctccgtcgacaccctgacccaccagtggctggacggcgggcccagcaccctcgcggccgatgtcgtccgcaaggtcccggccgggaacatcgccgccgccgcggccaccgaactgggcctgtacggggagaccgtcgtcatcccgacggcgtgctcggcggccaactacgccatcggcagcgccgccgacaagatcatcgccggtgaggccgacgtgatggtggccggcggcgcggacagcgtcaaccggttcacccacgccgggttcctcagcctcggcgccgtcgccgacggcgtgccccggcccttcgaccaggaccgctcgggcatcgtcaccgccgagggcggcgcggtgctggtcctggaggagctggagcacgcccggcggcgcggcgcccggatctacgccgagctgctcggctacgggctcagctgcgacgcccaccacatcgtccacccggacgcggagtccatcgccacctgcatccggcgggcgcacgccaactccgacatcgtcgccgaggacgtggactacatctgcgcccacggcaccgggacgccgaccaacgacatcaccgaggtcaccgcgacccggctggtgttcggcgacgagcacccgccgatgagctccatcaagtcgatgctcgggcacaccatgggcgcggccagcggcttcggcgcgatcgcctgctgcaaggcgatcgaggacgccttcctgccgcccaccatcaacctgcgcaccgtcgacccggcgttcggcgagggcatcgacttcgtcggcaccggcgccagggccgccgccgtgcgggtcgcgcagaaccacggcttcgccttcggcggcaacaacgccatcaccattttcggcgcctatgccgacggcgagcccgtcggcgcgggggagggagcgcgatgagcgtgccacagcaactccagatctccgacgtgtcggtgctgtccgcggccggggtcggcctggacgccctgcgcgcccggctccgtgagccgggcgcggcccccggcggcggcgcccgccgaggcggacgccgccgcctacgagggactgcccgggcaggtcgcggccgtaccggacttcgcgatcaccgactacgtgccgaggaaggggacgaagaacctcgaccggaccacccggctcgggctcgccgccgccaccctgctcaagcggtccctgggcgagcgggccggcatcgccgacgagtcctgggagtccaccgggatcgccatgggcacggtcgtcggcagcctgcgcagcagcgtcgacctggacgtggacatcatcgagggcaagggcaccgacctggtgaacccggcggtcttccccaacaccacgatgaactgctgcgccagccagatcgccatctggtaccgcttccgcggccccaactccaccctggccaacggcagtgtcagcgccctgtccgcgctgcgctacgccgcccggctgatccgctgcgggcacgccgggcggcgtagcgcagcg

SEQ ID NO: 1075 - DNA, 2595 bp, Unknown
  Kingdom: Bacteria, Phylum: Actinobacteria, Class: Actinobacteria, Order: Streptomycetales, Family: Streptomycetaceae, Genus: Streptomyces
  misc_feature (411)..(471): n is a, c, g, or t
ctgctggatccagcgggccgcgcccgcctcgtcgggaatggagtggctcaggaagcggcgcagcgcctcgtcctggtacagctcggcgagcggggcggcgtccgccggctcccacgggcgcagcaggagggcgggcgcggtggcggtggccggcgcctttagccggtcggtggccccgcgcgccgggagggggcccgtcgtgctctcgtgcgacggcagggggtccgtcgtgctcccctccgccgggtgcaggcccgtcgtgctcccctgcgtcaggtgcaggcccgtcgtgctctggtgcgtcggcatgggcgtcatcgtgccctatgcgcgtgcttcgcgtgcggtgtcgccgagccggtcccgcagttcccgtttgaggatcttgccgctggcgttgcgcggcagttnnnnnnnnnnnnnnnnnnnnnnnnnnnnnnnnnnnnnnnnnnnnnnnnnnnnnnnnnnnnncgatccaccgttcgtcggggaggccgaccacggccacctcggcgacgccgggatgggtgtacagagcgtcctcgacctggcgtgaggccaccagcactcccccggagttgatgacgtccttcacccggtcgacgaccgtgtaatacccgtcggcgtcgcgcaccgcgaggtctccggagtggaaccagccgtcgcggaaggcctccgcgctctcctccggcttgtcccagtagccctcgcacaactgcggggagcggtagaggatctcgccgggcgtcccgtcgggcacgtccgcgccgtgttcgtcggcgaggcgggcctccacgaacggcaccggccgcccgcaggagtccatccgcccctcgtgctcgccggggcccagcaccatggccagcgggccgatctcgctctgcccgaagcagttgtagaaggcgagccgcggcagccgtgcgcgcagccgttccaggacgggcaccggcatgaccgaggcgccgtagtaggccttgcgcagcccgtcgaggtcgcggccggcgaagtcggggcggttcgccaggccgatccagaccgtgggcggcgcgaacaggctgtcggcgcggcgggcttcgaccaggtcgaggatgcggtcgccgtcgggtgcgtcgaggaggacgttcgtcgcgccgacggcgaggtagggcagcaggaagacgtgcatctgcgccgagtggtagagcggcagcgcgtgcacgggccggtcgtccgcgccgaggtcgagggcggcgacggcgctgcggtactcgtggagcagtgcccggtgggtcatcatcgcgcccttgggcagggcggtggtgcccgaggtgtacagcagttgcaccaggtcctcgccgtgcggtgcgcggccgtcgcggggcggtgcggacgggagcgcggcgagcagcgagccgtcggcgtcgcgcagggccaacgagcgtacgccgtccgggagtcggccggcgaggtcggggtcggtcaggaccagggagctgccggactgaccgaggatgtaggcgaggtcgtcgccggtgaggttctggttgacgggcacgtggacgaggcccgcgcgggcgcaggcgaggaaggcgatcaggtaggcgtcggagttgtggccgtaggcgccgacgcggtcgccgggggccaggccctcgccgagcaggacgctcgccgcgcgggagacggcgtcgtcgagtcccgcgtacgtccaggagcggtcgcggtattccagggcggtccgcgcgggcgtgcgccgggcgctgcgccgcagcacttcgtcaaccgtgcgggcgtgtccaggcgtcatgacacatgatcctgagtccgccgcccaaggaggtcaagcatcccgcgttctcctcctcgtgtgacccgcgggaaccgccgaccccgcacgaccactgctccgagcacacaccgaacggtacgcacaaccgcccttcacctccacgacttcgggaggcacgatgcgcaccacccgtttcagaaagctcctcgtcgcggccgtcgccctgctcaccggctgcgccgtgctcccggccgccgcggcaccgcagcatcacggccgtcaggaacaccccgcgcacggcggcctgtccgccgtcatccgctacaccgagtacggcatcgcgcacatcctcgccgacgactacgcggacctcggcttcggcaccggctgggcgcaggccgccgaccaggtgtgcacgctcgccgacggattcgtgacggtgcgcggcgaacgctcccgctggttcggggccggcgcggcacccgaccgctcgctctcctccgccgccaccaacctctccagcgacctgttcttccgcggggtgcggcaggcggggaccgtgcagaaactgctggccgagcccgcgccgcgcggtccgagccgggcggccgaggatctcgaccggggtttcgcggccgggtacaacgcctggctgcggcagaaccggatcaccaacccggcctgccggggcgcctcctgggtgcgtccgatcaccgaactcgacgtggcgtcacggacgttcgcgctcgccgtgctcggcggtcagggccgcgccgcggacggcatcacggccgcccggccgcccgcgtcctcggccgggccgaagg

SEQ ID NO: 1076 - DNA, 4362 bp, Unknown
  Kingdom: Bacteria, Phylum: Actinobacteria, Class: Actinobacteria, Order: Streptomycetales, Family: Streptomycetaceae, Genus: Streptomyces
cacccgggagggccgcccggccgccgaggcgctgcgggacaccgtgcgcctggcacaggaggcggagcggctcggctaccaccggttctgggtcccgcagcgcctcggcggccgggcggccctcccgggtgcgggagcggtccaggacggagaaaggggtggactcgatcagggcgttcaccttcggttcaacgcggcagagcgccggtgattcccgctcagccgggcggggctccgggctccgggccccagtactccgggccgaccccgcgccagtcgatcaggggggagacggagacctcaacggggtctacatcgagaccggcgcggcgcaggaactcggcgacgtccgcgacgttgtacgccagccccaggatctcgccgttgacgcggacgcgtcggccgcccgtgggggagggcgggtgcacggtcacgggcagtgctccggacatgtacccagcatcgggtgcggggcgcgggcccgcatccggaccggtccgcccgggccccgccgggttccggcggggcccggcgggttccggcggcgagatcctcggaccccgccgggttccggcggcaagaccctcgggccctctccgggttccggcggccagaccctgcggcgtcggggcgtgcggaccctagggtggagggcgtgacggacaccagcaagcggcctctcgccgtgttcgacctggacaacaccctcgccgacacggcgcaccggcagcggttcctggagcggcggccacgggactgggacgccttcttcgccgccgcgccgaaggacccgccgctcgccgagggcgtgcggctggtccgggacagcgcggtcgagtgcgaggtcgtctacctcaccggacggcccgagcggtgccgtcgggacacgctggactggctcgccgtccacgggctgcccgaggggccgctccacatgcggcgtgacggcgaccgcaggcccgcgcgcagcaccaagctggagatcctgcgccggctggcccggacccggcggatccgcgtcctcgtggacgacgacgagctggtgtgccgggacgccgaacaggcgggattccgggtcctgcacgcccgttggacggcaccctcgggcgagctggcggacgcgcaggagcgggagggccggacctgagaccgagcgatcgggcgtaggcctcagcccgcctcctcgatccggaagccgaccttcaggcccacctggtagtgctcgacctgcccgttctcgatctggcccctgacctgcgtgacctcgaaccagtcgaggttgcgcacggtctgcgaggcgcgggtgatggcgttgcggatggcgtcgtcgacgccctggtgcgaactgccgacgatctcggtgacccggtagacgtggtcggtcatgatgcgcgtgctcctctcgcgggcgacgccggctgcggtgcctgcagcgtgggcgtagcaggacgacggcgtcacgtcgggcggtgacactccgtgagacacgtgtcacacctcactccacggtgccgcatacggcgcccgcgcgcgagatgtgcggatcgtgaccggacggacacttgacctccgtattggtccataccaaaatccccagaacgcccgtacgagccaccctgctcaaccccccacgtcgggatctttcctgtgcacctgacagaactggacccctcgtgagacgtcgcctcctcgccctcgtctgtgtgcccgccgcgctggccagcgcctgcggagcgctgcccggcagcggttccggcggacggcacaccgtcaccgtctggctgatgaaggacagcgcgtcgcaggacttcctgcaccgcttcaccgaggacttcgaacgcacgcacaaggacctgcgcctcgacatccgcatccaggaatggaccggtatcggtccgaaggtgcaggccgccctctcgggtgacgggaagggcggcccggacgtcatcgaggtcggcaacacccaggtcgcccagtacgtcgagggcggccggctgaccaacctgaccctggagtcgatgcgggactggggcatgcgggactgggtgccgggcctggccgagccggggcaggacaactccgcccagtacggcatcccgtggtacgcggccaaccgtgtcgtcgtctaccgcaaggacctcttcgagcaggccggcatcaaggccccgccgcgcacccgggccgagtggctttccgacacgcagaagctcgacaccggcggcaaccagggcatctacctggccggtcaggactggtacacgctctccggcttcatctgggacgagggcggcgacctcgccaaggagagcgccaacgtctggaagggcaccctcgccaccgcggccgccctgcgcggcatggacttctaccagcggctgcagaagctcggcgacgggcccgccggcgccgacgaggaacacccgccgcaggccggggtgttcgcctccggcaaggtggcgcagatcgtggccgtgcccggggtcgcccaggccatcgtgcagaagaacccggacctcagggacaagctcggcttcttcccggtgccggggaagaccgcggcccgcccgggcaccgtcttcaccggcggctccgacctcatcgtgccgcgcaacaccggcgaccgggacgcggccgtcgcggtcgtcgccgcgctcaccggcgcgaagtgggacaccgacctggcccgcaccatgaactacgtcctcaacaagacgacgctcgcctccgcggtcgccggagaggagggggtcgcggccatggcggcgggcgcagcgcacggccgggcgaccccgagcactccgcagtgggccgccgtggaggccgacaacccgatcaagcggtacatgacgaaggtgctcgacggcggcgacccgcgcaccgaggcacgccgcgcctcacagcggatcaccgagcaactggcacccggcctcggctgacggtccggcgcggatcacacccgccggccgggaccggcccgcccgcgtgcgcggcggctcaccgcaccacgctgagcgacagcgcgaagcgaccctcgccgtccgtccaccaccgggtcaggtccagcccggcggcggccagttccgcgttcaccccctcccggcggaacttcgccgagacctcggtgcgcatttcctcgcccgcgccgaagtcgacggcgagatcgagggcgggcaccttcacggtctgcgcggtgcgcgagcgcagccgcatctcgatccactcctcgtccgggttccacagcgccacgtggtcgaaggcgtccggatcgaagtcggcgcccagttcacggtcgacgaccgccagcacgttcttgttgaacgcggcggtcacccccgccgcgtcgtcgtacgcccgcaccagcaccgcctcgtccttgaccaggtcggtgcccaggagcagcgcgtcgccgggggtgagcagcgcgcgtacgccggccaggaacaccgcgcgttcggcgggcagcaggttgccgatcgtgccgccgaggaacgccagcagcctcggacccggggtgtcgggcagggtgagtccggcggtgaagtcggcgatcagcgcgtgcacggtcaggtccgggcgttcggcggcgagcgcccgcccggcctggcgcagcgcgctctcgctgacgtcgacggggacgtaggtgtgcaggccggtgagtgcgtcgagcaggtagcgggtcttctccgaggagccggagcccagttcgaccagggtgcgggcgggcagggcggcggcgatctcgggcgcccggccggcgaggatctcgcgttcggcgcgggtcgggtagtactcggggagtccggtgatccgctcgaacaggtcactgccgtgcgcgtcgtagaaccacttcggcggcagcgccttcggatcgctggtcaggccgtgctggacgtcggcgcgcagtgcggcggccgtggcgtcctcgggcaggatgcgggtgacgtggaaggggctcacgtacggggctcctcggctggggcggatgccaggtcttcggcggggttcccgaggctgggatcctcgaggccggcatccctgaggtcgggggtcttgaggccctggccgtggaggccggggtccttgaggctgaggtccttcagcggggtcagcaggacgtccgtgcggtgcgccgcgagcagcgtgcggtcgggcacctcgcgccagcgcggatcgtcgtcgtacggctcggaggccaccaccaccgacccgtgccctggttcggcgaggtaccacagggtgtcgccccaggcggtggccgtgatcgtctcgccgtcggtgagcagcaggttgagccgggagccgggggccgccgcggccacctcgaggacggtgtcggcgagggcctgggcgggcgcgtcgccg

SEQ ID NO: 1077 - DNA, 5822 bp, Unknown
  Kingdom: Bacteria, Phylum: Actinobacteria, Class: Actinobacteria, Order: Streptomycetales, Family: Streptomycetaceae, Genus: Streptomyces
ggccagcggcacgacggtcacctggcggaccggcccgtcgtgctgacggtgcgcccggcatcgggcggcccggtccgccaggtgaccgtcgtgccgctggcctcggaggccgcgctgcgctaccacgacctcgtccgcgcccgccggacgcgggtccgcgagcgggccggcgggcggctcggctatgtgcacgtaccggacatggtcgcgagcggctgggcgcagctccaccgcgacctgcgcgccgaggcgggccacgacggtctgctggtggacttccgggagaacgccggcggccacctgtcggccctggtgctcgaacgactcacacgtcggccggtgggctggcagctcaggcgcggcaaccggccccagtcctatccgcccctggcggccctgggcccgctcgtgttcctcgccgacgaactgtccggttcggacggtgacaacgtcgtggccgcggtgcgcgccagagggctgggctcagtggtgggcgtacggacgtggggcggcgtgcgcgccatggaagtcggccacagcctggtcgacggcacccgcctggtccacccgcgaggcgcgttctggttcgcgcacggcgggtggggcctggagaacgagggcgtcgaaccggacatcgaggtgaccgtcgcaccgcaccagcgggcggtgggcgacgacccgcaactggacgcggcgatcgacgtggcgctggcggagtgcgcgcgtacccccgtgacacgggccccggagctgccgggcgcctgagggccccgccgaccagggtttcagaaccttggcatgcatatttcccatttcatgcggtgacgcctccgcatcacgtttccctataaccgcggcatgggtgttttccggcattcccgaacactcggcgaatcagccgtgcgcgactccgtaaaagcatgccgatggccctggcggccataacccattggacctctgaatacccctgtatgatcctccagcatgaccgtccaaaacttccttgatcctttggtgaacgtcccaagaatttactgagcagtaatttggtaatctcctcaccagaagctttgggggcgtggaggggattacatgaccgcagaaagcggccagggggaactgggaccggacacccacatttttctgcggcaggactcggtgttcgtggaatccgatgacggggtttttctgcgcagtggcgcgggggacttctacatcaagggcgcgtccgcctacggctggctgagccggctcgccccggtcctcgccgcggggaccaccctgcgggaggtgtgcgaagggctggcgccggagcgcgccgccgtcctggacgggctggtgcgccacctcgtggacaagcggttcgtgcgggcgctcgccgaggagcccggtgatctgctggacgccgccgagcaggagcttttcgccggacagctcgcctatctcgcgcatcactgccggacgccgcgcaccgcccttcgccgggtacgcgacgccagggtcgccgtcctgggcgcggacgcggagggatccggggcgatcgccgccgcgcggaccctggtgcgcaacggcgcgggacatgtcgccctcctcggcgcgcggccgggcacactgccggccgcggaatccgctcaggtggaggcgctcccgggagtctggacggacggctggcgggaggcgctcaccgcgtggcggccgaccgccctcgtcgtgccgcccgacggcgtgcccggcgcgctgctggaccccctcgccgccatcgcccgccgcgccggcgccgtcttcctcgccgcccgctcctacggggacctcgttgtcaaggggccgctcgtcgcccccggcccgcacggcaccaccgcctgccggaactgcctgcgactccagttggccgaacacggtacggaatcgctggccgctctcgtcctgcgtgacgagacgtttaccgcgcagcgcctgcgccaccgaaagggcgccacgggccggctcactccgctgctcgccgcggcggtgggcagtgaactcgccaccgaactgttcaaacacctttcaggagaaatcgggtccgatctttccggggcggtcgtcattcagtgctccgaaacactggaaagctggcgcgaacttctgccccaacgccttgactgcgatgtgtgcggacagccggccccctggaggggaaaagaactccgagcagcggaattcgaccttccggattcccccgaggaccgcttgacgcggtatctctcggtgttcggccggaccactggactcctgcgcgagttcgccgacgacgacctggcccaggcacccgtacgggccggcctggtgcgcaccgcaggaagctccggcccgcaggcgtacggcttcagcaccggcacgtcgcacgaggcccgcgccgtcgccgccgagcgcgcactgcggcacgccgcgtcccattgccccgcacccctgcctgtacgacaggccacggccgcggaactgggggccgagggggcgcaaacgacggagagcgcggccgacggcgaggaacgggcgtggaccccggccctgcggctgcgtgacgacgcgccggtctgggtgcctgtggaacgagccctcgcggaaggctgcgccggcgcaggcgccacgttccgggaagtcgtcgccgcgggcctcaccgccacactgctggaggagcggctgcacgactggctgcacggccgcggcatcccccgggccctcggctcggtggagctggacgcccgccacaccccgctcgctctggcgctgctgcgcaccggcacgctcaccgtccaggaactgcccgtcccgccctcgcaggacgacggcatcgcggtggtcctggcccgtcacgtccccgcggcggacggagcggggcaccaggtggcggcggccgggccgaccccgcgggccgcgctcgccactgcgctgcgcgagctgtccggcctggcaacggcgcccgaagccgcccagggacccggcgggccctaccacgtggtgtgtccgcccgactggcccgcgccagaggccccgccggtggaccgcgcagacctcgtcctcgcggccccggacgacgacggccacgtacccggcggaacgggggacggcgcgaccccgtacggcgccgaggcccccggtcccgccgacctcaccgacctcctgcgcctcgtcggtccgggccgggacgctctcttcctggaactcgtccccgcgggactgcccaccgcgccggccggagagccggtcgtcctcgccggccgcgtgctcctcgtcgacacgccctagttccggtcgccccgcttctgtcgcacacccggccgtgcggaacccggtcctgtcgctgggctcgcctgccgcacgtgcgcccgggtacgccgggcacaagtgctggacaccacccggtccttcgggtcggtccggcccctcagatgtcccccgcgccgtccggcgcgggggaagacccgggtgaacccgcccggatattgcggaaccccacgaatggagactgccatgttcagcaagaacaacgagttcgccgacctcaccatcgagaccttctcgatggagccggtgcagaaggagaacgacccgaccatgctcgccgccacgtgcagcagcaacgtcggctgctgctccaccagcggcaccccggtcggcgaggaagcctgacactgatctccggcctccggccgtgaccctggcaacggcgtgacccgtggtgaccggccccgcagggccggtcaccacggcaccctgacggagaaccagtgactgacatcgacaccgcgccccgcgccccgttcgcgcccggagacccactcggtgagcggcacgaagcgcttgtccgagcgctgcgcgcccacctctcccaccacgacacaccgtccggtttcgccgtcccggtcaggacgctcggcctcgccctcgacccgccagacgcgcctggcgaggaagccctcacgatccccgtacacctctacggcgacacggccctcgtcggtcccgcccatgacacggccggcgggagcgggccgtgcgggggctgcctgcgccaccggtggaccaggctccggcccgcccgcgaacgccaggcactggaggccggccgcgccagtaacaccgccggccccggcacctgcgtaccggccgactggcaggtgcccacgatcgcgctcgcgctgcgtcaactggcggccgagcggcagcacaccacggccacccccggcgtcgccgacgtcctggagatcgacctcacgaccggcaggaccacccgtttccgcctgctcgccgacccggcctgtgcccactgcgcccgcccgcgcgacgacgagccgccctcggcacagggcttcccccgctcgcgccctcttccgcgtcccggcctcacccggctccgtccctggcacgccgtcgagcttcctctcgacgcgctggacaacgaactctgcggcgcggtgggcaccggtcgcgccaaccggctcctcgccggtgtcaacgccccggtgaccgggcaactccggctcgggggcaagcagtcggagcgcaccacgctgtacgagatcacctggggcggccacgccgcgagctaccgcgagagccgggtgctcggcctcctcgaaggtctcgaacggtatgccgggcagcgcccgcgcggccggcggcccgccctgcgcgcggccctcgcggacctggacgatgcggccgatccggcagccgtacgccccgcactggacccgcgcgacaccgtgctccccgaagacgacttctacgaacgagaccacggccggaccttcgccccgttcaccccggcccgggaactcggctgggtatgggggcactccttcgcccgcggcggccccctcctcgtccccgcccaactcgcctactacggaccgcacccactgggcgagcagttcgttctgggctcgtcgagcggctgcgccaccggcggctgcctggaggaggcggcactgcacggcctgttcgaactcatcgagcgggacgccttcatggtcgcctggtactcggccgccaccctgcccgcgatcgacccggagagctgtgccgagccccagacggccgccgtcgtggaccgcatgcgcgccctcggctaccaggtgcgcctgttcgacctgcggctggacctgccggttccgatcgtgctgtgcgtggcccggctgaacaccccgggaccgggcaacctgtgcatgtcggccggtgtcgggcccgacccggaggacgcggcgctggccgccgtgcgcgaagtggccagctatctgccgggcttcgcgcagcgcgtggagcgcgacgagagcgagctgcgccccctcgtcgaggactactccgccgtgaccgaactggaccatcacggcgcgctgtacggccttcccgagatggcggagcgctcccccttcctgggccccttgaccacgacgcgctcgctccgcgaggcgttcgcggactggtccccgccccggcacgccgatctgcgcgaccagttgctgcactacaccgacctggtgcgcaccgtcgccggcgatgtggtcgtggtcgaccagacctgccccgagcagcggtcggcgggagtgcacaccgcctccgtgatcgcccccggtctggtgcccatcgacttcggctggaactaccagcgcgtgctgcactccgaacgcctgcggacggcggcctggcgggccggcaaacggtccgcgccgctcggcgaggacgagatccaccggcacccgcacccgttcctgtgagccggtcgtccgcatcgccccttcggcgggcgcggcgacagcgcccggcggccccggacagcaagc

SEQ ID NO: 1078 - DNA, 3361 bp, Unknown
  Kingdom: Bacteria, Phylum: Actinobacteria, Class: Actinobacteria, Order: Streptomycetales, Family: Streptomycetaceae, Genus: Streptomyces
ggatcagcgcatgccccggcggaatgcgccgtacggcctcgtacggcgtggagtcgtccagcgcggccgggacgtccggggcggcgagcagggcggcgaggtgtccgaagtcgaggttggcctcgacgaggtcggccagcggcagcgcggccgtcgcgtaggccgtgccgctcgcccacggggtgtggaacaccgggcgggcacccgcgaggtcgccgcagacggtgatgcggcggcccacctggacgacggcggtgtaactgccgggccaggccgtcagatgccgcagtgcgcccccgcgcgcggccagcaggccgacccgcagctgttcgtcggaggcgccgcaggtgccgagcaccgcgatcctggtccggtcgtcggcccgtaccagccggacctcgtccgggcgccagtcgccgaccgcccacagcgggtcgggatcgccccacaggagctgggagcccaccggttgcacggtctcgccgtcgtatccggtggcgcccgcggagtcgatccctccgttacccgcggtggcgctgctccatcccaccaaccaccgcatcgacgcctccacggacccgggaccaccagtgcaccgcacgaaccgggtcccatgctgccacgaaggcggcgcaccggagggcaggcggagccgccttcggtgcaccgtgtgcgccctcgcgcgccgccccgcacgatggccaacgcgcgtaccgggcacggacactgcgacctgaatgcgccccctgatgcgctccccatgagaccccgcgcgccctcaactgccgtggtgagaacggaaattcacggcaggaggcaggggtggctttcggccaaatcggcacagcggagacagacgtgcgcacgctccgtacatgctctgcgcagcacgcggacaacgcgcagcccgggaggcgcagttcgcctcccggaccgttccgccgcccgcggggatgaaggcggcggtgtcccccagcccactggatccagtacagcgggccgacccacgcaccgaccatggaaccgctccccggatggccggaggagagcgcacgggcgggcgcacgaccacacagagggggcacgccgccacggtgcgtgcatggcccgtactgccgtgcgggccacaatcccgccaaccggaagaatgccccttaacgcttgggatgcggcgaactacgctgggtttacgaatgccgcgtggttatgccagcgcggcagccgtctgtgtcgaggggtggcgcatgtccagggagcaacgcgggccgaacgagaaactcggcgccgttctcgccctcgcgggaatcagcaacgcaggactcgcgcggcgcgtcaacgacctcggcgcccaacgcgggctgaccctccgctacgacaagacctccgtggcgcgctgggtctcgaaggggatggtgccgcagggcgcggcgccgcacctcatcgcggccgccatcggccagaagctcggccgcccggtgccgctccacgagatcggcctggcggacgcggatcccgcgcccgaggtgggcctcgccttccccagggacgtcaaccaggccgtgcgcgcggccaccgagctgtaccgcctcgacctcgcaggccgccgggccggctccggtggcatctggcagtcgctcgccggatcgttcgcggtgaccgcgtacgccacgcccgcctcccggtggctgataaccccggccgacagctcggtggcgcgcgaggccggcgggacggagggctcgggcgcaccggtcaaagtcggccacagcgacgtgcgcaagctgcgcgaggccgccgaggacgccaggcgctgggactccaagtacgggggcggcgactggcgttcgtccatggtgcccgagtgcttacgcgtggaggccgcaccactcctcctcgggtcctactccgacgaggtcggccgtgccctgttcggcgcctcggccgaactgacccggctggccggctggatggccttcgacaccggccagcaggaggccgcccagcggtactacatccagtcgctgcgcctcgcgcgcgcggcggccgacgtgcccctcggtggatacgtcctggcgtcgatgtccctgcaggccacctaccggggcttcggcgacgagggcgtggacctcgcgcaggccgccctggagcgcaaccgcggcctggccacggcccgcaccatgagcttcttccacctggtcgaggcacgcgcccacgcgcgcgcgggcgacgcccaggcggccggcgcggccctgaaggcggccgagggctggctggagcggtcccgggagggcgacaacgacccgacctggctcggcttctacggctacgaccggttcgccgccgacgccgccgagtgctaccgcgacctgaaggcaccccgccaggtccgccgcttcaccgaacaggcgctgtcgaaacccacggaggagttcgtgcgctcgcacggcctgagactggtggtctccgcggtcgccgaactggagtcgggcaacctcgacgcggcctgcgagcagggggtgcgggcggtggaggtcgccggacgcatctcctccgcgcggaccaccgagtacgtcagggacctcctgcaccggctggagccctacggcgacgaaccgcgggtggccgagctgcgcgagcgggccagaccgctgctgatgaccacggcctgagcgcagcgccggggaccgccggggagcccggcctgagcgggccgggcagcccgctccccgtgcgccggtctgtccgctcccggtttgaaggcattgtcagtggcgcagtgcactatcgggagcgggaggtggagcaggtgcggaagatcgcttacgactgcgatgcgctggtgatcggcggcggcatcgtcggcctgtcgacggcgtacgcgatcacgcgcgccgcgccgggcacccgggtgacggtgctggagaaggaaccgggcccggcccggcaccagaccggacgcaacagcggagtgatccacagcgggatctactaccggcccggctcgctcaaggcccgctacgcggtgcggggcgccgcggagatggtcaagttctgcgcggaatacggcatcgcgcacgccgtcaccggcaagctgatcgtcgccaccgagcgcgaggagctgccccggctgcacgccctggtgcagcgcggccgggagaacggcataccggtgcgcgagctgggcgccgcccagatcgcggagtacgaaccggaggtgcgcggcctggccgcgatccacgtgggcacgacgggcatctgcgactacacggacgtggcccggcacctcgcggccgcctccggcgcggagatccgctacggcgcccgggtcgtccgcgtggaccggcgccccgagctgggtgtg

SEQ ID NO: 1079 - DNA, 4028 bp, Unknown
  Kingdom: Bacteria, Phylum: Actinobacteria, Class: Actinobacteria, Order: Streptomycetales, Family: Streptomycetaceae, Genus: Streptomyces
ggcgacgccacggcgtcctcgtcccgcaccggccggacggtgccgacgaactcccgcagccgggcgccgtgttccacccgggcggggaacgtgtccgaggcggtacgccgggccagggcggccgtgtcgagcgggcggtgcgcggcgatcagcaccatgttgccgaagcggcgcccccgcagcacccccggctcggcgatgagcgcggtctcctcgaagagcgcggcgaaggtggcgagttgggaacgcaggaacgcgaagggcgcggcgtccgcgagattggcgaggtagacgccgtcgggccgcagcacgcgctccgcctcgcgggcgtaggcgagggacgtgaggtgcgccgggacccgggagccgccgaagacgtcggcgatcagcacgtccgccgagtcggccggggcggtttccagccacgcgcgggcatcggccgcgtgcagggcgatacccgccccctcgggcagcgggagatgcccgacgaccagttccagcaggctccggtcggcttcgacgacgtcctggcgtgatcccgggcgggtcgcggccacatagcggggcagcgtgagcgcgccgccgccgaggtgcagcacgtccagcggacggccctcctccgccacggtgtccagcacgtgcccgagcctgcgcgtgtactcgaactccagatgggtgggcgcgtccaggtcgacgtacgactgcggcgccccgtccacggtcagcagccacgcgcgctcacggtcgacgtcgggcatcagcttggcggtcccgtgatcgacggcgcgggtcacgggtatgggctcggtcacgtcaccattgtgccgggacggccccgccccgggacaggcgggcggaagccgccacgcggcacaggcaagccgaacagcgagccggcccggcgaccgacccggcgcggcccgggactccgcggcccggagagtcgcagcccgggccctctcggcccgcggagtcacgatccgtatatctgcggtgcgcagatatacggtccgtagcgtcgcggtcagtcgacggcggtcacggtccccgctcccaccgtccggccgccctcgcggatggcgaagccgagccccggctccagggggacctcgcggcccagctccaccgtcatggtgaccgtgtccccgggccgcgcgacggccgcctcgccgaggtcgacgtcgccgaccacgtccgcggtacggatgtagaactggggccggtaccccgtggccaccggcgtggtccggccgccctcgcgggccgacagcacgtacacccgcgccgtgaaccgccgtcggggcggcacgctgccgggcgccgcgacgacgtgcccgcgacggaccgcgtcgcgcggcaccccgcgcagcagcagtgccacgttgtccccggcctgcgcctcctgcatcggcttgccgaacgtctccaggccggtgaccaccgtctcggtctgcgcgcccagcacctcgacccggtcaccgacgcggaccgtgcccctctccacggctccggtgacgacggtgccgcggccggtgatggtgagcacgttctccaccggcagcaggaacggcgcgtcgaggtaccgctcgggcatcggcacgtaggtgtccaccgcgtcgagcagcgcctcgatggacgccgtccaccgcgggtcgccctccagcgccttcagcccggacacgcgcacgaccggtaccgcgtcgcccgggtacccctgctgcgtgagcaggtcgcggacctccagctcgacgaggtcggtcagttcctcgtcgcccgcgtcggccttgttgagcgcgacgacgatgtggtcgacgcccacctgccgggcgagcagcacgtgttcggccgtctgcggcatgatcccgtcgagcgcggagacgacgaggatggccccgtcgagctgcgcggcgccggtgaccatgttcttgacgtagtcggcgtgaccgggcatgtcgacgtgcgcgtagtgccgggtgtcggtctcgtactcgacgtgcgcgatgttgatggtgatgccgcgggcggcctcctccggggcccggtcgatgcggtcgaagggcacgaacgtgccggtgccgcgctcggccaggaccttggtgatggcggcggtcagtgtggtcttgccgtggtcgacgtgccccatcgtgccgatgttcaggtgcggtttggtgcgtacgtacgccgtcttgggcatggctgtacctcgaagcctggtgagaaaaggtgacgcgggaccccggaggagaaccgaccctccccctgcggggtccgccggacgatccggggagggtcagcttcgggcgccgtcgactgcggccacgaggatccggacggcagccttcggagcatccgcgactgcggatgctgcgaggaggaaggcgtgccggaacatgcgtcgatcatcgccgaagcgcggtcacgcgtcgaatggttttcggcgtacgagaacgcccggacggacgctcggaccaaagcacgcacggaccaaagcacgcacggacgcacggacgaacggcgggaacctcgtcgtcagggggcgttcagggcccgatgttccgcagcgcctcccgcaccgtcagcggcgcgaacctgccccgctcgcgggccacgaagccgcgtacggcctccggatccgtcttggcgtactcccgcagcgaccacccgatggccttgcggacgaagaagtccgggtggccggcctggcgcacgcagtacgcgaacaggcgctcgcggtcggtgcgttccttgtagcggagctggtggagcagggcggtgcgggcgacccacaggtcctcgtcggcgatccaggcgtccatctccgcccgcaggtgcggatcggccgcgaccagcgggccgacgacgtgcgcggcgagcaggtccacggtgtcccaccaggagacggtggtgatcaggtgccgtgccacgggcaggaacgcggacgagcaccgcctcacgtgccggcgcaggtagtcgacggcgaagtagtggtactcgcgctcgggcagctcccagcaccgcagcgcgaccgccgtgcagtcggcctcgtccggccggcgtgtgcccgcgaggaccgtgcggtccagggcgcggcgcgcgggtgcggtcaggccgaggaagggggcgacgtccttcatgtacgcgcgcagggccggtgcgcgccgcgggtcggccgcggcggcgtaggcggtggtcagccgttccagcacggtgtcggcgagagcgctgcccggtaccgccgggatgcccgcgtctgtgacactcatgagacgaaccatacggcgatcagacacacctgtcggttaatgtcaccggatgctcgatgccaccaaccgctctggaggcaccgccacggcctctccccgggccgccgtcaaggagccgggcgtcgccgtcctcacggccgcgccggccggcctcaccgcgtccacccgctgttcgagggtgctgctgtcgccctggtcgcggctgtccctgctgctcgtgctgctcgcggcggccggcgcctgcgtgctgctcttccagccgcagagactgctggcgcacggctggccgccacagctcggcgggttcgcggcggcgctgctgttcgcggtggcgtacggcctgtgcacggtggcgttcgtgccgcgcccgttgctgaacctcgccgcgggcgcgttgttcggctcggggctcgggctggcggcggcgctggccggcaccgtcctcggcgccgggatcgccttcggcctggggcgcgtgctggggcaggacgcgctccggccgctgctgcggggccggttgctgacggcggcggacggtcagctgagccggcacgggttccgttcgatgatggcggcccgcctgttcccgggtgtgccgttctgggcggccaactactgcgccgccgtctcccggatgggctggcccgcgttcctgctcgcgacggcgctcggctcgatcccgaacaccgccgcctacgcggtcgccggtgcccgcgcggccacgcccacctcgccggcgttcctgatcgcgatggcctgcatcgc

SEQ ID NO: 1080 - DNA, 2020 bp, Unknown
  Kingdom: Bacteria, Phylum: Actinobacteria, Class: Actinobacteria, Order: Streptomycetales, Family: Streptomycetaceae, Genus: Streptomyces
gatccaaacgaaagggcctagcatgctcgggcagtcgaccaggtgtcctgctcaaccagcgacctgctgatcaaggcccgcaagacgctgacactcggcacagcccgtttcgggacctgggcgcgcccatgccgttctcgggcgtgaccttcgctgccgcaaggccgatactgccgacagcagggattctgaccaagcgcacccgaccgtccgaccgtcctgacgagccgtcaccgaagtcagcattgagtcagcatcagtaccgccagaacccgctccaagccgtcacggaccgccaagatcgaaaaccgcccctacccactctgaccagcaaagaccaggtcatcgcctggcctgctaggcttcccaggaggtacccatgaggatgctgatcaacgtccccgaaaccgtggtcgcggacgcgctgcgcggcatggccgccgcccatcccgagctgacgatcgacgtggacaaccgggtgatcgtacggcgggacgcccccgtggcggggaaggtggccctggtctccgggggaggttcggggcatgagccgctgcacggcgggttcgtgggcccggggatgctcgcggcggcctgccccggcgaggtcttcacctctccggtgcccgaccagatggtccgggccgcggcggccgtggacagcggggccggggtgctgttcgtggtgaagaactacaccggtgacgtgctcaacttcgacatggcggccgagctggccgaggacgagggcatccaggtcgcgaaggtgctggtcaacgatgacgtggcggtgaccgacagcctgtacacggcggggcggcgcggcaccggcgccacgctgttcgtggagaagatcgcgggcgcggcggccgaggaggggcagccgctggagcgggtggaggcggtcgcccggcaggtcaacgagaactcccgcagcttcggcgtggcgctgagcgccgtcaccaccccggccaagggcagccccaccttcgacctgccctccggtgaactggagctgggcatcggcatccacggcgagccgggccgggaacggcggccgatgatgacctcgagcgagatcgccgacttcgcggtgaacgcgatcctggaggacatgagcccgcgcaaccccgtactgctgctggtcaacggcatgggtgcgacgccgctgctggagctgtacgggttcaacgccgaggtgcagcgggtgctcgccgaacgcggggtggccgtcgcgcacaccctggtcggcaactacgtgacgtccctggacatggcgggcgcctcggtcaccatgtgccagatcgacgaggaactgctgcggctgtggtccgccccggtgaacaccccggccctgcgctggggcgtgtgagccgcggctgctcctcgacgcatcgaccgtacccatcacgcaagggagttccagtgctcgacgccgatttcttccgccgttggatgacggcgacggccgcgtccgtcgaccgtgaggcgcagcggctcaccgacctcgactcgcccatcggggacgccgaccacggcagcaatctgcagcgcggtttcacggccgtacgcaacgagctggagaaggaggcgcccgacactccgggcggggtgctgacgctggccgggcgggagctgatctcgaaggtcggcggtgcgtcggggccgctgtacgggacgttgctgcgccgcaccggcaaggcgctcgcggatgcctccgaggtgtccgagcagcagctcgccgaggcgctgcgggccggggtggacggggtgatgaagctgggcggggccgcgccgggtgacaagacgatggtcgacgcgctggtgccggccgtggaggcgctcggtgagggtttcgccgccgcgcgcgccgccgccgagcggggcgccgaggcgaccacgccgttgcaggcccgcaagggcagggcgatgccacctcggcgagcgcagcatcgggcaccaggacccgggcgccacctcgtcggcgttgctgatcgccgcgctcgccgaggcggcatcg

SEQ ID NO: 1081 - DNA, 1626 bp, Unknown
  Kingdom: Bacteria, Phylum: Actinobacteria, Class: Actinobacteria, Order: Streptomycetales, Family: Streptomycetaceae, Genus: Streptomyces
atgccggtggtgccgggccgccaggtgggcgcgctcgtgcgcgaacagggcgcgccgctcggccggggggagcccgccgagcagggccgtggtgacgacgatccgtccgggggcgccggggagggcgtacgcgtacggggtgctgtcagggagtaccgcgaccgtggagccgcgcagcccggtcagcgcccggcgggcgcgccggatcacgcgccggtggcgccacagcgtgcgggagcaggccgccgtgaccgcggccagggccgggatcgccgcgcggccggcgatcccgtcatgcggtacggcagccctgacctcggggtcggaccagccgtccggcagcgggttgcccgggagctgtgcggtgccgaccaccatgagcagtacgaggcagagcgtgctgcagaccgccatcacgacggcgacggcggtcaggagccgggtggcggtgcgcgggtgcagatggagttcggccagccgggcgaccggccaggcggtcagcggcagcaccagcggcaggaagacgaagacccccatcaggtgtcagtcccttccgccctctccgccgcccttgccatcctctccgccgtctccgccgtctcccccgcccctgccgtcctctccgctctcttcgctcgctccggcttgctcgttcccgccgtcccgctcgtccgcgtccgccgtctccagcagcgcgcgcaggagttgctcgtcgccgggcggcagcgcggtgacgaagctggcgaggaccgcctcgcggtcccgttccccgtccagcagacggcgcatcctgagggccgcgagccggggcacgtccgccgtcggcgtccagacgaaggagcggccccggcgttcccgggagaccacgtccttggcgagcagccgggtcaggatggtgacgacggtggtgtaggcgaggtctccgccgagccgctcctgcacccaggccgcggtcaccgggccatccgcctcgcggagcgcggcgagcacctggccctccagttccccctgcccgcgccggggccgccggtcgtgctgcgccatgtccgtctccctccggcgtcggctgccggaccacgctacttcactccgtggcatgctgacccgatggcttctccgagtgcgatggccccccttgccgagcgggtcgaggaacttctgtcggcggacggcccgttgcccatcgtggcggccggtgatccggtgcttcggcgtgctgccgagccgttcgacggccagctggagcccgcgctgctggcccggttcgtgcaggcgctgcgcgtcaccatgcgcgccgcgccgggtgtgggcctggccgcgccgcaggtcggcgtgggactgcggatcgcggtcgtcgaggatccggcgccggtgccggaggaggtgcgggtggcccggggccgggtgccgctgccgttccgggtgctggtcaatccgtcgtacgagccggccggcacggagcgggcggcgttcttcgaggggtgcctgagcgtgccgggctggcaggcggtggtggcccggcacgccgaggtgcgcgtccgcgcactcgacgagcacgggcacccggtggacgaggtgttcaccgggtggccggcccgcatcgtgcagcacgagaccgaccacctc

SEQ ID NO: 1082 - DNA, 503 bp, Unknown
  Kingdom: Bacteria, Phylum: Actinobacteria, Class: Actinobacteria, Order: Streptomycetales, Family: Streptomycetaceae, Genus: Streptomyces
  misc_feature (291)..(311): n is a, c, g, or t
accggccctgaccagggtcgcgaccaggatggagacgatcagtccgccttcgagtccctcccgcagtccgatcaggaaactcggaaacgcgtcgtcccacatgccgtgcggccctccccggcacaccgccccggcctcgctgggaccgacttagtgaaggcatgccttacttcgggacccatcatgactacacgcatgtagtcgatcggtcatgaggtggtaatggccgggcaaaacccgcgacggatcgcggcgtggactgctccccgacgccgaccacgcccaccggcnnnnnnnnnnnnnnnnnnnnnacctgcacctgcacctgcacccaagccggcaggtcggcacgagtaccggcaccgggatcggcccttgacaccgacccggccgcgacaccgtcccgattcacccgttgagcggatcacgggaacgccgcaccggtcgttttcgtctacagtgcagtagacggtctacaggtgtgtagtcactcccccggccgc

SEQ ID NO: 1083 - DNA, 2979 bp, Unknown
  Kingdom: Bacteria, Phylum: Actinobacteria, Class: Actinobacteria, Order: Streptomycetales, Family: Streptomycetaceae, Genus: Streptomyces
gggcccgcgcccacgcgggcggcgtgccgggccggtggggcagctgcccggccagccggtccagttccacctgcgccgcatccagaccagcctcgtccagcgtcccgtcgcccgccgcgcccaccagcaggcacagcgccgccaggtcgggccgctcgcagcgcgcctcctcggcgaagcgccggcgcagctccgcggaccggtcgggaggcgggggagtgggatggaacactcccggcgtgtcctttcacgacacgccgggagcggtcggccccgccgccgggtccggctcgcggtagtggtggtacgtgtggtgcgcggcgaagcccataccggcgtagagcgcccgcgcagcggtgttgtccgtctccacctggagccaggcggccgacgcgccctcgtcgagggcctgccgggcgagcgcggccatgacggtggaggccagcccctgccgccgccgcgccgggtccacctcgaccgcggcgaacgaggcccaccgcccgtccacgaccaaccgcccgatcgcggccggcgcgtccccggccgccgcgcccggcaccgacgcgaaccacaccgagggcccggcgcccaggaccttcagggccacctcgctcacccccttgcgctggtagcgcgcgagccacgcctggtcggccgtgcgggacagcacgaccccggacggccccgcggagccccggccagcctggtccgcctggtccgcgaccggtgcgagcgccccggtccacagctcggcggtcacttcacgtatccagccgcgccgctccagctccgcgcacagcagctcctgcgtgccctcggcgccggtcgcggtctggacgtaggcgggcagcccacgctccgcgtaccagcgtcgtacggcggccagcgccgcgccgagcgggaggccggggtcgccgagcggcaggacggagttggcccggcgcgtgaatccggaggccgcccgcagctcccaggcgccgagccgctcgctctccaccggctgccaggcgcgcgctgcgacacgcgcgagttcggggtacgttgcggcggggccgcggcgacgggccggcgcggccgggacgacttttccggccaccagcgtggattccgcgatccggacggtctcgccgtccttgcgtgtgatcaggagcacaccgtcatcccatgatgtgagaacaccgaccgtgtcggtgaacttctcacccgttccccgaggttcgctcaaccgccgtacggagacccgtttgcccacgtcagcagcggtgatgcggacctcgagccgccctgtcgcccagatttccacaggtcagttcacccctcctgtatggatcatgccccggaacggagatactaggggcgggcatcgacgacgccgcgctcccgcgcgccaggcggcggagcctgtggaggcccgccagcgccctatcgaggaggaacgacagcgtgacttacgtcatcgcgcagccttgtgtcgacgtcaaggacaaggcgtgcatcgaggagtgcccggtcgactgcatctacgagggccagcggtccttgtacatccacccggacgaatgcgtcgactgtggtgcctgtgagccggtctgcccggtcgaggcgatcttctacgaggacgacgtgccggaggagtggaaggactactacaaggccaacgtcgagttcttcgacgagctcggctctcccggtggcgccagcaagctggggctgatcgagcgtgaccacccggtcatcaccgcgctgccgccgcaggccgagtaaccgtccggcggccccgagcctcccccacgttctcggcttcgctcgaacaggggggaccctcatcgcctcggtcccgtacggcctgaccgccccgcgcgtgtcggcagccgtacgggaccgaggcgttttccgtacgagaaagtgagcctgatccccgtgtccgcagtctccgaccgactccccacctttccctgggacaagctggagccgtacaagaagacggccgcagcccacccggacggcatcgtcgacctgtcggtcggcacccccgtcgacccggtccccgagctgatccagaaggcgctgatcgcggcggccgactcgccgggctacccgacggtctggggcacgcccgagctgcgcgacgcgatcaccggctgggtcgagcgccgcctcggcgcgcgcggggtcacccaccgccacgtcctgccgatcgtcggctccaaggaactggtcgcctggctccccacccagctgggcctcggccccggcgacacggtcggcttcccgcgcctggcctacccgacctacgaggtcggcgcccggctggcccgcgccgagtacgtggcctacgacgaccccaccgagctggacccggcgcacctgaagctgctgtggctgaactcgccgtccaacccgacgggcaaggtcctgggcaaggaggagctgacccggatcgtcgcctgggcccgcgagcacggcgtgctcgtcgtctccgacgagtgctacctggaactgggctgggagaccgacccggtctccgtcctgcacccggacgtgaacggcggctcctacgacggcatcgtggccgtccactcgctctccaagcgctccaacctggccggctaccgcgccgcgttcctcgcgggcgacccggcggtcctcggcccgctcctggagatccgcaagcacggcggcatgatgacctcggcgccgacccaggcggcggtcgtggcggcgctcggcgacgacacgcacgtccgcgagcagcgcgagcgctacgcggcccgccgcaccgccctgcgccaggcgctgctcgcccacggcttcaccatcgagcacagcgaggccagcctctacctgtgggcgacgcgcggcgagtcctgctgggacacggtcgcccacctggccgccctcggcatcctcgtcgcccccggcgacttctacggcccggccggcgaccgcttcgtccgcgtggccctcacggcgacggac

SEQ ID NO: 1084 - DNA, 4446 bp, Unknown
  Kingdom: Bacteria, Phylum: Actinobacteria, Class: Actinobacteria, Order: Streptomycetales, Family: Streptomycetaceae, Genus: Streptomyces
cgagccgcgcgacgccgccgttcttctcctgccagagccggtagacgtcgacggcggcgtcgcgcggctcgtgccgcatcggcagccggcgctcgtcccagttcttgccgaactcctcgtagaaggtgtccagttcgaagtacttgcggtcgtccacgtagtgcggctcgtaggcgtcgcgggtggtgaggaagacgacctcgtcgggcgagcagtagtacagcgcgcccaggcacatcgggcagggctgggcgagcacgtagaccgtggtgccgacgaggtgctcggtgcccagttcggtgcaggccgcgcggatggcgaggatctcggcgtgggcggtggggtcgttggtctgggcgaccttgttggcgctctcggcgaggacctcgccgtccttgacgatgacggtcgcgaacgggcgtccgccctcggtgacgttgcggcgggcgaggtcgatggtgcgctgcgcgaagtccatgctgtgtgtccttccggtccttgggtggacgatccttcggcggacggtcctcggacggacggtcctcggacggacggtcctcggacggtcctcgggtggaggagcggcgggccgtggccggcctgcggggccgggcgcgcccgggccgccgctccgatgggtcggcggggctggtcagaagggcttggtcggcaggtacttgccgtccagggtgatgacggcgcgctcgccgccctcggggtcggcgaccttcttcacgtccagcctgaagttgatcgcggagatgatgccgtcaccgaactgctcgtgcacgagtgccttgagcgtggtgccgtacacctggagcatctcgtagaagcggtagatggtcgggtcggtggggacgccgccggggatggagccccgggtcgggacggtctgcagcagcagcgccgcgtcgtcgtccaggccgagcagttcggcgacggcctgggcggcctgctcgggcagggcgtgctggccgagcacggcggcggtcacgaaggccggcgagaagccggccgcgtccgcgatctgctgccagctgaggtccttgcgggtcttggcctcgaccgcggcggcggcgagggcctggcgggcggcggggtcgaactgtgcgtgcaccatgaggagaaatgtcctttcttggttccagagtgaggggacacccggtccgccgcgacgcggcgacggtgctgccctcggcccgtgccttcagcgcactgggctcgatgcgtccaccttgcatgacctgcccctatagagtccaagacgcactactcatgacttctatcgttcatgtctatagcagcgcctatagtggtgtcatggctctggaactacgtcatctgcgctacctgctggccgtcgccgagcacggcagcttcacccgcgccgcggaggagctgcgcatctcccagccgaccctctcccagcaggtcaggcagctggaacggacggtgggcgtgcagctgctcgaccgcacgggtcgcagcatgcggctcaccgacgccggcgagacgtacgcacgccacgcccggcgcgccctgcaggacctggcggccgccgagcgcgccgtccaggacgtccaggacctcacccgcggccacctgcgcctggccgtgaccccgacgttcaccgcgtatctggtgggccccctggtcgccgagctgcacgggcggcaccccgggatcaccctggacatcagggagatgacccaggaccgcatcgagtccgcgctgctcgccgacgacatcgacctcggcatcgccttcgccggcgcccacctggccggcatcaccgccacgaccctgttcacggagaccctcagcctcgtcaccggagcgcaccatcccgaggacggcccgccccggccgctcccggtgcagaagctgacggagcatcagctcgcgctgctcagcggggacttcgccacccggtcccacatcgacgcccatttcgcggcccacggcgtgcagccgcgcatcgcggtcgaggccaactccatccaggccctggtcgagatcgtgcggcgcacgacgatcgtcacggtgctgccggacgccatcacccacgaccacccccatctcgaccccgttcctctcgaccccgccctgcccgcacgcacggtcaccctgctgcggcgcgggggcggttacgagagcgccgccgcccgcgccttcacccgcctcacccacagcctcgtccgcgcccgcggctacaccgacgccccagcctgaggcccgccggggacggcaccggacggcgcccacgccgggctcctcaggaggcgtccgtggacccgtagtcgtcgtagaagccccggcccgtcttgactccgaggtgtccggcgtcgacgtactgcttgagcaggtcacgcggtccggtcggcaggccggggcgttcggcggcgtagtggttctcgatgtcgaggaccacgtccaggccgacctggtccatcatccggaacgggcccgccgcggtccccatgttgatctcccacatccggtccacgtcctgcggcgtggacacgccgtcggcgaccacggccagggactcgcgtttgatggcggcccagatgcggttgaagatgaagcccgtggactccttgcgcgcctcgaaggggtggatgccgtagcggggcagctcgcgttccagcaggtcgatgacgcggcggtcggtgtgtccgtccgacatgaggtcgacggcgttctgccggggcggcatgtagaagtgcatgttgagcacccgctcggggtgctgcacatgatcgatgaagcggctcgtcgcgtacgacgaggagttgctggctaggacggcgtcgggcgcggtgagccggtcgaggtcgccgaagacgctcttcttcagctccagccgttccgggacggcctccaccaccagccaggcgtcccgcaccgcctcggccatgtcgtcggtgacggcgacggtgcccggacggcctccgtcgagcccggcggcgacgtcggcgacgttctgctccacgtaggcgcgggccgccactccggcctgtgccgacttgtcgctgatccggaccaggccgccgcgggtggcgaacatcagggcgatacgccgcccgagcgtcccggcgccgatgacggcgaccgggcgggtgtcgataccggtggggagggtgaaggccatggtccggtccgtcctgggcggcgaagaccgcaccgcctcaccgcgcggcacggtgtgtcgagctactgcgctcgagtctcccccgctcccggcgcccccgcgaaccctgccggacgaacgggcgatcccgctcccgggcaccggagtcggcccgccgccccgaaccggtcacggacgccctgaaccggtcagggacgcctgatcccccactggtccgcgaccggtccccgggtcgttcccaagaatgaccgagggccggtttcggatctctccgaaaccggccctgatctgcgactctgtcgagtcgggacgacaggatttgaacctgcgaccccttgacccccagtcaagtgcgctaccaagctgcgccacgtcccgttgcccgtctgacctggggtttcccctggccgaacgtgcaggaaaaccataccgcactcacgtcggtggtcgtgcacgtctttccgtgcgcgctcgcgcgcttgacctcaagcttgattgaggttgcacgatcgtcggcatgacgaccaccgaagaacgcgggcgcacccacgggtacgccgacctgtcccggctgatggggctcatgacgggtgacgagaagcacgggcccgccgccacgtccacgctggacgtgctctgggttctctacgaccgggtgctccgggtcgatcccgggcggctggacgacccggagcgtgaccggttcctgctctccaaggggcacggcccgatggcgtactacgcggttctcgccgcccggggcttcctgccggtcgagtggctgccgggcttcggctcctacgactccccgctcgggcaccacccggaccgcacgctggtgccgggcgtggagatcggcagcggatcgctggggcacgggctgcccatcgccgtcggcacggccctcggactgcgcgcccagggcctggacggcccccgggtgtgggtgctggtcggcgacgccgaactggacgaggggagcaatcacgaggcgatcgcgttcgccggccctgccggactcgaacagctgcacaccgtcgtcgtcgacaacgcctccgccagccatgcccgccccggcgggatcgcggcccgtttcgaggccgcgggctggtcggcggtgaccgtcgacggccgcgaccacgaggcgctgcacgccgcgttcaccgcgccgcacccgggccgcccgcacgtggtggtggcgcgggtggagccgaagacgtcctgacgcgcccgcccggcacggctcccgaacgccgctgccggccctctccccacacccctcaccccac

SEQ ID NO: 1085 - DNA, 1214 bp, Unknown
  Kingdom: Bacteria, Phylum: Actinobacteria, Class: Actinobacteria, Order: Streptomycetales, Family: Streptomycetaceae, Genus: Streptomyces
tacgtcgccgtccagtaggcgagcaactcgccgggctcgtccgggcgctggagcaccgagtccacgacctgccggttcgacgggccgccggtggctcccgccgccagccgggcgtgcacgtactcggcggcgcccacgaccgcggcggtgcgcaggttgccctcgccgcgcagccagccgagcaggccggccgtccaggacgggtcggtgacggcgagttcgcgcacgagccgcacgaaccggtcgtcgcggtcggcgccgttctcgtagaaggtctgctgggacaccatgtgggagaccgcgagcaggaagagttccgagcgcgcgtcccgctcccggccccggccgccctcgtacgtgcgcagcacgcgccccgtggacgtgacccgggaaacgggctgcggacgggcggccttggtgttgaatcgcgccatggtgaattcccccgaattcgtcaccggcggtgtgccggtcttcgaaagggaggcgcagcaaaaggaaggtgcccgagatcaggagtcggcgacggactgtgccagatgctctgccgtttgagctacaccggccctgagccggtgacgggattcgaacccgcaaccgtccgatccgaagaagtaaccgttgcctgcgcaccggacacccaccatgagctgcgcctcccgagatcagttcggcagcggcgtggatttctgtgaaaagaaggagccgcggcctgcgcaccgggaggtgcgtgaagttttcggtgtccagagatcgagggcggctgaaccgacgtgtggtgctctgcctctgagctacaccggcgtgtggtgccggtggcgggattcgaacccgcggcctccccattatgagtggaagtaggtcctgcctgtcgcacctggacgtgcatcactctaggagggagaccgcgggacgggcgaacgaatttattcgctccccggttcagtcagccttcggtcggccttcggtcaaccgccgtgcgcggaccacgtgggccagccaccgttcgccgaccgcgcggaccagccaccgtgcgcggaccgcgcggaccagccgccgtgcgccgaccgcgcgggtcaaccgccgtgcgcggagcgcgccttgaaggccgccttgcgggcctccttcgcgatcttccggtccgggtgcagccgtcccatctcctccagcacgtccgccgtctgcgggtggtccacccgccaggccgcggacgt

SEQ ID NO: 1086 - DNA, 1289 bp, Unknown
  Kingdom: Bacteria, Phylum: Actinobacteria, Class: Actinobacteria, Order: Streptomycetales, Family: Streptomycetaceae, Genus: Streptomyces
gccgtcaccagggcggcgagcaggaccggcagcgggccgcgccgcacgatcgcccggccggcgaacggcagcacgatcagcgcggccacggcgaagacggcgagcacgagacccgccgtcatggctcccagaccccgcacctgcgccacgtagacgtacaggtaggggacggtgaagccgagcccgaacgcgctgagtgcgttgcccacgtggatccggcgcatcgctgcgcccatcgccctggtcacgttcacctctctcaaacagaaggacggtcgtggagtcattgaagtgatcagtagttagacctgaagacttcgaaagtaaacttcgaagctaaaggctacacctggaaggacttcaatgccaagccggtccgtgcgatactgcggacatgggcgacacccccggcatcggcagcgagccgacactcgaagagcagatcgccgcctaccagcgcgagttccaggacctcgacccccaggtcgagaagatcgtctcggcactgtcccgcctgaaccgcaggatgaacgtcgcgtacggccggcagacctccgagctgggcatcagcaacgccgagtgggaggtgctcaaggccctcgtcctgtccggggcgccctaccggctgggcccgagcgacctcgccaagcgtctgggcctcaccccggccgcgatgacgcaccgcatcgaccgcatggtcggcgagggcctggtcacccgtgagcgggacgagaacaaccgggtccgcgtcatcgtggagctgacccccgagggccgcgagaagtggatggaggccatgcgcctcgccacggtcttcgagggtgacctcctccaggacctctctccggcggagcgcgcggtcctcggcgaggtgctgacccgcctcctgcgcagggtggagcacgcccagccggacgccggtggccggctcagcgacctcgactaaaagattttgacagagggtccttgacacgcttctgccggatccgtaaggttcttcgggttgccacggagccgtagcggttcctcggcagcacctccgccgcatcagcggcactcacaccaccagcacgatctcccgtccgggtcgttttcggcatgcccgaattcaattcgaatggaactcgtcgactccactcggatccgtcagggtccgattaggaatcaccgcgaggatcggctaaggtttgagacgtcggaacggcccaacagccgggaaggcaaaccccgctgaccggggatcagatcgaaaaaggatctgatagagtcggaaccgccggaaagggaaa

SEQ ID NO: 1087 - DNA, 4910 bp, Unknown
  Kingdom: Bacteria, Phylum: Actinobacteria, Class: Actinobacteria, Order: Streptomycetales, Family: Streptomycetaceae, Genus: Streptomyces
  misc_feature (291)..(292): n is a, c, g, or t
gtgtactcgacgggcggcccgctcggcccgcccgtcgagtacaccgacccggccggcgcccccgtcttcgtgctcggagcaccggacacgccccgcaccccgcaggacacggcggcaccgggcccaccgtccccgacaggagaagagaccccatgagcagcggcaccatccgcgtcctcatcgccgacgaccagcagatggtccgccagggcttcaccgtgctgctcaacacccagccggacatcgaggtgatcggccaggcggtggacggcctcgacgccgtcgccaagnnatggacatccgcatgcccgagatgagcggcatcgaggccacccggcaggtcaccgccgagacgcccggcacgaaggtgctggtgctgaccaccttcgatctcgacgagtacgtgtacgaggcgctgtgcgccggcgcgtccggcttcctgctgaaggacgcctccgccgatcaactggccgaagcggtcagggtgatcgcggccggtgacgccctgctggcgccgggaatcacccgacggctgatcgccgagttctcccggatgaacggcagaccccgcacgcccctgaaggcccgcgtcggtgaactcaccgagcgcgagaccgaggtgctcgccctgatcgcccagggcctgtccaacgcggagatcgccgagcacctcgtcgtcgccgagcagacggtgaagacccatgtcggccgcatcctggtgaagctgggcctgagggaccgcacccaggcggcggtgttcgcgtacgagtcggggctggtccgcccctcggggtactgacgtgcgttccgatgggcgttcccgcgtgcgtttccacgtggggccggggcgtacccgtagtacctgagagggagtgcgcaggacccctctcaaaggggacgaccgcgacgcgcgccgccgcctaccgttttcatcgtgaccgagacgactcagacgcagacgacgccggacggcgacttcagcccgtacaagccgcgcagtcccgagtaccggctggcggccgacgcgctgcgcgggctgcgcgaggacctgttccacggcgcctccgtgtaccgcccgctgtctcccatgagcaccgagggcccgctggtcggccggctgccgggccgcctccgggagtacgcggcctggacgccgcacggcgtggtggcggcgatcggcgtgctgaccatgatcgcggcgtggctgggctcccagggcagtctggccgctccggtctacgccctcgcggtcctcgtcccaccgctggtgaccctgtcccgtccggccctggcgttctggctggccgtgggcgcgaccgtggtctcgtcggcggtctccggcagcttcggtcaatggccgtggcagcccccggtcttcatctcctacctgaccgtgctcacggtcgtggccatacgcacccggccgcgcacggcggcctggatgtggctgatcaccgggttctactgcttcgcggccgaggccgtgctgggctaccacttcaccaacaactccggccccatgctgctgctgtccgccctcgtcctgctggcggtcaccgtctggcacatacgtaacgacgcccagcagacggtcagcgcccagcagacggtcaccgcgcacgagcgctcccgccgcaccctgctggaggagcgcaccaccatcgcccgcgagctgcacgacgtggtggcgcaccacatgtccgtggtcgccatccaggccgaggccgccccctaccgggtccagaacccgccgccggagctggagaaggcgttcgccacgatccgggtgaacgcggtggcggcgctgaccgagctgcgccgcgtcctgggcgtcgtccgcgccgaggactacgaggccccggaggccccgcagcccaccctcgccgacctggacacgctcctggagaacgtgcgggaggcgggcctgagcgtggagaaggtgcggaccggcgcggagcgcgaactcccgccgggcgtggagctgtcggcgtaccggatcgtgcaggaggcactgagcaacagcctgcggcatgcgccgggcgctacggcccgcgtcgagatctcctatgtgctgggcggcctcggcctgcggatcgtcaacggcccgataccggatgcgtgcctggtgaagccctcgcccggcgccgggcacggcatcaccggaatgcgcgagcgggtgtccatgctgaacggcgagatgacggccggcccggtggacggcggcggctacgaggtggcggtgttcctgccggtcaccgcaccgagtgagggcgacgcatgaccgatgaccgtacgatccgcgtactgatcgcggatgaccagatgatggtgcgcgagggcttctcggtcctgctcaacgcgatgccggacatcgaggtcgccggcgaggcggtcaacggccgggaggcggtcgagaaggtccgcgagctgtctccggacgtcgtgctgatggacatccgcatgcccgagctgaacggtatcgaggcgacgagggagatcgtcgcctcggacggcacgtcgaaggtgctggtgctgaccacgttcgacctcgacgagtacgtgtaccaggcgctgcgggcgggagcctccgggttcctgctcaaggacgcctcggcgcggcagctcgcggacggcgtgcgggtggtggcggccggggaggcgttgctggcgccctcggtcacccggcggctgatcaccgagttctcgcgcatgtccgagccgccgcgcccgccgtccggtgcgcaggcggcatacggagacctgaccgagcgggagacggaggtgctggtccagatcgcgcagggcctgtcgaacgcggagatagccgagcggctggtggtcgccgagtcgacgatcaagacccatgtgagcaggatcctggtgaagctgggcctgcgggaccgtacgcaggcggcggtgttcgcctacgaggcgcggctggtgagaccgggctgaccggtcagctcgcaccacacgtacttgccacggttgccgaacctggagagaggatgccatccccacacgtccgcacaggcccggaccagtccgagcccccggccggcctcgtcttcggccaggtccgccaaccgctcgggtgcgtcgggtggttcggggtccgcgtcccacgccccgatccgcaacaccgtgcccgaccagcgcacccgcagagcggcaggccccttggtgtgcagcacggcgttggtgatcagctccgtggcgagcagttcggcgacgtcgacgaggcggatcagcccgtgcatggtgaggatcagacggagggtgcggcggctgatggtgacggcgcgtgggtcgttggggatgtagagggagtactcccagggctcgtttccgggcatgcgtggactccgtttcgatgaggtgaggagagaggcggcttccgggtggtggcattgccgcacccgccatggcaggacggagcggtgcgcttccggtgccccggggttccgcagagtgcgcgtcgcgtcaccgacggtatttcctagtcttaggaaagtgcaacccgttgccgtattctggcgctcgaacgagggaaactcgcacaggagttgaagcaaggaggcccaggtgccgccgaagaggcatctcaccgctcgacgcgtgaggctgggcgctgagctgcgcaaactgcgcgaggctacgggcatgacggcccgggaggccgcagagctgctggaggccgacgccgtccagatgagccagatcgagtccggcaccgtaggcgtgagcgccaaacgcgtgcgccgcctggcagccaactatgcctgcgaggacccggcgttgatcgaagcgctcgtcgcgatggcgaccgaccgcacgaggggatggtgggaggcgtaccgggacgtactgcctccggtgttcctggacggtgccgaggccgagcaccacgcggcgtttctgcgcgaggtggtgatccactacgttcccgggttgctgcagaccgccgactactcgcgctcggtgttcacctacacccgccccgagctggccgagagcgaggtggatctacgtgtggaacaccgcttgaagcgccgggctgtgatcgagcgggagcctccgactccgtacgagacgatcgtgcacgagttcgctctgcgggtacatgtggccgaccgacgggcctcgctcgctcaactgcgcttcatcctggacaagatcgaggcaggccaggcaactgtgcgggtcatcccgatcgagcgcgaaggcttcgcaggcgccggggcctccatgctgtacttgggaggcccggttccccaactggacacagcacttcgggacgctccgaccggggtggcctacatcgatgcgcagccccaactggagcaactgcgaacgctcttcacgagagtgcaggcggcgtccctggaccccatggcgtcgcgcgacttcatcctccgactgacgaaggagctgtaatgcactggcgcaagtccacatactcaggaggcggtgacggcgacgcctgtgtcgagatcgccgcgctctccacacaggtagccgtccgcgactccaaggcaccggcccgggccaccctctccttccccgtcccctccttcctcgccttcatcgaaggggtgaagggggatggcgatgtgagggaagacggcgtcagccggtgatgcccgggatcaccaggccggattcgtaggcgatcaccaccgcgtgggtccgattctgcgcaccgagtttgctcaggacgttgccgacgtgggtcttcacggtctccaggctcaccgtgagcgcctgggcgatctcggggttggactcatcaaaccgtgcgccttctggaagcccggcagcgaggtcccgaccgcttgcgtcggccggctcagcggtggctggccgcgatggtcaggaggtcggcggccgggccgaccagtgaccggccg

SEQ ID NO: 1088 - DNA, 2617 bp, Unknown
  Kingdom: Bacteria, Phylum: Actinobacteria, Class: Actinobacteria, Order: Streptomycetales, Family: Streptomycetaceae, Genus: Streptomyces
gatgtgcatcgatgcacatcccgtcccgcaccgcccgcgccgcccgcctcctcgcggtggcagcgcttcccctggccttggcggcctgcggcacctccgggagcacgacggctgacgccgccgcgtccccgtccccctccaaggacccgaacgccggtctgctcaccggggcccagctgaagaaggcactcgccccggcgtcgttcttcgcccccggtttcgcggtcgagccgagcgcggccagggacaccggcgacacgtacgcgcccccgtcggcggctccggtggccgagccggactgcacgaagctgtccggcaccggctggatcgacatcgccggggtcaccggggtgtccttcgcgcagaacgactacgtcgacaagaacacctccgaggacatcgcccaggagatcgacgcctaccgcgggacgacggcgacgagcgtgctgaagtccgtggagaagctcgcgacgaccacctgcgcgaccttcacggaccccgacacccacaccaaggtgaagaccagcggccgctccgtccccggcctgggcgacgaggcctacaccctcacgctcaccgacagcgcctggaccaacggcaccaccctgatcgccgcccgtcagggcaccaacctggtcacggtgctctcgacggacggtcacgacaacggggcggccacggcgaagaagctggcgcggcggatcgtcgcgtccctgaaggcgtccgcgacgacggcttcctgaggcttcccgacgcggtcacgcggcttgcgcggcggccagttcgcaccagacgaccttgccccggttgccgtccctggccaggggctgccacccccacaggtcggcgcaggccttgaccagcgcgagcccgcgcccctcctccgactcggccaccttctccaacggcaccggcggctccggcggtgcggggtccgcgtcccacgccccgatccgcagcacgcccgccgcccagcgcacccgcggggcggcgggccccttggtgtgccgtacagcgttggagaccagctcggtggcgaggagttcggcggtgtcgacgaggcggatcagcccgtgcatggtgaggatcaggcggagcgtgcggcggctgacggtgacggcgcgggggtcgttggggatgtagaggcagtactcccagggttcggcagggcccgggctgttttcgggcatgggacgactccgttcgtcgagtgaggggcggggcgtggacggtggcattgccgcagccgccatggcaggacggagcggtgcgcttccggtgccccgggatttcgcagagtgtgcgtcgcgtcaccgacggtaggtctcaatttagggacgccgcaacccggtcgcgtaatctgaccccgaacgagtcacgtctgccaacgcgttaggggtcgagccgatggggaagagggccgaaccaacggcacgtcagttgcgactcgcgaccgaactgcgcaggctccgcgaggcggcaggcctcaactcccgtgaggcggcggcactgctcggcgtgaaccccgcccagatcacacacatcgagaccgcactcgcgggcgtgagcgagcagcggctgcgtcgcatggcgtcccattacgcctgcacggacaccgagttcatcgacgccctggcggcgatggccacggaccggacacgcggctggtgggaggagtaccggggcctgctgcccacgccgttcctggacctctccgagctggagcaccacgcccggttccttcgccacgtcgcgatcctgtacgtcccgggcctcctacagacggaggactacgcgcgcgctgtcttctcgtcccggctgccggaactgacggaagaagaactggaattgcgcatccggcaccggaaggcgcgccaggggttcaccgtcccgtacgaggcggtgatccacgaggcggcgctgcgtatcagggtcggcgaccgtgcgacctcaagggcccagctcacgcggctcctcgatctctcggaagcaggccacatcaccgtgcgagtcatccccttcgacctggacggtttcgccagcgcatcgagcgcgatgacgtatgtgggtggctccttgccccagttggacactgtggtgcgcgacgcaccccacggctcggtgttcatcgactccggagctcagctcaacatctaccgaacacggttgcgtaaagtgaaggcggtagcgctggagcccgaccggtcacgagatttcatccaccggcttacgaaagagctgtgaggcacccatggccctccccacccctgactggcggaagtcgtcctactccggtgagggcgacggcaacgagtgcgtggagatcacgaactcctccaccaacgtagccatccgggactcaaaggcccccgccagagccaccctcgccttccccaccggatccttcaccgccttcgtggacgccctcaaggaggggtcccggctgacgaaggagtcatgaagttcccccgtctcagctgacgccctggtgttccgccgggaggatatacctcccttgaaaaggacgtcgacggaccagctaccgctgtcctgatagacgttcagacgaattttctccgcctcgaaatgacggcagtaaacgacgtcccgtaaaccc

SEQ ID NO: 1089 - DNA, 1838 bp, Unknown
  Kingdom: Bacteria, Phylum: Actinobacteria, Class: Actinobacteria, Order: Streptomycetales, Family: Streptomycetaceae, Genus: Streptomyces
gcgctggcggcagcgcgcgggcgcgcgctgcgcgaggcggtgggccggctgcccggccgctgcccccggctgctggaggcactgctgtcaccgagggacctcacctaccgggagatcgcgggggagttgggtatctcacagggcagcctcggcccggaacgctccagatgtctgggatgtctgcgacgtttgctcgcaccggaggttgcgacgcgcgaagcccggggataggagtgggggacgacaggtgatcaggtgagcgggaggcgtgcgcacatgggcatgagcgtgaccatctctgcggcgaccgagcaggacgcggagcagatcttcaagttgcagtacctgtgcttccagagtgaggcggcgctgtacggcaactaccgcatcgacccgctcgtccagagcctcgactccctgcgccaggaggtcgccggggactgcgtcttcgtggcccggctcggcgacgaggtggtgggctcggtgcgcggcagcacgaccgaggacggcgcggcctccatcggcaggctctgcgtccacccccgcctccagggccacggcatcggcgcccggctgctgcgcgcggtcgaggcggccctgtccgaggagcgcggcgccacccgcttccgcctgcacaccggcaaccgcagcgagggcaacctgcgcctgtaccgccgcgtcggctaccagacggtgggcaccttcgacagccccgacggcgtcccgatgatcctgctggagaagccggccggcacgtacgtggcgaccgcctagggccggtccggcggatcaagtcgcggaaagacacggcgccctgcatgcccacgtgagcgaggtgggtgcgtgcagccgcgaggcggaggagggagtcatggcggagccatggcgaccgacgacaacgcccctggggtcccctgcgcgaagagcttgggggagtgcgtgccacaccccgcctctgcggcatggtccgccggacaggccctgcgcaccggaggcgtgcgggtgccggcggctcaggcggccgccggctcctgcctgcgggccttgcgcagccagtacagcgcggacagcggaagcagcaccgggatgaagatgtaccccatgccgtagtcggaccacaccgtcgagtccgggaacgcggacggctcgacgagggtccaggtcccgaccgtcaggacgcccaccagctcggcggcgcagcacaccagcgccgccctgcgggccctctccccgccgcggaccagcgagtacgtgatgaagccgtagaccacgcccgccaccgccgagagcgagtaggcgagcggcgcccggccgaagtcggtcgcgatctggtagacggagcgggacaccgcgccgacgaccatcacgccgtacagccagacgagcaggatgcccggcccgctgatgagccgggccttcgccgccttggccggcttctggtcgacagtggccatctcagcctccccagatgtcgtagagccgcacttcgaggacggcgaggacgatcccgccggccgcgaccgtcaccgagccccagcgcgtgcgctccgccagcgacatgaaggcggccgccgggacgcaggcgaaggcgcccagcaggtacgccacgaagatcgtcgccccctggtccggcttctcgccccgcgccagctgcacgatcccgatcacgagctggaccagggccagtaccgtgacgacggccattgcgatgaagtgccagtccttcgtcggctggtcacggtaggcggcccagccgcaccaggcggcgagcagcaacgcggcgacgccggtcaccagcgtcagggcatcaagcatgcctgtgaccctattacggggcg

SEQ ID NO: 1090 - DNA, 1575 bp, Unknown
  Kingdom: Bacteria, Phylum: Actinobacteria, Class: Actinobacteria, Order: Streptomycetales, Family: Streptomycetaceae, Genus: Streptomyces
cgccgcgcgcggcgcggaggccgactcggtccgtgaccgggagatcagcagggaacaggaacacctggaccgggtgtaccggcgcctcgaggtgaagatccacgaggccgagttcctgatgcgggacgcggcccagcgcggccaggtcggcacgcccggcgcgctggccgagcgcgacgcgcaggtcttccgggcgggcgtccacctcaaccggctgaacaacgagttcgaggacttcctcttcggccggatcgacctgctgctcggcaaggacggcaagaaggggcccgacggggcctacaccgccgtcgaaccggccgagggcgcggtgcgcgaggacaacaccgccgacatcgccgagaccctgcacatcggccgtatcggcgtcctcgacgaggactacgcaccgctggtcatcgactggcgggcgcccgccgccgccccgttctaccgctccacaccggtcgaccccggccgggtcgtgcgccgccgggtgatccgttccaaggggcggcgcgtgctcggcgtcgaggacgacctgatgcgccccgagctgacggcctacctcgacggcgaggaactgcccgcgatcggcgacggcgcgctgatggcagcgctcggccgggcccgcagccacagcatgcgggacatcgtctcctccatccaggccgagcaggacctcgtcatccgcgcccccgccgcctccgtggcctacgtcgagggcggccccggcacgggcaagacggcggtggccctgcaccgcgccgcctacctgctctaccaggaccgccgccggtacgcgggcggcatcctgatcgtctcccctaccccgctgctcgtggcgtacaccgagggcgtgctgccctccctcggcgaggaggggcaggtcgccatccgggcgatcggttcgctcgtcgacggcgccgaggccacgctgtacgactcgccggccgtggcccgcgccaagggctcgtaccggatgctgaaggtgctgcggaaggccgcccggggcgcactggagaccggccccggcgcacagcagggcgcgaacgcctccgccggacagctcaccctcggcgacgacgacacggacgcggaggcccggccggcggcccccgcgggcccgccgaaccggctgcgcgtggtcgccttcggccgccgcctcgaactggaggccgcggaactcgaccgcatccggcgcgccgccctcggcggcaccgcgccggtcaacctgctgcgcccgcgcgcccgcagactgctcctggacgccctgtgggagcagtcgggggccgccggccggcacaccgaccccgagctggccgccgagctgcgttcctccttcgacgacgacgtgacgggcgaggactccttcgtcgcgttcctcgacgcctggtggcccgagctgaccccgcgcgcggtgctcgccgcgatggccgacgaacggcgcctgggccgctgggcccgccgcgtcctcaaccccggtgaggtgcgcaaggtcgcccgttcgctgaagcgggacgggtactccgtgcacgacatcgcgatgctcgacgagctgcaggcgctgctcggcac

SEQ ID NO: 1091 - DNA, 4347 bp, Unknown
  Kingdom: Bacteria, Phylum: Actinobacteria, Class: Actinobacteria, Order: Streptomycetales, Family: Streptomycetaceae, Genus: Streptomyces
cgcggccctggtcgcctcccacgtcgccaaccagaccctggcgctgaccaccacgtccgccccggcgaccgccaacaccgcctatgtcgtctcgggcttcgcgggcgccgcgctggcctcgtccgtggcggccccggccttcgcgcactggggctggaccggggtgtgcgcggtggccgcggtctggctggtgatcggctgggtcaccacgtccgtacgacggtagtgccggctgggccacgacagctgtacgacggtgagtaccggctggaccaccacggcggtacgacggtgagtaccggctggaccacgaccggcggtacggcggtgagcgcgggcaccgccgtaccgccgcgcccgcccgtggagatccggagaggccggagactggttcaggcaggctcagagactggtgacgtccagctcgcccgccgcgtaccgcctgcgcagcaccttcttgtcgaacttgcccacgctcgtcttcggcaccgcggtaacgatcgtccagcgctccgggagctgccacttggcgatcttcccctccccggcgaggaaggcgcgcagggtctcgaagtcggcggtggcgccctccttgaggacgaccgtggccagcgggcgctcgccccacttgtcgtcgggcacggcgacgacggcggcctcggcgacgtccgggtgggacatcagggcgttctccaggtcgacggaggagatccactcgccgccggacttgatgacgtccttggcgcggtcggtgagggtgaggaagccgtccgggctgatggtgccgacgtcaccggtcttcagccagccgtcctcgctgaacttgtcggcggggcgcagcggctcggcgtccgggccgttgtagtaggcgccggcgatccacgggccgcgtacctccagctcgcccgccgactcgccgtcccaggggatgcgttcgccgccgggcccggtcaggcgggcctcgacgccggccgggaagcggccctgggtgaggcggtaggcgaactcctcgtccgtgccggccgcgtacgccggcggacgggccaccgtgcccagcggggacgtctccgtcatcccccacgcgtggcagacccgcatgccgagccggtcgaaagcctccatgagggacggcgggcaggccgagccgccgatggtgacctgggtgagggaggagacgtcacgggggcgtgcggtcagctcgccgagcaggccctgccagatggtggggacggcggcggcgtgcgtggggcgctcgcgctcgatcatctcggcgagcggggcgggctgcaggaagcggtcgggcatcagcatgttgacgccggtcatgaaggtggcgtgcggcaggccccaggcgttcacgtggaactgggggaccacgacgagcgaggtgtcctggtcggtcaggcccatggactgcgccatgttgacctgcatggagtgcaggtagatcgaacggtggctgtagaccacgcccttgggatcgcccgtggtgccggaggtgtagcacagggcggcggcccggcgttcgtccagctccggccagtcgtaggtgaccggcttgtcgtggatcagctcctcgtactcgtgcacccggacgggcgagccgtcgagcggggtacggtcgccgggacccgagacgacgacgtgttcgaccgtcttcaggtgcggcagcagcggggcgagcaacgggacgagggacccgttgacgatgatcactcggtcggcggcgtggttgacgatccaggccagctgctcggcgggcagccgcaggttgagcgtgtgcagcacggcgcccatggaggggacggcgaggtacgcctcgacgtgctccgagttgttccacatgagcgttccgatgcgatcgtcctcgcggaccccgaggtcgtcgcgcagggcgttcgccagccgtaccgcgcgcgtgcccgcctcggcgaagctgcgccgctgcggttcgtcctccccggtccaggtggtgatctgggaccgtccgtggacgcgcgtcccgtggagcaggatgcgggtgacggtcagcggtacgtcctgcatggtgctcagcacggcgtcctcccggggcggcatgggcctacgcggcagtaggtgtgcgctgattctgcgcacataccgcgcggtatgtcactagctccgggtgatcgatcaaccgggggtcacaaacctgaccgaccaggacacctcgctcatcgtggtcccccagttcctcgtgaacgcctggggcctgccggccgaacgagccgctggacgagccgccgaacgatccgccggacggagggccgccgggcggcgaagcggtcggtcagcgcacgcgtcccagctcggggtcctcgcggagcttgccgagcgcgcgcgagaccgccgacttcacggtgcccacggacacgccgagcacctcggccgtctgcacctcggagaggtcctcgtaatacctgaggacgaccatcgcccgctgccgggtgggcagcttggtgatcgcccgccacatggcgtcgcgcagcgcctgctgctcggcggggtcggccgcgccgggcaccggctccggttcgggcagttcgtcgcaggagaactcgtcgaccttgcgcttgcgccactgcgaggtgcgcgtgttcagcagcgcacggcggacgtagccgtccagcgcccggtggtcctcgatccgctcccaggcgacgaacgtcttggtgagcgcggtctggagcaggtcctccgcgtcgctcgggttcgcggtcagcgaccgcgcggtgcgcagcagcaccggctggcgggcccgcacgtacgaggcgaacgacggatacgccgggctgtgtggtgccggtacggcggcggtcgacgcgctggtgcagacgggagtggtcatgtcctccacgctaggagcgctcacaccgtcggcggatcgcccgcaggtcccgaagcgggatccgcctcaggttgtaggggtggggttgaccgcacctcctgaaggtggacgaggagggggagcggggtgcgggttcacccctgggtggtgccgtgcgacagcgtggacggcccgccggcgggagggccgggaaggccgtgaacgcctgcgcggcggcgccgaggcaccgccgcgcagtggtgtgttgcatccccacgagcacacccacatgacctcagggccggcggctccccaatgtgcgcgccggcccgcccgggctcaccacaggtgggtgaagtggacggccacgttcttgttgccctgctggatggccgtgaacgcggagccgttgacctgggcggtgttgctctggttcgaggcgccggagccgaccgcctgctgccccgtcgtggacgagttgccgctgttgttgtggccgactccgctgccgacgataccggcgacacccgcgttcgatccggtgcccgcgagagcaccggtgtccgccgccgcgatgccggtgaagagcgctgccgcgagcgggacggcggtgacggcggcgagaacgcgggcggtacggatgcttgccatattgctcctccagtaagaggtacgcaccggctgcctgccggaagtacgtgaagctgcgtgaagctacctgaactacggcttgcaccagggcagttggccgaccgccccggcggtttctcacgacgtcgcaagatcagaattgcccacccagccgcggcggaccaccccggtaggcccgattcgcacgcaagcgtgaggacaagtcgataaacccctttcaccacctttgccgcccccaacgccccggccggtggcggtgcgccccccgccggctcaagcgcggcaagaggtgaagcgttccggcaagcgcccggcggaaaccggccgcaacgcgcgcccccggcacgccacgcgaccgcccccttcctttcctcgaacgctcgtacgaatatggatccatggccaccatcgaccggcaggccacgacgctggccctcgcacacgccctgtcagccgccgaacgcggcctggccgtcatcccgctgtcccggacgaagctcccggccctgcgctccccgcaccgcgacgaccccgacccggcacggccgccctgccacggcgcgtgcggacgcttcggccacggggtgtacgacgcctccaccgaccccgcccgcatccgcgaactgttcgccgcggcaccccgcgccaccggctacggcatcgcctgcggcctgccgccgtaccacctgatcggtgtcgacctcgacaccaagaccggtacggacgccccggcggcccgctcagccacaggtggcggcctccgctcggggtcaggacgacgaccgtggcgggaagggcgaagccgtggcgcagggcgagctcacgcagggccgccggggcgtccgtac

SEQ ID NO: 1092 - DNA, 2467 bp, Unknown
  Kingdom: Bacteria, Phylum: Actinobacteria, Class: Actinobacteria, Order: Streptomycetales, Family: Streptomycetaceae, Genus: Streptomyces
cgacgccggcacgacggtggcccgcctggccgccgccctgcccctggaggccggcctcaccgtcgtgccggcgtcgaggatcaccgtgccctcggcggggagttcggccagggccgccttggcgatgcggtccttctcgtcggccgccgtggactcgcgctcggtgaggtccggctcgaagtcgaggcggccggccgggatggccccgccgtgcacccggcgcagcaggccggcccggtcgagggtcttcaggtcccggcggatcgtctccgcggtcacctggaactcctcggcgagcgacacgacgtccacccggccgccgtcacgggcgagccggaggatctcctgctgccgctccgctgcgtacatgtccgtttgcctccgaacgatgcccgaatttgtggtttctctcggaggctacgccggagtgcccggaaagtaaacagtcccggacctcatccgggcatgaacggacttacgtgtggggtggcgccggcaccgtgcgtggtgcgtggtgggtgcgcgtgccggaaccctggttcgtaccggaaccgggctgcgtgccggaagggaccagtaggggtcggaagagaccggaagagaccggaacgacgagggcccggcacctgaccggtgccgggccccgcctcctgacctgtcagcccaccagttcggcctccgcctccctctccactgtcggcagctccacctccgcgccttccacgtgctgggccggccgcccgggcagcgcggacatcaggacgaagatggcgcccaggaccgcggccacccaccacagcgcgtgctggaaggcgtcgacgaaggccgggcccacctgcgccggggtcagccggtcgccgatcacgccgaagaacacgaccgacaccaggccgaggcccagcgcgttgcccatctgctgcacggtgttgatcagtccggacgccgaccccgcgtgctcccgcggcacctcggagagcaccgcgtccgtcagcggagcgacgatcaggcccatgcccacgcccatgacgaccagcggcagcgccatctgccaggacgcgatgtgcaggccatagcggccggactcccagatgtagagcagcacaccggcgaccatgagcagggcaccggcctggagcaccttgcggccgaagcgcgggaccagcttctgcacggacatgcccgccgccaccgacaccgcgagcgagaacggtaccccggtcagccccgcccgcagcgggctccagcccaggccgatctgcatgtacagcgtccagaccaggaagaacacgcccatcgcgacaccgaagaccgtctgcacggcgatgccggccgcgaagctcttcacgcggaacagcgacagttcgaccagcggggagccgtcgcgcgccgccttgcgccgctcgtacgccaccagcgccccgaacaccaccaccgcgcccgccatcgacgcgtacccccacagcggccagcccagctcgcggccccgggtgagcgggtagagcagcatcagcagaccgagcgtgacgagggcgacgccgaccaggtccagcttcagggcgcgcggcgccttggactcggagatgaagcggctgccgagcagcagggccaccacgcccaccggcaggttgatcaggaagatcggccgccattccagaccgaacaggttccactccgtcagcagcgcgcccagcagcggcccggagaccgcgcccaggccgacgatcgcgccgaacaggccgaagaccttgccgcgttcgcgcgccgggaaggtggcgtgcacgatcgacaggacctgcgggaccatcatcgccgccatggcgccctgcaggatgcgggaggcgaccagcatctcggggttcacggcgaagccgcacagcgcggaggcgagggtgaagccgccgatgccgacgaggaacagccgcttgcggccgtggatgtcgccgagccgcccgccagtgatcagcccggccgcgaaggcgagcgcgtaaccggcggtgatccactggatctggctgaaggacgcgccggcgtccttctggatggacggtatggcgatgttgacgatcgtgacgtccacgaggtccatgaaggccgcggtcatcacgatcgccagcgcgaaccagcggcggcggtcggccgcaggcgctgaactgctggcagctgggctgctgacgagggtttcgctggaggtcataccgacaagctagtttggcaataggtcagatcgtgtcctagatctgcggcatcctcggacccatgacgacggacactccggcacggctcctccagctcctgtccctgctccagacaccccgcgagtggcccggcggcgagctggccgaccggctcggtgtgtcccggcgcaccgtccgccgtgacatcgaccggctgcgcgaactgggctacccggtgcaggcgaccatgggctccgacggcgggtaccggctggtcgcctgcaccgggtagc

SEQ ID NO: 1093 - DNA, 1609 bp, Unknown
  Kingdom: Bacteria, Phylum: Actinobacteria, Class: Actinobacteria, Order: Streptomycetales, Family: Streptomycetaceae, Genus: Streptomyces
gggcgtcgcgggtgcggccgtagcgctccagggcctcgcgcaggtccgcctcggcgcgctccacgtcgccctggcgcagcgcgagctggcccagctggaagtgggcccatgcctcgccgtgcacggagccgccctcgcggtgcagcaccagggaacgcgtcagcaggtccagcgcctcggcgaggttgccccggtcgcgctccacggccgccagcgcgtgcatcgtccacgcccggtcggtggccagctccggtacgtcctggagcgccatggcctcgcgcagccgggccgcggcctcggtcaggttgccctggtggtgcagggtgatgccgagcgagttcagcgcgcgggccgcacccgcctcgtggtgcgcctcccggtacaggtcgacgacggaggccagcgtggtgcgcgccttgtccagttcgcccagctgccgggccgcgatgccggtgcgccactgcaccgagcggaccagcaggccctggtcgacggcctgggtcagctcgctgatctcgcccagccggtacaggtcgccgcgcagcaggcagtagtcgcacagggcgccgagcaggttgaggacagccgcctggtccacgtcctcggcgtgccgcagggccgccgtgatgaagctggactcgtcgtccagccagcgcagcgcctcgtccagcgaggtgaaaccgtgcgggctgaagcggtccgagcgggtcgagttgttgccgtcgaccaggcgcagcacggagtcggccagctcgccgtagttcttgatcagccgctcctgcgcggcggtgcgctcggcgggctcctcctcgtcgaggaggcgggcgtgggcgaaggcccgcaccaggtcgtgcagccggtagcggctgccgcgtacgtggtcgatcagaccggcgcgggccagggccgtcaggtgccgggtcgcctccgcctcgtccgtggccagcagcgctgccgccgccgcggcgcccagggaggcgcggcccgccagggcgaggcgccgcagcagccggcgggcgggttccgcctggtcggtgtagcgcagccacagggcccgctcgaccgggtccaccgggccgtacgccgcgaggtcggtggccagccggcggggcgaacgcgggccgagggcggagcccgcgatccgcagcgccagcggcagcccgccgcacagcgcgcggatccgctcggcggactccgcgtcgtagggcccggaggcctcctcggcggcggcgcccagcagttcctcggcgcccgcctcgtccagggcctcgaccggcagctggtacacccaggccggcaggtcggccggcagctccagcggggtgcgggcggtgaccaggaccagcccgtcggaccgctcgggcaccagcgcccgcacctgctcggcgtccgaggcgtcgtccagcacgatcgtcaccggcaggcccgtcagatgctggtcgtacagctcgcccagccgcttgacctgctggtccggggaggaacggtcgcggaacaggagctgctcgcggggcgcgccgagccggttcagcagatgcagcagcgcgtcacgggtcggcagcggcggctcctccgcgctgtccccgcgcaggtcgacgacgaccgcgcc

SEQ ID NO: 1094 - DNA, 2866 bp, Unknown
  Kingdom: Bacteria, Phylum: Actinobacteria, Class: Actinobacteria, Order: Streptomycetales, Family: Streptomycetaceae, Genus: Streptomyces
cctacgtaccgaccaggaccccgccgccccgacctcgacggtcccggccaaaacccctggacgccgtgacgcacctgagtggaggctctcctagcggtgccctccgcgatcgcccatgcgtcggcgcaggcggtcgatgcggtggtggccaaccatattctgccgaaacctggaggaggcgcggtggggctggggacagtggcggtgacgggcgcggcggggaacatcggttccgtggtgcgcgaggcgttgcggcgtgaggccgggcgcttgatcctgctcgaccgcgtgccgttgcggcccgaggccgcgaacgaggacgtccgcaccgtcgacctccgggacgcggccgccgtggaggcggcgctcgcgggggccgatcgcgtgctgcacctgggcggtgtgccggacgaggcgcctctcgcggacctgctcgaagccaacgtgctgggcacccaccacgtcctggaggcggcgcggcgcacgggaatcgagcgggtggtgctggccggcagcaaccgcgtgaccggcttctaccccacgggacatctcaccggcccgcaggatccggtacgccccgacggcctgtacggcgtgagcaaggcggccgtcgaggccctcgggcagctgtatgccgacaagttcggcctgtccgtgatctgcctgcgtatcggcagtttcgagcaagcgcccacggagccccggcatctggcgacctggctgagcccgcgcgacgctgtcggctacatcagggccgcactgaccgcgccgccgtccacccgctccgccacggtgtacgccgtctccgccaacacccgccgcttctgggaacttcccgatcccgcggtactggcctacgttcccgtcgacgacgcccagctccacgccgaggccatcccgggagcagaccttccggccgaccccgccgcaccgcaggccggcccctacgccctgcccgagttcaccctcaagcacctcaggacctgacccgtccccccccgggcctcggcgtcctgcccgccttctccgcggtcgtgcggaccccacagggcgtcagggccggtatgtcgcccggcgggtccgcgtgtgcgggccgccgaagctcgggaccgggtccgtgggggacggggtgaggaggatgccgcccaggacggcgccggccgtgccgggggtgtgggtgtccgcctccgcgtacgggttgccgtgggtgcggacgtcctgctcggcgtgggaacgggcctcgcgggcgagggtgtcggcgcgcaggtggtcgggcggggagtcagaggtcaggaggcgttccgctccggccagcagggtgcgggcaccggcgcccaccgcgccccggtgcgtcgtgacgaagcccgccgccgccatggtgacgctgcgggcggtgagcagggcggcggcggacaggacgccggtgcgccccgcgtccagcggtgcggtcgccgtgacgatccggcgcaggaccgccagcgggtcgtactttcggcccgacgtcaactcctggcgtacggaggccagtacggcgtccgcgtgcagggcacgggcgcggatctcaccggccggcacgcccgtgaggcggtcccgcgctcccgcccgctccgcctccgccccgctcagcgcggccggcaccatcgacgcggcctcgtccagctcggcggcgaggcgttcgatgccgtcgaggaagaccgccgcctgcgccaccgcgccctcggtggcccgcagatgagccaccgcgcgggcgttctcgtcccggtcggcgctctggcgggcctggttgaggtggagcgtggcgaacatcagacggtccttggcctgttccgcgtagcccgtcacccggtccgacgccgcgggggcgtagcgccgtgcgagctccgccaggaccgcctccgccgccggtgtccgggccgccagcgcgcggaaacgggactccgccacctccaccgccccgccgacgtcccggtccaggccgcgtacctcctcgaaaccgtccgccgccgcgtccagcagccggccggcctcctcgcagtggccgatcacgtcggccagcacctgccgccgggcggccggatccgccgggtcgcccgcgtcgtagcgcaggcgcagccggaaagccgccgccagctccgtcccggcacgccgtacggcttccgcgaacggtgccaccgccgcgcccgctcctgtgcgcgcctcggcgaaccccagctcctcccggctggtgcgtacacagtcgtctgtcagagccagtaaccgccgggcccgttcgtcgagttccccgagttcgccgagttcagccgtcccgccgccgcccggtgtcgtccgcgtcctcgcgcgccgggtgcgccgtacgtagccgtaccccgcgcagaccaccgccgcgcccaccgccacgagcggcaggacgaggtcggcgtccgacgtctcgtcctgcgggggtgcgacggtgcccgcggcgaccgggccggcgcgtgaaagcggtcccgccgcaaccgccgtgccgctgttgatcgtcatcaccgggagtgccagccaggcgatccccgccgtgccgcccagtgcggcccgcgccgcccgcacgcaccagtgcgggctcgtcgcacggcgcagccggagcgcgcgaggcaggggtgatgacgtcacgtttcggagcgtatgaccgcctgtgcgggcccgcgaccgggactgcggcactggtggggcggatgtgaccgacgacaggggaggggcggacagcagcatggagaaccaaggaatcggagacggcagagacgccgaggaggacaaggaaagcgctgcggccgcgcagagcaaagagcccacgcgccgaccgcgcccctcccaccgcccactcctgcgcacc

SEQ ID NO: 1095 - DNA, 4026 bp, Unknown
  Kingdom: Bacteria, Phylum: Actinobacteria, Class: Actinobacteria, Order: Streptomycetales, Family: Streptomycetaceae, Genus: Streptomyces
ctcccgagtacgcctgagcgccccgcggacgcccccgcgccccgcgcacgggccgtcacacgcccgccgcagcgcgccctcacaaccactcccgccgtttgaactgccggtacagcagcacctcgaggacggccatgaccgcgatcacggccgggtaggaccacaaccagtgcagttcgggcatgtggtcgaagttcatgccgtagatgccggcgatcatcgtcggtatcgcggccatggcagcccacgcggagatcttccgcatgtcgtcgttctgctggacgctggtctgcgcgagatgcgcggagagtatgtcggagaccaggcggtccaggccctccacggactcgttgacccgggtcaggtggtcgctgacgtcccggaagaagggatgcgcagagtcgtccacgaacgggacggtcgcggtgaacgcgcccacaccggtgccgcccaggcgggacatcggcagggccagcgggcccgtcgcgcgccggaactcggtgatctggcgcttgaagttgtagatgcgcgaggcggtgttccgtgagccgccgcggtcgggggagaagacctccgcctccagctcctccaggtccgtctgcagttcggtcgccacgtccagatagtggtcgacgaccgagtcggcgatcgcgtacagcacggccgtcgggcccttgccgagcatctccggttcctgctccagccgctgccgtacgcccgtaagaccgtcaccctcaccgtgacggacggtcacgacgaacgagtcacccaggaagatcatgatctcaccggtcgagacggcgtcgctgtgcggctcgtacaccaccggcttcagcaccacgaacagcgagtcgtcgtagacctccagcttgggccgctggtgcgccttcagggcgtcctcgaccgccagcgcgtgcagcgcgaactcctggctgaccaggtcgaactcctgcgcggtcggctcgtgcaggcccacccacacgaaacctccggccgcccgcgccccggccagggcgtcggagaagtccgccgggccctccgtgcggtgcccggcgcggtagatgccacagtcgacgatcacggagcgtgttctcccttcgcccggccgacgccggaaccgcgtatacccctaccctggccgcatgcccacgttgatcctcgtcaggcacggacgttcgaccgccaacaccgccggcctgctcgcaggctggacgcccggcgtcaccctcgacgaacgcggcaccgcgcaggccgccgcactgcccggccggctcggcgacctgccgatcgccgaggtggtcaccagtccgctgcaacgctgccaggagacggtacagcccctcctggacgcccgccccggcctgagcgcgcacaccgacgagcggatcggcgagtgccactacggcgactggtccggccgcaaactcgccgaactcaaggacgagccgctgatggaggtcgtccagacgcacccctccgccgcggccttccccggcggcgagtccctgcgcgccatgcagacccgcgccgccgaggcggtgcgcgagtggaacgcgcgcgtggagcgcgaccacggcgccgacgccgtctacctgatgtgctcccacggcgacatcatcaagtccctcgttgccgaggcgctcggactgcacctcgacctcttccagcggatctccgtcgaaccctgctccgtcaccgcgatccgctacaccaggctgcggcccttcctggtgcgcctcggcgacaccggcgacctcgcctccctggcgccccgtgaggagcccgcgggcggcgacgcaccggtcgggggcggcgcgggcgcaccgtgatcgtcggccgcagtagggtgaagcggtcgcccgcgacccacagattccgtcgttttcccgatccccatggagacaggacgtgtcccgtcaggtgttcctctacgacctcccggaccgtttcgtggccggtacggtcggactgcccgggcgccgtacgttcttcctccaggccaccgccggcccccgggtgaccagcgtggccctggagaagacccaggtcgccgcgctcgccgaacgcatggacgagctgctggacgaggtcgtgcgccgcagcggcggcaacgcggccgtgcccgcggtcgcccccaccgaggtcgccgacaccggcccgctcgacacccccgtcgaggaggagttccgggtcggcaccatggccctggcctgggacggcgaggaagagcgcatgatcgtcgaggcccaggccctcgtcgaactcgacgccgagtccgaggaggacctcgccgaggccgaggagcggctgctccaggacgaggagaacggccccccgatgctgcgggtccggctcaccggcgcgcaggcgcgggccttcgccaagcgcgcactcgacgtcgtcaacgccgggcggccgccgtgcccgctgtgcagcctcccgctcgacccggaaggacacgtatgtccgcgccagaacggataccgtcgcggggcgtgacgcccgagcaggcgtccgccgagctgctcgcccggggcgagctgaccgtgcgcggccgcatccgtgaggcctccaacgcggtactcctgtgcaccgtcgccctcgacggccgtgaggcgtcctgcgtctacaagccggtggccggcgaacgcccgctgtgggactttcccgacggcacgctggccggccgagaggtcgcggcctacgaggtctccgaggcgaccggctggggcctggtcccgccgaccgtgctgcgcgacggcccgtacggcgagggcatggtccagctgtggatcgacgcggtctccgacggccccgacgccggactcctcgccctgctggacgccgaggagccgggccccggctggaaggcgatcggcttcgccgaggtcggcgaggaccgcaccgcgctcctcgtgcacgccgacgacgagcggctgcgccggctggccgtgctggacgcggtcatcaacaacgccgaccgcaagggcggccacctgctgcccggccccgacggccggctctacggcatcgaccacggcgtcaccttcaacgtcgagaacaagctgcgcaccctgctgtggggctgggcgggcgagcccctgtcccaggaggccctgtgcgccctcaagggcctcaaggacgccctgggcgacggcggcgccctcgcgacccggctgaccgctctgctcaccccggcggagatcgacgccacccgcgcgcgcgtggacgccctcctgaccgcaggcgtccacccggaaccgacgggggagtggccggcgatcccctggccgccggtgtagcgacgcgggcggccgggcgggcgccggtgcagcgacgcgggcggcccggcgggcgtccgccctgcacacgtcccgcgatctcgcaagaacgccttcccggccatctgcgcgatccggttcgtagacgggaccgcggtccggttacgctcatgacatgcatgcctggcccgcttccgaggtccccgccctgcctggtcagggccgcgacctgaggatccacgacaccgcgaccggcggcctcgtcaccctcgaccccggtcccgtcgcccgtatctacgtctgcggcatcaccccgtacgacgcgacccacatgggtcacgcggcgacctacaacgcgttcgacctcgtgcagcgcgtgtggctcgacaccaagcggcaggtccactacgtccagaacgtgaccgacgtcgacgatccgctgctggagcgggcgcagcgcgacgacgtcgactgggtgaagctggccgagcaggagacctccctgttccgcgaggacatgaccgccctgcggatgctgccgccgcggcactacataggcgccgtggaggcgatacccggcatcgtcccgctggtcgaacgcctgcgcgacatcggcgcggcgtacgaactcgaaggcgacgtctacttctccgtcgagtccgacccgcacttcggcggggtctcgcacctcgacgccgccgcgatgcggctgctgtccgccgagcgcggcggcgtcgaggtgcga

SEQ ID NO: 1096 - DNA, 5030 bp, Unknown
  Kingdom: Bacteria, Phylum: Actinobacteria, Class: Actinobacteria, Order: Streptomycetales, Family: Streptomycetaceae, Genus: Streptomyces
ccagcgactgcgccgcgtgcacggcccgcacgggcagccccgtccgggcgaccgtccgggaccagatctcctcgccgatccggtcgagttcgctccgggtacgccgctcgggcgccagctctcccgtacgcgtacggaactcggcgacagccccggagaccagcgcgcgcagcgcgtccaccgggggaagcccgtcctcggcccgccacccaccgcgcgggggcagcacgcccgcccacggcggcccggtcaccgcggccgggacggcggtcgtggccgccttctcgtcgacggcctccagcagctcgcccgcggagacggtcacgtcgagagcgacgtcgagcccgtcctcgtagggcttggccagggcgaccgcgcgcaccgccagcacctcgaaggaggccggccgcccgaacaccgcgagtgccgtcccggccgcctggaggcggacggcggcggcacggtcgtagtggatcagccgggagaggaaggcggcgaggtcggccgcctccgtctcgtcggcgaggtggagcaccgtcatgcggcgacggcctcctcctcgtccgcgtcccggtactcgcgcaggaactcgcgctcctcctcggtgagccggcggggccgctgcgcctcgaagtcgaacggcacgatcaccgtggaggcccggacgtagacctggtcgccgtccttcacctcgtagccgagggtgaaggaggcggccctgatctcggtgacccacagctcgatgtccaccggcgcgtgccggtggacgagctgccgcttgtagtcgatctcgtgacgcgccaccaccgacccctgcttgaactgcttgtccgggcggaacaggaagtcgatacgggcctcctccaggtagcggaggaagaccacgttgttgacgtggccgtaggcgtccatgtccgcccagcgcagcgggcagcggtatgtgtggcgcatctgcaggctcagccccgggtcagcttcttgtgggtggcccggtgcggacgggcggcgtccggaccgagccgctcgatcttgttcttctcgtacgactcgaagttgccctcgaaccagaaccacttggagtcgccctcgtaggcgaggatgtgcgtcgccacgcggtcgaggaaccaccggtcgtgggagacgaccacggcgcagccggggaactcgagcagcgcgttctccaggctggagagggtctcgacgtcgaggtcgttggtgggctcgtcgaggagcagcaggttgccgccctgcttgagggtgagggcgaggttgaggcggttgcgctcaccgccggagaggacaccggccggcttctgctggtccgggcccttgaagccgaacgcggagacgtacgcgcgcgacggcatctcgacctggccgacgttgatgtagtcgagcccgtcggacacgacctcccacagcgtcttcttcgggtcgaggttggcgcgggtctggtcgacgtaggagatcttgacggtctcgccgaccttgatgtcaccggtgtccggcgtctccaggccctggatcatcttgaacagggtggtcttgccggcgccgttcgggccgatgacaccgacgatgccgttgcgcgggagggtgaaggacaggccgtcgacgaggatcttctcgccgaagcccttgtgcaggtcgttcacctcgacgacgacgttgcccaggcgcgggcccggcgggatctggatctcctcgaagtccagcttgcgcatcttgtccgcctcggcggccatctcctcgtagcgcgccagacgcgccttggacttggcctggcgccccttggcgttggagcggacccactccagctcttccttgagccgcttctgccgcttggcgtccttctggccctcgaccttgaggcgggcggccttggtctccaggtacttggaatagttgccctcgtagccgtgcaggcggccgcggtcgacctcgcagatccacccggcgacgttgtccaggaagtaccggtcgtgggtgacggcgacgacggtgccctcgtacttggcgaggtgctgctccagccaattcaccgactcggcgtcgaggtggttggtgggctcgtcgaggagcagcaggtcgggggcctccagcagcagcttgcacagcgccacgcggcgcttctcgccaccggagaggttggtgacgggccagtcgccgggcgggcagcccagggcgtccatggcctgctccagctgggcgtcgaggtcccaggcgttcgcgtggtccagctcctcctggagcttgcccatctcctcgagcagcgcgtccgagtagtcggtcgccatctgctcggcgatctcgttgaaccggtcgagcttgcccttgacctcggcgacgccctcctggacgttctccaggaccgtcttctcctcgttcagcggaggctcctggagcaggatgccgacgctgtaaccgggcgacaggaacgcgtcaccgttggagggctgctcgagccccgccatgatcttcagcacggtcgacttaccggcaccgttcgggccgacgacgccgatcttggcacccggaaggaaattcagggtgacgtcgtcgaggatcaccttgtcgccgtgcgccttgcgcgccttgcgcatggtgtaaatgaactcagccaagagaaaccgtccggcagcttgaaactggcagtgggcagatacaccccatcttgcctgaccgccaccccgtagtggaaaccagtaggttcgcggggctctgagctggggtttcggtgggatcgccgacgggtcgcctgtcactgacggtcgccgttggtcagcctcggggggcctcggacggcccagggacggcccagcatcggcacggctcactcaagcggctgggtcgccacccgcagtcgttcgctgtcccgcacgggttctcccagcacccgcgcggtgtccgccaggttctcgcgcaccgcctccgccaaggtccagccgtaaggactgcgcttcttcagcctcgcggtgaggtgcactgcgtgagcccgcgcatgagcccgcgccatgttccgggatcgcttcgacgagcctgccggcgtgccgccctgacaaacccacggccctgaccagctcaggccgtgggctcctgtcgttgccggccgacgtgggctgaccttggacggccaggagggctgtatgccatgtacagggctaacccaggccttgaacacgttcaattcgcatgccaaggtggcgcaagcacacggcgaggggaccggaggaatcgggatggggatcgctcggcttggcggagttctcggtacctcattggcgagcggagtgttgtgtgccctgctctctgggtgctacagcctcgccgccgcaatccacgatcccccgcagccgccgggcatacctcaagccatcaccgacggccacctcgtcggcacctggcgggacgaagcgggcggcagcatcactttcgctgcgggcggtgcctttgccgccaagaagatctgtggcgacttcgcagactgggcgggcgacggccccgggctccatgtggcccagtcgaaaactggaagcgggacgtgggaaacgatgacctggacaccccccaacgagtccgtgcccagaactgaagtgacgatccggttctccgactcagagatgtccacggagtacgaaacgggaggaacttccagatctcccaagctctgggtgtacgtgggagacctggatgactacgacttgtgtaccttgactcggcagccatcactgtcagaaacagctgactgaggcgctcggtcagttcgtcccaagagggcgccgccgcgctcggcatcctggagcaccagtttcgatgaccgcgtatgcggagtcgcgctgagctggcacgacctgcgcgttcctgggatgtgcgccgtggttccccgctgcgccccgtcggtcgccgctctatcgggcacgccgagggcacggtcaaccttcgccgtgctcgggtgccgtgagatccacccatatccagggcttgtggtcccacgcgcgcacttcccctacgacgaggtcaacagtcgtacccacaggcggcaactcctggacgagtcgcttcactccaggttcgctcttgcggcggatcaggtccagtgaggcgcccacgggttcgtagtcgttgagttccgccgtgaggccccatggttggtgactggtgatcgttgctcggacggtctcgccctcgcgaagctcgctgaggggacgcctcgattcatctgccatggcggcatcatccctcctcagcccaccactctccccagctcccgccacaacggacccgcacccgcgaacggcgccccctccacgcgagcacatggcggccttcccgcccgtcgacgtcactctgccctggctgaccccgaccggtcccaaggtcacgcaccggctcctcttcacgagcagcatcggcgccgccatctggagccaaggtttcaacgaccaggcatggaaaaccgcgttgggcttccgccggcatcatcccggtgcccgaaaagggcgaacgctacgccgctgcccgggagcacggcatgcacgccctccgccacttctacgccccggtgctcttggacgccggggaaagcatcaaggccctgagtccctcccctggcaaataacaccccgacttgcctgaccgccgcccctggatggaaacccgtagggccgcagggccctgagctggggtttcgccgatggcgcctagctgtcgcgtgtgcagcggcccttcgcctcgggggccgggggacggcactggagggtgaagtcggcggggtcggtgctcaggtagcggccgatgcaggtgttggccgtggtgcgtccgtgctcggcgcagaaggtgagcgcggcgcggccgtcggtgaaggggcccggtgcgtagatcacccagtagccgcggcggagtgaggcgtactcgtcgctgcgcaggtagagcgcttccggcacggaggtgcggatgcggcgcaggcgctggtcgcgggcggcggtgcccgaggagacgggttcggagtacagctgtgcgatccagcggcc

SEQ ID NO: 1097 - DNA, 5089 bp, Unknown
  Kingdom: Bacteria, Phylum: Actinobacteria, Class: Actinobacteria, Order: Streptomycetales, Family: Streptomycetaceae, Genus: Streptomyces
gcgacggcgaccgagccgcggatgcgggcgctgagcagcacggcgaggaccaggagccggtacagcggctgcggggtgtccttcagggtgatgccggcctccgcggcgaaggtctcgccgtaccgctcgaccagctcccgcagcacctcgcccgcgcgccggtcgtcctgctccgccttcgaggtcaccggggccgctcagtcgtcgcgggagacgttctcggcggcgaacatccagcgctgcttctccagctccgcggtgatcgtgatcagcaggtcctgggtgaccgggtcgggcttctcggtcgcctcgatgcgctcgcgcagccgggcgatagcggcctccagagcctcgacgatgacctcgacgacgtcggtgtcgcgtacccagccgtccttcgggccgggcagcgtgaacgcggaggcgatcgtctccgggcggccgtccggcggcaggccgagcgccgaggagcgctccgcgaccgtgtcggcgaactcgcgggccgcggccaccacctcgtccagctgcaggtggatggagcggaagcggggacccacgatgttccagtgcgcctgcttaccgatcaacgagagcccgagaagatccaccagggtgctctgcagcgcctccccggtgacctggcgtgccgactcgggaatcgtgctcttcacgacagtcatgcggtggttctccctcgtggggtcgtcttggcggtaccgggcgggtgcccggcgcgtgccgccgcaaaccggcgcgtgccaccgcgaccgaccgtgtgccccagcgaaccggactggtcaacgtggccccgtgaggtgctcagcggggcaggacccggtccaggaaggccgtcacgtccgcgaagacctcggcccggttcgtctccaggaacacctcgtgccgggcacccgggtagatccgctcggtcaggtcgccgcgaccggccgctctgccggtgagccgttccacgccgacccggctcccggcgagcggcaccagccggtcgtcgtcgccgtgcagccacagcacgggcagccggccgacgtcaccgccctcggcgacggtcagcagggtgcgcgcgaacgcctggaccgtcggccgcttcatcgggccgtgccacaccagcgggtccgccgcgtacgccgcgccgatggccgggtcccgtgagagcgcggcggggctgatcggcgtgtcggggatctcgtcgagcgcgagcagccgcccgggcagctcccaggcgccgatgaccggacccgacagcacgagcgcggtcagctcgtcgccgtagcgctgggcgtagcgggccgcgatcaggccgcccatggagtggccgaccaggaccagcggcaggcccgggtacgcggcccgcgcgaggtccgccacggcgtgcgcgtcgctcaccacgtcctcgaagtcctccacggccacgcgctcacccgccgacctcccgtgccccacgtgatcgggcgcgtggacggccgcgccgagcgtcccgagcacgcccgccagctcctcgtaccgcccggcgtgctcgccgtagccgtggacgaggagggcgaggaagcgcggtcgcgggtgcggccactcgtggacgcacagggtgccccgggttccggtgaggacgtgctcgcgggtgtcggccatctctcctccagcggcatcggcgggtccggaggggatcttcccagcgggccggtccgcggtctatagtccaaaactagcagtgctaattaatggtccggcagtgctgattgatcgtcgtacgggacgagcggacaccccgccagtgtcgtacggccgtacgagccctccgaggagtcctgccgtgcgtcccgtccacttcgcggccgcccgccgcaccccgatcggcaagctgcgcggggccctgtcctccgtacgccccgacgacctcgccgcgaccgtgatccgcgccctggtcgccgatgtccccgccctcgacccggcgcgcgtcgacgacgtctactggggcgccgccaaccaggcgggcgaggacaaccgcaacgtcgcccggatggccgccctgctcgccgggctccccgagtccgtgcccggcgccaccgtcaaccggctctgcgcctccggtctggaggccgtcaccgccgccgcccgcaccatcgccgccggcgaggccgacatcgtgctcgccggcggctccgagtccatgagccgggcccccttcgtgctgccccgcccggacgaggcgctgccgcaccgcatcgagacgtacgacacccggctcggctggcgcctggtcaacccggcgatgaaggacctgcacgggctgctcgccatgggtgagaccgccgaggaggtcgccgagcggtacggcatcgcgcgcgaacgccaggacgacttcgcgctgcgcagccaccggcgggccgcccaggcgcgcgaggacggccacttcgacgccgaactcctgcccgtgaagcgccccgacggcgtcgtggtcgaccgcgacgagtgcatccgcgaggacacctcctacgacaagctcgcccggctgaagcccgtcttccgcgcgggcggcacggtcacggccggcaacgcctccccgatgaacgacggggccgcgggcctcctcctggtcagcgaggaggcgctgaacgacctcggcctgcactccctgggccggtatgtcgccggcgcctccgcgggcgtccaccccgacgtcatgggcatcggccccgtccccgccacgcgcaaggtgctggcccgcgccggatggggcaccggcgacatcgaggaggccgagttcaacgaggcgttcgcggcccaggccctcgcctgcgtcgaccagctcggcatcgacgaggacctggtcaacccgagcggcggcgccatcgccctcggccacccgctcggctgctccggcgcccgcatcctcaccacgctgctgcaccgcatgcaccgcaccggcgcggcccgcggcctggccacgatgtgcgtcggcgtgggccagggcagcgcggtcctcgtcgaacgcgcctagccgagcccccacagccgagcacccccggccgatctgagaaccagccgagctgagaaccagccgagctgtacccaccgtcgcaatccgacccccgttcagagccgcaacgaagccgcacctgaaggaagtaccccccatggcaaccctctccgtcgccgccgtcctcgccgagaacgcccggcgccgccccgacaagaccgccctcgtcgaaggcgacctgcggctcaccttcgcgcaggtgtggcagcgggcccgcgcacaggccggggcgctcgtcggactcggggtccggccgggggaccgggtcgcgctgatggcgcccaacaccgccgagttcccgcaggcgtactacgcgatcgccgcggccggcgcggtcgtcgtccccgtgcacctgctgctgtcggcggcggaggccgaacacgtcctgaaggacagcggggccacgctgctcctgtgccatcccgcgcaggcggagaccggcaccgccgccgcccgcgccgccgacgacccggccgtcgtcttctacaccagcggcaccaccggcgtacccaagggcgccgtgctcagccacttcaacctggtgatgaacgccaccgtcaacgccttcgacgccaacgacatccgccccgacgacatcgcgctcggcgcgctcccgctcttccacgccttcgggcagacggtgtcgatgaactccacctggcgggccggggcgaccctcgtcctgctgccccgcttcgacgcggcccgcgcgatcgagctgatggtcaaggagggcgtcaacaccttccacggcgtacccacgatgttcgtctccctggccgccgcggcggccgacgccgacgtcctgccggacctgcgcgtgtgcgtctccggcggcgcctcgctgccggtcgcggtcctcgaacggttcgaggcggcgttcggcgcgaagatctacgaggggtacgggctctcggagacctccccggcggcggccgtcaaccagccggtgttcggcgcgaagcccggcaccatcggccacccgctgtggggcgtggacgtggagatcgcccgcgccgagaccgaggaccgcgtcgaactgctgcccccgggcgaactgggcgaggtcgtcgtccggggccacaacgtcttctccggctacctcggacgcccggaggccaccgccgaggcgctggtggacggctggttccgcaccggcgacctcggcaccaaggacgacgagggcttcctcagcatcgtcgaccgcaagaaggacgtcgtcatccgcggtggctacaacgtctacccgcgcgaggtcgaggaggtgctgctgcgccaccccgacgtcgcccaggtcgccgtcatcggcctgcccgacgaactgcacggcgaggaggtgtgcgcggtgatcgtcccggcccccggcgcccgggcggacgcggccgccgtcaccgcgtgggccaaggaacgcctcggccgccacaagtacccgcgacgcgtggagttcaccgacacgctgccgctcgggcccagcatgaaggtcctcaagcgggaactgcgggcgcggtacgcctgacagggggcgcccgacggcgggcgcccggctcggcgggccgacaagccgccaagccgccgagtcaccggatcacctgacgagacgccgcttacggccgcagcttgtccgtgcataccatcggtctccgcatggacacgatggctctgtggcacatatccggctgggccttcgcggcgctcgcgtgcgcggccctgctcgtcggcttctccaagaccgccgtcagcggggccaacaccgtcagcctcgcgatcttcgcggccgtcctcccggcccgcgcctcgaccggggtgctgctgccggtgctgatcgccggggacgtgctcgccgtactcacctaccggcggcacgcccactggcccacgctgtggcggctgttcccggcggtcgcggccggagtggtcgtcggcaccctgttcctgctgtgggccgacgacggggtcgtgcggatctcgatcggcgccatcctgctgctgatggccgccgtcacggtgctgcggcgccgggcggccggccgcccggcg

SEQ ID NO: 1098 - DNA, 4931 bp, Unknown
  Kingdom: Bacteria, Phylum: Actinobacteria, Class: Actinobacteria, Order: Streptomycetales, Family: Streptomycetaceae, Genus: Streptomyces
cgacgcccgcgccgccgtgccgggcgacgcgacgcaccaggcgacgggctgggcgttctcggcgttcggggcggcctgaaggcgggcgcgcgcccctcgcaggcggccggaggcgcgggtgcccctcacctccggccgccccctgccctttaccccgccgctgccccgctgagcaggaccggctcccaggcgaacggcgggtccgggatcgtacggcgcagtacgggcgcgacctcgctctggaacagctccagcgagtcacggtgctgtgtgtcggtcagtccgcccgcgtcggcctgcacgtgctgcacggtgtgcccgaaccgctcgtggtagcggtgcaccttgtcgatcacctgctccgggctgccgatgagcgccgaggagcgctccgcgaagtcctccagcgtctcgaagaccacgggcaggcccgcctccttctggaaggcgaggttgctctcgaagacgggccggtaggcggccagcgcctcctgcgaggtacgggccacgtacaggcccgccgagcccgcgccgaccgcgatgcccgccgggtcgtggccgtagtgctcccagcgttcgcggtagtggcggatcagtgcggcgtacggctccatcgggtgggtgacgttcgcggagaacagcgggtcgccgtagcgggcggcgaggtcgacgctctcctcgctggtcgcgctgccgtgccagacccgtacgggccgctggtacgggcgcggccacacctcggcgtccttcagcgggggccggaagcgggtgccggcgctcacccggtcctcgcgccagatcgtccggaacacctcgtagctctcggcgttgcgctcccactgctcctcgggggcgacgtggaagaggtcgcgctgggcgctgccgttgcccttgccgatgatgaggtcgagccggccgccgcagaggtggtccagggtcgcgtagtcctcgtaggcgcggaccgggtcgagcaggctgagggtggtgacggcggtgaagagccggatccgccgggtgagcgcggcgaggtggccgagcaccaccgtgggcgcggaggacaggaagggccgctcgtgccgctcccccaccccgaagccgtcgaagccgagttcctcggcgagcacggcgttgccgacgacctcccggaagcggtcctgggtggacttcagcacgccggtggcggggtccgggcggtgcacgatcagggtgatcgcgaggaacttcacgaggccgccctctcctcgcgcgcgcggtccgggtgggccaggccgaggtggtcgcgcagggtcgtgccctcgtagtcggcgcggaagacgccctgttcctgcaggagcgggacgaccttgtcggcgaacgggtccagtccgccgggggtgatgtgcgggacgaggatgaagccgtcggaggcgtcggcctggacgaagtcgttgatggtcttcgcgacggtggcgggtgcgccgacgaacgtctgccggttgccggtgttgatgaccaggtcgcggatggaccagccgtgggcggcggcccgttcgcgccactcgcgtgcggtggccagcgggtcccggtacatgcgcacctgggcccggccgcgcgcgatgtggtgctcgctggtgtcggggtcgatgtcgggcagcggaccgtccggatcgtacgccgacaggtcgcggttccagacgaactccaggtgcttgatcgcggtggcgccgctgacctgctgcctgcgcacctcgcgggccagctcctcggcctcggcgtcggtgtcgccgagcacgaaggtggcggcgggcaggatgagcaactggtccggcccgcgcccgtacttggcgaggcggttcttgacgtccttgtagaacgcctgcccctcgggcagcgtcgcgtaccggctgaagatggcgtccgcgacggcggcggcgaactcgcggccctcgtccgagtcgcccgcctggaagatcaccggccggccctgcggggagcgcggcacgtcgaactggccgtggatgtcgaagtgctctccctggtggacgaaggcaccggcccgggcgtcgcgcaggaaggtgccggcggactggtcggcgatgatctcgtcgccgtgccaggagtcgaagagttcgttcgccgtggccaggaactcctgggcgcgggagtagcgctcgtgctgcggcaggaagccgccgcgccggaagttctcgccggtgaacgcgtcccaggaggtgacgacgttccaggcggagcggccgtcggagaggtggtcgaggctggcgaactggcgggccacctcgtagggctcgttgaaggtggagttgatggtgccggtcaggccgaggcggtcggtgacggcggcgagcgcggcgaggacggtgaaggtgtcggggcggccgacgacgtccaagtcgtagatcctgccgccctgttcgcgcaggcgcaggccctcggcgaggaagaggaagtcgaacttggcgcgttcggcggtgcgggcgaagtgggtgaaggagctgaagtcgatgtggctgccggcggccggatcgctccacacggtggtgttgttgactccggggaagtgggcggccaggtggatctgcttgtgcggcttgctcatggcgtgcggtccttccggctcaggcggtggcggctgcggcgtagcggttggcggggcgggctaggccgaggtgtccgcgcagggtgccggtctcgtaggcgcgccggaagaggccgcggcgctgcagttcggggacgaggtcccgggtgattctgggcaggtcgtggccgaggacggccggccggagccggaaaccggtgagtccggcggcgctcaacccctccagcagttcggcaagttggacggcggtgccggtgaagatacgggcgtcgctggtgtactcggcgccgtcgagggtgtcgaggcggtccttgcgggcggcggcccgcgcctcgtcgtcgtccaggaacaccacgaggtcgccgaagacgtgcagcggttcgtcggcgcggcccgcgctccgctgttcggcgcggatctcgtcgacgatgcggcgggcgtcggcggcgtcgcgcggggtgacgtagccgatgtcggcctggcgggcgacgagccggtacgggaccgtctggtgggcgagtgcgctgacgaccggctggccctgcggcggacggggtgtgatggaggggcccctgacgctgaagaagcggccctcgaagtcgatgtagtgcagtttgtcgcggtcgacgaagcggccggtggcggtgtcgcggatctccgcgtcgtcctcccagctgtcccacagccgccggacgacctcgacgtggtcggcggcctcgtcgaacaggtcggagatccgctcctgtccggccgggccgcgcaggctctccagggtgacgggcggaaaggtgcggcggccgaagtgggcggcctcgtgcggacggggcgtgatctggacgcgcagcccggcccggcccccgctcacatggtcgagggtcgcgatcgccttggagatgtggaacggctccgtatgtgtcgccaccacggtcggcaccagtcctatgtgccgggtgaggggtgcgacccgggaggcgatcagcacggcgtccaggcgtccgcggacctggtcggtgcggccgtccggttcaccgaagcgcgaggactgctggccgaggccgtcctcgaaggtcacgaggtcgagcagcccgtgctcggcctcggtcacgaggtccgcccagtaccgggcggtgaacaggtcccggggccgggagaccggctcccgccaggacgcggggtgccagccggtgccgtcgagggcgacggcgaggtggagcgggccgggggaagaggaggtcgtggacatgcgggtgccttcctggaggtccgggggtcaggagttgtcgaggggcaggccgggcgggttggtctccgccttggcgacggcctcgtcggaaaggttccaggcggccagccacttgccgtactgaccgttgcggatcaggtggttgagggcgtcggtgagcggcttggccagtgcgctgtccttcttcgcggtggccgcgatcaggccctgcaggcccgcgcccgcaccggagaaggcgcccgcgtcgcgggtcgcgcggggcgtgttcgcgctctgccggacgtggtaggcgataccggggtgggggccgaagtaggcgtcgatgcggccgctcgccagagccaggtaggtgctgttgctgtcctggtagtacttgacggtgagctgcttgctctcccgggcgagccgggccttccactccagcaggatcttctcctggttggtgccggagctgacggccacggtcttctgggcgagcgcacggtagtcaccgcggaagttccaggtgctcttgccgggcacctcgaaggcgaggttgtcctgccggtaggaggcgaactcgtacttcttcttgcgttcctcggtgacggtgacgttggagaaggccacgtcggtctttccgctgtcgatgccgacgaacatgttctcccaggtggagttcttcagctcgggcttcaagccgaggaccgctgccaccagccggccgaggtcgggctcggcgccggtgagggtcttctggtccgcgccgacgtacgccagcggcgggaagccggagggcagcgcgccgacgccgatgacgagcgtgcctatcttccgtacggcggcgggcagttcggcgtgcagggccttgacctcgggcacgtcgagggtggtccggcgggcggcgccgtcggagagctgtcccacggtgaccttcccgggggcggcgccggtggtggtggcggcctcgctgtcgccgccgcagccggtgaggaggacagcgagggtgacgagggcggtgccggcggtgagtacgcgcgggacccggccgaggggacggagggtgggcatggctgtccttcgcggaagtagcggaagtagcggaaacagggg

SEQ ID NO: 1099 - DNA, 5280 bp, Unknown
  Kingdom: Bacteria, Phylum: Actinobacteria, Class: Actinobacteria, Order: Streptomycetales, Family: Streptomycetaceae, Genus: Streptomyces
gcccgccccccagcgggccggccgccgcatctcccgggccgcgcccatgatctggtgcgccgggagtgtgaccccgccgcgcggcgcgagggccggatccgtcacggacagcggcagcgaaccgctgacctgggccagtacgggcaggttcgccgcacgcagtctgcggaccaccgccgcgccgtcagcgtcgcgcgcgtccagaaccaccggccgtaccggcagaccgacctccgccgccgtgtcgaggcacgcctcgatggaacagtcgccgagggtgcgctccagcagcagcccttccgggatcgacgcccgcacccgccggtgtccgttgcccagccaggccgcggagagcagcagccgccagttgaccggcacgcacagccgctccgacgccgcccagacaccgacggcctgctgggcgttgagcacctggcccagggccgacacgaactgccggtccacgccgacggagtgctccccggccttcgggatcaccatgggacgcacgacccaggcctcgggcggcgacacgcgggccaggtagcgcgccaggtcccggcgcaccgggacccagtcccacgtcgagctggtgacgaagtggtgcagccgctgctcggtcgccgaaccaccggtcctcgccgcgatgttccgtatcgacttgcgcccctcggtgctcagcagaccgctcacgtactccatgcccctcctgcgctggtcccggcggggcagggacgcgaacagtgccgcgcacaggtcgtcgaagacgtcgccgcaggcaccggcagaggtcaggccgccggcccggtcccgtccgtccaccgcgtacacgccgccgtcccgcatctcatcccccgtcacgtccgcctgggaaacaccgcagatgtcccctccactctgagcgcccggacgggccccgcccaggtaggcggggcacacatctgtggcactccttggtggccgggccacccccggggaggagtttggcgccgacgccgcccgtgctaatgccgggtgaccgagtggatccaggtcagttgctgtgagatctccccggcctcggcgatcccctgccggtcggagccgtcgaagacgccgaggagggtctcggtaccgcgcgggccgacgctcatcaccgggccgccggagtcgccgccggccgggatcccggagaccttctccatgcagaagtccgagccgcccggtgcggtgaacccgtcgcatcgcgggtcgtccggacgtacgacccgcaggtcggactgcttgagcacgggcgactggcaggcgctctcgtccccggtgcaggtggcgccccacccgtactgccgcaccagccgacccggacggacaccgaccgtggccggccgcgccgtgcggaccttcatcggcgcgaccttgatcagcatcatgtcggcgcgcgcactgcccacgcgtttgccgggcaccggacggaccgtggtccccttgcgcacgtcgaggctgcccacccggaacgagatccgcttgtcggcgaccggctgcgcctgctcgaagaagcagtgcgaggcgctgatgatccactgcgatgtgaccgctgtcccggtgcacaccggtctgccgtcgacgagcatccgcaccgcccacgggccgtagccgctcctggacccgccgatgacggcgcaggccggcgcggacaccgcgaccgatcctgtcaccagcagtaagacggtcagcagcagcactcgcactcgacgcaccatcaggaacatctcctctcaccggcgtacgggccgtacgcgtggtgagatgccccgccggagcagaacgttccgctccgcgcaccggggacacctgtgcgggcagcggtgtcagtggcgtcctctacgttcgtcccatgagctcctctctgagtcttcacctgcttgacgtcgccgccacgcgtgctctggtcgggtcccgcgacgacgagctgctggcggcgatacgcgccgaatgccgggacgagatggcccgcgacgacgactaccaccgccacgcgatcgagcagggcgccccgaccgcggacgaggcactgcgcgcggtcgtccacggcggcccgttcagcgagcacgggcaccacaccttccagtacgggtacgcctaccggcggctgtgctcgctcaccggagcgttcctgcccaacgactgcttcacaccgcaccgcggcgactggctgtccgtcgtcgaccaggggctgaaggcgctgggcatcaccgccgtgtccgtggaagccttcagccagggcgccctgcccgccccgctgccgtacaccttcacaccgggctgcggcgagtggacgcccggtcacatcgcgcgggcgctacgccagttcgaggccaaccggcgcgccgtcgacgcctcgggacagtccccgccgctggagcccgaggtcgtggaggccgtcatgcagtgcctcggctggatgcggcacgctgagacacgccccggattcggcgtcatcggcttccgctcctgagcccgtggacggaggacggacacggaagatcccgtccgcgtcagacgatgccggtgacggtgatggtcacgcgcgctgtctcggcgggggccaggtcggtgaggcaggtgtcgatcgcggtgcgggtggcgcgggcgacgtccagggcgcgggcgccggcgagcgtgacgatccgcacgtcgatcgtccagtgagcgccgccgcccgcccggctgacgcgcagcccggccggcgacgcgccgacgggacgcggtccgggcagcgcctcccgcagccgctggggcacgccgggcctgaggaaggcgaccccgggcacgtctcccacggtccgggcgagtgcctcggtgagcacggcctgctgggtcatcggccggatcccttctccgtcgtaccgtcgttccccatcgtgccgtggtcctccgtcgtaccgtcgttcaccaccgtgccgtactcctccgtcgtaccgtcgttcaccaccgtgccgtcgtcctccgtcgtaccgtcgtcgccgtccgtgtcgaccaggtcgccgatgcggacgtcgacagccgcgatgttcaggccgaggcgccggtcggcggcctcccggacccggcggcggacctcgtcggccagctcgcgcagatcaggagtggacagcggtgcgtgaatgcccagacggacaccgacccgtcctgggccgacggcctgcgccgggctgatccggcaggagcccgcgcggacaccgggtacctgttcggccgccgcgcgcagcgtgcgggccgcgaccgactccatgatccacaggtcctcgtccgggccgcccaggggcagcggccgtcctggccgcagttcctggcgtacgacgtccatgacacgccgcgtcagcgcggtggcgtcgaaggcgccggcgccgtccgtctcgtccgtgtcctcacgcagccggcgcacggcgccctccagctcctccaggtccacgacggcccggcggcagtgggggcaggtgcgctgatggtcgtcgccgacgctgtcttcccagtcgctccacacctgcgacagcagccgtccgcagggcagctgctcgtcgccgggctcgggcggcaaagaggcgggcgggtggatgcgggtggtcatcgccaggctcccagtgcggtggtcaggtggcgtcgggcgcggaagacgcgggcacggacggcttgctgggtgataccgaccgtgtccgcgatgaacgcgtaggaccggccgtccaattctcgcagcacccagcaggtgcgctgctcggccgagagcccggccagagcgcggtgcatctcgcgcacggcggcgcgtgcctcggcgatccggtcgggggcgacggtgtgctccggcgcggctgtctcggcgacggcctccagcggtgccacgggcttgcgcgcgcgcaggatgttcaggcaccggttggtgacgatccggtacacccaggtgccgaaggcggcgtgcccgcggaactcggggagcctgcgccaggcgctgatgaacgcgtcctggacggcgtcctccgcctcggccctgctgccgagcagccgggtggccagccggagcagcgccggggcgtgacggcgtaccaggacggcgaacgcctcgtcgtcgccttcggccgcccgtacggccagcagcgtgtcgtcgagcgcggccggcgcgtcgggcagcgcggccggcgcgtccggcggtgcggtcggtgtgcggtcccccggcacggggcggctcctctcgtcggtcctcttcgttggacagtccggccggccctcctgtgacgcggtgtcgttcacgaaagcgggctgcggctggcatcagaatttccgggaaggcgcgtaacaaccccctccgagcggtgtccatccaggtagagcagctcgcagcgccgccacggcgcccgacgaaggaagcttgcgatgaccatgcagcaaagcacgccggtgtccccgaaggcctccggcgcgcagacggggaaggtgtcaccggcgacgacggacgtcagcaagggagccatcggagtgaacgaaccggcggacacgcgcggcaagacctcgatcgccgatgtggtcgtggtcaaggtcgccggggtggcggcgcgggagatccccggggtgtacgacatgggcggcggcctgtcccgcaccatcggcgccgtccgcgaacgcgtccccggcggccggccgagcgtcatgcgcggcgtcaaggtcgaggtgggggagcggcaggccgccatcgacctggacctggtcgtcgaatacggggtgtccatcacggacgtggccggcgacgtacgggagaacgtcatcagcgcggtcgaacggatcacgggcctggaggtggtggaggtcaacatcaccgtcaacgacatccacctgcccgaggacgacgaggacgtctcgtccgccgagatccgcgtcgagtgacgccgcgacctgacggacgggccgcacggcgcacagcaccggcccctcgcgggccggcgggaggtggatgagagatgagcagggccttcatcggaatgatcgcgggcatggcgctgggcttcgccggctacttcggcggcttctgggccttcctgctcgtggcggtgctgggcggcgccggctatgcggcgggtgcctggctggacggcggcgggcgggcgcacgacctgcgggagacgttcgcacggagccggcgatgaccaccgcggcatcgcgcggtacgacggtcgtcgcggacaaggcggtccgcaggatcgcggagcgggcggccgcggaggcgctgcccggcagggtaacgggctccagcgg

SEQ ID NO: 1100 - DNA, 720 bp, Unknown
  Kingdom: Bacteria, Phylum: Actinobacteria, Class: Actinobacteria, Order: Streptomycetales, Family: Streptomycetaceae, Genus: Streptomyces
ccgcctgggcgggctggctccgccaccacccggaggcggcccgcgactgacggccccgtagcccgcccgccatgaccggtcccgcacggaccggccgcgccctgggcgccctgctcggctcggccggcggcgacgccctcggagcccccttcgagttcggccccgagggcgccttcagccggcgcttcccgcggccctcggccggcggcgagatgtgcggtggcggcggctggggatgccggtgaggcgaccgccgacacgcggatggcggtcctgaccggcgagtcgccgctggaacgcggcggtctcgacctgccggacgtcttcgcccggttccgccgctgggcggcggccgacccgaagggcatcggcctccagaccgaggcggtcctgaccagcggcgccccctggggcgcggcggcgtccctgcgccccgcgcccccaccacgaccgctacgccgtcgtcctcgcacccgactggcacccggatcacgctacggagtccaacggggcggtgcggccgtgtctcgggtccgccgtctgggcactgcgcaccaccggctctacacggacgccgtgcgcgccgccgtcgacctccgcggtgacacggacaccgtggcggccgtcaccggcgacctcgccggtgacggccacggcgccggtgccgtcccggcgcggtggaccgaggcgccgcacgtgcccctgcccggctcgggcggc

SEQ ID NO: 1101 - DNA, 1303 bp, Unknown
  Kingdom: Bacteria, Phylum: Actinobacteria, Class: Actinobacteria, Order: Streptomycetales, Family: Streptomycetaceae, Genus: Streptomyces
ggtccacaccgtgcgcgcgccgaccgcgtcgaacacgggggtcaccgcgtcccggccctcggcaggaccggccgccagcacggtcagccgaccggcctcggccggctgcctggtaccgagcaccggggcgtcgtagaagacgaggccccactggcgggcgagggccgcgagttcgccgacggactccaccgaggccgtggtcgactgcgcccagacggcacccgcgcgaaccgccggcgcggcctcgcgcatgacgtccagcaccgtgcccccgtcgtacagcatggtcaggaccacgtcggcgtcgcggaccgcgtcggcggcggagccggtgacccgcgcgccgtcggctgccaggggctcggccttggcacgggtgcggttccagacccggacggtgtgcccggcgcgcagcaggttgcgggccatcgcggcgcccatgatcccggtgcccagcacggcgacggtacggctcccggtggtcatgtcagccatgtcgttcccttcagcccttcgggcccttcgagcccttcgagcgggtctgcgggcggttctggtcggtcgtcgtcggcggtcgttgtccgcggacgacgaccgcccggttcaatggtccggcttcccgcccgccttcgcccggccgcccggcagcaggggggtgatgaccttcgccagctgcgtctgggacgtcgcgccgatccggacggccgcggccctgccctgcggatcgacgaccacggtgaaggggatcgactgcgtgctcacgaggccgcgcggcagccggaggatctgcttgcccgccgggtcgtgcagggacgggtaactcaggtggtgctcttgctggaacgcgagcgccgcggagcggttgctgtcgtcggcgatcccgagcacctgcaccccgcgggcggaccactcccgctggatcctgtccagttccggggcctccacccggcaggggccgcagaagtgggcccagacgttgagcaggacgaccttgccccggtagtcggacaggtggatgtcccggccctccagggacgtcccggtgaggtcgggcacggcggggcgctcatcggcctccagggtgcgggtgagcacgtcctgctgaccggtctcgccggcccggccggtggacgagcaccccgcgagcaccgcacaggccgcgatcactgccgcgtacgtacgcaggtccggcatcgtctccccctcgtccgtccagggcctgccccagcccccgccgctcctgatggatcattgtcctcgccgcggcgggcgagccggggccggggtgtcggggccgatgtgt

SEQ ID NO: 1102 - DNA, 2880 bp, Unknown
  Kingdom: Bacteria, Phylum: Actinobacteria, Class: Actinobacteria, Order: Streptomycetales, Family: Streptomycetaceae, Genus: Streptomyces
gccgcccgccaggggcaggtcgccgccgcccgcgccccgggcgccccggtgcagttcggtcaggtgcagttgcaggtcgcggcggttggcgccgaacgcgtccagcgcgcccacctgggcgagccgggcggcgaccgggcggctcggccgggcccgctcccagaagtcgagcagcgaggcgtacggctgcccgtccgcgatccgtgccgcctcggcctcgctgatgccgtgcacgtcacagagcgccaaccgcagcccccacgccccggatcccctaggtggctcggacccctttgattcagacaccagttcgatacgatgtgcgactcccgaccggttcacgtccagcggcaggatcggcaccccgcgccgccgcgcgtccgccagcagcagccgcttcgggtacatcccggggtcgtgggtgagcaacccggcgtagaaggcggccgggtgatgggccttcagccacgcggactggtacgtcggcacggcgaaggccaccgcgtgcgccttgcagaagccgtacgacccgaacgcctcgacgatctcccaggtgcgccggatcgtttccgcgtcgtaccccttcgccgccgcgtgctgcgcgaaccacaccttgatccgcccctgcgagtccgggtcggacagcccgcgccgcacccggtccgcctcgtcgcgcccgcagccggtcatgaggtgcacgatgtggatgatctgctcgtggaagacgacgacgccgtacgtctcccgcagcggttccgccaggtcggggtgcggatagcgggcgggcgcccgcccgtgcctggcctcgatgaacggccgcaccatgtcggcggcgaccggaccgggcctgaagagcgagatgtcgaccacgagatcgtggaaggtggccggctgcagccgccccaccaggtcgcgctggcccggggactcgatctggaagcagccgagcgtctcggcggagcggatgagccggtacgtcgccgggtcgccctgcggcacggcgtccaggtcgatccgctcccccgtcgtgcgccgcacctccgcgaccgcgtgcgccatcgcggactgcatccgcacccccagcacgtccagcttgagcagcccgaggtcctcgacgtcgtccttgtcgaactgggacatgggcaggccctcaccgctggtgggcacgaccggcgtacgggcgagcagggaggcgtccgacagcagcaccccgcacgggtgcatggcgaccccgcgcggcagggcgtccaacgcctcgaccagctcccacagcctgccgtacttctccttctggccggccagcgccttcagttcgggcagttcctccagcgccgcgcgggcgtcgcgggcgcggatgtgcgggaaggacttggcgacgcggtcgatctcggcggggtccatggacagggcggcgcccacgtcccggacggcgtggcggacgcggtacgtctccggcatggcgaccgtcgccacccgctcggtgccgaaccggccgatgatcttccggtagacctccagccgccgcgcggactccacgtcgatgtcgatgtcgggcagcacgaaccgccgccgggacaggaagcgctccatcagcagcccgtgctcgaccgggtcggcgtgggcgatgccgagcaggtggttgacgagggagcccgccccggagccgcgcgcggcgacccggatgcccatcttccgtacgtcgtcgaccacttgggcgacggtgaggaagtaggaggcgaagccgtggtacgcgatgacgtccagctcgtcgtgcatccgctcccagtacgcgcgccgcccggcgtagccgcgcagcaccatgccggccgccgcccgggaggccagcgtgcgctgcgcggtacggcgggcggcgccgaccaggtgcggctcggggaagtggacggtgcccatgccgaggtcgtcctccgggtcgaccaggcactcggcggccgtggcccgcgtctgctccagcagccggtgggccgcctcgcgccggaagcccgcggcctcgacgatccgctcggccgcgtgcagcatggtgcccgggtccttcagccaggcctcgccggagtccagttccttggtggcgtcgatggggaccaggcggcgggcggcgtccaggacgtcggcgaccgggccctggccggggtcggcgtagcggacggcgttgctgagcacgggccggatccgctgttcggcggcgaagccgacggtgcgggcggccagccgcagggagccggggcctgtgcccgtgcggccgtgccagacggcctccaggcgcagggcgtcgccgtagacctcgcgccaggggacgaggaggcgcgcggcccggtcggggcggcccgcggccagcgcccggccgacgtcggagccggggccgagcagcacggtcaggccgtcggcgtggttgtcgggccagggcaggaccggggtgtccgggcaggtgtgcgcggcgctgaccaggcggcacaggtcggcccagccgcgggcaccgtcccgggcgaggaaggtgacgcgcggagtcgactcgtcgacgaaggcacccccgcgcaccggcgcccggcgccgctccggccgcacagacccgtcacctcgtacggacctgtcaccccgcacggccctgtcaccctgtacggccccaccgccccgcacggatccgtcaccccgcgcagacccgtcaccccgcgcagacccgtcacctcgtacggacccgccgctccacgcagccccgccgcgccgcacggacccctcgccccctacggcctcgtcgcgccgcgcgggagcgccggggcgcagggccgagtccgggcggtcgcgttcgggttcggccaccgccagttccgtaccgaacagcgggcggatgcccgccgccgcgcaggc

SEQ ID NO: 1103 - DNA, 2254 bp, Unknown
  Kingdom: Bacteria, Phylum: Actinobacteria, Class: Actinobacteria, Order: Streptomycetales, Family: Streptomycetaceae, Genus: Streptomyces
cctgcacgtgcagggtcgagaccgaggtcgtgcccgggcggacgacgctgtggtccacggtgacgccctgcgccgcgacggccgtgcgcagggcggtgccgaggccgtcgtcaccgaacacccccaggtaggcggcgtccagaccgagccggcgggtgtagacggcgacgttgacgcagttgccgccggggtagtcggtgccgcggtccacgaagcggtcgacggtgttgtcgccgaagccgaggacgttcatgagggactcccggggtgcgggcacggtgtgcgcaggcacggtgcccggcgtgggcgcgccggtgccggggcaacggcgcgcgggacgtgagggacggaggcgaccggtcgtagggctcagtagtccatgacgcggtagtagcggcgcaggtcgagcgagtggtcgcgcacccgctccaggtgcttgctgacccggtccatcacggtgtccagcaccagcggcgcgagcagtccgcggaactgcgggctgatgccttccagggggtagtcacgggtgtcgaagacggtgacgtccttggagacgcgtttggcgaaggcctcggcccggtcggtcagggcccgggtctcgtcctcaccctggaagacgatgacgctcgtgttctcctccaggagttccagcgagccgtggaagaactcggcgctgtgcacccgggtggtgcgcagccactgcatctcctcgaggatgcacatggagtacaggtaggtgaatccccacaggttcccgccgccgatgaggaagtggtagtcggtgtccttgtgggcctcggcgaaggccgcggccaccggctcggcctgccgggcgacgtccaccaggacgcggggcaggcccgcgagttcgtcggcgaggcgttcgtagccctcgaactcgccccggcgcgacagcagccggcccatgaacagcagcaactggacgtcgaacggccaggccttgggctcggagatcagcgccgtgtcgacgttgcgggcgacgggggagtcggggtagccggtgaaaccgatcgtgtgggcgccctgggacttgcagtgggcgatggcgcgcaggctgtcgtcggtggtgccggagacggaggtgaagacggcgatggtgcgctcaccgagccgggcgtcgccggaggcgacgagttcggcggcgacggcggcccgcaccggcagcagcgaggaacgccgggcgaggtgctcgtagggccacatctgcgcgtacgtgccgcccgcgcccacgaggaggacgttgtcgtagccgtcgtcggccagccggtcgacggtcttctcgatctggggacgcagcgccaggaggctctccgtctgggagacgaactcggcttcgttgaacttgagcacgatggtgacttcctcgaaggttgttccgtaccggccggcgggggccgctggaccggtgttccgaaagagcgcgcggaccggttcgggtcagctcgcgcgacgccgggagaacagcacgttcgccccggcgatgatcaggccgccgacgaagatcagcgttcccatgacgttgacctgcgggggcacgccggtacggctggcgctgtagacccacagcgggaaggtgaccgtacggccggcgttgaagctggtgatgacgtagtcgtcgacggacagggcgaagcacagcagggcgccggaggccacgccgggcagcagcatcggcagggtgaccagccggaacgccgcccacggtcccgctcccaggtcgcgggcggcctcctccagcgtcgggtcgtggccggccatgcgcgcccgtacggtgatggcgacgtaggggatgcagaaggccacgtgggcgatgacgaccgtccagtaaccgcggggcacgcccagcacgatgaacagcgacagcagcgcggcgccgagggcgatctcgggggccgcgatggcggcgaacatcagcaggtccacggagccgcggccgcggaagcggtggcggccgagcgccagcccgatgggggtgcccaggagggtggcgaccacggcgacgaccacggcgatggtgaggctgttcaccagcgcggaggtcaggttggggatggcgaacaggtgccggtaccagtgcagggtgaaaccctgccaggtgaagttcaccttgctgccggtgtcgttgaagccgaagaggatcatcacggcgatcggcagcagcagccaggccagcaccagcacggtgtacagggtcagggcggggcggcggcgcccgcgccctgaccctgtacac

SEQ ID NO: 1104 - DNA, 3407 bp, Unknown
  Kingdom: Bacteria, Phylum: Actinobacteria, Class: Actinobacteria, Order: Streptomycetales, Family: Streptomycetaceae, Genus: Streptomyces
gtgggggcgggctccaggaggtgggcgcgaagggtggcggtgaggagccgcacgtcgagttccagggcgtcgctcacgtacgcctcgaccgagccgtacttcgccttcagcgcggccaggaacaggcgcatcaccgacgcgggggcgtggccgtagcccggccagttcggggtgcggccgccgttgcgggcccgccagtcggccagcagggccggggtggcgagttcggtgagggtgaagtcctcgacgacggtgggttcgtcgacgccgagcagggtcaggaccagggcggccagctcgcccgtgcggtccttgccggaggcgcagtggaagaccagcggggtgtcggagacggccgcgtcgcggatcagctccagggcctcgcggatctccttggtgccgtcctcggcgacctccatgtaccgctcggccaggtaagggcccggttccacctccgggcccagggccggctggtcgtacggccggtgctcgatgctcaggttgtggtacgtgaaggacgggtgctccggcacgcggccctggcggtcgacctcccagccgtggcggaggtcgatcaccgtgccgatgccgagggcgaggaagcggtcccagtcgggggtgtccgggttcagcttgccgaggccgtccgcgcggaacaggcggcgcgggcggacccgcaggccgtcgtcggcggcgtacccgccgagatcgcgcaggttgcgcagggcgtcgaagcgtatgtgtctgtccacggtcagtcaccctacggccgggagggcggccccgaccgggagttcacctcgcgtgtcgtacggcgtagatcatgacgaaggcgacgacgtggatgccgaagaggaagtagccgaggtagtaccagacgtagcgctcgcgcttcttctcctcggcgaggcgccgctgctcggcggcccggtcgcggccgggagcgccctgcgcgggggtgtcccgcgcgggggtgtcctgtccgggcgggtcctgccggggggtgtcccgcggtgtcgtcagcggtctcaccggtcccggtgcagcttggtgttcgacgcctgggcgcgcgggcgcacgaccagcaggtcgatgttgacgtggctggggcgggtgacggtccaggtgatggtgtccgcgacgtcgtcggcggtcagcggctcggcgacgccctcgtagaccttcgcggccttctgctcgtcgccgccgaagcgggtcagtgcgaactcgtcggtcttgaccagaccgggcgcgatctcgatgacgcggaccggctggccgacgatctccaggcgcagggtctcggccaggacgtgctcgccgtgcttggcggcgacgtacccggcgccgccctcgtacgtgccgtgaccggccgtggaggagacgatcacgacggtgccgtcgccgctcgcggcgagcttgggcagcagggcctgggtgaggttgagggtgccgatgacgttcgtctcgtacatcgtgcgccagtcggccgggtcgccggtggcggcggcggccgggcggtcgatgcccacccgcgcgagtgcccgctgcgcgtcggcgatctgctgcggggtctcggcgagcagggtgacgggcttgccccacgggatcagccaggccaggtacgtggcgagcttgccctcgccctcgaagttgaacgacccggccacgtgcccctcggcgaaggccactcggcagcgcaggtccaccacccactcccccgcggccagccgggaggcgatctcctcggcgtccgcacgcctgggcggcgtgaggtcgaccggcgcgggacccgcggcgttggccgggctcatgtgcgcgtagtaggcgggcacgtcgtccagcccggcgagcaccttggcgacgaaggtgtccacgtccagggtcagcgcgtcgttggtcttgcgctcctcgccgatcgtggtctcgtccccctcggcctgggacgaggagcagaagctgccgaatccatgggtgggcagcaccggcacctcgtcgcccagctcgtcggccagccggtgggcggaggcgtgctgggcgcgtgccagctgctcggtcagccgcggctcgaccaggtccggtcggcccacggtgccgatcagcagcgacccgccggtgaacgcagccacaccgcgcccgccctccatgagggcgtaggagatgtggtgcggggtgtgcccgggagtggcgatcgcgcgcagcaccaggccctcgtccaccgtcacggtgtcgccgtcggcaaccggggtgcgggcgaacgacacgtgcgccccggccggcaccaggtactgggcgccggtgatgcgagccagctccagaccgccggtgacgtagtcgttgtgcacatgggtctcggccacgaaagcgatgcgcaccccgcggagggccgctgcggcaatgacctggtcgatgtcccgcggcgggtccacgaccacggcggtgtcgggcccgccggccaggtagctgcggttgcccaggccctcgaactccagggtgtcgacgaagaacacggattacgactcctctcgaacggtgtaccccggggggtatctggcactcaccttaacagttataccccccggggtattccggtcggaaagcaccagcaccccgctcaaggcatcgcctgcgggcactgtctttccctcacgcggtgaagccggcgtcttcccggctctcctccgcccggagccgacgcagtcggagtacggccgccaccgccacgcccgcggctgccagggcccgtgccagcaggacaacccggtcggagacggcctcgccgagccgcgcagcgccacgctcccaggccgcctccgtgtcgatgccgaccagggagggcagggcggaggtgccgtcgaagacgaggaacacggcccccagcacgatgaagaggacccctcccacgagcgaggtgctgtgcacggtgagcgggccgagtctcagtgcgcgccctctcagccaacgccggcggccgaggtcacagcggtcccacagcagtgccagaacgaacatcggcacgaccatgcccagcgcgtagacggccagcaggaggccgccgtgcagcgggctgccgtcgagcgccgccatggtgagaatgccgccgaggatgggaccggcgcaaaaacccgccagcccgtagacggcgcccagggcgaacaccgacagagccgacccggccttgcggacgcccgccgcctgcgccaggcggcgggagccgaatccaagtcccaggatctgcgccagtcccagcccgatcaccgtccagccgccgaccgtgaccagcagatcgcgcaggcgaggacgcgcgcgccagtggccggcaggcgggtggcctcatcaccgagctcgccccgcaggacgatgttgagtccggctccgtagaccacgaccgagtcggtgagagtgcg

SEQ ID NO: 1105 - DNA, 4531 bp, Unknown
  Kingdom: Bacteria, Phylum: Actinobacteria, Class: Actinobacteria, Order: Streptomycetales, Family: Streptomycetaceae, Genus: Streptomyces
ctactgcgggggtggcgggcgcgccgaacccgtacgcgcaggccgcccccgccacccccgcagtagacgtcaccaagtccgaggacgcccgatgagcacgccgcagacaccgatgccgccggccgcgcagcccgcctgggacgcgggggccgcttccccgcaggccggttacacctcgccgatccccgtcgtccggacgcacctgggacacgccctcgcctcggagtggacgaagatcaggtcggtgcgctccacgatgtggacgctcggggtcttcgtcctgatcgtggtcgggatcgggctgctggccggcgggctggtcgcccactcctccagtgccatgtccggcgacgagaacgtgctgacgctgggcctgttcggcacgatgctggggagcatctgcgtcatcacgctgggcgtgctgaccacctcgtccgagtacggcaccggcatgatccgcaccacgatgaccgcgtgccccacccggggacgggtgctggcggccaaggcgctggtgttcttcctgctctccttcgtcgtcaccctcgcctgcaccgcggtcgtcgccctcacgcaggtggcgatgctcgacggccacggcgcgcgccggccggccggcggcgagtggttcaaggcgacggtcggcgtcagcctctacctggcgctgctgggcctggtctcgctgctcatcggctcggtgctgcggcactcggcgggcgccatcaccgtcatgatcggggtcgtgctcgcgccgctggtcatcgcgctgttcatggccacgccgtcgctggagtcggtgcgcaccgccctgttcgagtactcgatcccgaaccagttgggcgtcttctactccagctcgctgagcgattccgggccctcgggctgggacccgctgtggatcatgctgggcgtgacggccgtcgtcggcgccggcgcctgggcgctgctgcgcgagcgggacgtgtagggccccttcccggcctgcgccctcgggccgcctttcggcgcccggtccctcgggcgctcagaagcgcggcgcgttgcgggaccgctgcacccgtgtggtgcggcggtccttcgcgttccagcaggccttgtgccagtgcctgcggtcgtccacaccggcgtactcgggccaggccaccacgtgcgggacgcccgagccgatcatctggtcgcagccggggcagcggtacgtcttgccggccgcgctggcgcccgcgacatggcgcacgctccactcctcgccctgccagctctcggtggactgccagcctccgtagcggctcgccgcgtcgtcctcggcgctcctgccggacgagccaggacccttgggacggttgcgacgcggggacaagggacacctcaccgggttctgcggaaggacgggtcgacgggttggctccagcgtacgcggcgccaccgggcggacacgcaaggaaccggatcgcctgccaaacctcccaagtcaccctccggaacggtcaattccgcagacaatccggaaatccctccgccaggccgtgtcctcggcacgtgtcgtccggttatgcccggtgggggagctccgtgtcggagccgaggaagcaggaaaagcgatgcgcgtaggaagtttcgtgttggcggcccagttccccggccagggccagggagaggcgctgcaccgcgcggtgcgtacggccgaggtcagcgaggaggccgggctggacgcggtctggctggccgagcaccacttcgtaccgtacgggacgtgcccgtcggccatcaccctggccgcgctgctgctcggccgcacccgccggctgcgcgtggggacggcggtgagcgtgctgcccaccgcccacccggtcgcgctcggcgagcaggccgccctgctgcacgtgacgagcggcggccggttctcgctgggggtgggccgcggcgggccgtgggtggacctggaggtcttcgggacgggactcgcggcgtacgagacggggttcccggaatcactcgatctgctggtgcgctggctgcgcgagccgtcggtgtcggcccgcggcgaccggttcggcttccgggaggtcgccgtcgtgccccgccccaccgaggcgctgaccgacgccccgggacccgaggtcgtcgtcgcctgcacctcgccgtcgagtgtccggctggccgccgagcgcgggctgccgatgctgctcgggatgcacgccggggacgaggagaaggcggagatgatcgccctgtggcggcgcagtgcgcgggccgccgggcacggcgccgaggtgatcgaggacgcggcccatgtgtcggccggggtctgccagatcgcggaccgcagcgcggacgcggcggagaccctgctgaaggcgatgccgggctggctgaaacagggcctggacgcccatgtcacggtcgacggccgcagccgccggatgcgcgacccgctggcctacacggagttcttgtgcggactgcaccccgtgggcacgccgcagctgtgcgccgaccggctcgcggcgacctccgagcgcaccggcatctcccgtttcgccctgctcgtcgagggctccggcgacctggccgcgacggaggagaccgtacggcggctcggcgccgaggtactcccccggctgagctgaccgtgccgtcgccgggaggcctgccgccccggacctccatgcacctcccgcgggcggggtggcaagccggtgaccaggtcctcccctccggatcacgccgggcccgcgggcctggcacggcaccgtgatccggcctgatccagacggaaagaccctgcccccctcagcagtccctgagttccggcgactggttgagcagctgagcacgcaccgacgtgaagcgggccagccgctcatcgaccgaggcgtccagcgggaacaccgcgacccggtggcagttctggaaagccagccgcacaccgaagtgccgctgcagcgcgccgcgtatggcgtcactcgcgagcgcacgcagcagctgaccgcgcgcctgctcgtccggcggaggcgtctggttgtcggcgaactctccgccgtccaccttcagctgggccaccagggagctgatcatctcccatgcgtagggcagggaggtccggacgcagtcgacgaaagctgcttcatcgacctcgcctcgctcggcctgttcgagtagggccggtgagacgtcgagcgacatgggttctcctctcgcacccccgaccagcaggggttgccggacagatgagggagttcgcgataccgaacacggtgagtacacacctcgcgacctcccgttcctacggtaggcaacggaacgagggcttaccaggcgaatgcgtataccgactggtcgagttgggcacacaatcggccacaagtgaacacgggtgatccagggaaaaatggggcgtcctcgcaccgggcgtccacccggtgcgaggggagcaggacgggcgaatcgcgtccggcacggtgcgtcgagtagcgttgccgaccatgcgtctcgtcattgcccggtgctccgtcgactacgcgggccggctcaccgcccacctcccgtcggcaccccgtctgatcctggtcaaggccgacggcagcgtctcgatccacgcggacgaccgcgcctacaagcccctgaactggatgtcgccgccgtgcacgctgaaggagggcgcgggcgacgaggaaggcgtctggaccgtcgtcaacaaggcgggcgagaagctcatcatcacgatggaggagatcctccacgactcctcgcacgaactcggcgtggacccggggctgatcaaggacggcgtggaagcgcacctccaggaactcctcgccgaccgcatcgagaccctcggcgagggctacacgctcatccggcgcgagtacatgacggccatcgggccggtggacatcctgtgccgcgacggctcaggacagaccgtcgccgtcgagatcaagcggcgcggcgagatcgacggggtggagcagctcacccgctacctcgagctgctgaaccgcgacccgcacctcgctccggtacgcggcgtcttcgccgcgcaggagatcaagccgcaggcccgggtcctggcgaccgaccgcggcatcggctgccaggtgctggactacgacgccctgcgcggcatcgaggacgacaagctgcggctgttctgaacacggcgggcgccgtcacggcggcgccgcgcgcgagaagggggcccgatccggtgctgtgccggatcgggcccccttacgcgtagccgttgccgtcagatcacggtgccctcggcggtgcccggagtgccgctgccaggggcggcggccgagctgctcgcggtgtcgggaacgccggaggacgcggggccgctggccgagtcggagctggacggggtcagggtggacgactcggtcgggtccggatcggtcggcgtggacggatcggccggggtgccgggcgtcgacggctcgccggtcggcccgccggtgggcctgcccgtgggcttgccggtcggcttcgtgtgcgaggggtcgggcgagcccggtgtgctcgc

SEQ ID NO: 1106 - DNA, 1378 bp, Unknown
  Kingdom: Bacteria, Phylum: Actinobacteria, Class: Actinobacteria, Order: Streptomycetales, Family: Streptomycetaceae, Genus: Streptomyces
caccgagggcgacgacgcctggctcgtcctgcacaacaacctgtacgccaagttccgcgacgacatggaggacatcgtcccgacgacgaacctccccgcgttccagcagacgccctactcgcccgagccgtacctcgaaggggcgtacgtgttcaagtacgggggcaagtaccacctcgtccagaccgcctgggactgggcgtcggtcgacccctacggcagcacccggcacgcctacgacaatcccggcaccggtcgtgtgcagtaccagtacgacgcggtcgtcgccgtctcggaccgcttcgagggcccgtactcgaagcggtggaccgcgggtgtcggcaccgggcacaacaacttcttcgtggaccacggcggtcacctgtggtcgacgttcttccgcaacccgaacgccggctactgggcggacccgtcccgcgtcgccgacgccgccgtgcccggcgtggtgcggctggagtggaccggcccggcggacggccggctgtacgtggagcggcgaagcggccgcacggccggcgagtgaccggtccgcggcggcgggcggtcacggcgccgcccgccgccgcaccctctcaccctgagccacgaacgctcccccatctcgccgggcgacggagcggaagggcctgcactctggctgcgagcaggcgtgcggcaggggctggttgatcaggcagggtgacctcacgggctacgactggaacgacggatcggggagcagcaggcgctccagatcagcggccggcggtcggccgatcctggcggcgagttcggcccgggagcccgtctcgccggcgaggatgccgcccagcagcgctcccgtgcgggggtgcaggaagatcttggcgtagcgggaagcgccctcctcgaacgtgacctcgacggccgtgccgtcctcgccgtcgcccgagctgcttccgaaggtcgccacgtggacgccgaggagtttcagctcggtggaggtgtccaggtcgccgagcggctcggtggggtggcccgtcagctggcgggcgacgctctccgccgtccggtaccccggtgcgaccaggccgtgagagcgccccagcacggccgcgcactccccgacggcccagacgcgctcgtccgaggtccggcacagggcgtcggtgaggtatccgccgcgttcgccgagcggcagggcgggggtgaccggcaggtcgtcacgggggcgcaccccggcggcgaagaccaccaggtcggcgtcgagcacagtgccgtcgccgagggtgaccgaccccaccgtgccgtccgccccggcgttcaccgacgccaccgacgtaccgcagtgcaggtgaaggcccaggcggacggccccctcgcgcaggacgtccgcggc

SEQ ID NO: 1107 - DNA, 3068 bp, Unknown
  Kingdom: Bacteria, Phylum: Actinobacteria, Class: Actinobacteria, Order: Streptomycetales, Family: Streptomycetaceae, Genus: Streptomyces
ggccgcgcgtgtccgggcggggaccgccgaggtcgccgggaccgctgcggcacatggggccgccgatgcgcaggagaccgcggagtgccccgcgacggtcgtggccggagtggccggagtcaacggcgcgaccgccgtgggaccccgatcgcgtgtcctcgacgggcgcaaagccggaacgtcacgctgacgcccaaggtaagaatctgactaaagcgttgcctgttcatggggcggcaaagcagcctaataccagacaagttgcccccgattttgcacagacgggcaccctcactctcatgtgtgacagccagcacacccacttggtaaagaccgcatcaaatagtttgtgataccgttcacgagaaccccggacagagccgaagggccccgatgcaagggccccttggtgatgaggttcctctctcgacccggggtctacgctcgtccatgacgacaccctgcccccctgtgaaagcggagttgccgccatgccgtccaatgacgtccggaacctactgcacaccgccgtgcccaccgccgccgtcggtgtggtcgctgtggcggtcagcggtgcggtcgccggaggcaagggcgcgatcggggccgtcgtcggagtggtgctcgccatcctctacatggggatcggtctctacgtactgcagtggaccgcgaaaacgcttccgcagctcttccaggccatgggcctcatgctctacgtggcccaactgctgctgctcctgatcttcttggccgtcttcaagggcaccacgctcttcaacgcgaaggcgttcgcgttctcgctcgtcgtcgcgtccgtcgtctggatggccgcacaggcgcgcgcacacatgaagtccaagatcttctacgttgaaccggactccgagaagcacgacaagtccgagaagacagggcattcgtcgtgaggggtaggcccgggataaaggcgtgcgagatctcctgctatcgtccggtgccaactgcggcatcgcgggcgcgggcatctgagctgacgcctgctcgatcgcgaggctcgatgcccgccggccgcccccccatccgtcacaccagtccggtgccgacccgcggctgctcgccgcgccgacacaacgaggttgccgtacccatgcgccacgctgaaggagcccgcggtgagtgctgaacagaccacgctcgccttcgactggagttgccgcgtcttcgccgacaacggctgcggctttccgtcgccgggcctccactccttcctcttcaagccgatgttctcggtcggcggctacgacttcgacaagccgatgctgctcgccatcatcacctcgatcgtggtggtcggcttcttctgggccgcgttcagcaaggccaaggtggtccccggcaagctgcagatggtcggtgaggcgggttacgacttcgtacgccgcggcatcgtctacgagacgctcggcaagcgcgagggcgagaagtacgtcccgctcatggtctcgatcttcttcttcgtctggatcatgaacctctggtcgatcatcccggtcgcccagttcccggtgacgtcgatcatcgcctacccggccgccatggccgcgatcgtctacgtgacctggatggtcctgacgttcaagaagcacggcttcgccggcggcttcaagaacctcaccggctacgacaagtcgctcggcgccgtcctgccgctcgtcgtggtcatcgagttcttctcgaacgtcctggtccgcccgttcacgcacgcggtgcgactgttcgccaacatgttcgccggtcacctgctgctcgtgatgttcaccgtcgccagctggtacctgatgaacagctggctggtcgcggccggcgccgtctcgttcgtcatggccatggtcatgatcctgttcgagctcttcgtccaggccgtccaggcgtacgtgttcgtcctcctggcctgctcctacgttcagggcgctctcgccgagcaccactgagccaccgtcccgcaccgccccgtcacagacgtccggtggccaacccccaccggtccttgaaagagaaggaagaatcagcatggctgccactgagacccttgccgccgtcaccggctccatcgcctccgtcggctacggcctcgccgccatcggtcccggcatcggcatcggcatcatcttcggcaacggcacccaggcgctcgcccgccagcccgaggccgccggcctgatccgtgccaaccagatcctgggcttcgccttctgtgaggcgctcgccctcatcggcatcgtcatgccgttcgtttacacctacaagtaaaccgcggcggacgacccaccccattagggaaaggcactgatgacatgcagctgactcagcagctggtgcagctggcggcggaggagggtccgcagaaccccctcatcccgccgggccccgagctggtcatcggcctcgtcaccttcgccatcgtcttcttcttcctcgggaagaagctcctgccgaacatcaacaaggttctggaggagcgccgcgcggcgatcgaaggcggtatcgaagaggccgaggccatgaaggtcgaggcccagagcgtcctcgagcagtacaaggcccagctcgccgaggcccggcacgaagccgcgcgcctgcgccaggaggcgcaggagcagggtgccgcgctcatcgccgagatgcgggccgagggccagcgccagcgcgaggagatcgtcaccgccggccacgcccagctcgaggccgaccgcaaggccgccgcctccgtgctccgccaggacgtcggcaagctcgccaccgagctggccggcaagctcgtcggcgagtccctggaggaccacgcccggcagagccgcgtgatcgaccgcttcctcgacgggctcgacgaggccgcttcgacggctgaggcggctcgatgacagcgcacggagcgagccgtgaggctctgagcgccgcgcgcgagcgtctcgacgcgctgacggactccacgtcggccgacgccacccggctcgccgacgaactggcggccgtcaccgcgctgctccaccgcgaggtcggcctgcgccgggtcctcaccgacccgg

SEQ ID NO: 1108 - DNA, 5094 bp, Unknown
  Kingdom: Bacteria, Phylum: Actinobacteria, Class: Actinobacteria, Order: Streptomycetales, Family: Streptomycetaceae, Genus: Streptomyces
  misc_feature (4692)..(4819): n is a, c, g, or t
gcgccgctagctcagttggttagagcagctgactcttaatcagcgggtccggggttcgagtccctggcggcgcaccatgacgagggcgggtcttgttcgcggaaagcgcggacaaggcccgccgtcttcgtttccgcgcggctgcgccgcgcacagggggctccgccacccccaccccaggcaccgaaaggccccttgcgaaagcaaggggcctttcgcgttgcccccctctccggacggccctgttcgcactcctgtgcgcccgttcctcttgcgggtatatgagccgtaacctccgcttttagcatcttgcgatcatgctgggcaccgtagaaccctgggtgccacgatgccgccggtacgcggcagttgggggttcttggggggttttcgaaagaccgtttgaaccagttgcccgatgcgcgggaaatggggccccgttgcgtcgaccgctgccgaggggggcagccatgcaaccggacgaaaccggatcaacacgcgctgacctgcgtgtggggggatgagtcatgacgtcgacgccgtcgggcgcccggcaccagcacgaccagcacagccggcacgaccagcaccgtcaccacgaccagcacgatccgtcggagacgacacggctgcgggtgccgccgcaccgcaccggcagcaccaccggggcgttccgcaggatcaggagcaccctgccgcgatacgactacgagcactacagccgcctcgcgggaccgctcacccggcccgacccggaccggccctaccaggtgcagtaccgctcactgctctcgcaggaaccgcaccggctgcgggtcgcgctgatgctggccgccgctccgctgctctccctggtcctgctggcctggctgatgcagcctcagcactggaccgagcgggactacccggcctacgacttcctgccggtcctcgacgtggtcatgctggtctcgatcggcctgatcgagttcttccgctgtctgaacgtgctgtccaacgcgcacgccaccctggtcgcccgcgacccggtcccggtggtgcccgaggccggcacccgggtcgccttcctcaccacgttcgtgcccggcaaggaaccgctggagatggtcgtgcggaccctccaggcggccgtccggctgcgccaccggggcgtcatgcacgtgtggctgctcgacgagggcgacgacgaggaggtgaaggaggtctgcgcgcgcctgggcgtgcaccacttcacccgcaagggcgtcgagcggtggaaccggccgagcggcccgcaccgcgccaggaccaagcacggcaactacaacgcctggctccaggcgcacggcgacgagtacgacttcttcgcctccgtcgacaccgaccacgtcccgctgcccaactacctggagcggatgctcggctacttccgcgacccggacgtcggcttcgtcatcggcccgcaggtctacggcaactacgactcgttcgtcaccaaggccgccgagtcgcagcagttcctcttccacgcgctgatccagcgggccggcaaccgctacggcgcgccgatgttcgtcggcacctccaacgccgtgcggatcagtgccatcaagcagatcggcggcctgtacgactcgatcaccgaggacatggcgaccgggttcgagatgcaccgcgccaagaacccggccacgggccgcaggtggaagtccgtctacacgccggacgtgctcgcggtcggcgagggcccgaacgcctggacggacttcttcacccagcagctgcgctggtcgcgcgggacctacgagacgatcctcaagcagtactggaagggcttcggctcgctgccgccgggccgcctcttcaactacaccatgatgatcatcttctatccgatgtccgcgctgaactggatcctggccgcactgagctgcgcgctcttcctgggcctcggcgcctccggcgtgaacatcgaccccacggtgtggctcatgctgtacggcaacgcgtccgcgctccagatcggcctgtacatctggaaccgacggcacaacgtctccccgcacgagcccgaggggtcgggcggggtggccggcatggtgatgtccgcgctgtcggcgccgatctacgcccgctcgctgatggacgcggtgctgcggcgcaggagcaggttcgtggtgacgccgaagggcgagtcggcgagcccggacacgctgttcggcacgttccgcgtccactggttcttcatgctggtcttcggcggctcgatcgcggccggtctcgcacgggggcacgcccaccccgcgatgctcacctgggccttcctcgccctgctcatcaccgcctcgcccgtcctcgcctggcgctggtcgctgcggcgctcccggcgcgccccggcgcccgccgcgcaggaaacgtacgcggcccagggagcgcacggggcggctccggcgcccgtgccggccgagcccgaggacgccgtgccaccggcgtacgcggggcacgggacgggagggcgtaacgcatgagggagcaggccggcctccgccgtgcccgccgggtcgggatcggagcggtggtggtgctcgccctggccgggatgaacgggccctggctctaccgcttcggcacggagcgctaccaccagtacaagatcaacgagccggagtacaaggcggccaacgggcactgggacatcgtcgagttccccaagaagtaccggcaggacaccatccacgcggtgctgctgcacaccggcaaggtgctgctggtggcaggttcgggcaacaaccaggcgaacttcgacgcgaagaagttcgactcgcgcgtctgggacccggtcaagggcaccgtcaggaaggtgcccacgcccaacgacctgttctgcaccggccacacccagctctccgacggcaggatcctcatcgcgggcggcaccaagaggtacgagaagctcaagggtgacgtcaccaaggccggcggcctgatgatcgtccacaacgagaacccggacaagccgatcacgctgcccgccgggacgagcttcaccggcagggcgaacgggaagacgttcgtctccaaggacccggtgctcgtgccgcgcgcgacgaagaacttcgaccggaggacggggaagttcctcggcaacacgccggggctcggccggatctacgtcgaggcgctgaggagcggcgcccggtacgagaccggcacccaggacaactaccggatcaagggcctcaccggcgccgacgcccgcaacacctacggcatcgcacagaaactcgccctggacaagaaggacttccagggcatccgggacacctacgagttcgacccggtcgccgagaagtacctcaaggccgacccgatgcacgaggcccgctggtacccgacgctcaccacgctcggcgacggcagggtcctcagcgtctccggcctcgacgacatcggccagctggtccccggcaagaacgagatcttcgacccggcgacccggaagtggacgtacaccccgaaggtccgtcagttccctacctatccagcgctgttcctgatgcagaacggcaggatcttctactccggttcgaacgcgggctacggtcccgccgacgtgggccgtgccccgggcgtctggggcgtggccaccaacagcttcaccgagctgccggggctgagcgacgcgaacatgatggagacgtccggcacggtgctgctgccgcccgcgcaggacgagcggtacatggtcatcggcggtggcggggtcggcgagtccgagctgtccagcaggaagacccggctgatcgacctgaaggcgaggaacccgcacttcacggacggtcccccgctggacaagggcacccgctacccgcaggcctcgatcctgcccgacgacagcgtgctggtatccggcggctccgaggactaccggggccgcagcgactcgaacatccttcaggcccggctctacgacccggcgaggaacaccttccgccgggtcgccgacccgctggtggggcgcaactaccactcgggatcgatcctgctgcccgacggccgggtgatgttcttcggctccgactcgctctacggcgacaaggccgacaccaagcccggcaccttcgagcagcgcatcgagatctacacgccgccctacctgtaccgggacgcgcggccctcgctgtcgggcgggccgcggaccatcgcgcggggcgcgtcggggacgttcacctcgcggcacgccgcgtcgatcaggaaggcccgcctgatccggccgagcgcctccacgcacgtcacggacgtggaccagcggtcgatcgcgctggacttcaggacgtccggcgacaaggtcacggtgacggtgccgaggaaccggaacctggtgcagtcgggctggtacatgctgttcgtggacgacgaccaggggacgcccagcaaggcgcagtgggtgaaggttccgtagggggtcccgcaagccctgccgacccgcacggtcatcggggcgccctcgtggcagagggcgccccgacgggctattcgctcgcccgcgccagcccgagcgcgtacgagtcccaccagtcgccggccgtcgggccgcccttgcaggtgccgtcggactcgccggggcgcttgacccagaggtaggcgtcgacgagcgggtcggcggtcttggtcgtgggcggctcgccgagcgcccggccgggcgggttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccgcctgagcggctcgaagatctggtcgggacggccccagccggcgttgcccgcgtccaggtagaccttggtgttctccagcgacttgagcttcgcgacggcgcccttgaggaggtcgtagcgctcctcctggaactgctgcggggtgcagccgtccaccaggtgcagcacggcgtccggctccaggaccaccgtggccgcgcggtcgccgatcccgcgggcgacgccgtcgatccaggcccggtaggcgtcaccgtcggccgcgccgccct

SEQ ID NO: 1109 - DNA, 1273 bp, Unknown
  Kingdom: Bacteria, Phylum: Actinobacteria, Class: Actinobacteria, Order: Streptomycetales, Family: Streptomycetaceae, Genus: Streptomyces
gccgatgtcgacaccaccgccgccgtcggtggccgggatgtgcacggccatccggccgtccgagcccgccgaggcgacgacccgctccagctggccgcgctcggtggtgatggacagcgcgggtgcgacggcggcggcctgccgctcggcgttggagaacgcgcggtcgcgggccatctccttgatgacgagcccgagtgggaccgcgaaggcgacgacgaccatcgtggtgacggccagacagaccttgaccagcgcccacctcatcgcgccggctccgccccgggtggctccagcttcacgcccacgccccgcagggtgtgcaggtagcggggccgcgcggcggtctcgcccagcttgcgccgcagccaggagagatggacgtcgatggtctggtcgtcgccgtaggcctgctgccacacctcggcgagcagttccttgcgggccacgacgacgccgggccgcccggcgaggaaggcgagcaggtcgaactcacgccgggtcaggtccagtcgcctgccgtccagttcggcctggcggcgcagcgggtggacggtcaggccgccgacgcggatgacggtggacggcgcggcctcggcggggccggaacggacgcggcgcagcacggcggccatgcgcgccgagaggtgctcgacggagaacggcttggtcaggtagtcgtccgctccgtcgttgagcagccggacgatctccgcctcgtcgtcgcgcgcggtggcgatgatgacgggcacgtcggtgatgccgcgcagcatcttcagggcctcggcgccgtccaggtcgggcagtccgaggtccaggatgaccacgtcgaaacggatgtgggcgacctcgcgcagcgcctccagcgccgtaccgacgctgcgcacggtgtgcgaggcgtcggtcaggtgacggatgagcgcggagcgtacgaactggtcgtcctcgaccacgagcacacttgccatgcgccgcaccgtacgccatgcgggcggacccggtgcgggcctgtggacaactgaccgccggccgcccccacctgtggaaaaccctgctcccggacctcgtcccggccgctctcctgcgacaccggccgggcccgtgcggcaggatggccccgatgcacagaggactcgtacacgtactggcgtggtcgctggcgacgagcgccgcggtcacgctgtcgtggtggggcgtccacacggtgatggcgggcaccgcctacgacccgccgcgcgccctgcccatcacggcggccggtgcggacgccgtg

SEQ ID NO: 1110 - DNA, 1033 bp, Unknown
  Kingdom: Bacteria, Phylum: Actinobacteria, Class: Actinobacteria, Order: Streptomycetales, Family: Streptomycetaceae, Genus: Streptomyces
ggctgtgggaggccgtggccgagggcggggtgccggcacagcgcgcgtggcgtgaggacagcgtgcttccgccgccgagggaggtgcctccgtccgacgccgagctgatcggccggatgcgcgcgggcgacgacacggcgtacgaggatctgtaccggcgtcacgccgacgccgtgcgccgctacgcccgaacctgctgccgggacgccgacaccgccgacgacctcaccgccgaggtgttcgccgcgatgctccaggccgtgcgcggcggtgcgggacccgaacacgccgtacgcgcctatctgctcaccagcgtccggcgggtcgccgcacgctggacgaagaccgcgcggcgtgaacagctggtggacgacttcgccgtgttcgcgacgcaggcggcccgggcccccgaggcgtccgacgacacggcgcccctcggctccttcggtgcggacctgggcgcggacgtgcgggcgatgcaggaggccgagcagtccatggccatgcgggccttccgctcgctgcccgaacggtggcaggccgtgctgtggcacaccgaggtcgaggacgagtcgccgagcgaggtcgccacgctgttcggcctggacgccaacggcacgcgggtcctggccagccgcgcccgcgagggcctgaagcaggcctacctccaggcccatgtgagcacggccctgaccgacgacgaggagtgcgcccgctatgccgaccagctcggcggctatgcccggcgcaagctgcgcacccgtgccgaacgggggctgcgcaagcatctggaggaatgtgcccggtgccggctggcggcgctgcagatcgaggaggtcgcgagcggtatcccggcggtcgtcccggtcgccgtcatcggctggttcggcgccgccggatacgccaaggcgctcggtcttctggcgggcggcgcgggagcggcaggcgcggcgggtgcggcgggagtggcggcggccgccgggggcgcgggaggcgcgtcggccggcgcggccgggggcggttccgccggtgg

SEQ ID NO: 1111 - DNA, 2446 bp, Unknown
  Kingdom: Bacteria, Phylum: Actinobacteria, Class: Actinobacteria, Order: Streptomycetales, Family: Streptomycetaceae, Genus: Streptomyces
acgacgaaggcgcgcaggctcacgtcaccggccttgctgaaggtgaaggtgatcttctgcgcgttgccgtccttgacccccgggccggggttgggcagcgcggccgaggcattgcccttgccgccgacgacgaccgagccgtgcgccgggatggccagcttgcccttgccctgcgcgggggtgagctgcgcggtgccgtcgccgtcgacgcggatcgcgtccagcgtctggggggtgctgccgttgttgtagagggtcaccgagacgacggccgggcccttggtctgggtgccgggctgcgtgatgatcaccgcgttctggacctggatgtccccgacggaggtggccgcgttgtccggcttgacctcgagtgtctgagcgttgttgccggcgccgcatgcggcgagcgaggcgatcgagaacgcgatggcggcggcggcgagggcgccgcgtcgaaggctgctgctcacggcggcggcaactccttgaacgtgggcggtacagggcgactcccttataaagccgccctaagtgtctgtcagcggccttaggttaccgagccgttcccgcggccccgcacccgacccgcccctgcgcgcccggaggcacccggacaccgctcccgcacggcgaccggggagcgctctcagcgcggccggccgacccttgccgtggcgcttgccgtggcccttgccctggccctcgccggggtgctcgccgtggcctcgccttgagcccgtcccgcgcggctcgcgggcgcaccgtccacgccctcgccgggacgccgttcccggtccgggccgcattggatcgtgacctcgtccgtcattcacataagcgccgcccggcatacacgccgccttacgacacgccatacgtcatagcggcttacgtgccggatctccgtgtcgggatcttcgggccggatcttcgggccggatcttcgggccgggatctccgcgtcaggatctccgcgtcaggatcttcgtggattttccggcacgggaatgcgggcccggggctgaaattgatcaccggtcgcggtgtacgccgagcatccgccgtgatcaattccggaatcggccggcggccaccccggctcaccgaacggagtagcggaagtcgtgtgtctggggcgggacaaaacgggccgttcggccgcttggacggacggccggatgtgtgtaacgtacgcgtttcgccctgtgcgaagagcccctccgacctgcggatacctgtccgccgtcgacccgtgcgccccttccgaagcacgtcccggttgctgttgtcaagccccgagatatgccctgacctgcgaaaacgccattcagaagacgccgtatccgtgttaccctggatagccacggaaggggtacctgtcacatgacgttcaaggttggcgacaccgtggtctatccccatcacggggccgcgctgatcgaggccatcgaaactcgccagatcaaaggcgtggacaagacctacttggtgctgaaggtcgcccagggtgacctgacggtacgtgtgccagcggacaatgcggagttcgtcggcgtgcgtgatgtggtcggtcaggacgggctggaccgggtcttcgaggtgctgcgtgctccgtacgccgaggagcccacgaactggtcgcgtcgctacaaggcaaacctggagaagctcgcctcgggcgatgtcatcaaggtcgcggaagtcgtgcgtgacctgtggcgccgggagcgcgagcgcggtctctccgccggtgagaagcgcatgctcgccaaggcccgccagatcctggtgagcgagctggcgctcgcggagaacacgaacgaggacaaggccgaggctctgctcgacgaggtcctcgcgtcctgacgcgaggttttccgacgcgaggcctcctgaccgatacggatcgctacgaaccggtacgggacacgcgggacgtcctgacgcgaggcggcagccacgacgtccatgtcgcatggcccctctgttcggtttcagcgttcggtttcagcacggttctgcacggtgaagtgacatgccgcggcacccgagggcgcgattcccgcgctgccgggtgctgcggcatggccgtacccggacgcagcagcctctaccccacacgctcgtacccacgatgccggcgccgacaccgacgccgctgaccgtcaccgctgacgcggatgccgctggtacggacgccatggcccccggggcgaagatcccccgatactgtgtgccaggcccgggcagtcggctcgacccaggtcacggaagggtccggtcgaggcgtcgcgcccggcacggtgtggccatacccacgccgagccggaacacaaacctgacaggaaccgatgtctgacgattcgcgtccctcgcccgcacaggcccggtcaggggcccccgtcgccgtcgtgatcccggccgccggccgggatcacgacggcga

SEQ ID NO: 1112 - DNA, 5154 bp, Unknown
  Kingdom: Bacteria, Phylum: Actinobacteria, Class: Actinobacteria, Order: Streptomycetales, Family: Streptomycetaceae, Genus: Streptomyces
gccgccgcatcccgcgcgcgggctacccggtcgtcgccggcggcgaggtgatcggcgaggtcacctccggcgccccctcccccaccctgggcaagccgatcgccatggcgtacgtcgacgccgcgcacgccgcgccgggcacggccggtgtcgccgtggacatccggggcaaccacgagcccctcgaagtcgtggcgctgcccttctacaagcggcggaagtgacaccgtcgtccccggtcacgggtgacgtggggcacaccgccccggtcacgcacggcctcctcagccccaccttcaccagcactccaccgcgtacaggagaattcaggccatgaacaacccccagcagctgcgctacagcaaggagcacgagtggctgtcgcccgccgaggacggcgtcgcgacggtcggcatcaccgagttcgcggccaacgcgctcggcgatgtcgtctacgccgacctgccggcggtgggctccacggtgaccgcgggcgagacctgcggcgagctggagtcgaccaagtcggtctccgacctgtactccccggtcagcggtgagatcaccgagatcaaccaggacgtggtggacgacccgtccctggtgaactccgcgcccttcgagggcggctggctgttcaaggtgcgcctgacggaggagccggccgacctgctctccgccgacgagtacagcgcccagaacgccggctgaggagcggacgcacacagatgactgttctcaacacgcccctgcacgaactcgacccggacgtcgccgccgcggtcgacgccgagctgcaccgccagcagtccacgctggagatgatcgcctcggagaacttcgcccccgtcgcggtcatggaggcgcagggctcggtcctcaccaacaagtacgccgagggctacccgggccgccgctactacggcggctgcgagcacgtcgacgtggtcgagcagatcgcgatcgaccggatcaaggcgctgttcggcgccgagcacgccaacgtgcagccgcactccggcgcccaggccaacgccgccgccatgttcgcgctgctcaagccgggcgacacgatcatgggtctgaacctcgcgcacggcgggcacctgacccacggcatgaagatcaacttctccggcaggctctacgacgtcgtcccctaccacgtgggcgaggacggcctggtcgacatggccgaggtggagcggctggccaaggagaagaagccgaagctgatcgtggccggctggtcggcgtacccgcggcagctggacttcgccgcgttccgccggatcgcggacgaggtcggcgcgtacctgatggtcgacatggcgcacttcgccggtctggtcgcggcgggcctgcacccgaacccggtgccgcacgcccacgtggtcaccaccacgacccacaagacgctgggcggcccgcgcggcggtgtgatcctctccacggccgaactcgccaagaagatcaactccgcggtcttccccggtcagcagggcggcccgctggagcacgtgatcgccgccaaggcggtcgccttcaaggtcgccgcgagcgacgacttcaaggagcgccagcggcgtaccctggagggcgcccgcatcctggccgagcgcctggtccgggacgacgccaaggcggccggcgtggacgtgctgaccggcggcaccgacgtgcacctggtcctggtggacctgcgcgactcggatctggacggccagcaggccgaggaccgcctccacgaggtcgggatcacggtcaaccgcaacgccgtcccgaacgacccgcgcccgccgatggtcacctccggactgcgcatcggcacgccggccctggcgacccgcggcttcaccgccgaggacttcgccgaggtcgccgacgtgatcgccgaggcgctgaagccgtcctacgacgccgaggcgctcaaggcccgggtgaaggccctggccgacaagcacccgctgtacgcggggctgaacaagtaaatctccggcaacaccgcgcgggcgccggcgaccccggcgcccgcgcgctgcccgccctctgtcccgtcacctcgcaccaccccgcattgaggagtccccgtggccatctcggtcttcgacctgttctcgatcggcatcggcccgtccagctcccacacggtcggcccgatgcgcgcggcgcgcatgttcgcccgccggctgcgcagcgagggcgtgctggaacagaccgtgtcgctgcgcgcggagctgtacggctccctcggcgcgaccggccacggccacggcacgccgaaggcggtgctgctcggcctggagggcgactcgccgcgcacggtggacgtggagacggcggacgagcgggtggaacggatcaagggttccgggcgcctgaacctgctcggcgagcacgagatcgcgttctccttcgacgacgacatggtcctgcaccgcaggaaggccctcccctaccacgccaacggcatggccctgtgggcgtacgacgcctcgggcgccgagctgctcaccaagacgtactactcggtgggcggcggtttcgtcgtggacgaggacgcggtgggcgaggaccgcatcaagctggacgacaccgtgctgaagtaccccttccgcaccggcgacgagctgctgcgcctgacccgggagaccggcctgtcgatctccgcgctgatgctggagaacgagcgggcctggcgcaccgaggaggagatccacgacggcctgctggagatctggcgggtgatgcaggcgtgcgtgaagcgcggcatgagccgcgagggcatcctgcccggcggcctgaaggtgcgccgccgcgcggccgtcaccgcgcgccagctgcgcaccgagggcgacgccgccgcccgctccatggaatggatcacgctgtacgcgatggccgtgaacgaggagaacgcggccggcggccgggtcgtcaccgcccccacgaacggcgcggccggcatcatccccgccgtcctgcactactacctcaacttcgtgcccggcgccgacgaggagggcgtggtccgcttcctgctggcggccggcgcgatcggcatgctgttcaaggagaacgcctccatctccggcgccgaggtcggctgccagggcgaggtgggctcggcctgctcgatggcggccggcgcgctcgccgaggtgatgggcggcacgcccgaacaggtcgagaacgccgccgagatcggcatggagcacaatctcggcctgacctgcgacccggtgggcgggctcgtccagatcccgtgcatcgagcgcaacggcatggccgccgtcaaggccgtcaccgccgcccgcatggcgttgcgcggcgacggctcgcacaaggtgtccctggacaaggtcatcaagaccatgaaggacaccggcgcggacatgtcggtgaagtacaaggagacggcgcggggcgggctcgcggtgaacatcatcgagtgctgagcggccgcgggccgacgcccggggccggcctgggctgatgttcgaacgccctggagggatcgaccgtaccggagtggggcagaactcaaccgacgactcctcccccccacggtccttcagggagtttgcatgctgcacggcatcgacgtgagcgcgtaccagtcctccacctacggcacggacggcctctccttcgtcttcatcaaggcgacggagggccgttcgtacgtcaactccaagctcgccgcccaggccaagcacggccgcgacgcccatctggtcgtcggcttctaccacttcctgtggcccggcaacatcacggcccaggccgagtacttcgtctcccacgcccccgagaaggcgggcgacatcctcgccgtcgactgggagaccaccggcgagggcacccacgcctccaacgcggagaaggactccttcatccgcaaggtgaagcaactgcgcccgcacaaccgggtgatgctctacaccaaccgccacttctggctgagcatcgacaccacctcgtacgccggggacggcctgtggatcgccgactacgtctccgccggccacccccgcatcaaggccaagtggcgcttccaccagtacaccgacgatccccacgacaagaacgtggggaacttctccagtacggcggcgctgcgggagtgggccaaggcgtagggcgccaagagcgggaggcgaaggcgtccggtcaggcgcggaagtccgccgggcgttcgggagaggcctccgccagggccttggtgacggcgtcgacgccttcctgcagcccgtagaccggggtgccgggctgctggcgccaggagtcgtcgatggtgccggagtccacggtgtcgaagcccagttcgccgatcagcgcccgtaccttcgccttggccgccgcgtcgtcaccggcgaccggcagcgcgaggcggccggggtcgcccgccgggcggggccggtccaggaggtcctgggcgtaggtgccgttgaacgccttgaccaccgggtggcccagctgctgcgaggtccagcggctctcggtgaggccctcgtcctcgatcgcggcgatcctgccgtcgcgctgcgggtagtagttgccggtgtcgatcacgaccgcgccgtccgccgccccctccagcaggccggacggcaggtccgggaccgccttgagcgggacggtgacgacgacgacctcggcgccgcgcgccgcctcctcgacccggacgggcgtcgcgccggtctcctcggccagcgcggtgagggtctgcggcccgcgcgagttcgcgacgaagacgtcgtggccgagggcggtgagccgccgggtgaggttgccgccgatgttgcccgcgccgatgatgccgatcttcatctcagttcgcctcgctcttccggagctccggaggtcggtaccgctggtgtcgtgtccttgccgtacagcgtgtgcaaggcacctccaaccccggcccggcgcgggctattccgggcgtgcgccgaacgggtgagcggggccgtcggccactgcggcggccgtcccgcggactgcccgcagaggcgttcgtccggcggcggccgggtccgctcatcccgcgtgcggccgggccaggccgtggtcgtaggcgaagatcaccgcctggatgcggtcccgggcgccgatcttggacaggacgcggccgacatgggtcttcaccgt

SEQ ID NO: 1113 - DNA, 2114 bp, Unknown
  Kingdom: Bacteria, Phylum: Actinobacteria, Class: Actinobacteria, Order: Streptomycetales, Family: Streptomycetaceae, Genus: Streptomyces
cccggatcccacccatgacgtcccatcgaggacaacagtaagagcggaaatcccccgtgggacagggtttgcgcgcattcggccggggcgcaggggccgacacgcggcgtacggccgggaaacggggtgcgcggggcggtgcggtgacagatcatggcggcatgtctgcgaacccacacgacgctctgccgatccggctcaacgtcgacgactccgactcgccgtccgacgtcgtcgacgcgctgttcctcggccgcttcgcgacgggcgagcagccgtactcccacgcggtcaacatcgagcgggtccgctccggcgccacgctgctgcccgacggcgcccgggtgctgcgggtggcccgcgacgacgaccgcagcgcgaccctcgcggagggcgacggctggacgctgctggtctcccgctggaaccgcggagcggacgtcacggtcaccgcgaccggcgccgacctggccaagcggatcctcgaccaggccacggacggcgcggcggacgaaccggagccgcagccggagaacgtgacgatgggcttctggtacgtctccccgcggcgcgggccgcaccgcaccacccggcagatcgccgccggcacctgggacgaggtgcgggccaactacacggcgccggtcgcggacgcgatggaccgcctgatgaagaccgggccgcaggacatcgcgggccgcctcctgctgctgcacggtccgccgggcaccggcaagacctcggcgctgcgcaccctggcccgctcctggcgggactggtgccaggtggactgcgtcctcgacccggagcggctgttctcggacgtcggctacctgatggacatcgccatcggcgaggaggactcggggggccggaaccgctggcggctgctcctgctggaggactgcgacgagctgatccgcggcgaggccaagcacaccgcgggccaggcgctctcgcggctgctcaacctcaccgacggcctgctcggccagggccgcaacgtgctggtcggggtgacgaccaacgaggatctggagcggctgcatcctgccgtggtccggccgggccgctgcctggcccgcatcgaggtcggccggctgacccgccgggaggcggtggactggctgggcacggaggagggcgtgggccgcgacggggcgagcctggccgagctctacgcgctgcgccggggcacctctccgacggcgctcccggagccgcgcgagggcgcggacgcggggctgtacctgtaggagtaccagtaggaccctgccggggggggcggcctggcctgtggcgcacgggccggggtgttttgatgggcttatgaccctgttcgtcgggacgtcggggtggcagtacaaggactggcggggcgtgctgtaccccgaggggtgcccggtgcgccggtggctggaggagtacgccgccgcgttcgccacggtggaggtcaacaacgccttctaccggctgccgtcgcgggagaccttcgaggcgtggcgggagcggctgccgtccggcttcgtcgtcgcggtcaaggcgagccgctacctgacccacatcaaacgcctcaaggatcccgaggagccggtgcaccggctgatggcccacgcctcgggcctcggcgaccggctcggcccggtgctgctccagctgccgccgacgctgcgcgccgaccccggcctgctggacgcctgcctcgcgtgcttcccgcccggcacccgggtcgcggtggagccgcggcacgagtcgtggtggacgcctcgggtgcgggcggtgctggagctgcggggcgccgccctgtgctgggccgacgtcctcggccgcccggtcacgccgctgtgggcgacgacgggctggggctacgtccgtttccaccagggccgtgcccgggcgtggccgcgctacggccgcaggtccctggagacctgggcggaccgcatcgccacggcctggccggccggccgggacacggacgtgtacgcgtacttcaacaacgacccgacggcggcggcggtgcgggacgcggtggtcttcgcgcacgcggcccggcgcgcgggcctgctcgccacccgcaccccggagcgactgcccgcagcgcacgcctgaga

SEQ ID NO: 1114 - DNA, 4405 bp, Unknown
  Kingdom: Bacteria, Phylum: Actinobacteria, Class: Actinobacteria, Order: Streptomycetales, Family: Streptomycetaceae, Genus: Streptomyces
ccgcggacgcgaccggcctgccggcagccgcgccgggcaccgcggcccgggcggttccccacagcccgcccgacgcgacgacggcgagcaccgcggcgccgctcagcaggactcgcgcccgtgcgccggacctgtgcagacccatgggtcctccctctccgaaccgtgtggccgtacgagtcgtgccgtgccggccgccctgtcccgaaccgatgagaaccggcgggcgaagcaaccgcggctcccggcggtgaccgcgcggggaacactcggcgaacagctgtgcggcgcggtgaaggcggtgcggtccggtggcggcgtggcgccacgcgcggcctccgcaggccgcgccgtgcgcgcgcggcgcacacggacggtgcgcgcgtgaactgcgcgcatcggggcagccgacccctcacagacgttgccgatcttcaacagaggttgccgatcttcagcggaatgccaatacattacaaacagcggaaagcggacgaacggcaagtgaacgggcaaggtggcgtgtcgtggatgtgacacctgatggacagaccggcccctccagcggggagcgacttcgggagaccgtcgcgcacatgccccagcaggtccgcgaggagctgacccgaaggctgaggcgcagcaggcgcgcactgcgcaaggaggacgtgcaggtcgtcgagccgcccctgctcaggcgcgcggtcggggcctccgccctcggcaactgcatggagtggttcgacttcggcgtctacagctacctcgccgccaccatcggcaaggtcttcttccccggtgcctcacccggcgcgcaggtgatctcctccttcgcgaccttcgccgccgcgtttgtcgtacgccccctgggcggtctcttcttcggcccgctcggcgaccgcctcggacggcagaaggtgctcgccaccaccatgatcatgatggcggccggcacgttcgccatcggcctgatccccagctacgggacgatcggcatcgccgcgcccgtcctcctgctgctcgcccggatggtccagggcttctccaccggcggcgagtacggcggcgccaccaccttcgtggccgagtactcgcccgaccgccgccgcggattcctctccagctggctggacttcggcaccttcgtcggttacgcgctcggctccgccctggtcaccgcgctgaacttcctgctcagcgacggccagatgctctcctggggctggcgggtcccgttcctgatcgccggcccgctcggcgtcatcggcctgtacatgcggctcaaactggaggagtcgcccgccttccagcagcagctcgacgagcacgagaagagcctcgcgcagaagtcggcgggcagcgagttcaagaccatcgtccagaagcactgggcagcgctgctcatctgcatgggcatcgtgctgctctacaacgtcaccaactacatggtgaccggctacctgcccacctaccagacggagaccctgcaccgctccagcagttcggccgacctcctggtgctgctcggcatggtctggatcgtgctgctgatcaccttcatcggccgtctcagcgaccacgtcggcaggcgcccgatctacgccgtcgccgccgccgcgatgatcgtcctcgccattccctccttcctgctgctcaagatgcacggcacctggccgccgatcgcgggcgtgctcatcctgtccactctgctggcctgcttcgccgcgcccagcgccgcgaccctgcccgcgctcttcccgaccgccatccgctacgcggccatgggcatcggcttcaacttcgccgtcgccgcgttcggcggtaccactccgctggtcgcagcggccctggtcaacgccaccggcgacgacctgatgcccgcctactacctgatgctggccggcgtcatcggcctggtgaccgtgaagttcctgccggagagcgcgcaggtgccgctgcacggatcgcagccgatggtgggctccgcggaggagcggcgcgagctggtctccacctccgaggcgctctaccgcgccacccggaagacgcggcaagggccgtgacggcacttttccttaccgtcatttgataggacacctatataggaccgtgatacgaaggaagtgtggacgagtcgtactccgaacccggcacggaggacaccgcgcgggccctggccgatctgggctcggcggtgatcagggcgctgacggaccggcgcgggctgagtctgaccgccgccgccaccctcgcccggctcgaacgtgacggcccggcccggctgaccgcgctggccgccgccgaaggcgtcacccagccgtccatgacccaactggtgcagcgactgcagacccaggacctcgtggcacgggtcggcgaccccgatgacggccgggtcagcctggtcaccctcaccggcaccggccgggccgtcctgtccgaacgcagaagggcgcgcgacgcccggctggcccacctgctggccgccctcccggccgaggaccagcaggcgctcggggcggcgatgcggaccgccctgccgctcgtgcggcgaatgctcgaggaacgcgcgcagcagcccccgcttcccgaacacctgcccaccgggagcccgcgatgaccaccgtccagcagcgcggccacagatcgtggatcggcgtggaccaccccggctacaagtgggtggccctgaccaacaccaccgtgggcatgctgctcgccaccatcaacagctcgatcgtgctgatctcgctgcccgggatcttcaccggcatccgcctcgacccgctcgaacccgccaacgtcagctacctgctgtggatgctgatgggctacatgctcgtcaccgccgtcctggtggtcgccctcggccggctcggcgacatgaagggccgggtgcggatctacaacgccgggttcctcatcttcaccctcacctcggtggtcctctcgctcgacccgttccacggtggcggcggggcgctgtggctgatcggctggcgcatcgtgcaggcggtcggcgggtcgatgctgatggcgaactccgccgccatcctcaccgacgccttcccggcacggcagcgcggcatggccctgggcgtcaacatggtggccggtatcgcgggctcgttcctcggcctggtcctgggcggtgtgctggtcacctggaactggcggtccgtgttctgggtcaacgtgcccatcgggctgatcggcaccgtatgggcgtacaagtcgctgcacgagaccggtgtgcgcagacccgggcggatggactggtggggcaacgtcaccttcgcggccggtcttacggtgctgctcgccgcgatcacctacgggatccagccctacggcggtcacaccatgggctggaccaacccgtgggtcatggccgggctgatcggcggcctggtgctgctcggcgtgttctgcctggtcgagacgaaggtggccgagccgatgttcccgctcggcctgttccgcaacgcggccttcgcgggcggcaacgcggccactctgctgggcgccgtcgcccgtggcggactgcagttcatgctgatcatctggctgcagggcatctggctgccgctgcacggctacgactacgccgacacgcccctgtgggcgggcatctacatgctgccgctgaccatcggcttcctgctcgccgggcccatatccggggcgctgtccgaccggttcgggacgcggctgttcgccgcgtccgggttcgtggtgatggccgcctcgttcgccggactgctcgtgctgcccagcgacttcggctactggacgttcgccggactgatcctcctcaacggcctcggcgggggcctgttcgcggcgcccaacacctccatcatcatgtccagcgtgcccgccgacgcgcggggtgccgcctccggcatgcgggccaccttccagaacgccggcatggtgctgtccatgggcgtcttcttctcgctcatggtcgccgggctctcgggaaccctgccgcacaccctggcctccggcctgaccgcccagggcgtcccggcgggcgccgcccacacggtcgccgaactgccgccggtcggcgtcctgttcgccgcgttcctcggctacaaccccatccagcacctgctcggccccgacatcctcggccacctctccccgtccgccgccgcgcacctcaccggccgcgagtacttcccgcacctgatcgcgcagccgttccaccacggtctcgtcgtcgtcttctcgctggccatcgccatgtccctggccgctgccgccgcctcgctcgtccgcggtcgcacgggcaccccggcgccggccgcacccctcgcggggtcggcgaccgtgccgcgtccggccggccccgaccgggcggccggcggcccggccctgcggggccgcgtacggg

SEQ ID NO: 1115 - DNA, 540 bp, Unknown
  Kingdom: Bacteria, Phylum: Actinobacteria, Class: Actinobacteria, Order: Streptomycetales, Family: Streptomycetaceae, Genus: Streptomyces
atctgacgggtcgtcgagtcgaaggccatctcgttgatcagccacgccgtgagcgagggcatcatgaagcccgtgcacgagacgtagatgatcacgtcgatgtcggtggtgaggagttccgcgtcgtcgagcgcccgctggatgaccgcggggacccgggccttggcctcgcgctcgtagagcttgttgcgctcctcgaagcccgggtgcttcagggtctcctcgatgggctgcacgatgtgccgggtacgcacgccggtgttctcgatcagccggagggccagcgcgagttgtgggtggtccgcgtggtgggagcgtgcgagctccagcgtttcctccatggtgatcacgtgctctggaacggacaccgagggcctgcacaaagtcgccatgatccgtgcctgctttcgccttccggaaggccggtagccccccggtcagagggtggtgcacccagaagggtggtccacccacgatcacccgggagagcgacgatctctcgccggactactccaatccggggacggcgctgcggggccg

SEQ ID NO: 1116 - DNA, 1931 bp, Unknown
  Kingdom: Bacteria, Phylum: Actinobacteria, Class: Actinobacteria, Order: Streptomycetales, Family: Streptomycetaceae, Genus: Streptomyces
ggcgtcggtgccgtggacggcgagcgagaaccacaggggcaggccgcgcgggcgccgggtcaggtggtaggcgtagtcgctggggttccagtccgcgtcgtggtccgctccgtccgcgccgtggatcgcgtcgagataggacgcgtcctgggtgtgcgcggcacgggcgagacgcggttcccggtacagcagggccccgcagtcgaacggcgcgaacatccacttgtgcgggtcgacgacgagcgagtcagcgtgctcgatgccgctgaggcgtgcgcggagttccggcacgaacagggccgctccgccgtacgcggcgtctatatgcagccacagatcgcgggcccgggcctgttccgcgacgccggagaggtcgtcgacgatgcccgcgttggtggtgccggcggtggcgacgacggccacgacgggagcaccgccgtcggccgatgccgtatcgagtgccgcggcgagcgccgggccggtgaggcggtggtccgtggtcgggacgacgagcggttcgacgccgaggatccgcagggtgttgccgacggaggaatggacctggtcgctcacggcgatccggaccggtgccgtcgccgccagaccgagccggtgcctgccggtgtcccgggccacgaccagcgccgagaggttgccggccgaaccaccgctgacgaagcaccctcccgcgccctgcggcatcccggccaggtcggcgaagagccgcagcacctggttctccgcggcgaccgcgcccgaggcctccagccaggacacgccgtgcagcgaggaggccgacagcaccatgtcgaacagggcggcggccttggtcggagccccggggatgaacgcgagaaaggccgggtgatcgcaggacacgatcgtcggctccagcgcgtccgtgtaggtccgcagcacgtcggcggggcggcgcggccgcgtgccgatggcgtccttcagggccagggcaagttcctcgtgctccccgagccgccccagtggcggcgggtcgaggcgaagccggtcaaggagatggcccatgacctgctgggtgaggtcctcgtcgtaagcgtgcacggggggctcctgtcggaacgagcaatcaatgggtctgtagtggatccaattcggaccctagggctcagcccgagcgctcgtcaaccggctcgaccctccgaggggcgtcgagcggagggtggccgccgtcggctggcgcgggtcggtcagccggaggtggaagcggaggcgaactggtcgaggaggaccaggaactgccggtgggagtcctggaggtgctcgcgcatccggcgctcggcggtgtccccgtcgcccgagaggaccgccagggcgatggcctcgtgctcctcgcggaacgcccggccgaagtcccgcccggtcggatacaccggcgtccagtcggaacccagccacagcgcgttgccggccacgaacatctcggtgcgcgcccgcgtgaccgcctccgtgagcacctcgttgccgccggcctccgcgacgccgagatggaagcgggtgtccacgcggtggtactcgccgaggtcggcgaccttcgcctccagcatctcgacgagcccgcgcctgctcgccgccgcgccccgctcggcggcgagacgggccgcgaacggctcgatggcctggcggtactccatgtagtcgcgcaaggaggcgcggatgccggcggcgatcgccgcccggctgccgcgaccgccccgcgatgccggggcgacccgggtgccgccggagcgcccgagagtcgtgacgacgagcccttcctcggcgagttcccgtacggcctggcggaccgtgttgcggccgacgccgaagaccgtcgcgaggtcccgctcggtcggcagcctgtccccggggccgaatccgccgagcgcgatccgctggcgcagcgcctcggccaccac

SEQ ID NO: 1117 - DNA, 2276 bp, Unknown
  Kingdom: Bacteria, Phylum: Actinobacteria, Class: Actinobacteria, Order: Streptomycetales, Family: Streptomycetaceae, Genus: Streptomyces
gaccaggtcgatgtcggccgggcgcacgccggccgacatcgacctggtcctggtcgccacctccacggccgtcgaccgttcccccaacaccgccgcccgtgtcgcggcccgcctcggcgtcccgagtccggccgcgatggacgtcaacgtggtgtgcgccggcttcacccatgccctggccaccgcggaccacaccgtgcgcgccggggccgcgacgcgtgccctggtcatcggcgccgacaagatgtccgacgtgaccgactggagcgaccgcacgacctgcgtcctggtcggcgacggggccggtgccgccgtggtcgaggcctgtgcgccgggggagagcgcggggatcgggccggtcctgtggggctccgtgccggagatggggcacgcggtacggatcgagggcacgcccccgcggttcgcccaggagggccagagcgtctaccggtgggccaccacacagctgccgccgctcgcccggcagacctgcgagcgggcgggtgtcgcgcccgcggacctcgccgccgtcgtcctgcaccaggccaacctgcgcatcgtcgaaccgctcgcccaccggatcggtgcggtcaacgcggtcgtcgcccgcgacgtccgcgagtccggcaacacctcggccgcgagcatcccgctggccctgtccaaactggtcgagcggggtgaggtgcggacgggcgacccggtgctcctgttcggcttcggcggcaacctctcctacgccgggcaggtcgtccgctgcccgtgagccgccggccccggtgcgcgcggtgcatgcggtgcgtgcggtgcccgcggtgctgcggtgcccgcggtgcgcgcagtgcgatccggcccgccgggtcaccgcaccggtggcggtgccccgccttccctccgctgtgcggggcccgccgaggagggacggcgatggcgccggccggactgccccggggagccgtctcccggcagccggtgcgggaggtgtttcagcggctggacaccgagggccgggtggaactgcggcccccgcagggcgcgttcgtgcctgggccgagcaccgcgacctcaccgccgcgatcgcccaccacgacgagcaacgcgccacgcgcctcatgcgtgaacacactgaactgacgcgcaggtcgcaggaacatacgcgcaggtcgtaccgcgagcgcgcggacagctgaaccgtcacggtccgcgactaccgcaccggctgccgtcacgccgctctttgtcctgtgagtgggaaaagtcggcagtaattcgtgcacagcttcttcccaggttcggcggtcactgctacgttcccctcgaaagcccggaacggatggccgaattgaggcggggaggggcgcgtgagacgtatgacggcacgacccgccaacccacaccaggcccggctgctgaggctgctgcgcgactctggtcccagctcccgtgcccaactcggcgaccaggtcgacctctcccggtcgaaactggccgtggaggtggaccggctcctggagaccggactggtcgtcgccgacggcctcgccgcctcacgcggcggccggcgctcccacaacgtccggctggcgcccaccctgcgcttcctgggcgtcgacatcggcgccacctccgtcgacgtcgcggtcaccaacgccgaactggaagtgctgggccacctcaaccagccgatggacgtgcgcgagggcccggtcgcggtcttcgaacaggtcctcgccatggcggcgaagctccgggcgtccgggctcgccgaggggtacgacggtgccgggatcggtgtcccgggccccgtccgcttccccgagggcgtcccggtcgcgcccccgatcatgcccggctgggacggcttcccggtgcgcgaggcgctcagtcaggaactcggctgcccggtcatggtcgacaacgatgtgaacctcatggcgatgggggagcagcacgcgggcgtggcacgctccgtgggcgacttcctctgcgtcaagatcggcaccggtatcggctgcggcatcgtcgccggcggtgaggtccaccgcggtacgacgggcagtgccggcgacatcggccacatccaggccgtacccgacggccgcccctgcgcctgcggcaaccggggctgcctggaagcccatttcagcggcgcggccctcgcgcgggacgccctggaggcggccgggcagggccagtccgccgaactcgccacccggctcgcggcgaacggcacgctcaccgccgtcgacgtcgccgccgcggccgcggccggcgac

SEQ ID NO: 1118 - DNA, 4755 bp, Unknown
  Kingdom: Bacteria, Phylum: Actinobacteria, Class: Actinobacteria, Order: Streptomycetales, Family: Streptomycetaceae, Genus: Streptomyces
tggagtggattggccgggcagctggaccggagcgctgctgctggctctggtcacggcggtcgccgtgctgctgggccgaaggctgtcgcggcatccgtggctgtgcggcgtctgcgcggcgctgctcctgctggcggtggtgctgccgccgtcgctgacccgggtgttcaccggctggccgccgccggggtggcggttcgcgatgtgtgatgtggggcagggcgacgcgacggtactggcggcggggccgggagcaggcgtggtggtggacgcgggacccgacccgaagcgggtggaccactgtctgcgcaccctgggcatcaccaaaatcccgctgctcgtgctgactcacttccacgccgaccacgtgaccggcctgcccggggtcctgcgggggcgttcggtgggcgcgatcgagacgacgggcttcgaggagcccgccgagcaggcggagttcgtacggaaggaggcggcccggcgcggcattccgctcacccgtgccgtcgccggcgaggagcggcgcacgggggccctgtcctggcgggtgctgtggccgccggaccactcgccggcccggcccgacggccccaacgacgccagtgtcaccctgctcgtccgttccggcgggctgcggctgttgctgctgggcgacctggagcccgtcgcccaacaggaactgatgcgctccccggaggtcgcacagctggcccgtgtggacgtcctgaaggtcgctcaccatggctcggcgcaccaggacctcgatctgttgaggctggtggccccgaggctggcgctgatctcctgcggcgcgggcaacatgtacggccacccggctccggtcacggtggcggcgctgcgaggggagggcgcgacggtcctgcgaacggaccgcgacggggcactcgcggtcaccggcgagggcgcggggctgggcgtggcgcgggagtgaggagggggttggagctgctggcgtcgcccgaggtgcacacccacctcggcggcccgacccgcgtgacgagctggagcgcgaggtgcccgggcaacccgggcggtggcccggaagtttcgccgtcgatctggacggggcgatgatcggccagatccttgaggagagcaacacaggaccgtcgtccggctgccgagggaaaggtcggtctcggctatctgttcctgccgcgggcgtggggatccgggtacgcggccgaggcgtgcgcgccggcactcgactggttcgacggcgtccttcccggcgagccggtggtcaatgcgacccgcgcacggggtcccacctgatccgggtgttcggcccggcgtcggatggcagggcccctctgcgtcggccgacgaggaggcagacgcgggtgtcgagaaccgcacggctgcgcgaggcgcgagactgaggggatgaacgtcgcacagaccgacgcgtacctccgccggatcggggccgaggccccggccgcgcccaccaccgatgccctgcgagagctgcatctgcggcatctgcggaccgtccccttcgagaacctgtccgtccacctcggcgaggagatcgtgctgaccgaggaacggctgctggagaaggtggtgggcgcgcgccggggcgggttctgctacgaactcaacggcgcgttcggggccctgctcaccgcgctcggtttcgacgtggcgctgctggcggcccgggtgtacggggaggaggggcggctcgggatcccgtacgaccatctcgcgctgcgggtgcggacggtggacgggggtgactggctggcagatgtggggttcggggcgctgagccacttcccgctggccttccgggagcgggcggagcaggtggagccgggcggtacgttccggatcgcggccgcggagccggacgcggccggggtgcgcggcgccggtgacgggccggaggtcgtggatctggatgtggtcctggacgggcggcgccagtaccggctggaggcgcggccgagggccctcggcgacttcgcggccggggcctggtggcacagcacctcgcccgactcgcacttcgtgcgctccctggtgtgttcgcggctgacggcggacggcgggcggatcaccctcagcggccggacgctgacgacgacggggtccgacgggacgcgcgaggtggcggagttggggtcggacgaggaggtgctggcggtctaccgggaccggttcggcatcgagccgggttgtgtgccgactgtgcgaaatccggccgtgcccgtcaatccggctgtgaccggcaaacctggtgggaacggttaattccggctacccgggccactcgtgcacccgtggcacatgccctggtttcccatgatgtgatcccgtgttgcctcgaaagccccatcggtgatcgaatgtttctttggtaacagctgttttcacatcgtgcagaaggtgtcgtagatgatcggccggttgctgggaagccgaacgaaacgggcgcaacggacgagtcccctggcggcggtgtggacgccaccgcgtgcgggggtgttgagctgccgggtgctcgaccccgtcaaccagcccgtgccgcaggcggagttcgcggtgatcgacaccgcgggccgcaaggtggtcagcggcgggacggacccgttcgggtcgttcgtggcggcggtgcccgcgggggagtaccggctcgcggtgtccgccgaggggtacgcaccctaccgggccgcggcgacggtcgcggaggactccctcacctcgctcggcgatgtgacgctccaggtcgcgcagccgcccgagctgcccgcgcccggcgactgggagatcgaacccgcccattccgcgatcggtttcaccgcccggcacatcgggctggcccggatccacggccggttcaactcgttcgccggtgtggtgcgggtcgccgaggaggtcgagcgctcggcgatgcacgtggtgatcgacgcggcgtccatcgacaccaacgtcaagatgcgcgacgaccacctgcgttcgggggacttcctggacgtggcccgcttcccgacgctggagttctacagcgaccgcttcgcacaccgcggcggcaaccggtgggccgtcaccggagcactgtcgctgcacggcgtgacccgtacggtcaccctggacatggagtacctcggactcggcaacggcatggagggcgaggtccgggcggcctgccgggccaccaccgagctgcaccgcgacgacttcacggtgagctggcagacgatgctggcgcgcggtatcgccgtggtcggcccgaccatcaaggtcgaactcgacatacaggtcgtgcccaaggcctgagaaggcaccgcgcgcgacggcgggcggcgccggtgtccgacaatggcgtgcgtgagtgacgtgagacatgtcctggtgctgcccgaccgcgatgccgctgaggaggcggctcaggcactggcagagcggttcggggtccgggaggagccgcagctggtgcgggacgcgctggcgggcgaggacgacgcggaggacgcccagtggctcgtcgtactgcgtgacgaggaggaacggctcgacccggcggagctggacgcgttcgcgggggagtgggagggctggcgcgaggagccgtagccgcaagccccccgggtgggactgcgagagcctcgtggacgcagcggcctcgtgggactgcgggacctcgtggccgcggcggcctcgtggggtcgcggcgggggcgttgtcagtgggccgtgggatgcttgtcgcgatggccaggaagactgcgaatgacgaccctctcgccccggtgacgctcgccgtgggccaggaagacctcctgctcgaccgtgccgtgcgggatgtggtggccgccgcgcgggccgccgacgccgacacggacgtccgggacctgaccccggaccagttgcagcccggcacgctcgccgagctgaccagtccctcgctcttcgccgagcgcaaggtcgtggtcgtccgcagtgcgcaggacctgtcggcggacaccgtcaaggacgtgaaggcgtacctggcctcgcccgccgaggagatcaccctcgtgctcctgcacgccggcggcgccaagggcaaggggctgctggacgcggcacgcaaggcgggcgcgcgggaggtggcctgcccgaagatgaccaagccggccgaccggctcgccttcgtacggggcgagttccgggggctgggccgctcggctacgcccgaggcgtgccaggcgctggtcgacgcgatcggcagtgacctgcgggagctggcgtcggcggtgtcccagctcgtcgcggacgtcgagggcacgatcgacgaggccgtcgtcgcccgctactacacgggccgtgcggaggcctccagcttcaccgtcgccgaccgggccgtcgagggccgcgcggcggaggccctggaggcgctgcgctggtcgctcgcgacgggtgtggcgccggtgctgatcaccagcgcgctggcccagggtgtgcgggccatcggcaagctgtcctcggcgcgcggcggacggtccgccgacctggcgcgggagctgggcatgccgccatggaagatcgaccgcgtccgccagcagatgcgcggctggaccccggacggcgtggccgtggccctgcgtgcggtggcggaggcggacgccggcgtgaagggcggcggcgacgaccccgagtacgccctggagaaggcggtggtgaccatcgcccgcgcggcccgctcccgaggccgcggataaccgcgccccctgggccgcgtagccac

SEQ ID NO: 1119 - DNA, 3701 bp, Unknown
  Kingdom: Bacteria, Phylum: Actinobacteria, Class: Actinobacteria, Order: Streptomycetales, Family: Streptomycetaceae, Genus: Streptomyces
cgccctcgcgggctccgccgctgccgcccagcgcgagaccgagcgcggcggagcccgcgagggcgctgaatgtacgtctgctgagcgccaaggtgagtgcctcccgggcggatactacggggcgcgggccccgccattctcccctctcccgggcgccacaatggacgccatgaggatctcggcacgggcggactacgcggtacgggcggttctggaactcgccgtacgccaggaagcggacccggtgaccccggtgaaggcggagacggtcgccgccgagcagggcatcccgcacaagttcctcgaaggcatcctcggcgacctgcgccgcgcgggcctggtcaccagccggcgcggcgggggcggcggctacgccctggcccgggagccggcgcggatcacggtggcggacgtgatccgcgcggtggacggcccgatcgtctcggtccgcggcgaacgccccaccggcctcacctacacgggctcggccgagcccctgctgcccctgtggatcgcgctacgcgccaacgtccgccgcatcctggagggagtcaccctcgccgacatggcaacgggcaccctcccggaccccatccgcaccctggcgtcggaaccggcggcgtgggagaacccgtgagggttcaccgcgtggcatgaacgaggacctacggaacctgacggtagacgtcgcggcggttgccgacggccagcacccacacgatcagctgaccgttctccacggtgtagacgacgcggtagtcgccgatccgcagccgccagcgggcactgtgtccctgaagtggcttgatgtcgaacgcggtgctgtccccggcgtccatcgccttctggagttcggcgaggcggtacaggatgcggagggcgtccggacgcgggatcttgagcatgtcccgctgggcgtgcggcgtgaagcgtgtgacgtgccccatgaggtcagtcctgatgagcgcgcagcaaggccgccatctcctcaagggggaccgacccctccacgccctcggactcggcgtcgtcggccagccggttgagccacgcctcttcggcgttctccgccacctcgcgcaggcgccggtactcctggatgtcgatcacgacggcttcctgcttgccgcgccgggtgatgatcgtcggggtttcctcccggcgggcacgatcgatgacgtcagcgagatggctgcggacctcggccatggattcgaccaccggatcactcatgtcatgaatgtagcagatgtacatgaagcgggaagggttcagcagtaagggtgctgattggtcagggccgcggccactcgcatccacacgccgaacagccggtagaggctgggcgcagtgccctgtgcccggacggtccgggcatccaccggggtgacgccggggattcccagcagcgtcgaggcgactgaagcggactgccagcggaccgcgagggtggcgggggccgacgcggcggccggaggcttcggcggtgcggagagacgttcggcgaccgccttctcgatggccgtacgtgcttcttccggcggccgtagagctgccgagaaccggtcccgcgcgtacttcacggccacggtcgtcaccgaggcgtcccattccgtcatctcggcgcaggcgctgtcgtcaccggtgaggaccgccaccggcacaccgatggctgcggcggtggcgtgggccaggccgatctcgccgacgggccggccgtccagccacatgtcctcgatctcgtggcccatgaagctgtggctcagtacaccgggcgcacccgcccgtgagtggtagccgacgaagaccgcggcgtcgtgctcggaggtgagtccttcgagcatgcccatctgtttcggcttgccgcggatgaggcgcgcggccgggtggagcgactcgggcaggaggttgcgcatcgggccgtgtgcgtcgttgacggtgatgtcggtggccccggctgtgacagcgccgcggacggcggcgttgacgtcctgcgccatcatcagccgtccgcgctcgtagtcccgcccgccaggctggacgtcgtcggcgtccaccagcccggtgatgccttccatgtccgtactgatgtagatccgcactgcgcagtctcctcaaccttgatcctcaagggagacgtccgccgcttcacctccggttcctacgcccgcacgccgaaccactgctcggcgccgtactcctcgaaccgctccacctcggtgaacccgagcttcaccgcgaggcgcagcgcgcggtcgttggcgctctgggtgcagagcaccaccggttcgccggggagtgcgccggtgaaccagtcgagggccgccgcgcaggcctcggcggcgtatccgcgtccccacgcctgcggcaggaacaggtagccgagttccctctccccggcgtccggacggacgtgccccggacgctccgcgtcgcgccggtcgagcgtgaccatgccgatcatcgctccgtcgagttcggtcacgaagaggccggggcgctgtccgggcacctcgggcaccgcgcgttcgagctcggcgcggggccgagcgccaccgatgtaggtgcccacctccggtgacgcgaacagctcgatgaacgccgcacggtcccgggcctcggacccacgcagcacgagccgttcggtcctgatcggggcaggcggccaggcgacgcctccgagttcagtcatggcgggcaacgtagcgcacgcgcgtgactcagccgctgcttctcccgcacgtcagccgtaccgccgcagcagtccggccacatacgcctccagccgctcccgcagcacctcgggcgtcaggtcgccccggcccagttcacgccagggaccggccggcgtcgccgcgtcggggcagtagtgcagggcgtcgagcagtcgccagtacaagtggtcggcgccgtcggcgagaccccggccgccgtgtgcctcgtaccgctcgcggaaatccagcccgtgctccggtccgtgcagcagcgcgagcgcggtcgagcagtgcgccacgtccaggtcggcgggcccccacgaggtctcgacccagtcgacgacaccgctgatccgcaactcgggcccggcccccgtgaagagcacgttccccgggtggaaatcgcggtgcaggaagcagccctcgtacggtggcgggtcgcggcggatcacgtccacagcccgctcccacagggggccgtccggggtgcggacgtgttccggcaacgtccacgcctggtacgtgcgcggtctttccgccggtacgacgccgtggacgcggacgagctgcgccgccagcaggtcctggcgccggtcgaggtcgtcctcggccacgcggacgctgcccggcagcgcggacatcaacagggtcgggtggtcgcagtgctccgccgtggcgtccacggcgacgaactcgggcgcggggacgccgtcctgcccggcgagcatggccaggacggacgcctcacgggccagcagcccggggccgtggccgcggaagaaccgcttcacgaaggtccgttgcaccaggtccgtgccgtcgtcgagcgtgagccgacgtatctgggagctgcaaccaccggacaagagagccgagtcgacgaccgaccggccgtcgccgagctgcttgcccacccatgcacgcgtggccgtccagccaccgtcgtcgaggccggtcagcaccgtctccacgaaccggcgccggtcg

SEQ ID NO: 1120 - DNA, 1878 bp, Unknown
  Kingdom: Bacteria, Phylum: Actinobacteria, Class: Actinobacteria, Order: Streptomycetales, Family: Streptomycetaceae, Genus: Streptomyces
cggagaccagtccggagccgtctccggctccggactggtctccgttccgatcacgccgttgcgtatcttcgcggccggctgtggccgcctgcccgcgggctccttcggctcggtcctgccgtcgtcccccgccgggctaccggtctccgtggccgccatcgctcacgtactccttcgtcgtgtggtccgtggtgtcgtccgggctgtggtcctgctcgccgtgttcgagttcgtcctcgagtcgcacgggcgtggtggctcggccgctccccgaggcgccgccgggcgtgtactcgggtgcggtgagctgatggacgtaatgctgggcgtagatgttgcgtgcgcgcaagatcaggagcggatcgtactccggtgaggcgaagagcgcccggaagtcctccagagccttgtcgggctgcttccccccggccagagccttgtcgggctgcttactcccggcctcggcggcgatctcccggatcttctggaccagggcgtcagggatgccgtacccggggtcgccgtgcaggaggtacgcgtcgatgttcgccaggtcctcgtcggcgaaacccttgggacgggagaccggtcggccgcctcgatgggtggccttgaccgtcttgtcggtgctgtgccacgcggcgtgcttctgcacgttcctgcggtcgtccacggacagggtcagtttgtggtgctgtcccgagcgggtgggtgagtggctgacgatgaggcgttcgtagccgggtgccattgcgccgccggcggtgacgcctgtgtgcgggccggcctggtgccatgcctccatgcgcgcgccgccgagctcgctgccgggctcctccaagtaccgcaccgggaagcccatcagtgccatggcctccaggttcccgctgcggaagcccaggtgccgggtgtcgaagtgccggtggaggtagtcgaagagctggaactgaccggtacgggtgtgtcccttccacgccggcacgtcgccgtccttccagaactcggtgaggtcgacgaccttggccttgaacccctgcggagggtgcttctcctgcgtgccgggcaggatgccctcgttgaagtagtcggccatggtccggtacttggtgtgccgggcggtggccgccttgggtccggagtcgccgacgacgaggacggcgtcgaggtcccccagcccggcgacgatctgggccatgccgacatagctggtgtcgtgctcgatgtgcacctcgccgttcttgccgctgaaccgggaccagagcaccgcgaccttggccccgtcgggcagttcgagcttcttggaatccctcagccaatggtcgatcgccatgtccctgcgcgggtcgggaccgacgttccacgccttgcgtacgtcgtcgcgcacctgcggcgcgaactgggcgccgatcttcttggtggcgtccgccacgcccaggatgtgcttgcgcatctgccgcatcgagggcgccttgtcccccggtcggtggtccagctgctgcgcatagtgcgtgaacacgtcggacgtggcgacgatgtgcacgcgtccgtcgaactcgggcgactcggcgtagaagccggccgtcttcgcggcgagttggtgctggtcctcggagtcgtaggtgacgtagacctgcaggttctcgtcggcgacgagcgccgccgcgatgccgaactggtctcccgtggcgtagtagggctgcttgatgacgtacggcatcccgtcctgcaccggtccgccgtttccgccggtaccgcccttgccgccggacccgaaggacggctggttgccggtggtctggtgcggtgtcccggtgccggagagcacgtcgtagatgccggaggccacgtccgtcatctccacgtcctcgtcggcgaggt

SEQ ID NO: 1121 - DNA, 783 bp, Unknown
  Kingdom: Bacteria, Phylum: Actinobacteria, Class: Actinobacteria, Order: Streptomycetales, Family: Streptomycetaceae, Genus: Streptomyces
agaaccccgatcccggccgcctggccgagctggtccgacgcgccactcacctgggtgtcgccgccgaggagtggcaccacctggccgcctacctggagcacagacaccaagggacgctggaccagtgggtctccgccccgatcgacgtcgcccagtacctggtcgccgcgtggcgcgcctcgggcgaaggcccgttcccgctcaccctgccgcccccgcacccgccgcgtgtcagtctgcccgtcaatccggcgaccgacgcgatcgtcccgatccgcaagccgtacacctacccggagacgggattcctgctcggcgcgctcaagagcgagggacgggcacccggcctcggcaacctcaaggaaggcggcacgctctacgtcgtcggccacgaccaccagttgctcagcggcaaggaggcggcggacgaactcgcccagctcctcggccacgggcccgcacgcagggtgaagaacttcgacatccggctgatcgtgtgccaggcgggggcacgcaacgaccgcaccatctcaccggcggagaccctggccgtctccctcggcgtgcccgtgaccgcgtctttggtcgacatcaccttccaggccctggaccgccacgggaacccgcaggcgctgccctccgactacctcggcgccctgttcgcgggcagcaccgccggcccgctgaccctcatgggccaggaccgcgtccacacgaccgacgacctcttcgacgaactcgccgcccagatggacaccttgcacctcgccgacgaggacgtgg

SEQ ID NO: 1122 - DNA, 5174 bp, Unknown
  Kingdom: Bacteria, Phylum: Actinobacteria, Class: Actinobacteria, Order: Streptomycetales, Family: Streptomycetaceae, Genus: Streptomyces
ggccgcgtccgcctggccgcgggtggccttcatgaccgcgccgaccagggcgccggccgcggccaccttgccgccgcggatcttgtccgcgacgcccgggttgccggcgatggcctcgtcgacggcggcggtcagcgcgccctcgtcggagacgaccttcaggccgcgcttgtcgacgacctcgtccggagtgccctcgcccgcgaggacgccctcgatgacctggcgggccagcttgtcgttcaggtcgccgcaggacaccagctcggtgacccgggcgacctgctccggcgtgatcgccagctcgtccagggccttgccggactcgttcgcgctgcgcgccagctcgcccatccaccacttgcgggcggaggccgcgtcggcaccggcgtcgatggtggcgacgatcgggtccagcgcgccggcgttgaggatggcctgcatgtcggtggccgagatgccccactcggcgagcagccgggtgcggcgggccagcggcagctcgggcagcgcggcgcggatctgctcgacccactcgcgcgagggggccaccggcaccaggtcgggctcggggaagtaccggtagtcctcggcctcctccttgatccggccggaggtcgtggacccggtgtcctcgtggaagtggcgcgtctcctggacgatcgtgccgcccgaggacagcacggccgcgtgccgctggatctcgaaccgggcggcgcgttcgacggagcgcagcgagttgacgttcttcgtctcgctgcgcgtgccgaacttgtcggcgcccttgggcatcagcgacaggttcacgtcacagcgcatctggcccatctccatgcgggcctcggagacgccgagcgcccggatgagttcgcgcagctcacggacgtacgccttggcgacctcgggggcgcgctcgccggcaccgacgatcggcttggtgacgatctcgatgagcgggatgcccgcgcggttgtagtcgagcagggagtgggacgcgccgtggatacggccggtggcgccgccgacgtgcgtcgacttgccggtgtcctcctccatgtgggcgcgctcgatctccacgcggaaggtctcgccgtcctccagctgcacgtcgaggtagccgtcgaaggcgatcggctcgtcgtactgggaggtctggaagttcttcggcatgtccggatagaagtagttcttccgggcgaagcggcaccactcggcgatcgagcagttcagcgcgaggccgatcttgacggcggactccacgccggtcgcgttgacgaccgggagggcgccgggcaggccgaggcagacggggcaggtctgggtgttcgggtcggcgccgagcgcggtcgaacagccgcagaacatcttggtgcgggtgccgagttcgacatggacctcgaggcccatgacggggtcgtaggaggccagcgcgtcctcgtacgacaccaggtcggtcgtggtggtcacggtgaaaacttccctctcagcccagcaggacgtcgtcgtcgcccagccgcttcagctcgcggtagaggatggcgaggccggtgacgatggcggcggcggacacggcggcgtcgatcaggcgcagcgtgtcgctctccgtgcgggccttcttggcctgcttgatgacgctgacggcgccgaacgcggtcgtcgccatcgacaggtacgtaccggacttggacttcttgaagcccttggccttggacagtgcgttgctcacagcgacggagcctcctcaagcagcgggtgtccccacttttccacgaacgcggcctcgacggcggcgccgaccttgtacaggcggtcgtccttcatcaccggggcgatgatctgcaggccgacggggaggttgtcctccggggcgaggccgcagggcagggacatggccgcgttgcccgcgaggttggtcgggatggtgcacaggtcggccaggtacatcgccatcgggtcgtcggcgcgctcgccgatcgcgaaggcggtggtcggggtcgtcggggagacgatcacgtcgacctgctcgaacgccttgtcgaagtcctgcttgatgagcgtacggaccttctgggcgctgccgtagtacgcgtcgtagtagccggagctgagcgcgtacgtgccgagcatgatgcggcgcttgacctcggggccgaagcccgcctcacgggtgagggaggtgacctcctcggccgagtggctgccgtcgtcgccggtgcgcaggccgtaacgcaggccgtcgaaacgggcgaggttgctcgaacactcggacggcgcgatcaggtagtacgccgacagcgcgaggtcgaaggacgggcagtccagctcgacgatctcggcgcccagttccttgagcacctcgacggactcgtcgaagcgctggatgacgccggcctggtagccctcgccgcggaactgctggaccacgccgacgcgcatgccggcgacgctgccgttgcgggcggcctcgacgaccggcgggaccggctcctcgatggaggtcgagtccagcgggtcgtgcccggcgatcacctcgtgcagcagcgccgcgtccaggaccgtgcgggcgcaggggccgccctggtcgagggaggacgagaaggcgaccatgccgaagcgggagaccgcgccgtaggtcggcttgacgccgaccgtgccggtgacggcggccggctggcggatggagccgccggtgtcggtgccgatggccagcggcgcctggaaggaggcgagcgctgcggaggaaccgccgccggagccgccggggatcttggtgaggtcccaggggttgccggtcgggccgtaggcgctgttctccgtcgaggaccccatggcgaactcgtccatgttggtcttgccgaggatgacgacgtcggcggccttgagccgcttggtgagcgtcgcgtcgtacggcgggatccagccctcgaggatcttcgaaccgacggtggtcggcacgccctcggtggtgaagatgtccttcagcgcgagcggtacgccggccagcgggccgagcttctcgccgcgcgcccgcttctcgtccacggcgcgggcctgggcgagggcgccctcccggtcgacgtgcaggaaggcgtgcaccttctcgtcgacggcgtcgatccgggcgaggtgcgcctcggtgacctggacggccgtcagctcgccggaggcgatcttctcggcggtctcggcggcggtgagcctgatgatgctgttgatgtccgtcatggcggtcactcctcccccaggatctgcggcaccttgaaacgctgctgctcctgggccggggcgccggagagcgcctgctcgggggtgagcgacggacggacctcgtccgcgcgcatgacgttcgtcagcggcagcgggtgggaggtcggcggtacgtcttggtcggcgacctcactgacgcgggccaccgcgccgatgatgtcgtccagctgtcccgcgaagtggtcgagctcttcgggcttcagctccagacgcgccagccgggcgaggtgggcgacctcctcgcgcgtgatgccaggcatgcagcgttcctctggggtgagtgtgggtggttcggggctgggggctggcgtcgcgttcccggcgtccgcccgaagcgcggcaggtgggaatgtgacaccagtccccaatcctatgggtcgggcggtggtgtccgtacagcggtttgcccgggccccgcgctcagcggtggcggccgtcccaggcgtcgctcttgaggaagtggttgtcgtaccgctcctgcacctccagcaggctctccaccgtggcctcgccgagccggatgcgctggaggtggcggaagtactcgaagcgctcgacgcccggggtgatcacgatgagcaggtcggcgctggtgccgggagtggcggcgaaggcgtgcggccggtccggcggaacgatgatcaggtcgccgcgttcggcggtgacgacgtcgtcacccgagaggacctcggccgcaccgtcgagcaggtagaacatctcggcggagttgtggtgcacatgcgggcgggccccgtcggcgccctcggcgagggtcacgcggacggtggacagcgcgccgccgctggcgctgctgtcggcgaggagcctgacggtggtgggcgcctgtccgaccacctcggcctccgcgtcacggacgagcacggtctcgtcgaatgccggtacgaacagtgacatctggattccccctgatcggtgtccgcgcatggtggcgcgctgatcggtgtggcgtgtggcgtgtggcgtcgcgcgcggtggggcgcggcgtggtgccgtcagaccgcgaagagcagtccggcactgatgagtaccacgatcgcggtggcgcagtggacaccgtaggcgacggccttcgggccgccgtggcgcaggactatcagcatgtcgccgagcggcacgacggccacgcagagcatgaaccaggcctcggggcgggcgcccgcgaaggccagcagcgcgagaccgacgaggccgaaggtgccgtcgcgcaggcccttgatcgtcaggtaggcaccggcgtcgccggccgggtcggcggggacgccgtagccggccgcggcggaggcgggctggaacaggaagcggtagccgaggaacaggcagaacaggtcgagcacgacggccagggtgtacgcggtgacggtcatgtctcttctcccggaggtcatgtgctagcggcgctagcgatgagagtgaagctagcagagcgtcgacagattggctagcaccgctagaatgaggagcatgactatccagacgcgccgggagcgcgaacgagcggagcgcgagcggctgatcgtgacggccgcccgggaactggccgaggcggagggctgggacgcggtcaccacgcgccggctggccgccgagatcgagtacagccagcccgtcctctacagccacttcaagggcaaggacgcgatcatggcggcggtcgcggtgcagggctgcgcggagatggccgcgcagatgcgggcggcccgcacggccgcgcggggcgcgcgcgaggcgctggcggcggtgggcgcgtcgcccaccgccttcgggcggcggcggcccgcgctctacgacgcgatgttcacgcacctggtggacctgccgttcgccacacccgaggccccggcggcgctgcaggaggcgttcggcgagctgctggcggcggtcgagcc

SEQ ID NO: 1123 - DNA, 4547 bp, Unknown
  Kingdom: Bacteria, Phylum: Actinobacteria, Class: Actinobacteria, Order: Streptomycetales, Family: Streptomycetaceae, Genus: Streptomyces
gggcgctggagtacgtacagctcatgggtgtcgggatagcgcagcgcccacagtccgtccggggtgacgaggacgaggttgagggcgtagacgggcaggtgcgcggcgatccagcgggcggcgtgctcgatgcccgcggcgacgtcaccgccgtgctcgcgggtctcccgagtgatcagggcgaagaaccgctcggagtcggtgtcgcccgcgacgagcgaccggtcctcgcccaggtgctcgtcgagccggccgaggtcctcgatgaccccgttgtgcgcgaacagccgtccctcctgttcgaagggatgcgtgttgcggggctccagactccccgtggaggcgtagcgcacgtgcgcgacgaacgtggcggactcgacctgccgggcctcctcggcgaaggcacggtcctcgtacgcggcgatcggggccttgtccagccgcggggtgccgtccgcggcgaagtagcccaggcccgtgccgtcggggtcgtggcggctctgcctgctgaggctgtcgggcgcgtccaggagccagaaggtggcgtgggtgcgctccggggcactgctgaggccgaacagacggcacatcgggtactcctcggtcagtcgcggcccggggtgcgcgggttcttggtctccgcgccgtgggcgaacccgccggcgtcgtccgcgctgcggtgcggctcgttctgcttgtccagccggggcaggacgcggcgcagctcggccaggagcagatcggcgaggtcgtggctgaagccgttgcggaccacgacccgcaggacggccaggtcggtgcggttcttcgggaaggtgtacgcgggcaccagccagccgctctcgcgcagcgcggcggagacgtcgaagacgctgaagtggtcgatgccctcgcgcatccggaaggcgaagacggggatctcactgccgtcggtgatcagctcgaacgggccgagccccgcgatctcggcggcgagccgggtggcgacgtcacggcaggtctgctgcacgcgacggtagccgtcgaagccgaggcgcaggaagttgtagtactgggcgacgacctgcgcgccgggccgggagaagttcagcgcgaaggtcggcatgtcgccgccgagatagttcacgtggaagacgaggtcgtcgggaagggcgtccttgtcccgccacagcgcccagccgacaccgggcatgaccaggccgtacttgtgccccgaggtgttgatggaggcgacgcgcggcagccggaagtcccactccaggtccgggtcgaggaagggggcgatcatcgcacccgacgcgccgtcgacgtggacggggatgtccaggccggtgcgggcctggaggtcgtccagggcggcggcgatgccggcgacgggctcgtagctgccgtcgaaggtggagccgagcacggcgacgaccccgatggtgttctcgtcgcacagctcgacggccttctcgggcgtcaggtggtagcggtcgccctccatgggcacgtagcgcggctcgacctcgaagtagtcggcgaacttctcccagcagacctggacgttgatgcccatgaccaggttgggccggtcggccggcttgccctcggcgcgccgcttgtgctgccagcggcgcttgagcgcgagaccggccagcatggcggcctcgctggaaccggtggtggagcagccgatcgcctgccgagggttctcggcgtgccagaggcgggcgagcatgtggatgcaccgggtctcgagttccgcggtctgcggatactcgtccttgtcgatcatgttcttctcggcgcactcgtccatcagccgccgggcctccggctcggcccaggtggagacgaacgtcgcgaggttctgccgggcgttgccgtcgagcatcagctcgtcgtggacgatctggtaggccgtgtccggttccatctccgcctgcggcatcgcgtaccgcggaaccttcagcggctcccggctgaagaccgggttgaccgccaggtcacggctgtcgccgtggttgtcacgagggtgcctcaccgtcatgcgcgttccgtcctccgcctgtcgtcggcctgccgtcggcgtaccagtacccgggcatcgccggatggatcctcgcgtcaccgccccaggagcacgtcaccggccccggaacgcgtcgccgcttggagaaagcgtcaccgttccaggaagtcgaacagctcttcccagcggctggtgatggtgtcggggtcgaagcgccgcacactgcgcagggcctgctcgcccatcgtgtcccgcagccgctcgtcggacatcaaccgcacgagatggcgggcgagttcggaggtgttgccgggccgggcgagcagtccgtcctcttcgtgcgtgacgatctcgcggacgccgggcgcgcagtcgaaggccacgcacggcactccgctcgccatcgcctccagcagcaccagcgggaagccctcgccgcgggaggactggacgaagacggaggaggcgcgcagtgccccgggcacgtcgtcggtctgcccggcgaagtccaccgagtcctcgatgcccagctcggcgcactgccggcgcagttccgcctcggcctctcccctgccgtagacgcgcagggtccagccgggctgctgcgccgcggcctcggcccaggcgtccaggagcaggtcgacgcccttctcgtgggagagccggccgatgctcacgacgaccttctcggtgcgcggggagggcgtctcgggcgtgatgggcagcgggttgggcatgaagtcgaggttgttcatgccctcgccgacccagcggtcggcgtcctcctgggtgagggcgaggagccggtcgacgtccgcgtagtacttcttcacccgggcgaagcgggacgacttgcgggccgtctcgaaggactcgtgggtcatgccgatgacggtgtgcccggcggtgtcggcgagggccacccactccatcgcccagacctggctcacgatgatcacggcgccgggcgcggcggcgcggaacagtgccgtgagccgtccggcggcggcccgcatgtgggcgtcgtggcggcgcagggccgggtcggcggagccgagcaggcggcgcggcctcgggcggccgggagggcggcgggcgtagagcgtgaccgtgcggaacggcgggttctcgccgaggtccatcgggtgtccggccggtgcgatgccggcgatggtcacccggtggccgcggtcggcgagcagcttggccagctgggcctgccagcggcccacgccgccgagttcgtcgacctcgttggccacgaagaagatgtcgcgctgggtcatcgggcctctcccgcggggccgaagaaacggtccacgatctgcgccgcggcgtccccgcggtcgtactcgccgtacttgtccacgaactccttcagccgggcctcgtacgtcgcctgcacggcggtcaggtcgccgagcgcggcgaagaggtcctccggggtgcgcggcacgggtcccggcgcctcggcgagcaggtcgaagtaggtgccgcgggtgtccttggcgtactcctcccagtcgtggacgtagaacacgatggggcgctggagcagcgcgtagtcgaacatcaccgaggagtagtcggtgatcagggcgtccgcgagcagcatcagcggggtgatgtccggttcggcgctgacgtcgatgacgcgtccggcgaccgacgggggcagcgtgagccggttgaggtagtgcgcgcggacgagcaggacgtggtcgtcgccgaagcggtcggcgtactcctcgacgtcgaacgggaacgcgaagtcccgtacccggccgtcggggtgggcgcggaacgtcggcgcgtacagcagcacccgcttgtccgcatcgatgcccaggcgttcggccagccggcgcgcctgcgggtccggtgtgtgcgactcgcgggccttcacgagggcgtcgttgcgcgggtagccggtgcgcagcagtttgtgctcggggatgcggtaggcgcgggcgagggtgcgcacgtcgtgctcgctgcggaccacgaagtggtcgaaccggtccagtgcctgctggtaggagcgctgctcctgctcggactgcatccggtgggtgggctcgtcgaagcccatccgcttgagcgcggacccgtgccaggtctggatgtacgtcgtctcggggcgcttggtcaggcgcagcgggtagccctggttgtcgatccagtactcggcctgggcgagcgccttcaggtaccgccacgaccagcggcgcaccagctcggcgtcctcggggaagccctgggggcggtcacccgcgtaggaccagacgggggtgatggggacgccgcggcggcgcagctcctcgtagatggcgcgggggctgtcgctgtactgcttgccgaggtggctctcgaagacgacgctgcccttgcggaccgggagcttgctgagcatccggtcgtagacctggagcttgcgggtgccggagttgaggtcgcggcgcacggcccgcagcttgcggtaggcgcccttggcggcgcgggccggccggccgtgcaggttgcgctggac

SEQ ID NO: 1124 - DNA, 4249 bp, Unknown
  Kingdom: Bacteria, Phylum: Actinobacteria, Class: Actinobacteria, Order: Streptomycetales, Family: Streptomycetaceae, Genus: Streptomyces
tccggaccgcctcgccgtttcgcggcctacttcggctgcggcttgcgcaccgtcaggtgcagctcgcgcagacgggactcgtccagctccgtcggcgcgcccatcatcaggtcctgggcgttgccgttgagcgggaaggcgatcgtctcgcggatgttgggctcgtccgcgaggagcatgacgatgcggtccacgcccggggcgatgccgccgtgcggcggggcgccgaagcggaacgcgcggagcatgccggcgaacttctcctcgacggtctcgcggtcgtagcccgcgatctcgaacgccttgagcatgatctccggctcgtggttccggatggcaccgctggacagctcgacgccgttgcagacgatgtcgtactgccagcccaggatggacagcgggtcctgggactcgagggcctccaggccgccctgcggcatcgagaacgggttgtgcgagaagtcgatcttcccggtctcctcgtccttctcgtacatcgggaagtcgacgatccagcagaagcggaagacgtcctcctcgaagtgcccggcgcgcttggcggcctcgacccgcaccgcgcccatgatcttcgagacctcgtcgaactcgcccgcgccgaagaacaccgcgtgaccggcggccagggacagccgcttggtcagctcggcgacgttctcctcggtgaggaacttcgcgatggggccggtcagcgagccgtcctcggccacccgcacccacgccaggcccttcgcgcccagcgagaccgcgtagtcacccagctggtcgaagaacttgcgcggctggtcctggaccgccggcaccggcagcgcacgcacgtgcttgccggcgaacgccttgaactccgagccctcgaagacatccgtgatgtccaccagctccagcttggcgcgcaggtccggcttgtcggagccgtacttgagcatcgcctcgcggaacgggatgcgcgggaagggcgaggtgacgtgacggccgccgccgaactcctcgaacagctcggtcatcagctgctcgatgggacggaacacgtcctcctgctcgacgaagctcatctcgacgtcgagctggtagaactcgcccggcgaacggtccgcgcgggcgtcctcgtcacggaagcacggcgcgatctggaagtagcggtcgaagccggagatcatcagcagctgcttgaactgctgcggcgcctgcggcagggcgtagaaccggcccgggtgcacccgggaggggacgacgtagtcgcgggcgccctcgggggaggtggcggacaggatcggcgtcgccatctcgttgaagccgagcgccaccatcttgtgccggatcgcggagatcacggccgtccgcagcatgatgttgcggtgcatgcgctcgcggcgcaggtccaggaagcggtactccaggcgccgctcctcgttgacgccgtcctccgcgttgatcgtgaaaggcagcggggcggcggcgccgagcacctcgacctcaccgacctcgacctcgatctcgccggtgggcaggtcggtgttcacgttctcggttccacgtgaaacaacgccgccgtcgatccggacgaccgtctccttggacagcttgtccagcgcctcgtaggcgggcgtgccgggacgggcgacgagctgcgtgatgccgtagtggtcgcgcagatcgatgaagaggatgccgcccaggtcgcgccgattgtgcagccagccgctcagccggacgtcggtgccgacgtcagaggcgcggagctcgccgcaggtgtgggacctgtaccgatgcatcgtcgttcatccagtcttcgcggatcggggatcaccgggcggccacggcccggacccacccagcctaccggccgaggggagatcggctctccccatatcacgtcccccgcccggctccggccgaccggacacccgtccgccttcggtggcagtgtccgagagcctcttcttacagtggggcaatgcgcactggtgagcccctgcccgccgtgggggacgtcctggccgccctcgcgaccgggctgtggcactgggacacctccaccgggctggtcgcggtcgacgccgaggcggcacggctgctcgggctgcccgcccaggacgtcaccctcaccgaggcccaggcgcgcgcacgcctgcacccggtcgactggaacgagatcaccggcgtggtgcggctcgccgccgccgagggcaccctcgccgaggtacgcatccggatcatggacgagcggggccggatcattcgcgtggtccgcagccgctcccggcccgtctacgactcccgcaagaaggcctatgaactgatcggcaccctccaggaggtcaccgaaccgacccccggctccccggcggggcgcagcgcggtcaccggtgactggcggcgctcacgggaggcgttcctgctggacgccggccgcgccctggccgaggcacgctccacggcggaggtgctgcgggtcgccgccggcctgtcgatgcccgggttctcccccgacggcctggccgtcttcggcgtggaggccgaccacctgacgatcatcggccaccacgggcagcagcagggcgacgaggtgccgttcgtccacatggccctggacacggactacccggccgccgaggtgatccgcaccggacgcgccgtctacctctcctcgcccgaggagtaccaggcccactacccgctcacctggaaactggcccagcgcttcaaccgccgctcctgggcgttcctgccgctgaccgcctccggccacaccatgggcgcctggatggccgccttcacctatccggtcgccttcacgccggacgagcgctcggtgctgaccacggtggcccgcatgctcgcccaggcactctcccgggccggcaccgccgagaccgagcgggagctgagcgagggcctgcagcgctccatgatgcccacgacgggccccgccgtccccgggatggacgtcgccgcccgctacgtccccaccggcggcggcctccaggtcggcggcgactggtacgacgtgatcccgctgcccgacgaccacgtcgccctcgtgatcggcgacgtccagggccacagcaccgccgccgccaccctcatgggccagatgcgcaccgcactgcgggcctacgccgtcgagggccacccgccggacgtggtcgtctcccacgccaaccggctgctgctcgacatggagacggacctgttcgccacctgctcctacgtcgacctcgacctggaggccggcaccgcctggtgcgtacgcgccggacacctccccccggtgctgcgccaccccgacggcgccgtggagatcaccgaggtggaaggcgggccgccgctgggcgtgctgagccaggccgacttcccgatgaccccgctgcggctgcggccgggcaccgtgctcgcgctgaccaccgacggcctcgtggagtcgcccgaggacgacatcgacaccggcatggaccggctcgcccgctgcctcgccgccgtcgatcccggccggctcggcccggtcgccgacgcgctcctcaccggcgcccgccgcagcgacgacatcgccctgctcctggtccgctacgacggcctggccgagcgcccgctcagggagagctggacggtgtggcgggtgcccgaggcggtccggcacgcccgccgcttcacccggcgcaccctgcgctcctggggtgtgacggaggaggccgacgccgccctcctggtcgtctccgagctggtcaccaacgcgctcgtgcacaccgacggcccggtccgcctcgacctgaccctcgtccaccacagactgcgcgtcgccgtcgccgactcctcgccccgtacgccggtcaagccgacgagcatcgggtgggaggccaccggcggacgcggcgtgctgctcgtcgaggccgtctcgacggcatggggggcgctgcccgtcagcggcggcaagcaggtgtggagcgaactgcccgtgggccggtgagcgcaccgcccggccgccgacccgccacacgggtgcgccgcgccgccggcacggcaggtctgagccgcgcgcacggccgccgtgcttagggtcctgggctgtgtcacacaccttcgaagagctcgtggcgaagcagcgcgccgccgacgaggcgcacacccgggtcgaacagctccgggcgacctacgggccgcccgcgcaggagcggtggaccgggacgcagagcgagacgtacgagacggccctgcgcgcctggcgcgacctcgc

SEQ ID NO: 1125 - DNA, 1424 bp, Unknown
  Kingdom: Bacteria, Phylum: Actinobacteria, Class: Actinobacteria, Order: Streptomycetales, Family: Streptomycetaceae, Genus: Streptomyces
  misc_feature (155)..(156): n is a, c, g, or t
  misc_feature (647)..(648): n is a, c, g, or t
gcccttctgggtcgtacgaccgcagttccgccacgtcagcggcggtgaccgggcgcaactccgccaggtccgggctcacggtcaggtcccatccgcagtggtcccggacgcgggagacgcgctcggccagcggctcggggccgggggccacgtgnntcatcgtcccgacgacgagcacctcgtcggcgttggtgatgacgtcgttgccgccgccggatccgaccagataggggccgccgtcgatcttcgtcgtgttgatgttgccgtgccggtcgatctgcgccgagccgacgcaggcgatcgagcggaagaacgagccgttgaccaggttgcccagcacctgctcggtgtcgaggagcatggacgaggacgggaagttgtggaagctgaagatgaacgggtctcccggtgtgggcgtgtagtcccacaggcccagctcggccgccagggccacgcggtggccggcctccttggcccgtccgacccccacccaggccgcgaggttcgccagccccgccccggcgagaacggtgtcggccgaggtgtcggcgatccgctggttcacgaggtcggcgagccatacggccgctcgttcggccggggtcggccctccggtgcgctcgaccccggtgggcgcgggcggcggnnaccagggccttgaggcgctcctcgccgagcttcgccagataggcctcgtggtcggccggctccaggatccactcgcgcagccagtcgtcgaagtgcgcgcccctggtcgcctcacgggcctccacccagaaggggatgtcctccagatagccctggacgggcaacctggtcccctcagggccggggaacacaccaccggggtgtgcgccgaacggcgcctcgacgacggcgaggacccggtgggcggggattcgtaccagggtcgaccagggccgcaggtcgtccacgaccttctccaccgtggcgatcactccgcgctgcgaggcgagcgcccccaccacgccttcgaacatcggcggcgcgatggccaggttcccctgccggtcggcgacggcggcgtgcaccagggtcacgtccggcaccagcggcgccaccaggcccaccaggccgaaggcggtgtccacctcctggtacgtctcgttctccgtcatcgacgagtcgcgcaccgagcccgtcacgaccgcggggaccccggtggccgcggcccgcagccgctggatgtaggtgaggaaggaccagttctcgacctccacggcccccgaggtgtacgcctcctggaacaccggattgggggtgaagaccgggaacgagtcgccggagtacacggtgacgaccttcttcaggcatcccgcgcggaacagcacggccccgagcgaggacaggctcgccatgatcagggtgaagccggagggcttctcccagtgctggcgggccag

SEQ ID NO: 1126 - DNA, 1564 bp, Unknown
  Kingdom: Bacteria, Phylum: Actinobacteria, Class: Actinobacteria, Order: Streptomycetales, Family: Streptomycetaceae, Genus: Streptomyces
cagcgcgcgcgtcaccttcaccgcccaccgcttccgcgcgctgccggccgcccaggaggaggccgtgctccgcgtcgcccaggaggccctgcacaacgcgctgcggcactccggcgccgaccgcgtcgacgtcaccctggaccgccgcggcggcggtgccgtcctgcgcgtcaccgacgacggcaccggcttcgacccgcgcacggtgcgccgcgcgggccgccacctcggactggtctccatgcgggaccgggcgagcggcgccggtggcaggctgaccgttcaatcggcgcccggcaagggcacgaccatcgagatggaggcccccggtggctgacgcaatcaaggtgctggtcgtcgacgaccaccaggtcgtccgccggggcctgcgcaccttcctggaggtgcaggacgacatcgaggtggtcggcgaggcggcggacggcgccgagggcgtcgagcggaccgaggaactgagacccgacgtggtcctcatggacgtcaagatgcccgtcatggacggcgtcgaggcgctgcgccggctgcgcggactcggcaaccccgcgcgcgtgctcatcgtcaccagcttcaccgagcagcgcaccgtggtcccggccctgcgcgccggcgccgcgggctacgtctacaaggacgtcgaccccgaagcgctcgccggcgccatccgctccgtgcacgccggccacatcctgctccagccggagatcgccggcgtcctgctgtcccaggaggaggccacctcgggccagggacgaggcacgtcgctgaccgaccgggaacgggaggtgctgggcctgatagcggacggccgctccaaccgcgagatcgcccgtgccctggtgctctccgagaagaccgtcaagacccacgtctcgaacatcctgatgaaactcgacctggcggaccgcacccaggccgcgctgtgggccgtacgccacggtgtgaccggctgatacacccaggcggcgcacccttcggccacccgccgcggcaattcggagcgttccgttccgggctgagattcataccgtcgtgggaatgtcccccggatggcgcaacctccggggagcccggccgttctccagtgcgtgccgcggcgactgccgtggcgatcaccaggaggactcaagcgtgaagaacctgaagaaggcagcggctgtgacgatggtggccggcgggctcgtggccgccggagccggaatggcctccgcccatgacggcgccgcggccgccggtgcggccaagggctccccgggcgtcgtctcgggcaacgtcatccaggccccgatccacatcccggtcaacgccgtcggcaacagcgtcaacgtcatcggcgtcctgaacccggccttcggcaacctcggcctcaaccactgagtccagcaccaccgatgcccacggcctcccgggcccgccccgggaggccgatcggttttccgggggcccggcgcagcagagggcggagctgcagccgggccggctacaacagcgaggccaggcagtatcagcccgtcgggcgccccctgctcgaagagctcgggggagt

SEQ ID NO: 1127 - DNA, 1000 bp, Unknown
  Kingdom: Bacteria, Phylum: Actinobacteria, Class: Actinobacteria, Order: Streptomycetales, Family: Streptomycetaceae, Genus: Streptomyces
ggccgccgaagtagttgttgaccaccgtgtggtcgttgccgtagaggcgtacgccgtcggtgccgtcgagcaggtagttggcctccaccgtggactggttgccgtgccgcagcacgatgccgccacggctgttgcgcagcgtgttgtaccggatggtgttaccggacgacttcacggaaacggcctcggggtcgccgttgcaccgctcgaacaggttgtactccacgacgccgttggcgctggacagcgcgcggctgctgacgccgagccggatgggttcgccgccgttgtccccggcgtagctgtggtcggagaagtagttcttgaagatgtgcggcttctgggccatggcagtggagcccgggccgtcgacgacgacgaagataccctcggtcgtcttgtcgtggaagtggttgcggtcgatcttggtgttgtcgccccgcacgacgacccagtcgagtccgctgacgtcggcgaagcgaaagtcgttgcgggtcagccggatgcccgtgcagtccgccgggatctccagggtggtgctctgccggaaggcgaacccgctgatggtgatgttgctcgagttgccgaggacgaagctcttcgcgccctggagcaccgctcccccacgggactgcgcgacgatggtgatcggcgcgtcggcggtgcctgctttgcccgagatggtgatgggcttgttcgaggggacggtgtaggtgccgtcggccaggacgatccggtcgccgggcttcgcctcgttgatcttggtctggaggtcggccagggaaccgacggtcaccgtggccgccgacgcgccggccgacagggccgggacggaggcgagcgcggcggcgcccagcacggtgccggtgaggaacgtacgtcgttgcatgatgtctcctgtgaagcgggacgtgtcgagccgacccgccgggcagggcgagagccgtcggccggaaggtgtgggtgtggccggcaggggccgccggggtccggtcgtccg

SEQ ID NO: 1128 - DNA, 532 bp, Unknown
  Kingdom: Bacteria, Phylum: Actinobacteria, Class: Actinobacteria, Order: Streptomycetales, Family: Streptomycetaceae, Genus: Streptomyces
cggctacccgcccgccgccgcccagcggcctccgcagactcccgcggccggcggccgcacccgctactggatcgagatcaacggcacccgccaccagatctcccgcccgacgctggtgctgggccgcagcaccgacgccgacgtgcggatcgacgaccccggcgtctcccgccggcactgtgagatccggaccggaacgccctcgacgatcgcggatctcggctccaccaacggcatcgtggtggacgggcagcacaccacccgcgctacgctccgcgacggctcgcggatcgtcgtgggcagcaccaccgttatctataggcaagccgaagggtgaaccgggggcaatgtcagagctgaccctcacggtcatgcggctgggtttcctggccgtactgtggctgttcgtgatcgtggccgtgcaggtcatccgcagcgacctgttcggtacgcgcgtcacccagcgggggtcgcgccgggaggccgcacggccccagcagagcggacggcaggccgcgcgccaggccgccgc

SEQ ID NO: 1129 - DNA, 3597 bp, Unknown
  Kingdom: Bacteria, Phylum: Actinobacteria, Class: Actinobacteria, Order: Streptomycetales, Family: Streptomycetaceae, Genus: Streptomyces
atcgccgcccacgccgtccgtgccgccgcccgccgatcccccgtcgcggtccccctgcacaccgccctgggcctggtcctggccgcgcccctcgccgccctcaccgacctgccctccttcgacacctccgcgatggacggctgggcggtctccgggcccggcccctgggacgtccgcgagggcggctccctggcgggggacgcgcagcccgagccgctgaccgacggcgaggccgtacgcatcgcgaccggcgcgcgcatcccgcaggacaccaccgcggtgctgcgcaccgagcacggccgcacggacgccaagggcaagctgcactccctgcgggacctgagccacggccaggacatccggccccgcgggcaggaatgccgcagcggtgaccagctgcttcccgccggcaccctggtcacaccggccgtgctgggcctcgcctcggccgccggatacgacaccctcaccgccgtgccccggccgcgggtcgacgtgttcgtcctcggtgacgaactgctcaccgaaggcctgccgcacgacgggcggatccgggacgcgctcggcccgatgctgcccccgtggctgcgcgcgctcggcgccgaggtggccacggtgcgccgcatcggcgacgacgccaaggccctgcacagggcgctcacccggtccgaggccgacctcgtcgtcaccaccggtggaaccgccgcaggacccgtcgaccacgtccgtcccactctgcgccgcatggacgccgacctgctggtcgacggggtccaggtgcgtcccggccaccccatgctcctggcccgcaccaaggaggaccagcacctcgtcggcctgcccggcaaccccctcgccgccgtctccggtctgctcacgctcgccgagccgctgctgcgcgccctggccgcgcgcccggctccggagccgtacacgatgccgctgcgggacggggtgcacggacatccgagcgacacccggctcgtccccgtcgtcctgcgcggcgatcacgcggctcccctgcactacgccggccccgccatgctgcgcggtgtcgcggcggccgacgcactggccgtcgtaccaccgggcggcctccgcgccggccaggaggcggaactgctggacctgccctgggccgccgccggaatcggagtgtgtttcacgtgaaacttccgggccatgacgcgatcgcccgtcaggcggacgaacatctcgtgacccatcgggtgaaacttccgaggaagctggtcgaccgtcccatacgtcaggtcggcaaacgactggccatggcgctgctggtgctggtggtgaccgtggtcgtcgtctatgccgaccgtgacggctaccacgacaacgccgacagctccgtggacctcctcgacgcggcgtactacgcgacggtgaccctctccaccaccgggtacggcgacatcacgcccgtcagcgacagcgcccggctcaccaacatcttcgtcatcacgccgctgcgcgtgctgttcctgatcatcctcgtcggcaccacgctcgaagtcctcaccgagcgcacgcgcgaggaatggcgcctgagccgctggaggtccaccttgcgcgaacacaccgtcgtcatcggtttcggcacgaagggcaggtcggcgatccagaccgtgtgcgcgaccgggctgaagaaacagcaggtcgtcgtcgtcgatcccagcgccaaggtgatcgacgccgccacggccgaggggtacgcgggcatcatcggggacgcgacccgcagcgaggtgctgaaacgggcggaggtccagcgggcgcggcagatcatcatcgccacgcagcgcgacgacacggccgtcctggtgacgctgacggcccggcagctcaaccgtgccgcgaagatcgtcgccgcggtgcgggaggaagagaacgccccgctgctcaagcagtccggtgcggacgccgtgatcaccagcgcgagcgcggccggcaggctgctggggctttccgtgctcagccccgccgccggcatggtcatggaggacctcatccagcagggcagcgggctggacatcgtcgaacggcccgtcataaaggccgagacgggccgcagtccacgcgagatcgacgacctggtggtgagcgtcatccgcggccaccgggtcctcgggtacgacgatccggcagcctccgccctgcagttgacggaccgcctgatcacgatcgtccgggccactcccggcacccaggtcaccccggacacccgcccgctgccgctggactgaccaccgcacccgcgcacacggcccacagcgcgtgcctgtggaccgggcccgcgaccggcggacgaccgcggcgcgcgtgcgggtgcggagcccgggacgagggccgggcgaggagtagcgtcgggcccatgcatgcgatcacgattcccgaacccggtgggcccgaggcgctggtgtgggacgaggtgcccgatcccgtgcccggcgagggcgaggtgctggtcgaggtggtggccggggccgtcaaccgagccgacatcctgcagcgccaaggccactacgagccgccgcccggcgcctcccgctaccccggtctggagtgctccggccggatcaccgccctcggccccggagtgtccggctgggcggtcggggacgaggtgtgcgcgctcctcgcgggcggcggctacgccgagaaggtcgtcgtcccggccggtcagctgctgcccgtcccgcagggcgtggacctcaggcaggcggcggcactgcccgaggtgatctgcaccgtatggtcgaacgtcttcatggtcgcccacctgcgccccggcgagaccctgctcgtgcacggcggctccagcggcatcggcacgatggcgatccagctggccaaggccgcgggtgcgcgggtcgcggtcacggcgggcaccaaggaaaagctggaccggtgcgccgagctgggcgccgaggtcctgatcaactaccgcgagcaggacttcgtcgaggagatccgccgggccaccgacggggccggtgccgacgtcatcctggacaacatgggcgccaagtacctggaccgcaatgtccgggcgctcgccgtcaacgggcggctcgcgatcatcggcatgcagggcggcgccaagggcgagctgaacatcggcgccctgctgagcaagcggggcgcgatcagcgcgacctcgctgcgggcccgcccgctcgacgagaaggcggccatcgtggcggccgtccgcgagcacgtgtggccgctgctcgcggacgggcacgtcaggccggtcgtcgaccgggagatgccgatgcgggaggccgcgtccgcccatcggctcgtggaggagagcacgcacgtcggcaaggtgctgctggtgacctcctgagcggcgccacgacgtagagacccggcgcgccgggatggccacgccgggccgccagcatcctctccgaccgcctcgaccgcctcgaccgcctcgcccgcctcgaccgcctcgaccgcctcgccgaactcggcgaggccggtgtggtcagccgcgaggtggacgcagggccgcccctgcgcgtctgccaccggctcacgcccacgggcgaggcggtcgaggcggtc

SEQ ID NO: 1130 - DNA, 548 bp, Unknown
  Kingdom: Bacteria, Phylum: Actinobacteria, Class: Actinobacteria, Order: Streptomycetales, Family: Streptomycetaceae, Genus: Streptomyces
  misc_feature (283)..(313): n is a, c, g, or t
agcagcgcggcgggcttcttcacgttcacaggttcccccatgtgacgaaggtggtcgttccgccggagcggagtggttccaccgtggcaggggccgcgctgcgccggtacctcggaagtctcagggtcacctgcggcccgggggcgtgtactccttgaggtagtgggcgacgcgggcgcagtagtcgcggtacttcgggggaactccgcccgcgccgttcaccttcctgaacgacgtccggtaggcggcggcgatcagtacccgcttgtcgccgggcagcccnnnnnnnnnnnnnnnnnnnnnnnnnnnnnnngcgcagcacgcgcggggtccagcgggcgatgccgtactcgtccttggccgggtcggacaggttggggtcgaagtcgctctccgccttcagcatggcggcgatcagcgccggggtgacgtccgggtgggggcagtcgtgcgcggcgtcgacgatcagcggccggtaggagggcgggacgccctggtcggtacggagttcgggggcgccgtaggtggcgggggcgacggctccgggc

SEQ ID NO: 1131 - DNA, 3848 bp, Unknown
  Kingdom: Bacteria, Phylum: Actinobacteria, Class: Actinobacteria, Order: Streptomycetales, Family: Streptomycetaceae, Genus: Streptomyces
gtacacggcccgaggcggcacgctccggagcgagccgcgcgaagaccgctgccgccaaccgggccgtgtactcgccgagttcgaagccgtcggcaccttgacgggcacgtacgagcagcatccggtgggcgagcgccagttccggcgtcaccatgaccaggccctccggaacggtgggatcaccgcccagcagatcggcgacccgcggctcggacaggacgatctccgtgaacgtgtcgggccccagcggatgcgcgaactgctgctccgagcccatccgttcgacgaacacgctggcggcgtccagcacatgctccacgccgtcggcccggccgcgcagcaccccgtcgcggaccagcaccagaccgaacacgggcgcgggccgcacctgcgaccagccgcgcgtcgtactgctgcagcgcacgtcggcgaggtgaacgtcatcctcacgcaggtacacccgccggtccccggccatacggccatcgtagaggcccggacccttgcctggccccccgcgaaccggacacgaacgtacaagccctgctgcgccggcccctgcacgatgacggacagcacaccatctcgccgccccccgctcgtcacagccgacctcgcaagggagagaccatgacccaccgccccgttccgaccgccgccccggcgtcgcccgactccacgagccgccgccaggtcctgcggggcacagccgccgtgggcatcggcgcactcgccgcgtgggccggcgcggacggcacccccgccacggccgctccccgccgcgacgcccgcaccgcgcacatcgtctcccgccacacaggacgctacgaggtactcgcgctgctggacgcccacgggaccttccccggcaagcggcaggactggttccccgacgcgggcgacgcggactgggcacgcgcacagcggctcgaccccgctgccttcggcccggacgacacatgggaactcgacttccactgctacgccgtccgccggcccggcggccgtgtcaccctcgtcgacaccgggatcggcccggtcggcagccccgcatcaccctgggcgccggtgccgggccgtctgccggcgatcctcgggcacgccggcatcgaccgggacgacgtcgacaccgtcgtcctgacccacctccatgaggaccactacggctggacggtcgacaccaccggtaccccgatgttcccgaacgcccgccatgtggtccagcgggccgagatcgcggccctgggcgccgacgacagcgccacggcctacgtggtcgagccactgcgccgggccgggctgctgcacctggtcgacgtttgggtcagagtgcagggcggcggcccgggcggccccgcactgaccgccgtaccgacaccgggccacaccgccgggcaccagtcggtgctggtcgacggtggccgggaacgcgtcatgatcaccggcgacgtcctcgtgcacgccgtccaactggccgcgccgagcgtcgcgtaccggctggagagcgaccaggccacggcccgccgcacccgccagaagctcctcgacgacgcccgcgcccggggagacctcctggccaccgcccacctcaaccgccccttcgtccgtccctgaccccggcccgcggcgaccggcggcggcgccgggcacccgcggcgcgggcgggccgggggcgcccggcgcagcttcggccgcgatcttccgcgcgggccccggcacctgtgatgatgggaagcaggggagtgaccggtggggtcgtgaggtccggggggatcgatgagcagtgcgacgagcgcgacgtcggcgttgacgcggctgaagtccgcgcagaagagcgccaagggcgtatcgctgtattcgcggtacgtgaaccggcccgcgggccggtacctcgccgccggtgcgtaccggctcgggctgacccccgaccaagtcaccctgatcagcgcggcgttcagcttcgcggcggtcgtgacggcggcgctcgccacgcccacctggacggcggggctcctcgtgtggctcggcctcgcggtcggcttcgccttcgactccgccgacgggcagctggcccggctgcgcggcggcggcagcgcggcgggcgagtggctcgaccacgtggtcgactgcgccaagatcaccgcgctgcacaccgccgtgctgatctccttctaccggcaccccggtcacttcgggaccgcggccgacggctggctgctggtgccgctcggcttccagctcgccgccgtcgtcaccttcttcggcggactgctcaccgagcagctcaagcccaaggcggccccgggcggcggcgccgcgccctccacggcgcgcgccgtcgccctgctccccgtcgaccacggggtgttctgcctggtgttcctgctgctcggcggcggcgccgccttccgctgggcctacacggccctcgccgcggccgccgcgctcttcctcgtcgccttcctcaccaagtggttccgggagctgtccgcgcttcggcggtgacccgcgtcccgccgagggcgtcgatggcgcgccgcagctgggtgctcgaggtgtgcacggtgtacgggaagtagacgacgtccacgccgaccgtggcgaagtcccgctccagccgttcccccttcggcgtgtcccgccagtcgtcgcccttgaacagcacgtcgaagcggacctgcttccacgtctgcagcttgtccggcacggtctcgacgaacgcggcgtccacgtactggatgctgcggacgatctccagccgctccaccagcgggatcatcggccgtcggcccttggcctgttcgaccatctcgtccgacaccacgcccgccaccaggtagtcgcaccggtcgcgtgcgtggcgcaggatgttcaggtgcccgatgtggaaaagatcgtaggcgcccggtgcgtagcccacgcggtacggcttgctcgacggcacagatgtccccctcgttcgatgacggccccctgcgcaccccctgtgcggagagtgcgcgaactttgacgatagcgttcatgtccggtgtgggaagggtgaacaatcagggtgattcctggttcacttcaggacggggcgagggccggggggcccggagacgccggcagacaggggaggccgcccaggcggccggggggaaggtttcgtcgcgtgacacagcacaaccacagacgccggctgctcctggtgtccaccaactacgcgcccgagcacaccggtatcggcccgtacgccaccggcatcgccgagcactgggcgggccgcgggcacgccacccacgtcctcgccgggctcccgcactacccgtcctggcggctcgatcccgcctaccgcggggtgtggcgggccaccgagcagcgtgccggggtcaccgtgcaccggcgccggcacagcgtgccgccgcgccagagcgccctgcgcagagccctgttcgagggatcgatcctcgtccacggcctcctcgccccgccccgcaccggccgtatcgacgccgtgctcgcccagttgcccagcctggccgggggagtgctcggcgccaggatcgccgcccggcacggcgccccgtacgtcccggtcgtccaggacctcatgggcgccgccgccgcccagtccggcatccagggcggcggccgcgccgccgagctggccgagcgcgcggagtcgtgggtgctgcggcgtgccaccctggtcggcgtcatccacgagacgttcgtcgagcgggtgcgggccatgggcgtggaccccggccgcatccgcctggtgcccaactggtcccacatacaggcgccttccgcgccccgggagcgcacccgggagcggctgggctggcgcccggagcagaccg

SEQ ID NO: 1132 - DNA, 2440 bp, Unknown
  Kingdom: Bacteria, Phylum: Actinobacteria, Class: Actinobacteria, Order: Streptomycetales, Family: Streptomycetaceae, Genus: Streptomyces
cgggccggcccgcgctgctgccgcaggtggagcggatggtcggcagcttcgtcaacagcctcccgctgcagctggcggtccccatggaccgcgacgtgggggagtggctgcgcgaggtccagggacggcatgcggcggcgcgccgcttcgagttcagcccgctcgcccagatcaagtcctggacgggagtgacggcgaccgagccgctgttcgacaccctgctcgttctggagaactaccccgtcgacttcggcgagggcgccggtgcacagcagctgacgctgcggggactgacggatttcgagaagaccagtgaacccctgaccgtcttcgtcaccgcggcatccaccctgcgtgccctctatcaccgggaccgcatcggctcccgggacgtggaggagatcctcggcgccttccggacggcactgacggggctgacgcgcgagccgcggatcggcgctgtcgcctcccgcctcgcgcgaggcgggcaggcggatccggcggcgtccgggagtttcgcccgctacggcgggggcgggacgtccctgcccgcactggtgcggcgatgggtggagcggacgcccaccgcgcccgcggtggtggcggaagagggtgtgctcagctacgccgagctgtgggaccggtcgtgcgccgtggcggcggcgctggcagacgcgggagtgcgccgcggatcgacggtcggggtctgtctcgaacgctccgccgacctcgtggtcgccgtcctgggcacccagctggcgggcgccgcgtacctgccgctggagccgtcgcttcccgaggcgcgcctgtcgttcatggtcgccgacgcctgcgccgaggtggtgatcgcgcagcccgaccaggcgacgctcgcacaccgcctcggcgcgcgtctggtcgtcgaccccctgccgccgcaggagacggagccgcagcagaccgacacgagccggacgccggtgccggtgccggtgcagggctcggacctcgcgtacgtcatcttcacgtccggatccaccggacgccccaagggtgtcgcggtcacgcacgaggcgatcctcaaccgtctgctgtgggcgcaggacaccttcgggctgaccccggacgaccgtgtgctgcagaagactccgttcgggttcgacgtctcggtgtgggagctgttctggccgctgatcaccggtgcggtgatggtggtggcccgccccggcgggcaccaggacgccgcctacctggccgggatcctcgccgacgagaaggtgacgaccgctcacttcgtgccgtcgatgctggaactgttcgtcgacgaccccggcgccgccgagctgccggccctgcgccgggtgctctgcagcggggaggcgcttccccatggcctcgtccgccgcttcgcacagatcctgccgcaggtggagctgcacaatctctacggtccgaccgaggccgcggtggacgtgacgtggtgggactgcgccgggacggccccgccgggtgtggtgcccatcggccggccggtggcgaacgtgcgggcccatgtcctggacggccggctcgcggaggcgccgcggtcggtgccgggcgagctgtatctgggcggagtccagctcgcgaccggttacgtgggacggccgggactgaccgcggccacgttcgtcgcgcatccgctggcgggtcccggcgggcggctgtaccgcacgggcgacaaggtgcgcagactggccgacggctccctggagttcctcggccgcgtcgaccaccaggtgaagatcaacggctaccggatcgaactcggcgaggtcgagcacaccctgaccggccatcgcgccgtacgggagagcgcggtcacggtgcatgcgcgcggtgaacaccgcgagctggcggcgtacgtcacggccgccgagggcgaggccgatggtgaggttgatggtgaggccgaccgcgaggagctgccggcgcggctgagggcgtacctcgccgaccggctgccgcgctacatggtgccggcgacggtcaccgttctcgaggcgatgccgctgtcccccaacgggaagctcgaccggtcgaagctgcccgatccgcgccgagaggtgagggcgccggactcccgcccctggaggggaccgcagaccccgggcgagaaggcggtcgccgccgctttcgaggccgtgctcggcgtgcggtcgatcgagcgtgacagcgacttcttcgagctgggcgggacgtccttcgacgcggtccgcgcgatccggcggatcgagggggcgacggttccgctgatcaccacgcacccgaccgtgcgggggctggctgccgcgctggagtcgccggccgctgcttcgggcatgctcgtgagcctggcgccgccgcggacacagcccgcgacgaacctggtgtgcgtgccgttcggcggtggcagcgccatcgcctaccgggcactcgccgg

SEQ ID NO: 1133 - DNA, 3044 bp, Unknown
  Kingdom: Bacteria, Phylum: Actinobacteria, Class: Actinobacteria, Order: Streptomycetales, Family: Streptomycetaceae, Genus: Streptomyces
tctacggggagatcacgcggcgcgcgaccggcgcgttcccggtgccgggcgccggcggaaacggcgcgggcgcggcctgaggcccccggcccccgccccctctccttctccctctcctcccgtctccttctgtgcgggccctctgcgggtgtgcccgcacccactgcctctcttcaccccctccctctccgtacgtacgcaaggcctgttcagacgatgttcgacgctgccgtcttcggctccctgttcctcaccctttttgtcatcatggatccccctgggatcacgccgatcttcctcgcgctgaccgccgggcgccccgccaagatccagaagcggatggccttccaggccgtctgcgtggccggcggtgtcatcgccgtgttcggtgtgctgggccaccagatcctcgactacctgcacgtctccgtccccgcgctgatgatcgcgggcgggctgctcctgctgctgatcgcgctggacctgctcaccggcaagaccgacgaacccaaggcgaccaaggacgtcaacgtcgccctggtcccgctcggcatgccgctgctggcgggccccggcgcgatcgtgtccgtcatcctcgccgtgcagaaggccgacagcgtggccacgcagatctcggtgtggtcggcgatcctcgcgatccacgtcgtgctgtggctggtcatgcgctactcgctgctgatcatccgggtcatcaaggacggcggcgtggtcctggtgacgcggctggcgggcatgatgctctccgcgatcgccgtccagcagatcatcaacggcatcacgcaggtcgtccggggcgcctgacgggaccgcggacagaagacggagcccccgcccggcatcgctcacgcgtgtgccgtgcgggggctccgaagtgcggaaagcggccctgctgttatgaggccggggtgtcggccgggcggatccagagccgctggccgatcgccgcggcctgctgaacgatccgattgacggaggcggcgtccacgacggtgctgtccacggtggtgccgtcgacctcgtcgagtcgcatgatctcgaagcgcacaggcttctcccttcgtctggtcatcctcctgcggagaattactgtgagatggatggtgcacgtggctccggcgccccgtgctccgtatgtagtagtcaacgagcttcccgtgaagaacattccctacgctaaagaaaattttcgaacgtctaattactgaccggtcgtagccttcgaagagcgacgaaggaccgaacgaaggatccacgaaggatccacggaggaccttcgaacgaccgatcgggaccggttgtgttcgcagcgtgaccaccgggatgatggacccgatgaacgaggccatgaacgaggaccgcgcggcgctcgccgcccgcatcgaccgcacgaacgagctgctggaacgcatgctcgccgaggtggccaagacgccctccacccacgcgatcttcgtcgacgccggttacctgtacgccgccgcgggccgcctcgtggccggcaccgaggaccgccgcgccttcgacctggacgccgagggcctcatcgacgcgctcatcgaccgggcccgcacggtcttcgccgacagccggctgctgcgcgtgtactggtacgacggcgcccggcgccgcatccacaccgccgagcagcagtccatcgccgagctgcccgacgtgaaggtccgcctcggcaacctcaacgccaacaaccagcagaagggcgtcgactccctcatccgctcggacctggagtccctggcccggcaccgcgcgatcagcgacgccgcgctgctcggcggcgacgaggacctggtctccgccgtggaggcggcccagggctacggcgcgcgggtccacctgtggggcgtcgaggcgcccgagggacgcaaccaggccgagccgctgctgtgggaggtcgacagccagcgcaccctcgaccttgacttcttcaagccctacgtctcccggcgcaccgcggtgacgtacgagcccgcgggcagcgcccggccgagccgggatgacgtccgcttcgtcggcgcgcagatcgccgcgaagtggctcgcggcccgcggccgggacagcgtcgccgagctccttcccggccacccctacctgcccggctcggtggaccaggatctcctggtcgaggccgagggcctcctgcagtactcgctgcgcggccaggccgacctgcggcgcgccctgcgggacggcttctgggaccacctgcaggcgcagtactgacgccggacgcgcctaccggcccgtgctgtcccagaagtcggcgagcgcgcgggcggtggcgaggggctggtcgcagttgggggagtgctcggcgccttcgacgatcgtgcgccgggccccgagccgtacggccatgtcgtccaggagcggcaccggccaggcgtcgtcccgggcacccgagagcacgtggaacggcagcgggacggcggccagagcggtggtccggtccggttccgcgcacagctgtcgcccggtggcgaggagctgcgcgggcttgttgccgagccagcggcgacgcaggtcgtcccggtcgtcgccggccgccgggccgggagccgccgcgaggccgccgtcgccctgcccggccgcctcggcagggtgctccatcgactggatgacctcccagacctcggccatcgacatcaccgcgagcgcgtcccgcagcagcttcacgcgctgctgctgcgtggcggagacctgtgccggtccggacgacatgagggtgagcgagaggaagggggagtggtcgagcagcacggccgcgcgggcgatctggccgccgagggagtgcccgagcaggtgcaggggcgtcccgagggccgcggcctgcgcgaggacgtcccgggcgagctgctcctgggcgtaggcggactcgtcgtcctcgggcccgtccgactcgaactgcccgcgcccgtccacggccacggtccggtacccgcgcgcggcgagcggggcgtgcagcgggttgaagtcctccttgctgccggtgaaccccggcagca

SEQ ID NO: 1134 - DNA, 3796 bp, Unknown
  Kingdom: Bacteria, Phylum: Actinobacteria, Class: Actinobacteria, Order: Streptomycetales, Family: Streptomycetaceae, Genus: Streptomyces
atgggggcgccccctgagccggcccccgcccccctttctgcccgcgcgcacggcgccccgccgggcgtgtaccgaaccggctccgctgagcggaacaccgtacgccggttatcggattggcaaagaaggtcaacgacccctgttctcagacgcctcacagccggaaggatcccccgtactcgattcgtaacgatgtacggggaggtcccacttgagggttatgagaccgaagaaccgggctgtggcgctcggttcggccggtgcgctggtcacggcgaccctgatagccggcgccgtggcggcccccgcggcaagcgcggacagccgccacggccaggaccgcgaggcccggggcgcggccatcgccgcggaccgcgcggcccgggccggcatcgactggcaggactgccccgccgactgggggctggccaagcccatccagtgcggctatgtctcggttccgctcgactacgccgccccgtacggcaagcagatcaagcttgccgtcgaccgcatcggcaacaccggcaccaaggatgagcgccagggcgccctcgtctacaacccgggcgggccgggcggctccggcctgcggttcccggcccgggtcacctccaagaaccccgtctgggccaacgtggccaaggcctacgacttcgtcggcttcgacccgcgcggtgtcggccactccacgcccatctcctgcgcggacccgcaggagtacgtcaaggcgcccaagccggacccggtgccggactccgaggccgacaagcgcgcccagcgcaagctggcccgcgagtacgccgagggctgctacgagcgcaccggccgggccatgctccagcagatgaccacgccgaacaccgcccgcgacctggacgtcatccgcgcggcgctcggcgagaagaagatcaactacctgggtgtctcctacggcacctacctcggcgccgtctacggcacgctgttcccgggccacgtgcgccggatgctcgtcgacagcgtcgtcaacccggcccgggagaacatctggtacgaggcgaacctcaaccaggacatcgccttcgagggccgctggaaggactggcaggactgggtcgccgagaacgacgccagcttccacctcggcaccacccgcgccgccgtccaggccaagtggctcgagttgcgcgccaccgcgaagaagcacccgctcggcggggtcgtcggcccggccgaactgctcggcttcttccagagcgccccgtactacgactcctcctgggtgccggtggccacggcgttcagcaagtacttcgccggtgacccccagccgctcatcgacgccgccgcccccgacatgtccgacaccgcgggcaacatctccacggagaacggcaacgcggtctacaccgcggtcgagtgcaccgacgccaagtggcccaccagctggaacaagtgggaccgggacaacacccggctcaacgcccagtacccgttcctgacctggtccaacgcatggatgaacctgccgtgcgccacctggccggtcaagcagcagaccccggtggacgtcaagaccggcaaggggctgccgccggtgctgatcgtgcagtccacgcgtgacgcggccacgccgtaccccggcgccgtcgagttgcaccagcgcttcaagggctcccgtctgatcaccgagaaggacgcgggctcccacggggtgaccggcctggtcaacccgtgcatcaacagccgggtggacgcctacttcctctccggcaaggtggacggggcggacgtgacctgcggcccgcacgccacgccgaagccgtaaggacccggcgcgacacggtgaggggcggccggattcccggccgccccttcgccgtgccgccgccggtcaggccagcggcctgcgcgggaacttgcgggccctcgtgccctgctcggcggcctgctccgccttggcgaccgccgcgtaccggtcgacgtactcctgcccggacagcgacaggatggcgtacatgatctcgtcggtgacggcgcgcaggaccgccttctcctcctccatgccggcgtaacgggagaagtcgaggggctcgccgaagcggatgacgaccgggtggagcctcgggacgacgcggcccggcggctgcgcctcgaacgtgccgatcatcgcgcacgggaccaccggcacccccgccttgagcgccatcaccgcgacgcccaccttgcccttgtagaggcggccgtcgtgcgagcgcgtgccttccgggtagatgccgaggagttcgcccttgccgagcaccccgagcccctcccggatggcggcccggccggcttcctgccccgaccggtcgaccgggatctgcccggcgctgcggaagaacgcggccgtcagccgtcccttgaggccgggaccggtgaagtactcggccttcgccaggaaggtgatgcgccgcttgaggatcgcgggcatcaggaaatggtccgagaacgacaggtggttgcccgccacgatggccggcccagtctccggcacgtgctccagcccctcgatgcgcggccggaagaacagcctcagcagcgggcccagcaggacgtacttgagcaggtggtagaacacggttcgcccctcactcacaggcccgcgcgcgtgcggccgtccatgaccgcgcccggcgggacgcatcccggcccttcgactctactgacgcccggtcagccaggcgctccacacgagcggaccgatcgccgcggagaccggggccggtggctgccgcggtgctccggagcgggacggctgcgaccggtggcgcggtgcctgccgggtctcgcgtggccggcgtcgtacggtggagggcatggctcctccgcttccgggtccgctggagcacctggcaccgctgctcagtcactacggctacctggccgtcggtggcatcgtcctcgtggaggacttcggcatccccgcaccaggggagacgatcctgatcgcggcgggcgtgtacgccggggcaggggagctgaacgtggtcgccgtggccctgatcgcgttcgccgccgccgtcatcggggacaacatcggctacctgatcggccgctacggcggacgcgccttcgtgcaccggtggggcaagtacatcttcctgacgccggagaggttcgagaaggcggagcggttcttcacgcgccacggcggcaagatcgtcacggtggcacgcttcatcgaggggctgcgccaggccaacggcatcatcgcgggcaccaccggcatgcactggctgcgcttcgtcgccttcaacgcgctcggcgcggccctgtgggtggggctgtgggtctcgctctcctacgtcgcgggcacccacatcaacgccgtctacgacacgatcaagcggtacgaggtgtacgtgctggtggcgatcggcgtcttcgtcgtcgcgctgatcgtccggcacctgctgcggcgccggcggcagcaggaggcggactgagcgcccggagcgcgtgacccactgaggggcgggggcgccgcgtggtgcggccgggccctccgtacgatgggcccatgacgtccggcgcccgcacccgctccccggagcaccgtgcccgccggacgctgctcgtcctggccgtgctggccgggatcctggcgatgcacgggctggcgcccggcgggatgtccgtgccgagtcaccctggcgggaccccggtgtcgggacaccaggacgcgagcgcgatgaccatgtccgcgcaccgtgccggcgacgcccgccgtcatccggccggcgcggacgcgggcggcggcatggccgtgcac

SEQ ID NO: 1135 - DNA, 529 bp, Unknown
  Kingdom: Bacteria, Phylum: Actinobacteria, Class: Actinobacteria, Order: Streptomycetales, Family: Streptomycetaceae, Genus: Streptomyces
cggcggtggcggatctgcccggactggacttcgcggacgccttcgacgacctgggcaggcaccggcacgggcacgcagggtgaggcgtacggagcccggccccgcccctcccgctcccgcttcgccgttcgtacgcgggactcgtactgccgttgatacgcggggctcgtaccgccgttggtgcgcagggccgtaccgccgttcgtacgcagggcccgtaacgcgttcgtacgcgcgtccgtgcctatcgtccctgtgcggcgttcgtacgcctcgccgagcgcgccctccaggttgtccacaacgcccgcctcgtccacagcttcccgtcgtcgggggtgtgaacgactaggctcgcgcccgtacaggacgagccgtaaccgggagacacccagatggccaagaagcgaccccagacgaaggccaagcgcccgcagctcacggacggagagatcccggtggtcggcgcccgcgagccgtgcccgtgcggcagcggccggcgctacaaggcctgccacgcccgggccgc

SEQ ID NO: 1136 - DNA, 4211 bp, Unknown
  Kingdom: Bacteria, Phylum: Actinobacteria, Class: Actinobacteria, Order: Streptomycetales, Family: Streptomycetaceae, Genus: Streptomyces
cgccgggtcgaccgcctcggcgaccagggcggactgcgcggcgtcggccacgacgcccagggcgccgtagaggaacagcaccgcgtacaggagccataggcggccgggggagccgagcgccaggaggggcaggagcagggccgcgagcagcaggttcacgctgatcagcaggggtttgcgacgggtacggtcggcgagcgcgcccagcgccggcccggccggcgtcggcgcccacatcgcgaccaggcacagcgcggccgacccggtggagccggtgaggtccttggcccacacaccggacgccagccacagcgcggacgtgccgaaaccggagatcaccacggccgtcaggcacagcgccgcccgccggtcccgcaccacccgcagcagcggcggcaccctcatgtcactcgtctcgtgcgtcgtcatgcctgccgatcgtgcgtctgaggccccgccgcgcggatcgggcaggtgccccggtttccgcgccggacggcgggcatccgacgcgcccggcccggtcatcctcctgagggccgccgtccggagcccccgatgagttccgtcggcggaggcggtctgcacctgcgagggaagacatccgcgcgacaccgaggagcagaccatgaccgaacagaccttcgatctcggcccgcaggcccgcatcgtggcacggttggcgcaggcggtcggcgaggacggcctcgctgccccgacaccctgccccgacctggccgtccgccatctgctggcgcacctgctgggcctgtccgtggccttccgtgacgcggcccgcaaggacctgggtcccacgaccgacaccccgccgaacaccaccgtgcccgacctcggcccgggctggcgcgaggaactgccccgcgcgctcgacgacctcgccgaggcctggcgcgacccggccgcccggaccggcatgacccgcgcgggtggcgtcgacctgcccggtgaggtcgccgccgccgtcgccgcggacgaactggtgatccacggctgggacctggcccgcgccaccggccaggcctacgagccggacccggccgcgctgcgggccgcgcacggcttcctgcgcgccgcggccgagcagaacccggagcaggacggcggcatcttcggccccgtcgtcccggtccccgaggacgctccgctgctcgaccgcgcggtgggcctcagcggccgcgacccgcactggaagccaggcctggcctgagcggccgcgatccgcgctgccgtcgcacccctgaccggccgtcacgacaagtccccgggttctctccgtcagaagcgttgaccgaaacacggcgcccctcttgccgaccgccccgcacgcagacgagaacggctacgcgggaggcgcacgcgtacctgggggaccgggcgccgtggcagcgctgccgacggacagccggccggatcggggccggtgcccggcgggcgtccgctgccgtccgccggacgggcgccgctagatatcgatcaggcaacgagactcgcgtccaccggggtgacgcgcgtagaaacctgtcatgaataagccactgcgtctcgcggcgatcgccgccacctgcgccctcgccggcggcgccctctacggtgccggcgccgccaccgccgggcagtcgaccgtcaactccacgcacgagccgtacaacatcggtctgctcaccaaggacatcgacacctactacggcaccacgctggacgccgagggtgtctaccaggcctcgccggacagcccgtacgcgaaggacctggcgcggatcgactcggaggccaggcggcagatcgaccaggcggcgcgggcggcccggcatgggcaccacgggaagaagccggccgtcgtgttcgacatcgacgacacgctgctgctcagcctggactacgagaagaagaacaactacggctacaacggcaccacctgggccgcctacgtcgacaaggccgaccggccggaggtcttcggcagccccgagctggtgcggtacgccgcgaggaagggcgtcgccgtcttctacaactccgggctgagcgaggcccagcgctccgccgccgtggagaacctgaagaaggtcggcgccgacgtgaacctcgacgccggccacatgttcctcaaggacgcggccaacccgccggcgtacctgagcggctgcgccgcgcccggcgcctggaagtgcaccaccgtgcagttcaagtccggcacccgcaagcacatcgagagcctcgggtacgacatcgtcgccaacttcggcgaccagtactccgacctcgagggcggctacgccgaccggacctacaagctgcccaacccgacgtacttcgtcggctaggacggatcacgggtccgggcacgggggcgcccccgtgcccggacccgcccggcccgtcagcccttcagcgcggcctgcatcatcgcgcgggccaccggcgccgccagcccgttgccgctgacctcggagcgggccgcgtccgactgctcgacgaccaccgcgaccgcgacctgcttgccggtggcgtccgaggtgccgtacgaggtgaaccaggcgtacggcacctggctgttgttctcgccgtgctgcgccgtgcccgtcttgccgcccaccgtcacgccgctgatccgcgcgttcgtgccggtgccctgctcgacgaccgtccgcatcgccgactgcagctgggcggcggtggccgcgctgacgatccgcttgctgcccgggtcgtggtcgtagttctgcaacacgttgccgttcccgtccgtggtgcgcgacaccatgtgcggggagacgagggtgccgccgtgggcgatggccgccgacaccatggccatctgcagcagggtcgcggtcacatcgaactggccgatgccggtcagcgcggtctgcgccttgtccatcccggacgggtacacgctcgggtaggcccgcacgggcacgtcctgcgaggtgtcgtcgaagccgaacttctccgccatcgcccgcaccttgtcctgcccgaggtcgacggccatcttcgcgaagacgttgttgcaggagtactgcagcgcggtgcggatcgtggcgttctcgcagggcgcggaggggttctcgttcgccaggtcgcgggtcgtgcccggcagccggtaggggtccgggctgtcggtcttcacgtccaccgacgggtacagcccgtcctccagcgccgccgaggcgacgaccagcttgaacgtcgaacccggcggcagcggctggcgcagcgcccggttcgtcatcggcttgtcggggtcctcggtgagcttcttccaggcggtgccgtcgccggtgctgagcgcggtcgggtcgtacgacggtgtggagaccaccgcgaggatcctcccggtggccgggtcgatcgccacggcggcgcccttcttgtcgccgagcgccttgtaggcggccttctggacgtccgggtcgatcgtcgtgatcacgtccccgggcgtggcccgtcggccggtgatggtgtccagcgggttcttcagccggctgtccgagccgttgaggaggtcctggtagaccccctccagttgggtcgcgccgtagacctgcgagctgtagccggtcaccgccgagtacaacttgccgttctcgtacgtccgctcgtacttgaggtcaccgctcgtggtcggcgcggaaccggtgacggcgctgccgcccacgatgatgttcccgagcggctgcgagtacgtcgcgatcgccccgcgccggttgtccttgtcggccgcgagcgcctcgccgtcgtagaactgcacccacgtcgccctgagcagcagcgcgaacacgagcagcagcgtgaagacggacgcccgcctgatcgtcttgttcatcccgttcatcccagtcatcccggtcaggacgacgagcggaacggagtgaatcgttcctgttccgccgttttctcatcgcatgttcatgaaccccgtctcctgcgcggcgatgacggcctcggtgcggtcccgggcccaggtcttcgccgggacggccgccacgtgcgccttcacagtggccggaccggcccccatccgccgcgcgacctccgcgtcggtcagccccgccgccatcagccgcagcacctcgccctcccggccggtcagccgtgccacccagggcgcgggggcgccgcgcgcgtgctcggcggcaagggcgcgcaccgccgcagggaacagcagggtgtcgctgtccgcc

SEQ ID NO: 1137 - DNA, 744 bp, Unknown
  Kingdom: Bacteria, Phylum: Actinobacteria, Class: Actinobacteria, Order: Streptomycetales, Family: Streptomycetaceae, Genus: Streptomyces
accccgcgagccaggccatggtgcgttcgattgtccagcggtgtcggcccaggcgttggctggagtctgttcccttgcgggcgatccgtggcgtgatgtggcggctgcgtaaccaacggcgcaggtggttgtagtcgtaccccttgtcgccgtggagctttcctggccggcgccgtcgtcgaccgcgccgggagcggatcggcggtatgccttgcacgagtgggatgagggcctggctgtcgtggacgttggcgccggagatgccgacggacaggggcagaccggtgcgttcggtgatcaagtgaatcttcgagccgtacttgccccggtccacaggattcgggcctgtcagctcccccttttgagggcccgcatgttcacggagtcgatcgcgcagcgggaccagtccagctcaccgcgagcacccagctcgtcgaggaccaggcggtgcagcttcgcccatactctggccttcgaccattcggtgaagcgccgatgagccgtggctcccgacggtccgaacgaggcggacggcagctgctgccacgtgcagcccgacgtcgcgacgaacacaatcgcggccagcacttcccggtccccgtgccgacgccgtccaccgccttgcggacgagtcggcgcctccggcacgacccgctggaacaactcccacagctcatccggcaccagccgctcaacgatccccacacccgcaggctatcgaacatgccaaatgagatgccctgt

SEQ ID NO: 1138 - DNA, 1119 bp, Unknown
  Kingdom: Bacteria, Phylum: Actinobacteria, Class: Actinobacteria, Order: Streptomycetales, Family: Streptomycetaceae, Genus: Streptomyces
aggcgctgcgcacccggtacgccgaggccgacggcgagccgcggcagttcgtgaccgaggccgcgcccgtaccgctggcagagatccgcaccgaccgcgaaggcctgcccggccacctcgccacgctcctcggcaccggattccgcctggacagcggcaacctgctgcgggccgccctcgtcacgctcgacgacggcaccgccctgctcgccgtcgccatgcaccacatcaccacggacggctggtccaccgccgtcctggaacgcgagttccaccaggtgctggccgccctgcgcgcaggcgacacccccgagctgccccggctcgccgtccagtacgccgactacgcggtctggcagcgggaacagctcaccgccgacgtggtggcccgcgaactcgcccactggcggaccgtgctggacgggcaccagccgctggcgctgcccaccgaccacccgcgcccggccgtccgcgacggcgtcggcggcatcaccccggtcaccgtcgacgccccgaccctgaaggccgtcgacgcgctcgcccgcacccacggcaccactcgcttcgtcgtcctgctcaccgcctacgccaccgtcctggcccggcacagcggccagtgggacctgccggtcggcacccccgtcgcaggccgcggccggcccgaactcgacggtgccgtcggcttcttcctcaacaacgtggtgctgcgctgctccctcggccccgacctcggcttcggcgccgccgtgtcccgcctcgccgccgccacccgggacgccttcgcgcaccaggacctccccttcgacctgctggtcgacgagctggtcccggaccgcgacctgtcccgcaccccgctctaccaggccgccttcgacctgcacggcgacgacttcaacggcgcggtcgacgacgacttcgagacggtccgcaggctgtggcggatcacccacaccgacctcaccctgctgctgcgcccctgcgacgcggacggcggcaccctggtcggcggcctggagtacgccaccagcctgtacgaggaggccaccgcggcccgtatcgccgccggcctgaccacgctgctcgccgccgccacggccgctccggacacctcgctcggcg

SEQ ID NO: 1139 - DNA, 8430 bp, Unknown
  Kingdom: Bacteria, Phylum: Actinobacteria, Class: Actinobacteria, Order: Streptomycetales, Family: Streptomycetaceae, Genus: Streptomyces
gcgcgaggccggcgggcgagtcggggccccgcgtgccggcgtcggtgcccgcccaggtctccagcgcgatgcggatcgcgtcggtggcggcggccgccgccagccgcacctcgagggagcgctcgtcctgccccacgagccgggcgagcaccgggacgagccgctcctcggactcctggttcacgcggtaccagaccgcccgcagcgccggatcgtccgccgcggcgcgcagcagcccgcgggtgcgcagcagtgcctggacggcttcctcgtcgggcgtggcgagcgcctgccgggccgcgttctccagcgcctgctggaggggggtgccgggttcggcggcctccagcagggaccgccagcggacggcgccgtcggcgagcagcggactcaccgcgtcctgcttggagcggaagtaccggtagaaggtgcgcagcgcgacccccgcgcgcccggcgatctcctcggccgtcgtgccgtcggggccccgggtggcgaagagttcggccgcggcgtgggcgatgtcgagctgggtggcggccttgcggcgctcggtcagggtcgcggacggcttggtgctcacccgcagaagcctacgccccggaggtggtgttcggcacgttgcgacggtgtggcaaaacgtgccattgaggcgtaccgtgacggcatcgggagcgtcggcgggccagagagccggcgccgcagggtgccgtcggtgaccggcgggaccgggttggagacacacgcatgaaccgctatgaaggccgccgcgcgctgatcaccggcggcggctcgggcatcggccaggccaccgtgctgcgcgtcctcgcggagggcggcaccgtcgtcgccgccgacgtcagcgagcggggtctgcaggacaccgtcgcgaaggccggcgcccacgcggaacggctcacgacgctcgtcgtcgacatcgccgacgaggcgtcggtacgcgagggcgtcgccgcggcgctcgccgcgctcggaggtctggacgtgctggtcaacgcggccgggatcctgcgctcctcgcacacccacgagacgtccctggacgccttcacccgcgtgctccaggtcaacctggtcggcaccttcctggtgatccgcgagtgcataccggcccttctggagggccgggacgcggcggtcgtcaacttcagctcgacctcggcgatgttcgcgcacccgtacatggcggcgtacgcggcgagcaagggcggcatccagtcgatgacgcacgcgctggccgccgagtacgcggggcgcggcatccggttcacggccgtgcagccgggttccatctcctccggtatgacggacggcagcggcgccagcgggcagagcgcgggcccggggctgcccgaggacgccgacatgagcctgttcgtgaagctcgccccggcgctcggccagggtttcgcgggccccgagacggtggcgtccgtggtcgcgatgctcgccagcgaggacggcaagttcatcaccggcaccgaggtccgcatcgacggcggcacccacttctgacgggccgcccgccgtccgcgcgggcgcgcgcccgcggagaccacatctcaaggagcacaacatgaacgacctcaccggcaagaccgtcgtcgtcaccggcggagcccgcggcctgggcgccgaggcggcgcggcaggcggtcgccgccggcgcccgcgtggtgatcaccgacgtacttcagagcgagggcgaggccaccgccgccgaactcggcgccggtgcccgcttcctgcggcacgacgtcacctcggagcaggactggcaggcggtcgccgacttcgccgtcgcggagttcggcggcctgcacggactcgtcaacaacgccggcatctcgaccgggcagctgctggagtccgagtccgtcgagcacttccgcaaggtgctcgacatcaacctcaccggtgtcttcatcggcatgcggaccgtgatccccgcgatgaaggaggccggcggcggttccatcgtcaacatctcctcggcggcgggcctgatggggctcgcgctgacggccgggtacggcgcctcgaagtggggcgtgcgggggctgacgaagatcggcgcggtggagctgggcacggcccggatccgggtcaactcggtgcaccccgggatgacgtacacgccgatgaccgcgtccgtcggcatcgagcgcggcgagggcaagtacccgaacaccccgatgggccgcgtcggtgagccgcacgagatcgcgagtgccgtcgtgtacctgctctccgacgccgcgtcgtacgtcaccggtgccgaactcgccgtggacggcggctggaccaccggcccgacggtgaagtacgtcatgggtcagtgaacccgggacgcggacggatgcggggcacgcgcccgtagggtgaaccgtcacttgtgtccgctccgaggggaactgatggtgcgcaatacaaggatcgtccgctgtgccgccgcctgcgcgtcggccctgatgctcagcgccccgctcgccccggcggcctccgccgacggcggcccggccggaccgaatcccgccgcggcccggctcgacgcctactggaccccggcccggatggcggcggccctgcccggcgacacggccgagggcgccgaggccgggccggccgccccggccgccgcgtccgcggtggacgggccccggcccggcgagtacatcccgcccagcagaagcttcaccggcataccgcaggccggcaccttcttctggaccgacgccaccggcaccggccgcacctgcagcggctccgtggtgcgcagccccggccactcgctggtgctcagcgccgggcactgcctgaagggctacgccggtacggcgcccgagcggcacctggccttcgtgccgcggtaccacgacgggctcaagccgttcgggctcttcccggtccgcgtggacggcgtctacgtcccgcagcagtactacgacttgggcgcccgcgccggcgcggagtacgacgtggccctcgccgtcaccgagccgaacgaggacgggacgccgctccaggacgcggtcggcggggtccagttgctcaccgggaccggctacctccacgcgcccgtacggatgatcggctacccggcgggtgcggcggagccgctggagtgctggagctggacgacggcctgggtcagtgacgacccggccgaaccgggcacgttcccgcgcatcgcctgcgacgcgttcgtcggcgggacgagcggcggcccgatgctggtgccgtggttcggcggctgggcggtggtcggggtgatcggcggctaccacaccggcggcaacacctcgcaggtctcctacagcgcctacttcggcaccgccgtcagcgcgctctaccgcgccgcggtcaccggcgccccgccggccggcccggcttcctgaaccactcccctgcccgggaggcaccggctccccgggcagcgagccggagccggaccggtcaggccgtgggggctccggcgcgggcggcgtccaccagggcgcgcagacaggtcatgaacaggcggtgcgttccgctcgcgtcctcgttctgcaggacggtcgcgaagtactggctgagcgcggcgccgacggcggctccgacgacggcgttcatcggatggtcggcgggcaggccggtggcggcggccagggcggggccggtgatgcgcacggcctcggtgatctggctgctgccgtgcgccctgagcgccgggttggcctcgtacatcgcggtgagcagtgccacgacctccgggtccagcgcgtcggcctcgcccttcagccaggtgtcgacgacgtcgaggaacccggagtcgggccggtccttgaagacggcggtgagccgggacgcgatctcgtcggggacggacagggcgatgtcgtgcttggtggggaagtacagggagaccgtgcgcggtgcgacgtcggccgcctcggcgatgtccgcgatggtcgtcccgtcgtagccctgctcggcgaacaggcgcatccccgagcgcctgatggcctcacggcgtctggccttgctgcgctcccggtgggacgtggacgccctcgtctcgccagtcatggccgtagcgtagtcggaccggcgggcgagagcggccggtgcgggtcacggccgctcccgtcccgcggcgccgcctactcctcgggggcgatgcgggcgctggtgtcgcggtgggtcaccaggatggcctccatggggcaggactcggcggcgtcgaccagttccggcgcgggcccggtggtctccgacgtcgggtgcgaggcaccgtcacggacctggaaccgcccgggtgccacgcccgcgcagatgccggtggccatgcacgccttctcgtcgacctgtacgcgccaggcgccctcgcccggcccctgagccgtgccggagtcccgccgcgcgcggtcgccgtcccggccggtcatgccgcgtcccaggtcaccagcatcttctgcaggcccttcacgccggcacccgccttccacacgaggtcctcgccggtgccggccggccgcagccccggcaggcgctccagcagggtgcgcagggccacctgcagttccatccgggccagttgggcccccaggcagtggtgcggtccgtggccgaacccgacgtgcgacgcctcctggcgggtcaggtcgagcttctcggggcaggtgtagacggcggtgtcgcggttggccgacgcgttcgaggcgacgaccggttcgcccgcgcgcaccactccgccgctcagttccacgtcctccagggcgtagcgcgcgaccccgccgctgcccagggggacgaaccgcatgagttcctcgacggcctgcggcacgagatccaggtcggcacggagccgggccagttccgaggggtggtcgagcagcgtgtacacgaagttggggatctggctggcggtggtctcgtggcccgcgacgaggacgctgacgcccatggcgaccagttcgtcctcggagagccggtcctcctcgtcgcgcgccgccaccatcactccgagcaggtcgtcgcggggttccttgcgccgctcggcgaccagtcccgccatgtaggcggagagttcgtcggcgtagcgttcgacctcctcggggctgaagcgggtggtcgacagcagggcgtccgaccacaggcggaaccgtgtccggtcctccagcggcacgcccagcagttcgcagatgaccgtgacgggcagcggcagcgcgaagtcggcgaccaggtcggagggcgcgcccttgacggtcatcgcgtcgacgagtccgtcggcgatcgcctgcgcccgcatccgcagctgctccacgcggcgggcggtgaacgccttggcgaccacccgccggagccgggtgtgctcgggcgggtcgaacgccaggatgttgccggccaggccccggtggtaacgcgtcctgggttcgtcgcgggccaccgcctcggcccggctgaaccggggatcgccgagcacggtcttcacgtcctcgtaccgggtcaccagccaggcgggctcgccgtgggccaggcgcaccgggcacatcggttcgctgtcgcgcagctgctcgaaccgcggctcgatgcacagctcgtcggtctcgtggaacggaaacgcctggggatcgctgatggccatgaggtgccgcctctcgtgggggaaaccatctgcaggggctgtccgtacgggcgggaggccgaggccgaggtccgccgatccgtcgtgcggtccggcagcagggcgcctcagccgcccggagcatcacatttcgtccatattcgaaccgtaagcaatcttgcagagcaccgcaatattgctttcggacgcattccggtcggcgaaacgagccgaggtcggcgaggaatgagctgcgggccgacgggggcaggccggcacgtaaggtgtgagcgttccgatcaagccatgacaggcggtccgccgccgcgcgcccccgatctgcccgcggcaggcaccgaggaagctggagtcacgtgaccgagaccgaggtcgtcaccgcgccccgtcccctgctgctggacgacggccggcccgccgccgcggcctggtccctcgatcccggcctgctccacctcaaccacggctctttcggcgcggtcccgctggtcgcccagcagcggcagaacgcgctgcgggccgagatggagcgcgcgccggtcgtctggttcccgcaactgcccgcacggatcgccgaggcgcggggcgctgtcgcacgccacctgaggaccgaggccgcggacctcgcgctggtgccgaacgccagcgcgggcgccagtgtcgtctacgccgccgtgaccgcgcacccgggcggcgacgtcgtcgtcaccgaccacggctacggcgcggtcaccatgggagcggaacgcctcgcccgccgctggggccgccgcgtgcgcacggcccgggtgccgctggcagctgacgccgaccaggcgtaccgggccgtgatggcggaggtggacgacggtgtcgccctcgtcgtcctggaccagatcacctcggccacggcgcgcaggctgcccgtggagcgggtcggggcagagctggcccggcgtggcatcacgctgctcgtggacggcgcgcacgcacccggcctgctggccgccccgctcgacgggctggtctgcgacgcctgggtcggcaacctccacaagtggggctgcgcaccgcgcggcacggcggcgctggtcgcgcgcgggccgctgcgcgagcacctgtacccgctgatcgactcgtgggccgcccacgagccgttcccggaccgtttcgaccagcagggcacgctggacgccaccggcccgctcgccgcgcccgcggccctggacttcgtcgaggccgcctggggctgggacacggcccgccgctacatggacgaactggcggactatggtgcccgtgtggtcggcgcggcgttcgccggccccgcggggcggaccgagggcgtcgaggtcggcatgcccgtgcccgggatgcgtctggtccgtctccccgagggactgggcgccagccgcatcgccgcggacgccctgcgcgaccgggccaccgtcgagctgggcgcggaggccgccttcaccagcttcgacggtgtcgggtacctgcggctgtcggcccacgtctacaacactcccgccgactacgaccgtttcgccgagtcctgcgtcccggtcgtgcacgagtgggcccgccgggcccgcaccgggagctgaccagcaccgactggaactgacgggcaccgactggcaccgactggcaccgactggcaccgactggcaccgaaggccacggtttcctgaaacctgcccccgtgatcacacgtcttccccaccgaacggcgaacagcggccgggcgaccattcggtccgtttcgatccagtcgatccagggggagacatccatgcgcacacgatcactcaggtcctcgcgggcgggcgcgcggggcgcggccctcgccaccgcactcgtcgcggcgggcacgctcctggcggccggcgccgggccggccgccgcggtgcgcggaggcggttcgacgaccaccgcggcgcatccgtacaccatgctgatcgaacgcgacggcagccagttctgcggcgggacactcatcgcgcccaccaaggtgctcaccgccggacactgcgtgaaggacgccggaaaggtctcctcgctgcgggtgatcggcggccggacccgggtcggcgacaccggcgggaccgtgcgccgggtgtcctcctaccggctcgacccgcactacggctcgcccggcgtcgcgcacgacgcggcggtcctcaccctcgaccggccgatgccgtaccggacgatcccggtggccgggccgcgggacgccgctctggtcgcccgcggccggacggcgctcgccctgggctgggggcgcaccggtcccggcgtcgaggccacccgcctgaagcaggcccagctggtcctgtccccgctcacccgctgccggccctacaccgacgccggtacgagccccgcccagatgctgtgcggcatgccccggcccggccgctccgacagcatctgcccgggtgactccggggggccgctggtcagcggcggcaagctcatcgggatcgtgtcggccggcaacaagtactgcgacggccagtacccggtgtctctcttcgtgcgcgccgacgcggcggcggccgacctcggtatccgcacccgctgacgccgggacagacccggccgctccccgcacgcgctccgcgcgtggcgcgggtcagccgggccggtggccggggcccaggtctgcgtgggcggtcgcggtgccgtcggcgatgacgacctcggtcgcgagggacgggccgtcggcgacggcgacggtgtacgtccccggcaggagaccggcgaccgcataggtgccgtccgcggcggtcgtggccgagg

SEQ ID NO: 1140 - DNA, 1002 bp, Unknown
  Kingdom: Bacteria, Phylum: Actinobacteria, Class: Actinobacteria, Order: Streptomycetales, Family: Streptomycetaceae, Genus: Streptomyces
cctgcaccagcacggccgtgcggccggccgcctccggttcgttcttcgccagccagcgcagcttcgccaccggctgcgcggcctgcggcacacagccgacggcctgcgcccacgcctcccggccgccgagcgagtcgatcagatccgccgcggagacctgggcccggcggtcgccgccgaccagcgccggacgcaccgtggcgcccttcccgtcgagcgggaccagcgcgttctgctgcgcggagacgccgatcgcctgtacgccctccagcagtccgccgcccgcggcctccccgagcgagagcagccaggcctgcggatccacgtcggcaggacgcccgcctccctcggggctctccaccggatgcggcgcgtagccctgccggagcacggctcccgtgtcggtgtcacagaccacgatgcgtgtgaaatcgggcgaactgtccaacccggcgactatccccatgccgaaaattctgccgcatcccggcacccgcgtggggcgggggccggatggtcgccccgttcccgggttcaggtgttgctggtgccccagtcgtcggcgccgttgccgcccgcgcgctcgcgcagggaacggacccgctgggcgaccgagtcggggacgcggtcgccgaccttctcgctcaccgcgtggtacgccttgcccgcgaactgccgcccctgctgcgcggcggtctcggcggtgttgcgcacggccgggttctgcgccacctggcgcgcggacttccggagctgctcgtagcgctcacgtcccgccttggtgcccagtacgtaacccacggccagccctgcgatgaacacgagccggtagcgcatggtgccacccttccttgcctcgacgtcggagcccgggggaaccgattggcggagcacccccctgcttgcgctaatgtatgtgtcgcagcgagcgcgcgcttcccggggactaccccggaagacgcgttcgatgcgacgaggcattcctccgtagctcaattggca

SEQ ID NO: 1141 - DNA, 1162 bp, Unknown
  Kingdom: Bacteria, Phylum: Actinobacteria, Class: Actinobacteria, Order: Streptomycetales, Family: Streptomycetaceae, Genus: Streptomyces
agttcgtggtggcggggtggtcgcccgcggagtcctcggcgatgcgttcgtggtggcggatcacttcggcgatgatgaagttgaggaacttctcggcgaaggcggggtcgagtttggcgtcctcggcgagggcgcgcaggcggccgatctggcgggcttcgcgggccgggtcggcgggcggcagctgatgggcggccttgaggtggccgacctgctgggtggccttgaagcgttcggcgagcatgtggacgacggccgcgtcgatgttgtcgatgctgtcgcgcagccgtgcgagttccttgcggacggcggggtcgacgtcactgttaccggtgctgctggtggtcatgggggtcaaccctacggggtggtcgcggtcctgatcgggggtgtccggtgggcgggccgtgggcgggggcaggacctacagtgagagagggctgagggcgtctttgggggtgcggtcgtggcggacggcggaccggtcgagcacgggttcccgcatctggagacggtgcgcgccgcgatcacggcgttgtaccggcggctgtcgtacgagacggtccggacgttcgcgacgagtgtggcgccggtggacgtggcgttctgcgacagcgacgatctgcatctgggggcgcagcgggtggcccgggagatggtgcggcactacgggttgccggatgcgcggctgatcgtgagtttccgggagatgacgcatgcggcgaatgtggagctgacggcggggcctgagtacttcgtggagttgaacgaccggttccgtacgcatcgccgggacatcggggcggcgctggcgcacgaggtgatgcacgtctatctgcaccggctggatctgtcgttcccggggacgcgggacaacgagatcctcacggacacggcggcgacgtatctgggtgcgggctggctgctgctggacgcgttccggcaggacggcgcgtcgtcgcagaagctgggttatctcacgccggaggagttcggttacgtgctggccaagcgggcgctgctgttcggtgaggatccttcgacgtggttcacgagtgcgcagggttatgaggcgtatgtgaagggtttggcgcgggcgcggggggacggtcggcagccgccgctgacggcggcgggctgggcgggccggcgccgctacgcc

SEQ ID NO: 1142 - DNA, 1469 bp, Unknown
  Kingdom: Bacteria, Phylum: Actinobacteria, Class: Actinobacteria, Order: Streptomycetales, Family: Streptomycetaceae, Genus: Streptomyces
  misc_feature (995)..(996): n is a, c, g, or t
atgccgggcacgaagcgggccccgcgggtgccgagccgccgggcgcggcccatggggacgacggccggggtgaggcgccgggcgatcgcgcgcagcacgtcgtcctcgcgggcgccgcgccggtcgatcttgttgacgaacagcagggtcgggatgcgcagccgccgcagggtgcgcagcaggacgcgggtctgggcctgcacgccttcgacggcggagacgaccaggaccgctccgtcgagtacgccgagcacgcgttcgacctcggcgatgaagtcgggatggccgggtgtgtcgatgaggttgacggtgacgtcgtccaccgggaaggagacgacggcggacttgatggtgatgccgcgctgccgctccagcgcgagggtgtcggtccgcgtactgccggagtcgacgctgccgagttcgtcgatcactccgacggagtgcagcagccgttcggtgaggctggtcttacccgcgtcgacgtgcgcgaggattccgaggttgagcaggtgcacagggcgtcatgtccttgtgaggggggcggattccttccgggatggacatggacgcagtgcgcatcggggctcctcgctggtgacggttcgtggcgactcgtgacgactgggtgacgtcgggtcgtacgcagtgcagcagaggcggccgtacgacagcaatcgattaacggtcaacgaacctcgtcgcaccactcgccctgcccggagcccggtcatagagtgacctacatcacgctggtcgctgatttccctcacgtatgcccattcggtctctggagggcccatgacccacatctcggtcacggtggacggcacgacgtacgaggacgaggtcgaaccccgtctgctgctggtccactacctgcgtgaccggctcggcctgaccggtacgccgatcggctgcgacacctcgaactgcggtgcctgcacggtcgaactggacggcatgagcgtcaagagctgcacggtgctggccgtccnncaacctgtgccggtgcaccggctaccagaacatcgtccgcgcggtgctcaccgtcgccgaggaggctccggagagcacctccgcggcagcgcaggaggtgacggcatgaccgaccaggccgtcgagggcgaggtcggccgggcccggctgcgcaaggaggacgcgcggctgatcaccggccagaccacctggaccgacaacatctccgtcaccggactgctgcacctggcgttcctgcgcagccccatggcgcacgcgcgcatcgagcggatcgacgtctcccccgccctgcgacgccccggtgtggtcgccgtgttcaccggccgcgacctcgccgacggcctgggctcgctgccctgcgcctggccggtcaccgaggacatggtgctgcccgaccacccgccgctcgccctggacgaggtccggcacgccggtgacccggtggcggtcgtggtggcccgcgaccggtacgc

SEQ ID NO: 1143 - DNA, 3219 bp, Unknown
  Kingdom: Bacteria, Phylum: Actinobacteria, Class: Actinobacteria, Order: Streptomycetales, Family: Streptomycetaceae, Genus: Streptomyces
ggtgcgccatctgtcggcggcggtacggcggctgcgcacggccggtgccgaggtggtggtcggcacctgtcccgacctgggcacgatcgagccggtgcagcagccgctgcgctacctggcccggcgcgcctcacggcagctggcggcggcgcagacgatcgggacggtggagcaggggggccgcacggtgtcgctgggcgacctgctgggcccggagttcgcggccaacccccgcgagctgttcggccccgacaactaccacccgtccgccgaggggtacgccacggcggcgatggcggtgctgccgacggtgtgcgcggcgctcgggctgtggccggccgaggaggaacggccggacgtgtcgcggcgcgaggggttcctgccggtggcgcgcgcggcccctgggccctgctcaaacggcgccgccgccggcgcgtgccggaaccccagccgacgcaggtcaccccgtccgcgtgaccgcgtcgccacgaaggggcgcctcaggcacttcaggcgcccccagaccaaagcaagcgcttagaaaactgcggtcagggtcacaccgccattcccgtgaccaggaccatacgtacgggtaacttcccatccagccctgcccgtccatttcccctcccgtggagccgtgatgcccgaagccgtcatcgtctcgaccgcccgctcccccatcggccgcgccggcaaggggtccctcaaggacctgcgccccgacgacctgaccgcgacgatcgtccaggcggcgctcgccaagatccccgagctggacccgcgggacatcgacgacctgatgctcggctgcggtctgcccggcggcgagcagggccacaacctcggccggatcgtcgccgtgcagatgggcatggaccacctgcccggctgcacgatcacccggtactgctcctcctcgctgcagacctcccgcatggcgctgcacgccatcaaggcgggcgagggcgacgtgttcatctcggccggtgtcgagatggtctcccgcttcggcaagggcagctccgacgggctcccggacacgcacaacccgctcttcgccgaggccgaggcccgtaccgccgccgtggcccagtccgagggctccacctggcacgacccgcgcgaggacggcctggtcccggacgcctacatcgcgatgggccagaccgccgagaacctggcccgcctcaagggcatcacccgccaggacatggacgagttcggcgtccgctcgcagaacctggccgagcaggccatcaagaacggcttctgggagcgggagatcaccccggtgacgctgcccgacggcacggtcgtcggcaaggacgacggtccgcgcgccggcgtcaccatggagggcgtggccggactcaagccggtcttccgtcccgacggcctggtcaccgccggcaactgctgcccgctcaacgacggcgccgccgcgctcgtcatcatgtccgacaccaaggcccgcgagctgggcctgaccccgctcgcccggatcgtctccaccggcgtctccggcctgtccccggagatcatgggcctcggcccggtcgaggccagcaagcaggcgctgaagcgggccggtctcaccgtcgacgacatcgatctggtcgagatcaacgaggcgttcgccgcccaggtgatcccctcctaccgcgacctcggcatcgacctcgacaagctcaacgtcaacggcggcgccatcgcggtgggccaccccttcggcatgaccggcgcccgcatcaccggcacgctgatcaactcgctgcagttccacgacaagcagttcggcctggagacgatgtgcgtcggcggcggccagggcatggcgatggtcatcgaacgcctcagctgaccctcgcgccccacccgcacggccacttgatgcaccgtcagtggccgccatagcacccgctgtgagcgaacggcccggaatccggaaaactcccggattccgggccgttccgtgatccaatctcccccagagtgtgacctatctccctcggggaggagaactccgcaggtcagccatggcccctcaggcggctcaagcgtcccgcgagccacattcctgtccgtttcgtgacgttacgcactgacagctggatagtccacccttcaagctgatgtaggaagtcgggggtcgaccatgaacccgggagtacgtcagtgagcgccatgcccatcgccctgctgctcaccacggccgccaccggcgccgtgggcgtcgccgtcctgcgcaccgtcttcgtcctgcgccgccaggtcacggccctgcagaaccagctcgccgagaaccacgccgccaccgcgcgcgccctgctgcccgccgcccgcgctcacgcggacgccgagcacatacgcaccgccgtggtgcaggcgctcgcggaggagcgggagcgggaactggccgaggcgcgcgccttctgggccgcccaggaggcccgcgacgccgacacgccctccctgctcgggctgcccgacagcgagctgttcctgccgcgccaggccgacctgtcgggccttgagtacctggagccggtgaccgagtccggtgcggaggccgacgagttctccggactgtccggcaaggacgccggcgcgggcaccacgggtgactccgcggagctggccgcggcccgccgccgccacccctcgcacccggacttcaccccgcacccctcccccgtcgtcggcgaccacgaacgcaccgtcgccacgctggaggagctggccgacgcccgcgtggagctggccgacgtccgcccgggcccgctgggcaccctcgacgtgtacgtcttcgccgacggtacgacgctgtgcatgacgccgggtcaccgcgagaccgcggagcggctggcggcggccctgcagtcgggcgagtccccggtgctgctgggcggctcgggcgtgtccggcgcctacaccctgaccttcgcctgcggcgaggagaacgtgtacatcctggcggaccgggtcatcgcctcactgtgaccggccggcaaccgggccgctgatcgcgcgcgggtgttcacacgcccgcgcgtttctgtgcctcctccaccagccgcaccgcctcctcgacctcggcctcgctcgtgaggacgagtgccagatcgtgtccggcgacggtcacctggtccgccgccgcgaacatcccggcgtcgggcatctcgcgcggctcggccgccggatcctccagcagtt

SEQ ID NO: 1144 - DNA, 4833 bp, Unknown
  Kingdom: Bacteria, Phylum: Actinobacteria, Class: Actinobacteria, Order: Streptomycetales, Family: Streptomycetaceae, Genus: Streptomyces
gcggaggcgctccccgttggtccgggcgacaccgccgacgccacgcgcaccggctgaccgacacggcttccctctcctccgccccaccgcgggccaccagctgccgacggcggtcagtggtcacggggccgagccgggtggcgcgggcgggcgccatcaggtgcggaagccgacgtgcacgtgctcgtgatgggtggcgtcgctgaagaactgaccgggaccgccgcccgacagcagtaccggaccacccacgttgcaggaaccggccgccgccgcgtcctgcctgaaccgctcgatcaggctccggggtgtcgccgggtcgacgaccgcgtgtccgtcgatccgccccacgtcgaaggcgcggccgtgcggatggtcgctgggcccgctggtgccgaacacgtccagtgggtgaccggagcgggcgacgctcaccccagccggtacgtccgcgccagcgcgagcatcgcctcggccacactggtgtgcacctgaccgctgcgcaggtccgccgtcgcggccggcgtgtgttggaggtcggcgtactcctgtacggcgggtgcggtgtcgatggtggccaggtaggcgctgggcgttttcacgaagacgggctgtacctcggctacgtccccggagacgggtgcggtgcagagcacgggggtggggtgcttggccgggcgccattgagcaggtgccgcagacctgccgggtcgcggtggccggcccactcggccagctgccaaccgtttttgcgtcccaccggcgccagcggcccgcggacgtagtcccgcatccgccggcgcagatcggcccgggcgaaccggcctgccacccgaccgagcgaacaccgactccaactcgccctgccaccggtcggcttcagctgtcgcctccatgcccggacgacgacaacgaccagctctggacacgaaatctcgctggagtactcaggtcatatgcctgacttttccgccgtcggttgacgggggtcgcctacctctattacgttccgatgcggatcggaatgttattgcacgttgtcagaggaggtcgcgtggaagcggttgtggtgcaggagtcgggagggctttccgtgagggaggtgccgcggcccgtgcctggtccgggccaagtgctcgtccaggtggaggcgatggggatcggctacgtggacgtcatggcccttcgaggtgactacggtggctttcccggcgtgggcgccgtgcccggcatggagatcgcaggccgggtgacggcactggggccggacgcgccggaggaaatggtcggccgacgggtcttcgccctgctgccccggttcggcggcttcgcccgcctggccgtcgccgacgtcggccaggtgctgccggccgcggcggactggaccgcgagggacacggtcgcgctgggcatcaacgcactcgtcgccgagacggcgcttgaacgggcgggagtctccgccggggagcgtgtgctcatccgcggtgcgggcgggggcatcggcgtgctggccacacagatcgcacgtgcacgcggggcggaggtcacggccgtcacctcctccgaggtccggggcgagctgctgcgttccctgggcgccgcgcaccttctcgaccggacggcttccgccgccacgctccccgagtccgcctacgacatcgtggtggacacggtgaccggccccgacctcggcagccacctcgggctcctgcggcccaacggacgctacgtcctgtgcggagcggcgggcggccctccggggccggacgccttcgcaacgctgctgagggacttccacaggtcgccagccctgttcgcccacagtctccgctccgcgacaggggaggagctggcccgttcctgggagcggatcgaggcgctgcgtgcggccggtcacctctcggctgtcatcgaccggacgtatccgctggcggaagcggcccgcgccgtggcgcacgtggcggagggcaggcccttcggaaaggtggtgctgatgtcccgataaccttgtacggcagcagcagtgggaaagggacccaggaaagcggtatggcgcgtacgcgggacgaacggatcgaccatgccgtgctgaccgcggtctcggagctccttgaggagtacggctatggggcgttgaccatggaggccatcgccgccagggccggcaccagcaagcccgccatccgccgccgctggaagagccagaagcatctcgtcgtcgacgccctggcgcacgatcgggtcggcgtcgtcagcatcgatacgggctgtaccgtctgtgacgtcgtcggacacctcgaggcgctgcgccggggattgaccgagccgaggttcgggcgcctgcttcccgcgctggtggcggacatcgccgacgaccgggaactccacgcccgtttcctcagtgtcgtgtgggaaccccgcagagaggcgtgcttgtggtccctgcgcaaggcggaagaacggggcgacctccgacccggcctggacgccgacctggtactggacctgttcgcggccccggtcgttttccgcacgcttttcgggcaccgtcccctcgcaccgaattttgtcgaggagatcgcacatgccgttctgaggggcgtgggaaccggcgccgatcaccgttgcgcggacgcttgaggcgatgtgacaagtgctgctcgcgcccggcgaggcagttcccgcacgcgcggcaggagtcgaccatgcagccgatgccgacgcgcggagccagcgccgcacggatgggccgtgcggtgctggcggagggggcgacgggttgagcgtgcgccccagagctccgatggcaggcacgcttgcgaatttcggctcgaaggcccagcggcaccggccagaccccttacggcggggccgacgcctggggccgggccggccgggcagcagggtcagcgtccagcccggctgcgggcatcgccgaggatctcgtcccgcgctggatgagcgtcccgcctcacaggccgagcgtctgcggagggtgcggcgcctcttcctgcggggctgcaagccggacatcactgccttgatcggcccccgttccccccatgaccagtcaaaaccaccgggacgccgaactgcgtcgccgggtgcggccgtggagcaccggctggacgtccggcggccgccccgctacctgccgtccacgtaggcgcgcagggccgacaccccgtagccgtcggtctggagcccgcgcagggacttcgacacggtgaaggcgagcgtcgggacgtagaccgggaccgccgcggcccgttccatcacgcggcggtcgacagccgaccaacgggcgccggcggtacggatgtccggggcctcgtcggcgtggtccacggccgcgtcgacacccgcgtccgcgagccgggaccagttgacgtgccccagaccctgggcgctgtgcgcgctgaagtagtccggcagcagggacgagccgacggggagggaggcggtgacggcctcggagccgaacacgtcgtacgaggccgtctcctggtagaacttctcgggtgccacggcaagcagggtgaccgcgaacccggccttctccagggactgacgcacgacttccgcctggccggcgccgtggaactggtccgaccggtaggccaccgtcagtttcctgccgctctggccggcccggtcgagcagggcgcgggccgcggccgggtcgccgtcgtcccccgccccgtacacgtcgaagtcccgggagcccacgacgtccggcggcagcagatgatgggtgaccgtccccgacacccccgaggcgcgcagcacctgcccggcggggatcgcggtggcgatggcctcgcggacggccgggtcggtcaggcgccgggtgttgacgaagtagctccgcgtgtaccacgccggggccgtgagggtccgcagccgcgcgtccgccggaacgctgtcccggccgagaggtccgccggtgaaggtcatcaccggcaggcccgactccgccagcgacagcagggtccttccggcggtggaggcgtcaccggtgctctcgaccgtgaaccggtcggggtatgccgtgcgcagcgggtcgctgtccggctgccagcgcgggttgcgcgccagctcgaccgtgcccttgccgtccgagagggcagccttcgtgattcggtacggcccggtggtgggcggtgcctgcgccgcgggcggcttcccggaccaggagcggggtaccggcaccccggacgggccggtgagggcgacgccgaagtcggcgcagggcgcggccagatggaagaccaccgtgcggtcgtccggggtgccgatcgccccggcgggcagcgtggcaccgctcatccgctcggcgcccgacagaccgagcagccgacggcgcatcaggtcgtcgttggtgctgaacgccgggtcgagggtgcgttccaccgcgtgggcgaagtcctcggcccgcaccggttcgccggtgtcgtagcgcagccccggcttcaggtggaacatccaggtgcggccgccgtcgctcaccttgcccggaccgtcggcgaggtcgccgacgaggcgcatgctgccgtccggcagcggcttcaggccggtgagagcgcggtaggcgagctggctcagtctgacgtcgcccgcggcctgcgcgttgcccgggtcgaccgtggtgagggaggactccaccaccgcgacccgcccgccgcgccgggcgccggtcaccgccggggccgggccccgggagtccgcggccgtgccctcggcgagggtctgggggtgcgcggcgggcgccacggtgccggccgtgccgtcgaagccgccgccggcccccgcaccgccgcgcacccccagacc

SEQ ID NO: 1145 - DNA, 630 bp, Unknown
  Kingdom: Bacteria, Phylum: Actinobacteria, Class: Actinobacteria, Order: Streptomycetales, Family: Streptomycetaceae, Genus: Streptomyces
  misc_feature (218)..(219): n is a, c, g, or t
ccgccgggggcacggacgacgtgcgggtgcgggttcgggtggagaccgggtagcggttgatctccaccctcggttccacccgtgggtccaggcgccgggagcctcctcgcagcagtcttgagggcatgacgccaaccgagtggatcaccgacatcgcgctcatcctcgtcgtcttccggcagctgcgggaagaccgactcgaccgcaagaccttcctnngcctacgtggcctactcgtacctggacaccatccccaccgcgggcaacgacctgatactgatcggggccctgatgggcgtgggtgccgcgctcggtgtcgccggtggcgtctacacccggatccggacggccggcgggcacctcatgatcaaggccggcgcggtctcggcgatcctgtgggtcgtcggcatgggagcgcggatgggtttccagctgtgggtcgagcacggcggcggtgccccgcacgtcgcccggttcagcgtcacccaccacatcaccggcgaccaggcatgggtggcggcgttcgtgctgatggccgtcaccgaagtggtcacgcgggtggccaccatctacctgcgcagccggaccggggcggcgacccgtcccgtgcccgtcctcgaccgtgcggtc

SEQ ID NO: 1146 - DNA, 2760 bp, Unknown
  Kingdom: Bacteria, Phylum: Actinobacteria, Class: Actinobacteria, Order: Streptomycetales, Family: Streptomycetaceae, Genus: Streptomyces
gggccgcctccagccggccgagtccgaccgcgaggtgcgccgggtccgcggggcacgcgccgtgccgtaccagggtcgggaccagctcgggcgtgcccgaccaggcggcctcgtccaccaggtgggccgccaggtgccacggctcgtggtccggtgtgcccaccagcagcagcccgcccccgtgcgacaccaccgagccgcgcagcgtccgcgcgaagcgccgggtggcgtccagccactcggtcccggcgagcacttcgcgcagcaacgcgacccgtacggcgtccatacgagcgcatggtgccccaaaccacggctccggatgcggagttcggcccggattcgcccgcaccggggacaccggcggacccggccgagcggccgtcgtgacgcggctcacgtgagcgggtgggcagcgggacgcggacgtagagtcggcccatgacctctaccgacagtgcacagaaggcccccgccaaggacccctgggacctgcccgacgtctccgggctggtcgtcggcgtgctcggcgggaccggcccgcagggcaagggcctcgcctaccggttcgcccgggccggccagaaggtgatcatcggctcccgggccgccgagcgggcgcgggccgcggcggaggagatcgggcacggcgtcgagggcgccgacaacgcggagaccgcccggcgcagcgacgtcgtgatcgtcgccgtgccctgggagggtcacggcaagaccctcgaagcgctgcgcgaagagctggccggcaagctcgtcgtggactgcgtcaacccgctcggcttcgacaagaagggcgcctacgcgctcaagcccgaggagggcagcgccgccgagcaggccgccgcgctgctcccggactcgcgggtcaccgcagccttccaccacctgtcggccgtgctgctgcaggaccccgggatcgagcagatcgacaccgacgtgatggtcctcggcgaggagcgcgccgacgtggagaccgtccaggcgctggccggccgcgtcccgggcatgcgcggcatcttcgcgggccggctccgcaacgcccaccaggtggagtcgctggtcgccaacctgatctccgtcaaccgccgctacaaggcgcacgcgggactgcggctcacggacgtctgagccgcccgcgcgcgacccggcacgcccgcgcaccggtcctgggcacgcatgggggacactggtcggcgaagcagtcccgagcagtgtccccgtgtccccgacaggagcccgccctcatgccccgcctcgccctctacgccctgatcgtctgcgtgctcaccgtggccgcggccgtcgtctccttcgtccagggcagctggctggggatcgtgtggatcctgctggcgggtctgtcgtccaacatgacctggtactacgtgcgccgtggccgggcggcggcccgcagcgggtccgtcgccagctgatcgtcacgaggtgatcaccgccgggtcgatcaccgccagttgatcgtgcacatctcgtccggcccctgccagaactggtacaggctccggccgcagtaccgctcgaagtccccgacgccgagatggcgcatgatcgcgtagatcacgtcgaagaacgcgccgtggaccgccggcacccacagcagcgcgaagacgaacagcagaccgaacggcgcgaagggctccacctgccgcttgaccccgtgcgacagccagggctcgatcacgccgtagccgtccaggcccggcaccggcagcaagttcaggatcgcggccgtgacctggagcagggcgaggaaggcgagcgcgtagcggaacgcggagggcacgccgtccagcgcgtgcagccagaacggagccgtgcacaccaccgcgaacagcacgttcgtcagcggacctgcggccgagacgagactgtgccgccagcggcccgggatgcggccccgctcgatgaagacggcaccgcccggcagaccgaagccgcccaggatcacgaagaccaccggcagcacgatgctcagcagcgcgtgcgtgtacttcagcgggttcagcgtcaggtagcccttcgcgccgaccgtgatgtcgccgctgtgcagcgcggtgcgggcgtgcgcgtactcgtgcaggcacagggagacgatccaggcggccgtcacgaacaggaactccgcgacccccggccgctcggcgaacccggtccaggtggcccacgcggtgacggcggtgacggccaggatccccaggaagacgggactgatccggcggtcgctgcggcgggcggtggcggtggtcatgggcggagcgctcctgagggcggtgtcggtgccgccgcgatcggcggctggggtcgaccgtaccggtggtgtggtcgaccgtaccggtggtgtgcggggaacgtcctgcggccgggttccggttcctggcggccgtcgaccgccggtcgtcaggcggtacccgaggaggcgaaggagacggccacggcgatcgccgaccagaccctgaggctcgattcctcccggttcgtacggatctgaggcgggcgcgcccggtcggggggaaaccccgggcggggtcgctgcgtccccggggacaatggaccccgtgcgctaccgcattctcggcaccacccaggcgttccgccccgacggcacccccgtcccggtcggcggggcgcggctgcgtgccctgctgaccgtgctcgccctgcggcccggacggacggtgacggtgcccgtcctggtcgacgaggtgtggcaggacgagccgcccg

SEQ ID NO: 1147 - DNA, 3245 bp, Unknown
  Kingdom: Bacteria, Phylum: Actinobacteria, Class: Actinobacteria, Order: Streptomycetales, Family: Streptomycetaceae, Genus: Streptomyces
gccatgcttcgtcgatgcgctcgtcggcggcggtcaccgcgcacagcagcagggcgccgaggctctccacgagcgcgtcgagcagttcgccggcggtgcagtccagcgggtaggcgcgccagcgtttgagggcgtccccggcgagcacggccccggactgcaggcggccccgcacgcgcgcgtgctcgccgtcgtaggcgctgtccacggcggagatgagccgcagggccgccgagtgctgtgcggcggcggcgccggccagctccggcatccgggacttgagcgagtcgagcaggccgtgggccgtgcgggccatcacatgttggcgggccgcgggatcctgcgcctggtggacgagccaggtgcgcagcggcgcgacggcggtggccggcagcagcccgccgccccaggccgactcgggcagttcgggcacggtgaaccggggtacgtcgccgagaccggccttggtgagcagggccccgtactgccgggagacctcggagacgacctggtggggcacccggtccagcacggtcacgagggtcgcgtcgtactccttggcggtgcgcagcaggtgccaggggacggcgtcggcgtagcgggcggccgtggtgaccatgacccagatgtccgcggcgcagatcagctcggcggcgagggcccggttctcggcgatcagggagtcgatgtccggcgcgtcgagcagggcgaggccgggcggcacggtctccacggtctcgacgcgcagcacgcgcgcgggctcctcatcgggtgccggcggttcgggcagctcgtcgacgaccggtccggctccggactcctggcggggcacccacacgcgcgcgaggtcgggcaggacgcgcattccgctgaaccagtggtggtcctccggatgacacaccagtacgggggtcctggtcgtcggccgcaggactcccgcctcgctgacccgtcttccgacaagggagttgacgagtgtggacttgcccgcgccggtggatcccccgacgacggcgagcagcggcgcgtcgggctccttgagccggggaaccaggtagtcgtcgagctgggcgagcagttcgtcgcggttggaccgcgcgcggggggcgcccgcgaggggcagcgggaagcgtgcggcggcgacgcggtcgcgcagggcggagagtgcttcgagcagctgaggccgtacgtccaaggtcaccacatgcgaagaatgcccaattttaggggaattctgaagcatatgagcatgtctgcgcgccgacggaacacaagggatggaacggacgactgggacgagggggcagcccaggcataacgagtgcacaacacccggtgcgcgaggcaccaaaagcggtgcacgattcgtacctgcctgcgattatcaggaccgcttcaccgaacctccacatcgagccacggaggcgaagcagcaggggcaaggacgcgggagccctatccttgtccccggcaacgtcacggaacggcccgcaccagggcggcaccacgacagaggccaccacaccaggcccccgtagctcagtggatagagcaggcgccttctaagcgcttggccgcaggttcgagtcctgccgggggcgcaaacgcccaatgaccagcggaaacgctggtcattttcctttccggccccctgcgcacagccatcaggccaagcgccttgaccctccaagcgtggagatcaggacgccgccgccggcctcgggcccggccgggatctccccgtctcctcgatcgcggcctacctcgacgcccggtggtgcggccagccggccaggccgctgccctcgggggcgcggcgggtcgcctcctcgacgcaagagtggaacgagtagacggcgtgcaggccgccggccttgaagactttgagtatgcgcggatcggcgcaggtcaggaccagtgaacccgcgttcgagcacaggcgcttggtgagcgccacgatcagacccaggcccatggagtccaggaacgtcacctggcacaggtccaggacgaagtgccggtgcccctcctcgatgagccggacgacagcctcgcggatcccgggcgacgagcagacgtcgacctcaccggtgacggtgacgacggtccatccgttcgccgtgcgccggtcgagaactccgttctccctctccaccgtgcgtcggtcgacgccgttctccggggcgggtcgatcgagggtggtgttctccggggtgggccgtggggcagtccgcactcttcgctctccgcctctctcgcatctctcggcgcccgttatgaggcgcttcatccagtagacgtttttagatccctttgccacaagagagtggttttcagatggtgagcgagagtcctcgcgtcacccggtccgccgccgcgagcagccgctcaccggcgctctggatcgcgcccgcccggtcaccgcccgcacgcagggagacgccgagcgagcccagggtgccgccccggtacacggggaccgccacgcagacgatcccgagggtgtactcctccaggtcggtgaccaccggggcgtcggggaaggcgtccaggcgccgcagcagttccgtgcggtgagtgatcgtcctgggcgtgaggtcggccagcgggtgccgggagaggtactcctggcgtgcctcgtcgtccagctcgcgcaggacgcacttgcccagcgcggtggcgtgaccggcatcctcgaaccccacccacagctcggcgcgcggcgcgcggggcccgtcgacgatctccgccacccggatctcaccgtcctcgtagaacgtgaggtacgcggcggccgacagctcgtcccgcagggaacccagcgtcgggcggacgcggctgagccgggtctgcgcgctgctgacgtcgtgcagggcgtccagccgctcgccgaggacgaaggagccgtcctccagtttgcgcacgtagccgtcgtgcaccagcgtccgcagcaggtggtaggtggtggcgagggccagccccgtctcgcgcgccagctgcttggccggcgcgccgccctcatgggccccgaccgcctccatcagccggaacgcccgctgcacggaggcgatgagcgtggggccttcctgcgcacccatacctccaccgtgcgggtgacgggcgcgctcggcaagcgcagggcaaggagatcgcaagcggaaggtaagcgcgggtggcgtcagcggccgggggaaccggccggccgcccgccggcggctcgcggccggcccccgccccccggccgg

SEQ ID NO: 1148 - DNA, 7439 bp, Unknown
  Kingdom: Bacteria, Phylum: Actinobacteria, Class: Actinobacteria, Order: Streptomycetales, Family: Streptomycetaceae, Genus: Streptomyces
ggcggcgaccgccggggtgaggaggtcgccgccctcgccccgggcgggcggctggtcgcgtacagctcgggcggcgggaccgtccaggcctacgacctgctcgtgggcgccaagtcggtcatcggcttccagatggcccgcatcgcccgcggcgagccggagctgtacgagcggtggcggcaggaactgtggcggctgttcggcgagggcgctctgcggccggccgtgcacgcggagttcgcactggaggacgcggcgacggcgcacgaggcgatcgagtcgcgcgccaacctgggcaaggtggtcctgcggccctgaccgggccctcggtcaccgaggacggggcgccgtaccggccgttcgcaccctggtcggtgacgccccgggcgcgcccgccggtgccgcgccctcctgcgtcgccggaacgcctgcgcccgaagcccgcgtctgcgaagcccgcccctccggatcgcgcgcctccgtatcacccacctccgaagccggcgcctccgtgtcgtgcgcctccggatcgtgcgacctgcgcttggcgatcaccgcgcacaccatgagctgcatctggtggaagagcatcagcggcagcacggccagcgaggcatgggcaccgaacaggacgctcgccatgggcagtccggaggcgagggacttcttcgaaccggcgaactggatcgcgatccggtcctgccgcccgaagcccagcgccctgccgccgtaccaggtcagggcgagcatcacggcgagcagtacggcctccacgaccagcagggcgccgagccgcagcgggctgacctggtgccagatgccgcgcaccatgccctcgctgaacgccgtgtacacgacgagcaggatcgagccgcggtcgacgagtccgagcaccttcttgtgccgggccacgaagccgccgatccagcggcgcagcacctgtcccgcgacgaacggcaccagcagttgcagcacgatggtgaccagcgagtgcgccgagaagccgccgccgctgctgccgagcagcgccgccgcgagcagcggggtgaggatgatcccgaccagcgaggagaaggaacccgcgcagatcgcggcgggcacgttcccgcgggcgatggaggtgaaggcgatcgaggactggatggtcgagggcacgagggtgaggaagagcaggccctggtagagcggctggtcgagcaggaacgggaccagtccgcgggcggcggtgccgagcagcgggaagaccacgaaggtgcaggccaggacggtgacgtggagccgccagtgcttgagcccgtccagcgcctcacgggtggagagccgggcgccgtagaggaagaacaggaaggcgatggcggcggtggaggcgccggaggccacgtgcgcggcgccgccgcgggccggcaggagcgccgccagacccaccgtcgccagcagcagcacgatgtacgggtcgatcggcatccaactcggccagcgcaggcgtttcacggtgctccacttgctcgtcgctcgtcactcggcgtcacggcaggaggaaccccgggttcccctctcctctcgtcccatcgtgcccctccctgcgctgatcgggaatccgtcacaccgctctcactgtcatcacgtgtcgtgatgagcgggcgtagtctgggctcgtgtacgaccccgctcagctgcgcaccttcctcaccgtctcgcagacgctcagcttcacgcaggcggcccggcggctcgggctgcgccagtcgaccgtcagccagcatgtgcgccggctggaggacgccaccggacggctgctgttcacccgcgacacccactcggtggagctgaccgaggacggtgaggccatgctgggcttcgcccggcggatcctggaggtgcacgagcaggcgacggcgttcttcaccggcacccgggtgcgcggccggctccgcttcggcgcgtcggaggacttcgtgctgacccggctgccggagatcctcgaggcgttccgctacgggcatcccgaggtcgacctggaactgacggtggagctgtcgggcaccctgcacgagcagctggccgccgggaaactggacctggtgctggccaagcggcgcccgcaggacccgcgaggggagccggtctggcaggaccggctggtgtggatcggcgcgcagcggctgcggctggacccggaccgtccggtgccgctcatcgtctacccgccgcccggcatcacccgggcgctcgccttcgaggccctggaacggcagggccgggcgtggcgcgtcgcgtgcaccagcggaagtctcaacgggctgatcgccgccgctcgcgcgggcctcggcgtgatggctcactcgcgcgggctgatcccgcccggactggtccgcgtaccggagcgggccgggctgccggagctgggcggagtcgacttcgtcctggtgcacggccgccaccgcccgtccgcccagtacgcggccgacgccctggccgaggcgatcctggcgggcgccgaaagcctgcaccgccgctgacccggcgctcctcgccggaaccgccgggccgggacctgcagggccgcaaacgccgtcgggggtcgtacagattcggtggagataccggcaccgaaacttactgaaccgtaagaaattctgtccgacccttacccatgtgagcgtattttccgatgctggcctgggcggacgtgagcggccctcgctttcgacccccctcccgccccgtgttcccgtggggtagctttcacggcctgtgcggagcgtcaccaacgcaccggaggctaaccggaccgagccggactgagagcgggagcggggtttgcgcgagttcaccagccctccgtcgacgtcggcaccgccggtgggcggcctggccgacgtcgtgttccagcacgcccaggacgacccgctgcacatcgcgctcggccgcaaggacgaggcgggccggtggcgcgacgtgaccgccgccgagttccgtgacgaggtgctcgccctcgccaagggcctgctcgcccagggcgtccgcttcggcgaccgggtcgccatcatgtcccgtacccgctacgagtggaccctgttcgacttcgcgctgtggaccatcggcgcccaggtggtgccggtctacccgacctcctcggccgagcagtgcttctggatgctctacgacgccgaggtgtcggcggcgatcgtggagcacgaggaccacgcgatgacgatcgccaccgtcatcggccggctgccgcgcctgggccggctgtggcagctcgactcgggggccgtgcaggagctgtacgacgcgggcgctcacatcgaggacgaggtggtgcaccggcaccgggaggcggtgacgccggagtcggtcgccacggtcatctacacctccggcaccaccggccgtcccaagggctgtgtcctcacccacggcaacttcatgaccgaggcggacacggtcatcgaccgctgggagccggtgttccactcccgcaagggcgacgaggcggcgacgctgctgttcctgccgctcgcgcacgtcttcggccgcatggtggaggtggccgcgatccgcggccgggtccgcttcggccaccagccccagctgcacgccgccgcgctgctgccggacctccaggcgttccggccgacgttcatcctcgcggtgccgtacatcttcgagaaggtgttcaactcggcccggcgcaaggccgaggccgagggccgcgccggcccgttcgagaaggccgtggacgtcgccgtgaggtacgcggacgcggtcgaggcgaaggcatggggcatcggccccggcccgtcggccggactgcgcatgcagcaccagctcttcgacaagctggtgtactccaaggtgcgcgcggcgatgggcggccggatccgcaacgcgatgtccggcggctcgggcatggaccggcggctcggcctgttcttcgcgggcgccggcgtgcagatctacgaggggtacggcctgaccgagtcgacggccgccgccaccgccaacccgcccgagcgcacccgctacggcacggtcgggcagccgatacccggcgtcaccgtgcacatcgccgacgacggcgaggtgtggctgcgcggcggcaccgtcttccagggctacctcaacaaccagaaggccaccgacgagacgctgcacgacggctggctggccaccggcgacctcggcgcgctcgacgaggacggctacctcaccatcaccggccgcaagaaggagatcctggtgacctccggcggcaagagcgtggcgccgggcgtgctggaggagcgggtgcgcgaccatccgctggtctcccagtgcatcgtcgtcggcaacgaccgcccctacatcgccgccctggtcacgctcgaccacgaggcggtcgagcactggctcaagatgcgcaacaagccgcgcccgaccccggccgagctggtgcacgacccggacctggagaccgaggtgcggcgcgcggtggtcgccgcgaacacgctggtgtcccaggccgagtccatccgcaccttccgcgtcctcgcgcagcccttcaccgaggagcacggcctgctgacgccgtccctgaagctgaagcgcaaggcgatcgagaacgcgtacgcggccgaggtcgaggcgctgtaccgggtctgagccgtgcacggtgggggccgtagccggtgtgagccggtcggccggatcagccggatcagccggatcagggataccgcaggtgtgtgcatcaggaatgcgtcggcgcctgtgatcgttgaggatacgagtaccacttggacgacaaccgaaggatcaacagcccgtgagcagccaggtccccccgatcatcctcaacaacggcgtcgagatgccccagctgggcttcggcgtctggcaggtgccggacgacgaggccgagcgcgcggtcgccaccgctctggaggccgggtaccgcagcatcgacacagcggcgatctacggcaacgaggaaggcaccggcaaggccatcgccgcctccggtctcccccgcgaggacgtcttcgtcaccacaaagctctggaactccgaacacgggtacgacagcaccctgcgcgccttcgacacgtcgctggccaagctcggcctggagtacatcgacctgtacctgatccactggccgctgccggcccggggcgcgtacgtcgacacgtacaaggcgttcgagaagctgctcgccgacggccgggtccgggcgatcggcacgtccaacttcctcccggagcacctgcggcagctgatctccgagacctcggtgatcccggcggtcaaccagatcgagctgcacccgcacctccagcagcgcgccgcccgcgagttccacgcggagcagggcatcgcgaccgaggcctggtcgccgctgggccagggcaagggcctcctcgaggtcccggcgatcgtcgccatcgcgcagaagcacggacgcaccccggcccaggtcgtgctgcgctggcacgtccagctcggcaacatcgtcatcccgaagtccgtgacgccgtcgcggatcaaggagaacatccaggtgttcgacttcagcctggacgacgaggacctcggggcgatcagcgccctgaacgaggaccggcggctgggccccgacccggcgacgttcgacgtcgtctgagtcgtctgagcggccggacccgccgaggctcttccctcgcgtgtgaccgtgtgaccgtctgacgtgtgccccgcgcccgctgcctgaccggcgggcgcggggcacccgcgtaccgcactattgacgcgcacatgctcaaggggccatcttgtagcgcacccggtaaggaaagtttcctaacagaagggtcccctcaccccgtgcgcattcgaacactggccctcgccgcagcctccggcgccgtcctgctcgccgccggcgcgctccccgcgaacgcctccggcgccgccgccccgcgctccgcccaggagggctcggtcagcgcggccgacctgctcgccaaggtgaagtcctgccggcagatctccagcggcaagtacaagaccgacgacgagacgtcggccaccgtgcccgtgtgcgacaagaacggcgcggtgttctggaaggccgacatggacatcgactgcgacggccagcgcaccaccaactgcaatgaggaccgcgacccctggtaccaggacgacaccaggttccaccagtccgacggcaagccgctcaaggcggagtcgctgccgtacgtcgtggtgcccagctccagcggcatctggaactacgccgactccggcatcaagggcggtggcgtggtcgccgtcatctacggcgacaaggtcgagtacgccgtcgtcggcgacaccggaccgaacaagatcatcggcgaggcctcgtacgccaccgccaaggccctcggcatcgaccccgacccggagaccggcggcgcggactccggggtgacgtacatcctgttcaagaactccaaggcgtccccgatcgagagccacagcgcggccgtcacgctcggcgacaagctcgccaagcagttcatcgccgccaactgaacccggccaggcgggcggggcgggcggtcagccggtgcggacggccgtgtacacggtgtgcgccttcagcacgaagacgtccttcctgcggtgcacgctcgcctcgtcctcggggtcgaggagccggtcgagggtggcccggtcgtccgcgtcgaagtcgtccgccacgctctcccgcagccgccccagggtggcggcgacgtaggcacgggccggttcggagaccggggcgggcaggtcgagcaggaagctgcgggtgccggtgggcttgagaccggcggaggccagcagcgccggccagtcctcggtctcggcgacggagtccgggagatcctcacgcatccggctgaaccactcggactcgaccgcgtccatgcgggcctgcagcccgggacgcccgatgccgatgtcccggggcaggtaacgggcgggcagaccgccctccagcagggcgagggtcccgccgggcgccagccgctcggcgcacgcggcgagggcggcgcgctggtcgccgaggtggtgcaggctgttgctggcccacaggagatcggccgggtactccaactcggagagcacttcggggagttcgccggtgaccgtggtgaagcggtcggcgatgccgagtcgggcggcgcgggcggtggcgcgctccagcagcggcgccgaaccgtccaccgccacgacgcgggcgcccgggaaggtctcggcgaacaggcaggagaccacacccggaccgctgcccgtgtccacgatgagcccggggtcgctcacctcccgggccagccaggccatcgcctgccggtacagcggggcgaagagttccgcctgcgactcgaggagcggggccatcacggcccagtcgatgtcgccgtgcgcgtgatggccccggtgcccgt

SEQ ID NO: 1149 - DNA, 3257 bp, Unknown
  Kingdom: Bacteria, Phylum: Actinobacteria, Class: Actinobacteria, Order: Streptomycetales, Family: Streptomycetaceae, Genus: Streptomyces
ttccgcgaacgcatcccgcaggacgccctgacgtaccagactcacgaccacggccttcgcgctgttcctatgcctctgtgacggagcacaggatcagacggaggccgcctacgtgtccgctgaactgcgaaaacgccgatcaagttcgagtcgcgttcgacgccggaccataaatgacaaggtcagagcctgttccatatctccggttctgagtagccttggcgcctaggctggctgtgagcggacaagccgcctcccgcgaggccaaccgggactgatccacttggagacggtggtcaccgtctcctcccagaggtccccgaaatcggaccgcgactcccagagtctcacgaactcccgtgatcctgccgccggttcgggacgggcccgcaggatcagtgcacccactcgccgacgaccgaccactccttgaccaggtcactcgcccgatgcccgcggatctccgcctgcatctccacaaccgtggctgccttgctagtgaaagggcatccagcgcgcgcgtggctcatcggcagcacgcactctgcaggcgaacacacgcggacatcaggtcggctactcggcatgcttccactctttcacagcaccgagccgccgcatcaacccctccatcgcctccggcctgcaccactcagcggccgggctcaacacgagccgttcgttcaagcgtcacggccaccgttatggcctcaggaacaggcactcacgacggctcgggccaggtcttcaggtcggcgcctgtggtctcgtcgaccgaggagacgcgagcgtgtggcaggccgccgtactcgcccacccagcggatgaacttgccccgcgcggtctcctcgctcgcccaccagccatgcgcggccgggcggccggcgacggtcagggtgaggtggaagcgctggtcagacacgatcccaggatggcagaccggctccacgctgcgcgctgcccgtgtcctcaccgcccagggggatcctctccaccggctcccaggtgaccgtcttcccgccggcggacccggtggcggtcacgtcgaccagctccaccgccgtgacccgcagcgaggcatggccgggccggacgcggcgcagcagtcgctgcgcctggtcggagtcggcctcgccgtgagcgtaggcggtggtgagatggggcacgccgagcgggtaccggcaggcgtcgtctccgagcatgtcgcgggtcgcgctgcgggcgtgccggtgaaggacgtgcaggtcctcgtcggggtggaggtcggcgatcactccggaggggtaggacagcagactgcccaccatcaccgtgaacggcggcaccactgccaggcggcgggcggtctcacggacgaggcggccacgctgggcggtggagatgcggtgggcggggcggctgatctggtcgacggtgatgtgcgcccactgcggctcgaccggagtcagggggaaaccggcatcccgcaggacctggtgggagtcggagagcagccgtgccagaggctggtgacgggggtcgtcccagtccacggtgatgtaccagtggagcaggctgccggtctctggctcccagggggcggtgccctgctggaactggaagggcttcatgaccgcaacgtagcgccccgggccgcaacggcgcggccggtcacgccggttcggcggtccgcggcccgtgtagcgtccgggcatgactcgtacccgcacggtccgcctgccctcccatgtgcctctctccgccgtcacggtcgacggcatgcggcaccatgcgcaggaagaggaagacggcagcgccgtggtcgagttcgtcggtgtcctgcgcgtgcacggccggccagtcctctcccccggccagctcctggaactgtgggagggccgggcgcaccttgaatacgaggtagcagccgccaccttgcgaccccaggacgccatgccggtgagcgacaaagcccggctcggcgcctacgcggtgggcgccgacatcgcgcgcaaagtccgcggcctgggccacggagacgacaaggtcccggcagtgctggaagagatgcgcaccaagttcgccgcgcagggcccagctcagggaaccaccgccacaacagctcggcgcgccgccacccaggagaccgacaccatcctccagcagatgatcgcctcctggcagcaggccatcacctacgagtggatcagcgacagctaatccaggcagcgtgctgcgcgacagctcagaagtgggtggcgatgccaaacgcctgccggagctgggacatgtcgtggcggtcgtggtcagccggttcgtagccctggtggaagtagacctgctgctccggtgacaggcacgggacggtggtgtccaggatcgtgccggtgacgaagcacgcggcgggatagacgaacggatgctccgggtcaggcgacgcctgcacagcgggcccgtccgccgcaaagtccagaggatgaagatcgatctcccgcccgcggggcccggcgacgacgaaccgtacggggcgccagtcgaaggtctcggcgaatccggcatccctgagagccgccatgagatccggttcctggctgctgcggtgcatcaggtccaggtcgcggtgccgtcgcgtctgccgccccaccagagcgtcgatgccccagccacccccgatccagatgtcgatgcccgcatgccgcagcacactaaggatggacaacacgtcgtcagctgtcatcaccccgcgcacgctagccgctgtcctccgggcagggtgagccgtttggccggtcacgcgaggtcagggccgcccgccactccgttcccccacccggccagaggggcactggcttccagcccctcacagcaacttgatgcaggagtgagctgggatgggcggaggtccccggtcgggtgaatcatcaccgctcgcagaactcccgccggccacgaacacgtcctgtgacgcgtggatgggatcaacgaagtacacgtgtcagaacccggcctcgtcgtcgtggacgtggcagccgccgacgaccagacagccttcgccttccagaccgccctggcatcgatgtgggccaccaccctggtcgaacgcaccacccgcgaccccggacaacccggcgtacggatccgctgctacctcgacatgcgccagcagccataacctcggacagcagggcccggtcccggcgctccccctcttcaggcccccgtgcccggatacgtttcctcgaccgccgccgctgccccgccgcatgggcagccgcggc

SEQ ID NO: 1150 - DNA, 1489 bp, Unknown
  Kingdom: Bacteria, Phylum: Actinobacteria, Class: Actinobacteria, Order: Streptomycetales, Family: Streptomycetaceae, Genus: Streptomyces
gagaccggcgcggccgatccccgccccgctgccgcagtcgcccagcagatggccccagccgtccgcgcggtgccagccggtcaggtcggtgccgatcgcgatcagaccggtcccgccggccacgaccgcaccgggccgcgcccccagcgcaccgacataggcggtgaccgcgtcggccacgagcgcgaccctgcgcaccccgagttcgcgtgcgagtgcgccgggcagctcggcgcgcagcgcgtcacccagggtggcgagtccggccgccccgacgacagccgtctccagccgccccagcccggcttcggctaccaaggcccgtgccagggggacgagttgttccatcaggtgtgccgggtcgattccccgggggccggtgcgtacgggctccttggactcccgctgagccgacggcccgtgaccgggtacgccgacgacgacccgcaggcccgaccctccggagtccacggcgaggaagccgctcgcaccgcttgccccgcgccccgtcaccaccggctccgggcagggccgaccaggcagagcactccggccacagggcgcactgacatgcctcctcctcgggcttctcgggaggtccgaagaccgcgaagacctcgacgacagggaagggtagcgccgcgggacccgcctgtgcggggggcgcctcccgcctgtgcggcgtaccggcatgtgccagtagagtgacgcgccgtggcaccacgaccgttgcatgaactcgtcgaggcgggctgggcgaaggccctcgaacccgcggccgaacgcatcgccgccatggggaacttcctcagggccgagatagcggccggccggacctaccttccgtccggggccaatgtgctgcgggcgttccagcagccgttcgacgacgtgcgcgtcctgatcgtcggccaggacccctatcccacccccggtatggccatcggcctgagcttcgcggtctcgcccgaggtgcgctccctgccgggcagcctggagaacatcttccgggaactccattccgacctcgggctgcccaggccgtccaacggcgatctgacgccgtggacccggcagggtgtgctgctgctcaacagggcgctgacgacggcgccgcgcaagcccgccgcgcaccgcggcaagggctgggaagaggtcacggagcaggccatccgggcgctggcggcccgcggcaagccgctggtgtcgatcctgtgggggcgtgacgcgcgcaatctgcgcccgctgctcggtgatctcccggcgatcgagtccgcccatccctcgcccatgtcggcggaccgcggcttcttcggttcgcgccccttcagccgggccaacgacctgctggtgcggcagggcgcccagccggtcgactggcagcttccctgagccggcgcacgcccgccgacccgtccgcatgaccgtgcgggcggccgggacccggcgcgtgcggccgggccggtccccgcgggcgtagccccgcagg

SEQ ID NO: 1151 - DNA, 2601 bp, Unknown
  Kingdom: Bacteria, Phylum: Actinobacteria, Class: Actinobacteria, Order: Streptomycetales, Family: Streptomycetaceae, Genus: Streptomyces
tcccgctgagctaatcgtcctcgggactgtgacccgaaggccacaggctgtgcgtgcgcgatactgggattgaaccagtgacctcttccgtgtcagggaagcgctctcccgctgagctaatcgcgcgggtccggatcacatcgtacgagacggctgatccagtggacgatactgggattgaaccagtgacctcttccgtgtcagggaagcgctctcccgctgagctaatcgtccttggaggtggagacgggatttgaacccgtgtagacggctttgcaggccgttgcctcgcctctcggccactccaccaggagtgcaggggaccgggagtccccttcgttcctacgagcggacgacgaggctcgaactcgcgacctcaaccttggcaaggttgcgctctaccaactgagctacgtccgcctgtcggttcggtccgcttgcgcgtcccggcgacgtgttgaactctagcggattcccgggccagcacaaaaacgcgtttgcgcagcgtgctgcggtacgtccccgcgaggacctggtcaggcaccccgcaggacacgccagggccacccgccggacaccggccctagactcggagccgtgctcgacctgccccctctcgcccgtttcggcgaccgcgtcgccaccggcctggccgacgtcaccagtgaccccgcggccctggactccgccggcttctgggccgtcgccgcggactacgagggacggctgacctgcgcccgcttccgtgacgtacgccaggaacccgtgcccgccccggcgcccggcgcgtggcgcggaccggccgccggtgactggacgtcctccctcgaccgcgccgcgtacaccgcgggcgtgcgccgcatccgcgcccacatcgcggccggcgaggtctaccaggtgaacctctgccgggtgctctccgcgccggtcgacgccgacgccgacgtggacgcgctgagcgccgtcctggcccgcggcaaccccgcaccgtacgcgggaacgatccgcctgccggagcacggcgtggagatcgccaccgcctcccccgagctgttcctgcgccgcgccgcccgcgcggtggagtccgggccgatcaagggcaccgcccgcaccgaggcggaactcctcgccaaggaccacgccgagaacctgatgatcgtggacctggtccgcaacgacctcggacgcgtctgcaccaccggcagcatcaccgtccccgacctgtgcgccgtggagaagcacccgggtctggtccacctcgtctcgtccgtgcgcggcgaactgcgcgccggcgccggctggccgcagctgctcgccgccgccttcccggccggctcgatcaccggcgcccccaagtcgagcgccctgcggatcatcgacgccctggagaccgcaccccgcggccccgactgcggcgccgtcggctgggtcgacgccgaccggggcacgggcgagctggccgtcggcatccgcaccttctggatcgaccggcccgaccggacccccggcgcgcccgccgtgctgcgcttcggcgccggagcgggaatcacctgggactccgacccggacggcgagtggcacgagaccgaactgaaggcggcccggctgctcgcggtagcgtcaggcacgtacgaggacggcggagaggacctgcgggaatgaagatctggctcgacggcgggctgcgggacatcgagtccgcgcgcgtctccgtcctggaccacgggctgaccgtgggcgacggcatcttcgagacggtgaaggcggccgacgggaagccgttcgcgctcacccggcacctggaccggctgacccggtcggcgcgcggcctcggcctgcccgaccccgaccacgacgaggtccgccgcgcctgcgccgccgtcctggaggccaacccggccccgctcggccgcctgcgcatcacctacaccggaggcgacggccccctcggctccgaccgcggcgcgcacggcacgaccctcgtcgtggccctcggcgagaccacccgccgccccgactccaccgccgtcgtcacggtcccctggacccgcaacgaacgcggcgcgctcaccggcctgaagaccacctcctacgccgagaacgtcgtcgcgctcgcccgcgcccgcgaacacggcgcgtccgaggcgctgttcggcaacacggtcggacagctctgcgagggcaccggctccaacgtcttcgtcgtcctcgacggcgagatccacaccccgccgctcgcctccggctgcctcgccggcatcacgcgcgcgctcgcgatcgagtggacgggcgcccaggagaccgacctgccgctcgacgtcctggagcgggccgacgaggtcttcctcacctccaccctgcgtgacgtccaggccgtgcaccgcgtcgacgagcgcgcgctgcccggcacggcgggcccggtgacggcgaaggccgtgcgggtcttcgccgagcgctccgccgacgacctggacccgtgagccacgggcggctgcggaaaatgagctgactcgggcgatcgtggcgggtagaactcccctgatgaccacgaccctgcggcccaccgagccgctccagcagcacgccgacggggcggctgtt

SEQ ID NO: 1152 - DNA, 1133 bp, Unknown
  Kingdom: Bacteria, Phylum: Actinobacteria, Class: Actinobacteria, Order: Streptomycetales, Family: Streptomycetaceae, Genus: Streptomyces
ctggtacgggggggagcggacccggcggggggtcaggccaccttgctcacgtcggccgtcgcgggatcgccggccgtggcgggatcgccggccttccgggcggcgccggccgtcccggagccgcccgccttgagcagccgcagccggggcgccggtccggaacggccgccgcgccggtgcagggagcgggcggcgaagtcgccggcgaactggatgagcgagatgaccacggcgaggatcgccacggtgatccacatcagctgggtctcgaagcgctggtagccgtagcggatggcgatgtcgccgaggccgccggcgccgacggtgccggccatcgcggagtagccgatgagggcgacgacggtcgtggtggtgccggcgatcagggagggcagggactcgggcacgaggaccttgcggacgacggtccaggtgttgccgcccatggactgcacggcctcgacgagcccgctgtcgacctcgcgcacggaggtctccacgaggcgggcgaagaacgggatggctccgatggcgagcggcacgatggcggcctcgcggccgatggtggtcccggtcacccagcgggtgaaggtcatcagggcgaccatgaggatgatgaacggcatcgagcgggcgatgttcaccgtctggccgatgaccttgttggcgaggaggttctgcagcaggccgccccggtcggtgaggaccagcaggacgccgagcgggagtccgccgacgacggcgatcagcgtggaccagccgaccatgtagagggtgtcccaacaggcctgggacagcagcgggtgcatctcggaccagctcatcgggcgccttccttcaccagcgggttctcctggccgacgaccgggttgtcctggccgacgacgtcgatctgcaggccctgctcgcgcaggaagccgacgggcacgacgttgtcctcgtagcggccgggcagttcgatgcgcatccggccgacctggaggccgccgacggtgtcgatggcggcgccgaggatcgatatgtcgatgttgtaggtgcgggacagctgggagatgacgggctgggtggcggcctcgccgtggaaggtgacgtccaggacggtgcggtcctcgccggtggcgtcgccgcccacc

SEQ ID NO: 1153 - DNA, 3652 bp, Unknown
  Kingdom: Bacteria, Phylum: Actinobacteria, Class: Actinobacteria, Order: Streptomycetales, Family: Streptomycetaceae, Genus: Streptomyces
ttcacgatcaggtcccgcgacgccggctccaccacgaggtccccggacgccgggtccacggcgaggtccccaagggtgccctgcccgcgggccggttcgcgctgagcggcgacggcgagggcggcctttcggggccgctgctgcggcacgccgtccaccgggcgcggggccgcggcggccgggtccgcggtccgttccacggtggggctccttccgtcgggcctccacccttcgcgccccggaagccgctgtctatgatcgacgccacccggcggcggattcacaggaacctattaacttcctcatgggcgccggccccgccgcgcgcgggcccgtcgcccgccacggccgcgaacgcgccccgcgggtacggggctcaccgggcgtcacccgtaatccatgtggcgacacgggcccgttcgggcaggatgccttcatgaacgtctcgtacgacgcgcccgtggtcctggaccgcagcgagggcccgcacggagaggtcgtgctgcgccggcacggcgaactgctgcagatcatcgccaacggctgcttcctgatggacacctccgacggacgttcagagcggctgctcgtggacgcggcgctcgccgccctggacgggcgtccggaaccgcacgtgctgatcggcggcctcggtgtcggcttctcactcgcgcacgccgccgcccaggaccgctggggccggatcacggtcgtcgagcgggagccggcgatcgtcggctggcaccgggacggaccgctggccggcctgacggcgggggcactcgccgacccgcgcaccgagatcgtcgaagccgacctcatcacctacgtcaatgagacgtccgccacgttcgacgcgctgtgcctggacatcgacaacggtcccggatggaccgtcacggagggcaacggagagctgtacaaaccgcccggactggcaagctgcgcaagggcgttgagacccggcggcgtgctcgccgtgtggtcggcgcagccctctccggaatttgaaggaaccttgcggaatgtcgggttcaaacaggtgcgcaccgaagagatcccggttgcccggggcgttccggacgtcgtgcacctcgccgtcagggctggatagcaaaggcaccgtgactccccgtacgctgcatccctgacgccgatcattcaagcgtcaatcgcaactacgcgcagtcaaggaatcaccccactgattccggaaagcacactcaggggcgggcgatggagcagacacacaccgcgcacaacacgacggccggaccgggcgcacagcgccgcgtcctggtggtcgaggacgaccagaccatcatggatgccatcgccacccgcctgcgcgccgagggcttcctggtgcagacggcgggcgacggaccaagcgcggtcgacaccgcggaggcctggcagcccgacctgctgatcctcgacatcatgctgcccggcttcgacggcctggaggtctgccgccgggtgcaggcgcagcggccggtgccggtgctgatgctcaccgcgcgcgacgacgagaccgacatgctggtcggcctcggggtcggcgcggacgactacatgaccaagccgttctcgatgcgggaactggcggcacgcgtgcacgtgctgctgcgccgcgtggagcgggccgcgctggccgcggccaccccgcgcagcggcatcctgcgcctgggcgagctggagatcgaccacgcgcagcgcagggtgcgggtgcgcagcgaggacgtccacctgacgccgaccgagttcgacctgctggtgtgcctggcgaacaccccgcgcgcggtgctctcccgcgagcagctgctggcggaggtgtgggactgggcggacgcctccggcacccgcaccgtcgacagccacatcaaggccctgcgccgcaagatcggcgccgaacggatccgcacggtgcacggcgtgggctacgccctggagacgccgaccccatgagcgaggggccggccgcgcacgaggaccggggggagccctggggcggggtgcgtccgttctcggtgaagacgaagctgggcgcgctggtcgtcatcgcggtgctgatcaccacgggtctgtcgatgatcgcggtgcacaccaagaccgagctgcgcttcatcatggtcttctcgatgatcgccacgctgctgatcacccagttcgtggcgcactcgctgaccgcgccgctggacgagatgaacgcggtggcccgctccatctcgcacggcgactacacgcgccgggtgcgcgagaaccgccgggacgagctgggcgacctggcgcagacgatcaaccgcatggcggacgagctggccgcccaggaccgccagcgcaaggagctggtggcgaacgtctcgcacgagctgcgcacgccgatcgccgggctgcgcgcggtgctggagaacatcgtcgacggggtcaccgaggccgacgcggagaccatgcgcacggccctgaagcagaccgagcggctgggccgcctggtggagaccctgctggacctgtcccgcctggacaacggcgtcgtgccgctcaagacccggcgcttcgaggtgtggccgtacctgtcgggcgtcctgaaggaggccaacatggtggcctccgcgcgcgcggggatggcctccggctccggcagccacacccgtaccgacgtccatctgcgcctcgacgtcgagccgctgaacctgaccgcgcacgccgacccggagcggatccaccaggtcgtcgccaacctgatcgacaacgccgtcaagcacagcccgccgcacggccgggtgacggtacgggcgcggggcggggcgcagccggagtcgctggagctggaggtcatcgacgagggccctggcatcccgcgctccgagtggcaccgcgtcttcgagcgcttcaaccgcggcgccgtgagccggccgcacgggccgggcagcgacggcggcaccgggctcggcctggcgatcgcccgctgggcggtggatctgcacggcggccggatcggtgtggccgaatccgatcgcggctgccggatcctcatcacccttccagggcttccctctgtaccaagttgacgtaaagttcgatccggaacctcaagatccacgagcgtcccgctgtccggccgaccgtctcccgacgctccggccggtgtgtccgaggctcactcccggcgcaggcggacacgtgtgatcaggccggggcccgcacccttgggggtcgggcccggatggccccttcccattcaccggcgaaccacgcttgtttcccgccatttcaagccccgaaaccagggtttcgatgtgacttacgcgacgatgaacgggctcgacctgaccttcgcgctcttggaggcgtagcctttattcccgctgtccatcaccttgtgaagcggaagagggcggttgccgccgtgtcgccacagtcccccagtaactcgagcatctccaccgagaccgaccaagccgcgaagaaccccgcagccgcgttcggtgccaacgagtggctcgtcgacgagatctatcagcagtacctccaggacccgaactccgtagaccgcgcctggtgggacttcttcgccgactacaagccaggggccgccgcggcagcctcggctccggcgggtactgcggccgcggcggcccctggcttg

SEQ ID NO: 1154 - DNA, 1217 bp, Unknown
  Kingdom: Bacteria, Phylum: Actinobacteria, Class: Actinobacteria, Order: Streptomycetales, Family: Streptomycetaceae, Genus: Streptomyces
gggtcggtgggggtggatgcgccgccggtgtcgctggcgttgccgcgttcgcagtactgccgcgcccgtccgacgatcaggtcgcaccgcctgtcgtgcgccgacggggagggcgtcgcgctgggcgagggcgcggcgacggcgcgggacgccagcagcacgaccgatgcctgcacggccgccacgactccggtgagtttgagcgcgcgctgcctgctaccgggcatacgtgaaccctccgtactcttcgatggccttgcggatctggtcggaggtggcggccttgtcatcgccggggaccggtgcggggccgttctgctgcgtgtcggaggcgatcttccagtcgccctggttccactgcaggtcgaacgtccacgtcttccaggacgaggtgatcgggtccgtcgtggccttactggacatgccgatgagtcccacgtaccagaccgagacccgggcgctggtgctgctgtactgctggacggtggtgccgaccggagccacgcgggagacgaaggtgctgcctgccggtgcgttgccgcccgcgtccaggcccattctggcgaggaattcggccgagtaggcctggtccatcgggccctggagcttggccgcggcttcgggggtgtagaggaggcccacgatggtgtgccggctgtccttctggaacatgccggtcgagcccagtgtcacggcgtagttcgccgccgcgctctgtgccccctgttggtcgtgggcgaagccggaggggaggcctgcggttttggtggtcacgggctgtttgccggtcggggcggtggccgctgccttcgggccggggtcgccgtgggagcccgtggcggaggaaccgccgccggagcggttcgcgacggcgatcgcggcgatgaggaggacgaccacggcgaccaccgtgatcaggccccgtgaggacgagcgggggccgcgccgggcgccgccgtaggggtcgccggcccggtccgggagccgggtgcgggtctgcccgtcgccgtacgggtcgctgccggtgcgcgccgggtcgcggtgtccgtgctcgtctccgagactcatgcccggtacgccccctcgacgttgacctcgacctcgtggcggaacgcgtggaagtacgacggtagccgtgctggttcccgcgtggacgcggtgtggtgactcgacatcagggaaacgcaacctcggccggtgggcacggtgggtgggtg

SEQ ID NO: 1155 - DNA, 2851 bp, Unknown
  Kingdom: Bacteria, Phylum: Actinobacteria, Class: Actinobacteria, Order: Streptomycetales, Family: Streptomycetaceae, Genus: Streptomyces
cgtcggcttcggtttcggcgggggcttcggcatcggcttcggcttcggcgggggcttccgtttcggatccggcgtcggcttcggtttcggcgggggcttcggcatcggcttcggcttcggcgggagctgccggctgcgggcgtacctccgtgagccacaggtcgtcgggagcgctgcccgtggggtcccagcggagcaggtgcggggcgaggtccgggagttgtccgtaccgcacggcgcagcccagcgcgatcgaccacagccgggcggcgaggccctggtgggccaccgaggcggcgacccgtggttcggcggcccggatgccttccgcgacccggcggacccgtacggtgagcgggtggcgggcgtgctcggcgggcggctcggcgtaggcctgtgcgagggtgggcagcggccctcggggcggctcgcccgtacgcagggcgaagaagccgccgagcgggcggagggcggcgagttcggcaccgggaccggtttcgagtgcggcgtcgggttccacgaggagcagtactaccaagtcgggtgcggccgacgtcccttaggggcggctccggacggcttctcagggggtgtccgccgtgtgtcgcccaccttggggaggacaccgggagacggctactccatcggcagtatgacccattgactgctcagggacgacgacgggaagagatcggcacggcaaggtgttgaaccatggaagccgcctgttcgtcgcgccgggcccgatgcccccgcctcccgcagaggaccagctcatgagcgccctcgcgctgtccgtgctgctgtcactcgtgtccgccgtggcgtacgcgggcggcgcgatcgtgcaggagcaggtcgcggtgtccgctcccggcgagcagtacgcgccgctgcgccggccggcctggtgggcggcggtcggcctgaacggcctgggaggcgtgctgcacgtggtggcgctggcgtacggcccgctgagcctggtccagccgctgggtgccctgaccatcgtgttcgcgctgcccatggccgccctgctggtcggccggcgcgagttcaacgccatcggcgaccgctccaaccccaagctggccctcgcggtcggcgccggcggcatcctcgtcagcgccggaatcggcacctggctggtggacgccaccaacaaggcgcacggcaccgcacccctcaccgagaagatcttctacgccctgctgcgcggcgtcagcgtcggcccgctcgccgaccacatcccgcacgtgcacgcgccccgctgggtggacatcaccatcaacgccctgacggcggcgaccttcctgctggtcctgtacgtctgcttccgctcgccgcgcggccgggccctgctcggcgacgaggacgagcagcggctgcgcgccctgctcgaccggcacggcgaccgcgactccctcggttacttcgcgctgcgccgcgacaaggccgccatcttctcccccaccggcaaggccgccgtcacctaccgcgtggtcggcggtgtcagcctcgcctccggcgacccgatcggcgacccggaggcctggcccggcgccatcgggccgtggctggccgaggcacgggcgcacggctggatcccggccgtgatgggcgcgagcgaggaggccggcacggtgtacgcgcgccacggcctcgacgccctggagctgggcgacgaggccgtggtggacgtcgccgagttcaccctggagggccgggccatgcgcaccgtgcggcaggcctacaaccgcgtacgccgggccgggtacacggtgcgcgtccggcggcacgaggacatccccgcaggcgagatggcgtacctgctgcgccgggcggacgactggcgggacgggccgaccgagcgcgggttcagcatggcgctcggccggctcggcgacccggcggacgggcggtgcgtgatgctggagtgccacgacgcgcacggcgacctgcgcgccctgctctccttcgtgccctgggggccgcacgggctgtccctggacctgatgcgccgcgaccgcgacgccgagaacgggctgatggagttcatggtcatcgatctgctgcgccgcgcccgggaggtcgaggtcacccaggtctccctcaacttcgcgatgttccggtcggtcttcgagcgcggcgcgcgcctcggcgccgggccggtgctgcggctgtggcgctcgctgctcggcttcttctcccggtggtggcagatcgagtcgctctaccgcgccaacgccaagtaccggccgatctgggagccgcggttcctgctcttcgagaagagtgcggatctgctgcgcatcggcctcgcggcggcccgcgcggagggcttcctgacggcggggccgaggacggcggaacccaccacggcgggaccggtcacgcccggaccggtcacgcccggaccggccacgccggggctgggggaggcctgaggagctgatgacgaggaccgtccgctgggcccgcgccgagtgggggctcgtgtacgacaccgtgcgcggcccgctgctgcggcgagggccgcgtgcggtcccgctgacgctggccgccgtctgcctgaccgcgctgctgcagtgcgcgcagcacacgcactggggcgacgctctcgtacggcaggccgggaccgtacgcgccgcggacccgccggcgcaggccctgctgtgcaccccgctgtcgctgttcgtgcccgcgcccgaccttccggtgtggggtgcgctggcgcaggtcctgggcgtgttcggcgtcgccgagatctgcctgggcaggcggcgcaccctggccgtcgcctacgtcgccacgctcgcggacacgctgtacgcgcgcgtggcgacgt

SEQ ID NO: 1156 - DNA, 1587 bp, Unknown
  Kingdom: Bacteria, Phylum: Actinobacteria, Class: Actinobacteria, Order: Streptomycetales, Family: Streptomycetaceae, Genus: Streptomyces
gcggcggtggcgcccaccgcgtccgcgagccgggccgcgaactcctcccgtgcctcctcgctcagcccggcccacctgcggcccgtctacgccaccgggccgcggcgccccgttcggccacgaactgcccgagggagtcgcgcagttcaccgatgccgtcgccggtgagcgcggagagcgcgaggacggtcgcgcccggctcgccgtactcgcccagcgcgatgccgtcctcgtcgagcagccgccgcacgtcgtcgaggacctggtcggcggcctcgccgggcagccggtcgatctggttgaggacgacgaacatgacctcggcgtggcccgccagggggcgcaggtagcgctcgtggaggacggcgtcggcgtacttctccggatcgaccacccagatgaccgcgtcgaccagtttgaggatgcggtccacgtgctcccggtgctgcacggcggccgagtcgtggtcgggcaggtcgaccaggacgaggccgcgcagctgcggatcggcgtccgggccctggacggggcggcggcgcaggcgtccggggatgccgagccggtcgatgaggccggccgcgccgtcgctccaactgcaggcgatgggcgcggcggtggtcggcctgcggacgccggtctccgagatgggtacgcccgccagggcgttgaacagctgcgacttgccgctgccggtggcgcccgcgatggcgacgacggtgtgctgtccggacagccggcggcgcgccgccgcctcgtcgaggacgcgtcccgcttcggcgagggtgcggttgtccagccgggtgcgggacagcccgacgagttcgcgcatcgcgtcgaggcgggacctcagcgggccgtcgtaggcgagcggcggcacgggcagcgaccgggcggggcggggatcgacggggacgagttcggcggcgctcgtgccggtctcggtgacgcggcgggcgatcagtccgtcgtcccaggccccgtcggctccggtacggtccggggcgtcgtcgtccttcacgcgcgcgtgccggtcgggccggtcggcggcccggtcggcgtgcccctcggcatgccgggcggcgtacgcgtccgggtgcttcacgagtgcggcgccgggcgccgccccgtcccttccctcccgtacgcctctgccatctctcccgcccctgcgctcacccgggtctctcatggtgttgccgtccaccgcgtccgcgccctccgccttctcgcgagagccctggtagcccccgggggccgggctccgcgggtcccgggtgccgtgtgcgtccgcggggaccgtgccctccgtgtggtccgcgcgctccgtgtgtgcggtgcgtgcggtgtgttccgttcggtcctggtcagtgacggcggtcaccggtcacctctccttcagcagtacggacagcgcggcgatgagttcggcctggggctcggcatgcacctccagggcgtcgagcggggccagccgccgctcccgttcggcgtgcatcacgcggtccaggtagtcggcgagcagccgcccggcgcggtcgcgcagccgcagggcgccgtgtgcgccgatccgctcggcgagcccctccc

SEQ ID NO: 1157 - DNA, 2768 bp, Unknown
  Kingdom: Bacteria, Phylum: Actinobacteria, Class: Actinobacteria, Order: Streptomycetales, Family: Streptomycetaceae, Genus: Streptomyces
gggtcgcgcgcagcgtcgcggcgctcaggtcgcgcacgtcgacgccgccgatacggacggcgccctcgtcgacgtcgtacaggcgcggcaggagctgggcgatggtggacttgccggcgccggaggagccgacgagcgcgatggtctggccgggttcggcgcggaaggagacgccgtgcaggacctcggcgccgccgcgggtgtcgaggctcgcgacctcttcgagggaggcgagggagaccttgtcggcggaggggtagccgaagcggacgccgtcgaactccaccgcgaccgggccgtccggcaccgcacgggcgtcgggcctgtcttcgatgagcggcttgaggtcgagcacttcgaagacccgctcgaagctgacgagggcgctcatgacctccacgcgcgccccggcgagcgcggtgagcggcgcgtacaggcgggtcaggagcagggcgagcgagacgacggcgcccggttccagggtgccgcgcagggcgaaccagccgccgaggccgtagaccagggccagggcgagggaggagacgagggtgagcgcggtgatgaaggcggactgggccgtcgccgtccggatgccgatgtcgcggacccggcgggcgcgggcggcgaactccgccgactcctcctcgggccggccgaacagcttgacgagggtggcgccgggggcggagaaccgctcggtcatacgggtgcccatggccgcgttgagcgtggccgcctcgcgctgcatgcgggccatgcggctgcccatgcggcgggccgggatcacgaacaccggcagcagcaccagggcgagcagggtgatctgccaggacagcgtgagcatgacgacgagcgtgagcagcagcgtgaccacgttgctgaccacgccggacagggtgttgctgaaggcgcgctgggcgccgatgacgtcgttgttgaggcgggagacgagcgcgccggtgcgggtgcgggtgaagaaggcgaccggcatgcgctgcacatgatcgaagacggccgtgcgcaggtcgaggatgagtccttcgccgagggtcgcggacaggcgtctgccgaggatgccgagcgccgcctcggccaccgcgatcgccgcgatcagcagggccaggtggacgacggtggcccggtcgccgtgcgagacgatcgcgtcgacgacgcgtcctgcgaggatcggggtggcgacggcgagcagtgcggtcaccacgccgagggcgacgaagcgcgcgatgcggcggcggtgggggcgggcgaaggcaccgatacggcgcagcgtctcgcgggcgaaggggcggcgctcctgctgggcgttcatcacgctgtgcagctgcgtccaggcggtggtctccatactcatgacagagaacctaggacctcaagcaacgttgaggtcaacgcccggccgcgggacgggggcgcgcaggtccgcgcgggacgccgctgcggtgcctcccgtgcaccggtgatgtgcgccccgggcaccggtcacgtacgaactacccttcctcatggggcaggatgagcgctcgcgcatcccgagaccgagcaggtgatcacgtgacaccacatcgcccatggccctcgacggcccccgttcccgcggcccgcccgcacggaggcggccggtgaaccgcgccgtgaccctggacgatctggtcctcgcgggggtctccctcgcggcgggtgtggcggtggcgttcctgtcgcgctcgttgctgctctggctggcccggcacgccaagcggacccgctggagcggtgacgacgtcatcgtggacgcgctgcgcacggtggtgccgtgggcggcgatcgcgggcggcgcggcgggtgcggcggcggtgctgccgctgacccgggccgtccggcaccatgtgcaccaggccctgaccgtgttcctgatcctcgtggtcacgctctcggcggcgcgggtgatcgccggactggtgcggacggtcacgcagtcccgctccggggtcgccgggtcggccacgatcttcgtcaacatcacccggatcctggtgctggccatcggcttcctggtgatgctgcagaccctgggcatctcgatcgcgccgctgctcaccgccctgggcgtgggcggcctcgcggtcgcgctggcgctgcaggacaccctcgccaacctgttcgcaggcgtccacatactggcctccaagaccgtgcagccgggcgactacatccgcctgagcaccggtgaggagggctacgtggaggacatcaactggcgtcagacgaccgtccgccagctctccaacaacctggtcgtcatccccaacgggcagctcgccaagacgaacatgaccaacttcacccggcccgagcagcggctgacgatcctggtgcaggcgggggtgggctacgacagcgatctggagcacgtcgaacgggtgacgctggaggtcgtcgccgaggtgatgcacgagatcaccggggctctcccggagcacgagcccgccctgcgcttccacaccttcggggagtcacggatcgggttcacggtgatcctcggggtcggtgagttcagcgaccagtaccggatcaagcacgagttcatcaagcggctgcaccggcgctaccgccgcgagggcatcagcatcccggcgccgaccctgacggtggcgctccagcagggcgcgggcccggtggtgataccgcagccgcgcggggcggaggacggcgcggtgtccgcctgagaacggtacgggcgcgggcttccggtccgcgtggggacggcgcgg

SEQ ID NO: 1158 - DNA, 5489 bp, Unknown
  Kingdom: Bacteria, Phylum: Actinobacteria, Class: Actinobacteria, Order: Streptomycetales, Family: Streptomycetaceae, Genus: Streptomyces
ccgccgcgaccgtactgcggctgcagggcatcgtcgcccgggaggtcgccggcacgtccaccgcggtggtcaccgtgggcgccctgcacgccgggaacaagcccaacgtcatcgcggaccgcgccgaactgctgctgaccgtacgcaccttcgagcccgcggtacggacggccgtcctgcgggccgtggaacggatcgtgcgggccgaggccgccgcctccgacgcgccccgcgatccggagatcgccgtcaccgagtcgttcccggccgtcgtcaacgaccccggggcgtccgagcggacccggcggacgctcgccgaaaccctgggcggggcacgggtgatcgatcccgggcccgcgaccggcagcgaggacgtcggcgtgctggccgaggccgccggagccccgtgcgtctactggctgctgggcggcgccgacccggcggacttcgccgcggcccgcaccttggaggaactcgcccaggtggccaaggccctgccgtccaaccactcaccgctcttcgccccggtcgtcgaaccgacgctccgcacgggcgtcacggccctcaccgccgccgcccgttcctggctggaccggcctgccgacccggccccctgaaccaccgcgtcgaccggccatccggccggaccgggcggggccctcgcggtcgtcggctcaccgccccggaagtcccgagagcacgcgagagggcgccggcccggcggtcccccgcagaccggcgccctgcccggcacccttcacgggccgggccacggcgcccttcacgggccggtgtccgctccggcccccgctcagacgacctcgatcagcagatcgccgccttccacctgctggatgcggttgatggcgagccggcgcacacggccggacttcggggccgtgatggacgcctccatcttcatcgcctcgatggtcgcgacggtcgcccctgccgcgacctcctcgtcctcggcgaccgcgagggtcaccacgcccgcgaacggggccgcgacatgccccggatcggcccggtccgccttctccgtcacggggacgtcggaggcggcggcggtgtcccgcacctggatggggcgcagctggccgttgagggtggacatcacggtgcgcatgccgcgttcgtccgcctcgccgatggcctgcagttcgatcaggagccgtacgccgggttcgaggtcgacggcgtactccttggcggggcgcaggccgtagaagaagtccttgctgtcgaggacgctcgtgtcgccgtaggcctggcggtgctggtcgaagtcgcgcgtcggaccggggaagagcagccggttcagggtggagcgccgggacttgtccaggccctcgcggtcctcggcgctcagctcggcgacgggcctggcctcggcgcggcccttgagcgccttggtgcggaagggctccggccagccgccgggcggggtgcccagctcgccgcggaggaagccgatgacggagtcggggatgtcgaaccggtccggactctgctcgaagtcctccggggtgacgcccgcgcccaccaggtgcagggcgaggtcgccgaccaccttggaggagggcgtgaccttgacgaggcggcccaggatgcggtcggcggcggcgtacatcgcctcgatgtcctcgaagcggtcgccgagaccgagcgcgaccgcctgggtgcgcaggttggagagctgtccgccggggatctcgtggtggtagacgcggccggtcggcgaggccaggcccgcctcgaagggggcgtagatcctgcggacgctctcccagtacggctccaggtcgccgacggccttcaggtccaggccggtgggatgctcggagtggtcggtggcggcgaccagcgccgacagcgacggctgggaggtggtgccggccatcgaggcgaccgcgccgtccaccgcgtcggcgccggcctggatcgcggcgaggtaggtggcgagctgaccgcccgcggtgtcatgggtgtgcaggtggaccgggaggccgaactcgcggcgcagcgccgagaccagcgtggccgcggcgggcgcccgcagcagtccggccatgtccttgacggccaggacgtgcgcgcccgcctcgacgatctgctcggccagacgcaggtagtagtccagggtgtagaggcgctcggcggggtcggagaggtcggcggtgtagcacagggcgacctcggcgaccgctgtcccggtctcgcgcacggcatcgatggccgggcgcatctggccgacgtcgttgagcgcgtcgaagatgcggaagatgtcgacgccggtggccgcggcctcctgcacgaaggcgtcggtgacctcggtcgggtacggggtgtagccgacggtgttccggccgcgcagcagcatctgcaggcagatgttgggcaccgcctcgcgcagcgcggccaggcgctcccaggggtcctcggcgaggaagcgcagcgcgacgtcgtaggtggcgccgccccaacactccagggagagcagtccgggcagggtgctggccacggtgggggcgacggccaggaggtccttggtgcgcacccgggtggcgagcagggactggtgggcgtcgcggaaggtggtgtcggtgacgccgagcaggggcgactcgcgcaggtgccgggcgaagccctcggggccgagttcgaccagtcgctgcctggagcccgcgggcggctcgccggcgggcagcggcggcagcttggtgacggggtcgacggtctcggggcgctcgccgtgcggcttgttgaccgtcacgtcggcgaggtaggtgaggagcttggtgccgcggtcggcggaggagcgcgcggtgagcaagtgcgggcgctgctcgatgaacgacgtggtgacccgcccggcctggaagtcggggtcgtccagaacggcttgcaggaacgggatgttggtggcgacgccgcggatgcggaactcggcgaccgcccgccgggcccggccgacagcggccttgaagtcccttccgcggcaggtgagtttgaccagcatggagtcgaagtgggcgctgatctccgtgccggcgtgcgtggttccgccgtccaggcggatgccggaaccgcccggtgagcggtaggcgctgatccggccggtgtcggggcggaagccgttggccgggtcctcggtggtgatccggcactgcagggccgcgccgcgcaaccgcacggtgtcctgcgacagcccgaggtcggccaggctctcgccggcggcgatgcgcagctgcgcctggaccaggtcgacgtcggtgacctcctcggtcaccgtgtgctcgacctggatgcgcgggttcatctcgatgaagacgtggttgccgtcgcggtcgagcaggaactccacggtgcccgcgttgcggtagccgatctcgcgggcgaagcggaccgcgtcggcgcagatccgctcgcgcagcgccggatccaggttcggcgcgggcgcgagttcgatgaccttctggtggcggcgctggagggaacagtcgcgttcgaagaggtggatgacctcgcccgtgccgtcggcgaggatctgcacctcgatgtggcggggttccacgacggccttctccaggaagaccgtcgcgtccccgaacgccgaggccgcctcgcgcgaggcggcctcgatggactcgcgcagcgcggccgggtcctcgacccgccgcatcccgcgcccgccgccgcccgcgacggccttgacgaacacggggaaaccgatgtcgtcggcggcccggaccaattcgtcgacgtcggtggagggcgcgcaggaggccagcaccggtactccggcggcccgcgcggcggccaccgcgcgggccttgttcccggtcagttcgagggtgtcggcgtccgggccgacgaaggtgatcccggcccgttcgcaggcgcgcgccagttcagggttctcggacaggaacccgtagcccgggtagacggcgtcggcgcccgcccggcgcgccgcggcgacgatctcctcgacggagaggtaggcccgtaccggatgcccgggctcaccgatctcgtaggcctcgtcggccttgagccggtgcagcgagttgcggtcctcgtaggggaagacggcgacggtgcgcgcgcccagctcgtatccggcgcggaacgcgcgaatggcgatctcgccgcggttggcgaccagtaccttgcggaacatcctggatcccttcggcctgccggtgacgaggaccatggtgtcggtcacacccccggcacgccatgtgaaccgggccacttgtcgcgctcacgggtgcgggcgatcgtccgacgagccgtcagaaggggcgaatcggcggtggactgtcgcgtatcgtccgcgaaattgtcagtgatcggtaacagagggatccccagagagggtttcctcatcatcatcagtgcacggcaacacggaagacggcgagaagcggggcgggacatggtgcggcatggcggcggacggggttggcacgggcgggtcctggcagcggcgctcggggtgactgcggtggccgccgccacctcggtgtggaccgcgcaggccgatccctccggggggagcaaggggcacgcggacgcgtcggcgagcgcgtcggcggcgggcggcgcgcagggctccgccgcgaaggtggcggtgaccatcgcgcacgcgtcggacaagggggcccggggcgtcaacatcacgatcgacgacggaccggacccccactggacgccgcaggtgctggaggtgctgcgggagaacggcgtgaaggccacgttctgcatggtcggcacgcaggccaaggcgtaccccgacatggtgaaggcggtcgtggccgccgggcaccggctgtgcgaccacacggtgtcgcacgacaccgccatggaccacaagtcggaggcctaccagtcgcagcagatcctcgacgccgagaagatgatcacggacgcgtcgggaggcgtgcggccgatgtactaccgcgccccgggcggcgcgttcaccccctacagccgtcagctcgccgcgtcccgcgggatgcggccgctgggctggaacgtggacaccaaggacttcgagcggcccggcaccgcggccatcgtcgccaccgtcaagcaggaggtccacaacgggccgaccattctcttccacgacgcgggcggtgaccgcacccagaccgtggcggccctgcgcgaggtcctgccctggctgaagcagcaggggtactccttcggcttcccggtgcgctgacccgcacctcgcgccccgcgtcccgcgccccgcgtccggccgggcgcacccggaccgccgggcgtgcgcccggccgacccgtgcgggttccaggccgacctgtgcgggttccaggccgacctgtgcgggttccaggccgacccgtgcgggttccaggccgacctgcgcgggttgcagcccgcccgagtgcgttccaggccgccggatgagtcccggtcagccatgtcccgagccatgccccggcatacgc

SEQ ID NO: 1159 - DNA, 964 bp, Unknown
  Kingdom: Bacteria, Phylum: Actinobacteria, Class: Actinobacteria, Order: Streptomycetales, Family: Streptomycetaceae, Genus: Streptomyces
gctggtacgggcccgggtccaggagtacgcgggccggcccgaggagtgcctgcgcacctgccaggaagcggtcgagtgggcgcgccgcgccgaggacgtacggctgcaggccgcactccagctacggctcgccgacaccctggaacggctgggcgatccggcggcggcgcagctgcaccgcggggccgcggaacgcatgctcgggggcgggatccggcccgtcgggacccccgccgcggccgaagcggcggccgtccagggcgacacatcacaggaacaggacgctgaagcctgcgaaatccgcagcacatccgctgaagattgatgcaatgaaaggctagacagcgagaacgccttcattaaactggctctgccgctcgttctcctgcggtgtctcctggtatgcccccgcatgccggggtacgtctttattgccccacattccctgagtcaaggaccgtgatcgacgtgaaggtcggcatcccccgcgaggtcaagaacaacgagttccgggtggccatcaccccggccggcgtgcacgagctggtgcgacacggccaccaggtcgtcgtcgagcggaacgcgggcatcggctccgcgatcccggacgaggagtacgtgaccgccggcgcccagatcctggagaccgccgacgaggtctgggccgccgccgacctgctgctcaaggtcaaggagcccatcgcggaggagtaccaccgcctccgcaaggaccagatcctcttcacctacctgcacctggccgcgtccaaggagtgcacggacgccctcctggagtccggcaccaccgcgatcgcctacgagaccgtcgagctgtcgaaccgcgcgctgccgctgctcgccccgatgtccgaggtcgcgggccgcctcgccccgcaggtcggcgcctaccacctgatgcgcgcggccggcggccgcggtgtcctgccgggcggcgtcccgggcg

SEQ ID NO: 1160 - DNA, 1817 bp, Unknown
  Kingdom: Bacteria, Phylum: Actinobacteria, Class: Actinobacteria, Order: Streptomycetales, Family: Streptomycetaceae, Genus: Streptomyces
cacagtcaaagcggcggccgccaccgccaccgcgaccccagcggccgccgctttgactgtgcgcacggctccagtgtcgtggcgtaccggttcaccggccagtggaaggaacggtcggggtgacatgttcctgcgggttccaggaacagcggccttcatccctgcgggcgccgtcaggcctccggctgccggggccgttgcccgtagccgcgcagccgttcctccgcctgtgtcagttgtgccggggagagcagcgagggggtcaggccggggaccgaggacgcggtcagccacaggcggcacatccactccagttgggcggtgcggtcgtacgcctggtcgagggtgtcgccgtaggtgagggtgccgtggttctgcagcaggcagccggagcggtcggcgagggcgcgcagcatgttggcggccagctcctcggtgccgtaggtcgcgtagggggcgacgcgcacggggccgccgagggcgccggccatgtagtggatcagcggcagttcggggacgagcgtggagacggccgtggcgtgcacggcgtgggtgtggacgacggcgcccgcgccggtggtgcggtagaccgcgaggtgcatgggcagctcgctggtcgggaccagggtgccgagcacctgcgtgccgtcgaggccgacgccggtgacgtcgtccggtgtgagccggtcgtacggcactccggacggggtgaccaggacggtgtcccccacgcgtaccgacacgttgccggaggtgccgacgaccagtccgtcggcgacggtgcggcgggcggtggccaccagttcgcgccacgcacgggactcctcgtcccgcgcctgccgcgccacccgcaccgccggtacccccggctcctcccgtactccgctcgcgcaccccgcgtcccgctgctgtccggccatgcggcgatcctgccagcctcgcgccggccacgccgggcatccggcccggagagcgggcggacaagggagaagacagggagacgaagggagggaagacacagaatcggacaccgctgcgaccgcctcagttcatcttccgttcacccgggttacctacgttcgacgagccaatgacgctcgaacgattgcctgggtaaatggaaagcttctcgctgatcctcgcgattgtggtcgttaccgcactcgcgttcgatttcacgaacggtttccacgacaccgccaacgcgatggccaccaccatctccaccggcgcactcaagcccaaggtcgcggtggccatgtccgccgtgctcaacctggtgggcgcgttcctctccgtggaggtcgccaacacgatctccaagggtctcgtcgacgagaccggcatccgtcccgaggtcatcttcgccgccctggtcggcgcgatcctctggaatctgctgacctggctggtcggactcccgtccagctcctcccacgccctgctgggcggtctgatcggcgccaccatcgcctcggccggcgtcggcgccgtgcacggcgacgtcctggtcaccaaggtcatgatcccggcggtcgcggcgccggtcgtcgcgggcgtcgccgcggtggtcgcgacccggctgtcgtaccggatcggcaggaacacggacggcaaggcggccgagaagggccaccgggccgggcagatcgcctccgcggggctcgtctcgctggcgcacggcaccaacgacgcgcagaagacgatgggcatcatcaccctggccctgatcgccggcggcgccatcgcccccggttccaaccctcccacctgggtcatcctctccgcgggcctggccatcgcgctcggcacgtaca

SEQ ID NO: 1161 - DNA, 1722 bp, Unknown
  Kingdom: Bacteria, Phylum: Actinobacteria, Class: Actinobacteria, Order: Streptomycetales, Family: Streptomycetaceae, Genus: Streptomyces
ccgcccaccggcagcagcgccacgtccaccggcccgacctcctcggccatcgactcgaacaggccggtgtccccggcgaagtacgtccgcgcggcgccttcgacgacgtagccgagcgccggtgagcggtgcggcccgaccggcagccgccgtccgtcgtggcgcgcgggcaccacccggacgacgagcccgccgacctcgacccggtcgcccggcgtcacctcggtcatccgcaggccggtgagccggcgcagtcccggcaccgcgcggggcgcaccgcgcggcaccagcaggggcgtgccgggggcgagccgggccagcgaggggacgtgcagatggtccgcgtgcaggtgggagacgagcaccacgtccgcctgccgggcactcggcggcggcagcgcgccgcgccggcgccgcaggtgcgcgagacggcgggcgaacagcggatcggtcagcacacgcacgcccgaatcctcgaccgtgcacgtcgcgtgaccccaccaggtgatctccaccggcacttctttgcctccttcgcgcgactccccctgagcctacgtgcaggggtagtgtcggcggccagaacccggaggtgagggagactccatgggacacgtgcgggacgcccgcggccaggccggcgcgacgccggtgcgggtgacggcgatcgccagcctgacgcccctggaggagctgaacgaggaccccttcctcgtggactcccgcggccagcacgcgatgtgcgcccgctgggccgccgagcacggctacgtgatcgcgcgcgagctgctcgtacggggcctgcgcaccgaccaccgcgccctgtgggacggcgtccggcccggcatcgacctgttcgtcgcccccagccgccgggtgctggagcgggcgctgtcctccgtggaggagttcaccgcggagtgcgcccggcgcggggtgcgcgtggagaccgtcggcaccgccgaaccgtcctacgacgcccagatgaaggcccacgtccaccgccgcctctccatgcccaccgccggctacgacggccgctaggcctttgccgcccgcccctgctttcccctcctcacctgcggtgttccgtggttgtccacaggccggccgggccgctcggggcgtgtgacaagctggagcgggcccatcggacgaccgggccgggacgtgaggtgtgcgggcgtgcgaggcgggtggtggcggcgagccgccagtcaggcggggcggagcatcacggtgtgggccgtgtccacggtcaccatgctggtgctcgccggtatcctgcccgacttccagctccagtccgccgacggtgacagcgcgaccaccatcgccgtgaccgcggccctgggcgcgggcgccttcggtgtcctctcggccgtcgtctggccgctgctcgtgcggctgctgctgctcgtgccagcgctcgtcctcgggctgctggtcttcttcctcaacggctcgctgctcctgctcgccctgcgcgtcaacccctccgggcacccgcaggcggccccggagaccgcggtcatcgtggccgccgtgatgtccgcggtcgcctccgcgaccggcggcgccctcgccgtccgcgacgacgaggcctaccggcgccggctgcaccggctcgccgaccgccgccgacgacgccggccgccctgctcggcgacacccggaacggtcgtcgtccagctcgacggcgtcggccacgacgtcctgcgg

SEQ ID NO: 1162 - DNA, 3170 bp, Unknown
  Kingdom: Bacteria, Phylum: Actinobacteria, Class: Actinobacteria, Order: Streptomycetales, Family: Streptomycetaceae, Genus: Streptomyces
ccctggaacaactcgccgtacagggcaccggtttgcgggtccacggccgatccggccgcgttggccacgacgagcgccgccaccgtgacacccgaggcgagcacggtgctcgcactgccgaccccgcccttgaccggccccacggccgctcccggcggcggcctcgaccgcgtcgcgcccggtggccgcgtccggcctggcccggaagtcgccgcccctgcccaggtcgaacacgcaggccgcgggcaccaccggtaccacgtggcgggggtcagggcccacccgcaccccgcgcccgcgctcctccagccaggccatcacccccgaggcggcgtccagcccgtacgcgctgccgccggtcaggacgaccgcctccaccgtccgcaccaggttgcgcggatcgagggcgtcggtctccttggtgccgggcccgccgccccgcacgtccaccgcggcgacggcaccgccttccggcgccagcacgaccgtcgtcccggtgagccacccgccgcccgcgcgggtcgcatgccccacgcggatcccggcgacatccgtcaaagcgtccactgtcatgcgcgtcggtctcctgtcatacgcgtccgtctccccgccggtccggtccggtccggtccgtcgccgcggcggcccgcagaccgtcaccgacgtcactccgcccggcgcgccgcccggtccccgcccgctccggcggacctgcgcgcggtcaggatgacccccgtcaccacggcaagtgccgagacgaaccccgccgcgagcaccgcccagtcgcccaggaaggtgcagcagatcaccgccagggcggtggccggcaggacgagctgctgggcgatgcccaccttgaagtggcgtgcgtgcagtgcccagacggtgatcaggtacagcgcggtcggcagcgtcacggcggcggacgcctccagggccgacaggtggctcttgccgacggcctgctccaccgccacctccagtcccgcgccgatcgccgccgccgaggcgaagatcaggtagtggccgtatccccacaggaacgactcgtggttggagcgcagatgaccgtggatcggcaccacgaagtagatccaccaggcggagaagacgatcagcaggccgcccgccgcgatcggcagcaactcgcccagcgcgaagtgttcgtccgcggccgacttcaccgcgaccgtggccgccgacaccgtctcgcccagcacgatgatcgtgaacagtccgtaccgttcggcgatgtggtgcggatgccaggaggtcgcccgggcccgctccgcgtacaccggcaccgccagctccgcgaacaccatcaccaggaacacccagggcctgcccggttccggcaggagcaccagccccagccagccgacctggcacagcagcacgccggccgcgtaccgcaccgccgtcttgcgctccgcgccctcggcgtcccgtgccgcgcgcagccactgggaggccatcgccacccgcatgatcacgtagccgagccacaccaggaagaagtcgtggtcggtgaaggcgcgtgagacgcccgccgccagcaccagcacacccgcgatctgcagcagcgtgacgatccggtagaggacgtcgtcgttgtcgtacgccgaggcgaaccacgtgaagttcatccacgcccaccagatggcgaagaacgccatcgcgtagctgaggatgccctgcccggtacggccctccgccacggcgtggaccagctcggcgcccgcctgcgcgatcgccacgacgaagcacaggtcgaagaagagctcgagcggcgacgacacccggtgcgtctcgtgtcgcccgcgcgcggtcagcgggcgcagcggccgggaagtgcgggagggctccggggagccgggcccctgagcggaagcggaactggacgtcatggctcacagcacagcagaaagccgccggaaaatcccgcgccggacgcgcccgcccgggaccgtaccctggaggcatgagcactgcccccgagccgagtgagccgcgtgagccgaagagcgcgctggtcttcgacgacccgctgaaccagcagtccaccgacgacaccgaccggggatggggcgagcgcccggacggcgacgccgccgccgacctcaagcgcttcctcgacgagaagccgccgcaccacttgtgaccccggcggccccgccctgccgtgaccgctacacccgctcgtgctcgccgccgcgctgcgcgaccagctcgtcgcggatctccttgaggacctgcagctcggtcacctcgagcaccggctgcgtctcctgctcggcgtccttggccttcttccgggcctcctggcgggccaggaacttggccatcggcaggaccatcaggaagtagacgaccgctgccgtgatcacgaactgcagggtcgcgccgaggaccgagccccacatgatctggatgccgtcgttccccttgcagctggaactcaggcacgagctgtagtggtcgaggttcttggtgccgatcgctccgacgacggggttgatcacgcccttcaccactgcgctgacgatgttgctgaaggcggcgccgacgaccaccgcgactgccagatcgacgacgttcccgcgcatcaggaaggccttgaagccctgccagacgctcgggtccttcttcgtactcacctcgggacactcctcgggcatgcaggttgtacaacaaacagctcagcaacctaaggctcaccagagggtcaccgccaatcgggccgtcgcgcccgccccggccagctgtaccgccgtggaacgcggcacggcgagtgtgaccagggcattgtccgtgccgctccctgcggccgatgccacgccggtccccccgccggtgtccatgcccgaacccatgtgcaccgccgcgccggggtcgccgagcagctcggggaccttcttcacccgtgctccgcgcgcgacgacccgggcctggccgcctgtcgcctgatccgtgacggcgatcacgtccacccggtcgccggggcgcagcagccggaccgtcgcggcgtcggccacgcgcacgggcacggtcaccgtccggtccgcgtctgtggcgcgggcgccgcgcaccggggcggcggccggatctgccgccgggcgcggatgtccgcgggcgggggtgccgcgaggggcgtccggcgccaggcg

SEQ ID NO: 1163 - DNA, 3092 bp, Unknown
  Kingdom: Bacteria, Phylum: Actinobacteria, Class: Actinobacteria, Order: Streptomycetales, Family: Streptomycetaceae, Genus: Streptomyces
cgactacggcgtgcgccggcggctcagcggccagggcgcgcgcttcgtgcaccggcactggctggacccgctggtcgtcctgctgcccctgctccggccggtgcgcatcgtacgggtccacgacgccgtacagcgccggcgcggaggtccgcggtggccgctgcaggcgcgggtgacgctgtacgccggtctgtcggcgctgctgctcggcctggccgcgtccctggccgtgtacggcgtcgagcaccgggccccgcacgccacgatccgcacgtccggcgactcggtctggcgggcgcgctccacgctgtccactgtcggctacggcgatgtcgctccggtgacaccgacgggccgggtggtggccgtcgccctgatgggctgcgggcttgcgctgctgggaacggtgacggggtcgttcccgtcgtggctgatgcagcgcttcgcgcagccgggagacggagacgggcgaaggcccccggggagctgagcttcccgggggccttcgacgtgcccggtcgccggtgccggatcagacctgcgtgcgctcctcgacgaccttcgcgatcttcgcgatggcctcgtcgaaggggatgccgttctcctgggagccgtcgcggtagcggaaggagacggcgttgctcgccatgtcctcgtcgcccgcgatgaccatgaagggcaccttctgcttctgggcgttgcggatcttcttctgcatacggtccgaggaagagtcgacctcgacccgcaggcccttcttcttcgccgcggcggcgaacttctccaggtactccacgtgcccgtcgccgatcgggatgcccagcgcctgcacgggcgccagccaggccgggaacgcgcccgcgtagtgctccaggagcacggcgaagaagcgctcgatggagccgaacagcgcgcggtggatcatgaccgggcgctgcttggagccgtcggcggccgtgtactccaggttgaaccgctcgggcaggttgaagtcgagctggacggtggacatctgccaggtgcggccgatcgcgtccttgacctggacggagatcttcgggccgtagaacgcggcgccgcccgggtccgggaccagttcgagcccctgcttctcgccgacctggcgcagggtctcggtggcctcctcccagacctcgtccgagccgacgaacttctccgggtccttggtggacagctccaggtagaagtccgtcaggccgtagtcgcgcagcaggttcagcacgaaggtgagcgtcttgtccagctcgtcggccatctgctcgcgggtgcagtagatgtgcgcgtcgtcctgggtgaagccgcgcgagcgggtcaggccgtgcacgacgcccgacttctcgtaccggtacaccgtcccgaactcgaagagacgcagcggcagttcgcggtaggagcggccgcgcgcgtcgaagatcaggttgtgcatcgggcagttcatgggcttgaggtagtagtccacgccctcgtcgagctgcatgggcgggtacatgccgtcggcgtaccagtccaggtggcccgaggtctcgaagagcttccccttcgtcgcgtgcggggtgtagacgaactcgtagccctcctcctcgtggcggcggcgcgagtagtcctccatgacccggcggatggtgccgcccttggggtggaagacggcgaggccggagccgatctggtcggagatggagaacaggtccagctcgttgcccagcttgcggtggtcgcgcttctcggcctcggcgaggaagtcgaggtactgcttcagctcgtccttggacggccaggcggtgccgtagatgcgctggagcatggggttcttctcgctgccgcgccagtaggcggcggcgttgcgcatcagcttgaacgccgggatcaggcgggtggagggcaggtggggaccgcggcagaggtccttccagcacagctcgccggtcttggcgtccaggttgtcgtagatcgtcagctcgccggcgccgacctcgacgtccgcgccgtcgtcgtgcgaggcggagcccttgaggccgatcagctccagcttgtacggctcgtcggccagctcctcgcgggccgcctcgtcggtgacgacgcggcgggagaacttctgcccgcgcttctggatctcctgcatcttcttctcgatggccttgaggtcatcggggtggaagggcttttcgacgtcgaagtcgtagtagaagccgtccttgaccggcgggccgatgcccagcttggcctcggggaacagttcctgcacggcctgcgccatgacgtgggcggtggagtggcgcaggatattgaggccgtcctcggaggagatctcgacgccctcgacggtctcgccgtccttgacctcgtacgccaggtccttcagctcgccgctcacgcgcgcggcgacgatcgagcgctcgccggcgaagaggtcggcggccgtggtgcccgtcgtcaccgtgcgctcttcccgctcggaatcgcgttggatgatcacacggacgtctgacaccggtctctcctgactgcaggtgggtgcggcgccataccgggagcgcgcgcatgactgggatggtaccgagagcggggtgccctccgcgaaacggttgttcctcagtcctgctcagggggctcccgccccgtgtccggctcgccgaagaagtccgtgtccttcggctcctcctgcagcgacttcatcagccggtcccgctcctcgtcgtccacctggacggggacgacctcgcaggcgccggtgagccggcggaagccgccccggctctccagccggccgaggacccgcaccggcaggccgacgaggtgggcgtgcccggcggtgcggtagtcctcctcgtccagggtgacgcggacgtagggcacctcggcgcccgagagcacccgcagccgcaccgtgccctcgccgtgcggctgggtcctgcgcatccggaccatggcgccggtggcccgccggtagtcgatggcctcgcggacggcgtacacggcctggtggagccgtacggccagcggccgggcggggtcgacgggcacgagggcggtcaggcctgcgccgccggtcgcggagccgacgaggacgtggg

SEQ ID NO: 1164 - DNA, 1043 bp, Unknown
  Kingdom: Bacteria, Phylum: Actinobacteria, Class: Actinobacteria, Order: Streptomycetales, Family: Streptomycetaceae, Genus: Streptomyces
ttgcgtgaccgtgtcgggcgtgttggggggaccgcggtgggggcgggggatgtgaggaccggggcgtgcgcggcgcgtgcgctgttgcgagagcggtacaacggggagcgaaccggggcgcgccgcacctcgtccttgctggtcgaggcccgtacgaccggtgcgggcgcgggtgggagaagggggaaccgtccgatgtcgtcgctgacggggatgcggatgcggacttggacgcgcacgtggatgcgaccgcgcctgccgcgcacgcggagcgggcagcggcggctggtgcaggccctcgcggccgtgtgcgtgctggcgctgcttccggcgacctggctgtacctcgccaccggcgaccggctgcgcaccacggcggacgcgccgcgcaccgacgtcgccgtggtgttcggcgcgggcctgtggcagggcgagccgtcgccgtacctggcgcaccgcctggacgcggcggcgaagctctaccgggagggccggatcaaggtggtcctggtcaccggcgacaacagccgtgaggactacgacgagccggacgccatgcgcgcgtacctgacggcgcacggtgtcccggccgcccggatcgtgaccgactacgccggtttcgacacctgggactcctgcgtgcgggcgaagaagatcttcggcgtggaccgggcggtgctggtcagccagggcttccacatccggcgggcggtggccctgtgcgaggcggcgggcatcgattcctacggcgtcggtgtggacgcggcgcacgacgtcacctggtactacggcggcacccgtgaggtgttcgcggccggcaaggcggccctggaggcggccttccggccggacccgaggttccttggaccgaaggagcacggggtcgcgcgggcgctcgccggggcgggggccgggaccggggccggctgaccccggcctcaccccggaccgggtgaccacggcctcaccccggaccgggggcggcggggaggtccccgcctcggcggcgtaacaggagcccgcccggtggcgtaacacgcccg

SEQ ID NO: 1165 - DNA, 857 bp, Unknown
  Kingdom: Bacteria, Phylum: Actinobacteria, Class: Actinobacteria, Order: Streptomycetales, Family: Streptomycetaceae, Genus: Streptomyces
cagcctgccccgcgcggcggacgcgctccgtgtcatgcacggtcatgcacgccccgtccttcttcccccaccgaggagaccgaggaacccgccatgacaccacccgctccggacggctccggccccactcccggcagccccaagtccggccccggcccccgcaccgtccccgcggccccggccgccgccgaccgcgtgatcagccgcaagaccctgctgaaggcggccgtcgccgccggtgcccccatcccgctgctcacgggcacggtggcgctcgcccgcgactccgccggccggggagccccgctgcccgcgacccccacctgtgacgacggcgacggcccgacccacgaccagatcgagggcccgtacttcaagccgaactccccgctgcgcacgaacctggtgacggcgggcgtcaacggcaccccgctgaccgtcagcggctacgtcttcggccgcaactgcgtcccgctctccggggtgctgctggacttctggcaggcggacgacgccgggaactacgacatggccgggttcaccctgcgcggccaccagttcacggacgccaagggagccttccttctgaccacgatcgtcccggggctctatccgggccgcacccggcacatccacgtcaaggcgcaggcgcccggtcggccggtgctcaccacccagctgtacttcccgggtgagccacgcaacaacacggacaccatcttcgaccccgcgctgctgatgaacgtgcgcggcgccggcagcggcgaggaggggacgttcgacttcgtgctgaacgtcgacggcacccccggccccggcggccccaccgacccgccgaccgatccgccgggcggcac

SEQ ID NO: 1166 - DNA, 7626 bp, Unknown
  Kingdom: Bacteria, Phylum: Actinobacteria, Class: Actinobacteria, Order: Streptomycetales, Family: Streptomycetaceae, Genus: Streptomyces
gccgcgacgttgtcgatggcgatgtggtcgtagggcaggtcgtactcgcgttcgccgagcaggaccagcggcaccggttcgctccgctcccgcaggtcctccgcctccagctcgatggggctcaggatgagcccgtcgatgacccgcgtacggaagccctggctgaccaggatctcctggtcgcgccgcccgcccgtgtggtcgagcagcaccgtgtagtcgtgttcggccgccgcgtcgatgacctcggcggccagctcggcgaagtaggagttgccgagttccggcagcgcgagggccacgatgccggtgcggcccttgcgcaggtgccgggccgtgaggttcggacggtagccgagttcgtcgatggacttgcgtacccgggcgcgcatcgcgggggcgacgtgcggatggtcgttgaccacgttggagacggtcttgatggagacgcccgcgtgcaacgcgacgtccttgaggctcacccgcacgacattcctccacgcacccgggcaggagtcccggccgacgacctcgccccgcccccggctgccgggccccggcatgccgaaggaccagcaccgttttccaacgttatacgggtcgggcgtccgcgctggcaaggccttgcccggcggaacaccccgacgagccgccgcgcactggctcttgacgctgcgtcagcccggtcctacggtggcgcaccgctggcgttgcaacgatgtaaagcactggatcggccgcacagcggaaccgacgtgcgggcggtcctcccggaaggagcccctgatgcacccgcaaccccacagaacccggcatccctcgctcaccctgcgcctgctcggcgtcctcgccgtgctcggcctgatcctcaccggtacgtacgctctgcggcccgccaccgccgacgccgccccgcgcactgccgacgccgccccgcgcaccgcccaggcggcacaacgcaccgccgtcgcgggcacgttccgcaacccgctcaacaccgggcccgacccgttcatgacgtactggaacgggaactactacctcaccacgacccagggcggcagcatccgcatgtggcgctcgccgtccctcgccaccctgctcaccgccacccccgtcaccgtctggaccgacaccgacgcctcccggaaccgggacatctgggcaccggagttctaccgtttcggctcccgctggtacctgtactacaccgccgacgacggcaccgacgatcaccaccggatctacgtcgccgagtccggcggcgacgatccggcgggcccctaccacttcaaggcgaagctgaccccgcccaaccacgcctccgacttcgccatcgaccccggcatcctccagcacgacggccgtctctacctggcctacagcggcatcaaccagtaccagcacaacggactgaacatcgcgccgctgtcgaacccgtacaccgtctccggcgacgccgtggccatcgacggcgccggcggctgcccggaggtccgggagggacctgagttcctgtaccgcaacggccgcacctggatgacctactccacctgcgacacgggcaagcccgactaccaggtctggatgatgtcactgccgtccggcgccgacccgctggtccccggcaactggacccagcaccaggggccggtcttctcccgcgccgacaaccacggggtgttcgggccgggccaccacgccttcttccgctcgcccgacggcaccgaggactggatcgtctaccacgccaagaccacctcggcctacacctacagcgaccgcaccacccgcgcacagcgcatcggctggaacgccgacggcagccccgccctcggcgtcccgctcgcgatgggcgccacccaggacctgccgtccggtgacccgggccccggcgcctactggatcaacgacgacggccgttccaacggcgccgggaccctcgcttacaccggttcctggaactccggcaccggctgcgccgtccagtgcttctggggcgacgaccactggagcgcgaccgcggggaacaccgccacgttcgccttcaccggcacccgcatcgccctgctgtccgtccgcgacaccggcaacggctacgcggccctcagcatcgacggcggccccgagcagcgcctcgactactacggagcgatccgcaccggtgagaccctccagttcctcagcccgccgctgccctacggacggcacagcctgcgcgtgcgggtgaccggtgagcacgacgggcagtcccaggcgtcgtacgtcagcgtggaccgggccgaggtctatgtgaactgacggcgtatgtgaactgacacggacggccctcccgggcccggcggaacaccgggtccgggagggccgtcgcaccgtccctgggagtgttacgtcaccgcgtggttccgctcgccgcggcgccggccgaggcacccgccgcgatgagcctgcggttgacgtccctgacctggtcgggcaggaccttcaggaccgcccggtcgtaggtcaccagcccgttgagttcgccctcgacgtcgctgatctgcgtgaagacggagccggacagaccggcggccgcgttcgggatcagctggctggtgttgtccacgtacgccttggtcatcgccgcgatgtccttggggccgtcaccgtagtcctgaccgcccgcgacacccgcgatgtgccccggaacggtcagcgagtagccgccgtgctcgccgtcgaccgccgcgcgggtggcgtcgggcgcggggttcgccgggccgtggtacatgtggtagtcgatgacgtcaccacgaccggaatcgcccttggacgcacagcagttgactcccgagtgggcgtcgaccagacgcgaggggtcctgctgcttgaccgagtcggcgagcgcgccggtggactgcttgctctgctcgccccagccttcgttcatcatggtccacatgacgacggaggggttgctgatgtgctggtccacgatctcgtggacttccttgtcgaactccgcgttgctcgcggcactggcggagtcggtgaggcggctgggcatgtcctgccagaccagcagcccgagccggtcggcccagtagtaccagcgggccggctccaccttgatgtgcttgcgcacggtgttgaagcccagctgcttgtgcagctggaggtcggactcgagggcggcgtccgtgggcgcggtgtagatgccgtcgggccagaagccctggtcgagggtggccagcaggaaggtgggcttgccgttcagctcgatcttgttgacgccgccgaccttgccgaccgagatcgaccgcatgccgaagtaggagccgacgctgtcgtgcgagcggccgtcggagagggtcaccttcaggtcgtagaggaacgggttgtccgggctccacagcttggggtgcgggacgcgcagcttcagcgcggtgccggcggtgccggtgaccgaaccgacgcgccggtggccgtcgtaggcggtggcggtcacccgcgccgtgcgcttcgttccggcgccgggacggaccgtgaccgacagcgagtcgtccttgaggtccggggtgagcaccagcgagtcgatgctctcctcgggaacgggctccatccacaccgtctgccagatgccggaggtgggcgtgtaccagatgccgctcgggtcgggcgactgcttgcccgtcgcctgctgggaggagtcggtggtgtccttgatcttcagcagcacggtctggtcgccgtgccgggtcacggcgtccgtgatgtcggccgtgaacgcctggtagccgccagtgtggtgggcgacctgccgtccgttgacgtagacccaggcctcgtagtccaccgcgccgaagttcaggtgcagccggttgcccgaaccgacccgccagccggccgggaccttgaacgtgcgctggtacagcgaccagtcgtggtgctcggcgacaccggacagcggcgcctccatcgggtagggcacgaggatcttcccgctgagcctgcccttcggcagcggggcgtcctgcgaggtcccctggaactgccaggtgccgttgaggttggcccactgcttgcgggtctgctgcggacgcgggtagtcgggcagcgcgttggacggcgagacgtccttggcccactcggtggcgaagtaccaggtggagtcgttctgcgcgacactggagaacaccggcagcgggccggtggccgtgttcagtccgccctggccgtcgtagttgatccgcacctgggacttcatggccgccggggtgtccgaggccgcggcggtgaagaccagcttggagtggtcggaggcgtccgtggtcacggtcggggaccagcggtggccaccggcgatcaccgagacgtgccgcgtcaggtccgcgggcagcgcgttcaccgcgccgggcagctgcacgaccgccttgcggccggtggtgtccacggtgctgtgcaggtccgcgggcgcgaagccgtccggctggtgcagcgcggagtccgggacgggctggcggccgatgcccgggcccgaccactcggtctggatgtaggcgccgccgttgccctggttgtagtcgaacgacagcaggtgcttcccggccgtcagcgtgaccggctcggactgggtctgcacgtcccagtcggtcgtccagtggtcgatgacgctcttgccgtcgagcgacatgcggaacccgttgtcacccttgatgtagaacgtgtacgacccgtcggcgggcacgtccagcgtgcccgtccagtgcacggcgacgttcagcgtggaaccggcgcagtcgcgcagcgtcgggaggaggtccttcacgttcagggagggctgcacgccggtgctgccgtaggtggcgaagtccagcgacgtgctgtcggagctgaggtagcagtcgctgcgcagtccctgcggggtggaggcggtggtggcggcagcggcggaggcggcggccggcttgcccgccggttcggcgtgggcggtggagaccggcgcgaggagcgcacctcccaacagcagcggagccacggccgccagtctgcgggggagggtcatgcggtgtcttccgggactcaagggagatctacctttcgtcggagcgtcggagcgatggagcgatggagcgatggagcgatggagcgatggagcgatggagcagtgggacggtggagcggtgggacggtggagcggtgagcgggcctgcctggtgccgggtgcctctgcggacaccttcggcaggccctgagggctccgccggcgatcaggcccgtgtgccgcccggccgggcgcgccaggccagcaggccgccggagaacccggttctgagctgcgccgtgatgcgcagggccgtggtggtgacggcggggaaggagacgtcgttgaagcggtcggtggcgatgccgtagccggggctaccgccgacggggagccaccggccgtcggccgagcggtactccagccgccaggaccgcgggacccggcaggctccgtgcccggtgtcgtcgtaccagtacaccgacaccgcgtcgaggcggacggcgtccgtgtagctgtactggatccactcctcggtcccggtgcggtcccaccacgtgaagcgcggcaccgcctggtcgtaggaaccggagggcgtcacggcggcgttcatcagcagggcctgcgggctgtcgactccgctgaaggaggcggtcaccgcggcccactcgtgtgctctgcccgacgcggcggcggtcggaaaggacgtgatgcgcagccgtgcggcggcggccgggatcagcgtgaggtgttcgaccggttccgtggtgcgggccgggctccgctggagcggggcgacgacgttctggtcgtcgctcacccacccggccaggcgccgtcccctggcccgcagggccaccggggtcccggactgggtgaaggggttgccggcccgggcacgggtgcgctcgagggtgaacgaccgggcgggatcgtgctcgtccagctccagcgcgtagttccacgccgaggcggggcgcacctcgtactccggccatgcggcgctgccgccggactgctgccacttctcctcgatgcgcagggagtagccgagcgggccgtgggagacggacaccgagtcctcgttctcaccccacgtgcgcacgctcgtgcgcatcggcagccgcagcacgatccggtcgcggtcgtgccagcgccggtcgagcaccaggtacccgccactgcgccggacggacacgggacggccgccgagccggaccgacggctgctcgcaccagcccgggacacgcaggtggagcgggaaggagacggcacgcggagtggacacggtcagggtgacggtgtcgtcgaacgggtagtcggtgtgctcggtcacggtgaccgtggtgccgtcaccgaccttggcgcggaccgaggactcgccgtacagagaggcgcacaggccgccgtcggcgctcgcgagccacatctcctcggcgtagtagggccatcccatgccgtagttgtggggacagcagcggtactggtggatgcccggcatgtacgcctgcatggcgaaggagttgttgaactggccgtgggacttggcaacgttgtccagctggacgctgttggcggccgtgacgtagtgggtgcccttctgcagcgggtcgaaggcggcgggcagcatgttgagggccaggtcctcgcagcggtcggcccacacggtgtcccccgtcatccgggtgagcaactggtggctgtgcatgtactcgacgacgccgcacgtctcgaaaccctggcgcgggtcgtggtatccggggcgggcgttctcgtccgcggcgaagccgccgccggggaactgcccgtagctgcccatgacggtgtcgtagacgcggtgggtggccgcgaggaaggaagggtcgccggccaggacgccgtactgggcgggctcgcggaagccctgggcgaggttgacgttgtgccaggtcgggatggagtgggtgtagtcggcgctgtgggtgtgcatggtgcgcaccaggtcgaggagccagtcgtcgccggtgcggttgtagagccagtaggcggtgtcgatggtgtcgccgacgcgggccgagccccagccctgtccgaagagcgtgccgggctggccgtgcaggaacttcagccagcccgtcagggtgggcacgacgcggtcgtcgccgctgaactcgtgccaggtgcgcagggcgtccaggaccggcatgtggggccagaagtccggtccgccgttcagggcggtgcgcaggcgggcggggccgaagaagccgtcggactgccgggtggcgaggatgcggtcgatccaggcgcgggtcagttcgagggtgcggccgtcctgggtgacgtagcccaggtcgccgaagcccctgagccagtagggcagttcctcccagccgtccttgtccgggacggaccagccgctggtcgtcgcgtccaggtagccggacacctcgggcatgcgtccgttcagcccgtcgagttgcagatcgagctgtgtgcgcagccagcccttcggggtgatgctgccgggcggcagccgcaggaacggctcctttcgcagcggggcccggttggccgtgtagtgggggccggagccggcggccgcccggcagcatcacccc

SEQ ID NO: 1167 - DNA, 3133 bp, Unknown
  Kingdom: Bacteria, Phylum: Actinobacteria, Class: Actinobacteria, Order: Streptomycetales, Family: Streptomycetaceae, Genus: Streptomyces
gggccgccagtgacaggaacttgcgaaggagtccctgtgatcgacagcatgacacgcccccgcccccgcacggcggccggggacgccaaccgtcgtctcggcgagcacctcctggccgtgatccgcgcccaggacgccaggatccccgctcaccgtcgcgtcccgcgcacggcggcggagatgcgcgcccgcctcgccgagcgcaccgcgcaggcgcaggctggcgtgatgagggaggacgcctgtcccatctgcggccggtggtcgtgcgacggcacgaactgcatcgcggccgcgcccgcagagccgaccgccgtaccggcgactgctgggccgggtgaccccggctggggacagtgcagcaagtgcgggggctggttccccgatttctgcggcggcctctgctcggcctgccgctgacggatgccgcacctcatacacgcggcccgcgcagcccagcatcgggcagcgcgggccgcgtccgtcatcggccccgctcacccgctgacccggctgttgctcgcggccgccgctctggccgccgcagccgcctgggacgcgggccaccgggtgaccgacctccaccaccccacccgccggcaccacgaaagacaccctcgtgcctgacgacctgtaccagcgctacatggccgcccaccgcgccaaccaggcgcacaccggcgcctgcaccacctgcaccgccaccacccgctgccccgacgggcaacggacgtacgagcgcttcgcccgccttcaggacgcctacctgaagcgccagcgcgaccagcgccgccgctgagccatcccgctcagccgacaccgccacctctgtcggttgcctgacccgcccgtcccggccccgccccacggcggcggccggtacgggcgcggtccaggggagccggacagccgtgctctgtctgcctgtttggagatcccatggcccacacgatcccgttgcgcacgcctctggacgagtccggactgccgcgcaaggaactgaccgccgccccgggcggcggccccgccgtaccgcgtccgagcatccccgcgccccgtcgaggagacgacatgtccggtagcacgttcaagctgacgcccgacgagacgcgcgaggtcttcgcccggctccagccgcatctgccgccgtacctgaagaagatcgagcccggcccctgcgggcggggactgcacttcgagttcgccccgttcaccggccgcgagaacgagccgaccatgcccgccgcttactaccacgacccccggctgacctacgtgctggagtcggaggacgcgaccgagaaccggctccggagggcggccgacaccatcctgagtgacctcttcacccaggcgcggggagagtggcaggacgccgcctacgtggccgccctgcgccgggtcgtcaaggacgcccccgacctctggcgggcctacgagcgggaggcgaagaccctggagtcggcctacgcctacctgcgcaccccgcaggccgcggcggagtggcctgccgcaatctcccgtctggtcgacgcccaggaacggaccaaggccgcggccgccgcgttcgacgaacgggcggcggacatcgcccaggtcgactacgagtacctgcacgccgacctgagcccggcccaggccctcaagaaggccggctaccccgaagccgcggactggcacgtcggcgacggcttcggcggctacttccgcaacggcctcgccgaaaaggtctcctgcctcatcacggagcaggaagcgcatgtggccaaggttgcccgcctgaccggccacgccgtcatctgacccccgccgctcctgccggagcggcatcgagtttcgagcccgccccgcgacgcttcgcgagaccggccgcctgccacccgggccgtcggtcttttcgtgcgcgcgcggagcgggtagagccggtgccggtttcgtgatcactcgcctacaccgagcgccgcttcggggacgcgccgccgcgtttcgggagcagcccccgccgtttcgcgcacgccctgaacgagcccactggaggcccctatgacgatcaccgacatgccgcagacggcggctcccgacacccccgcttcgcacccgccggaccgcgcttcgggcgcacccgagaaggtttcgggtacggccgggggcgtttcgcggacggacaagcggaagacgatcaagcccaaccgcgaccggctgatgaccgccctctccctcgtcgccgcgatcggcggaacgctggtcggcgtcatcggcttcgcgatgtcctacagcaccctggctaaggtcgccctgagctggggattcagcaaggaactggccccctggttcccggtcggcgtcgacgccagcatcatcgcgttcctcgccctggacctgtacctgatccgcaagggcaccccgtggccgctcctgcggatggccgcccacgccatgacgggcgcgacgatctggttcaacgccagctcacagggccacatcggcaccgacccggtccaggccgccagccacggcgtcatgccgatcctgttcgtgatcggcgtggaggccgcccgccgcctgatcatccaaaaggccaggctggaggcgggcacggtcaccgaccggatcccgctgcaccgctggatcctctcccccatcgccaccccggtcttctaccgccggatgcggctgcacaacgtcacctcgtacccggagatgatccggcgccagcaggagctcatcggctacgagcagtggctcaagcgcaagtacgacggcgacctcggcaaggccaccgaggacgaactgctgccgatgaagatggccgcccacggctacaccgtcgcgcaggccctcgcgatgcctgagcagcaggaacgcgctgcagaggcccgcgcggaggaagccgagcgccggcgcctggacgcggagacgcgccgggagctcgcgcgcaagcaggccgaagccgaccggctggaggcggagggcaagctcgaggccgtccgcgctcgggtggcgggtgagaccggccaggcccgcgcgcacgcccgagcccaggtcagcgccgcagagcgtgccgctgagctggaggaggccgcgctggaggcggccgtcatcgctgaagcccgtgcacgcgaggcggaggcgg

SEQ ID NO: 1168 - DNA, 1130 bp, Unknown
  Kingdom: Bacteria, Phylum: Actinobacteria, Class: Actinobacteria, Order: Streptomycetales, Family: Streptomycetaceae, Genus: Streptomyces
ctccttcaagctgcgcggcgcgctcctccggcagcaggccggcgatccgcacgtaggcgccgcgcagcttgaaggagccggtgcgctggaggttctcgcacttgaggaggaccggcgcgcccgccagctcggacaggtgcctgctgctctccatcgcggtcacccgcgccacgcccgagagcatcttctgggcgccccgcacgtcgtccagcgtgacgggcgggaaggactcagccgtgccgtagctcatgatggaagtctcgcagttcacggtcgcggcacgccggtgtgaccaacccgcgagaccggtttgcgcagcgccggtacggcccgccgtccggccgcgtaccctgtcccccaacccagcagcccgtcagaagtgagcctccggccatgcccacaacacctgaaatgtcgatggacatgacgagcgtcggtgacaccggtctcctcgaaaccctccagcacgaggtggcgctgttcgcccgccgtgcggaacagacccggctcggcggggtggggcaggtccgcaactccatggaccgtgccgcctacctgctgctcaaccgcctcgacaaggaaggcccgatgggcgtcaaggcgctcgccgcgagcatgggcatcgattcctccacggtcacccggcaggtggcaccgctcgtcgacaccggcctggtcaagcgcacctcgcaccccgaggacgggcgggccgtggtgctgcagctctcgccgcgcgggctgacgcggctggaggaggtgcgcacgtccaggcgccgtctgatggccgagctgaccgaggactggacgcccgaggagcgtgcgacgttctgctccctgctgacccgtttcaacgacgcgctctccggccgccagtcgccgcagggcggcgcggcgcggggggctggaccggcgtcctgaccgccgtcctgcccgccgtcccggtgcggaccggggcgccagacgccgatgccgcctgcgcggctcttgaccgacgggccgcgcctggcctgatatgagaccgggggttcggccgcaccggttctccgtgtgccgtcacgcggccgcggtcccttcttcccacgatcgccgtcggcaggaggcgcggtgcgacaacggcaggcgtccggcgg

SEQ ID NO: 1169 - DNA, 4755 bp, Unknown
  Kingdom: Bacteria, Phylum: Actinobacteria, Class: Actinobacteria, Order: Streptomycetales, Family: Streptomycetaceae, Genus: Streptomyces
gcagccgggtcagccgcttgggcgcgcccggcgggcggctgcgcagctggccggtgaactgccaggtgcgcggcacgatgcagccgatgagggagacgaacagcaggatgtagatcgccgagaaccacaccgagctgtagacgtggaacaggccgagcttgtcgtagagcggcgcgagcgtggtgtgggtctgccggaaggtctcgaccttcatcgcgtcgctgccggtctgggggatcagcgagccggggatggcgccgagggagagcaggaagaggagcagcagcgcgacccgcatggaggtcagctgccgccagaaccagcgggtccagccgatgacctcgcgggcggaccaggcgaggcggccggccagaccgggggcccggctgccgccgaaggaaccggggacggtcgtctcggcgggcgccgtggacaactgcgatccggcggcgcccaggtcgtcctcaccggggggctccgcggccgggttctcgtcggcgctcgtgccaggtgtcgtcttgctcatggatcagatccccacagtgaagccggtggaccaggtctgcatctcctgcaccagccggtcccaggcgccggtgagcagcagcacaccggtcacgatcatcatcgttccgccgaggcgcagcacccagacgtagtggcgcttgacccagccgaacgcgccgagggccttgcggaaggcgatggcggtgagcacgaacggtatgccgagtccggcgcagtaggcgacggtcagcagggcgccgcgcccggcgctggcctcgttggaggacagggccaccacggaggcgagggtcgggccgatgcacggggtccagccgacgccgaagagggcgccgaggacgggcgcgccgaccaggccggtggccggccgccggtggaagcggaactcacgctgggtcagccagggcatcagccccatgaagaagacgcccatgaggatcatgagcacgcccagcaccttggacagggtccccttgtagtcctggagggtctgcccgaagaacccgaacagcgcaccgccggagacgaacacgacggtgaagccgagcacgaacagcgaggcgccgacggtcatgcgtccgcgccgcgcctcggccaggtcggtgccggtgacgccggtcacgtacgacaggtagccggggacgagcggcagcacgcacggggagaagaaggagacgagcccgccgagcacggcgacgggcagcgcgagcagcagggctccgctgaacaccgtctggttgggatcagtggctgcggccagtagcacggcggctcacttctccgcgacgaccgggtcgagcatcttgcgcagcttgtcctcgctgagcgcctgcagggcgcgtgccgcgatgttcccgtcccggtcgatgatcagcgtgctcgggatggcctgcgggttgagggtgcccttcttgaagcggagcatcagcttgccggtcgggtcgtacagactcgggtacggcaccgcgtagctcttctcgaactcctgggcgggctgggtgctggtgtcgcgggtgttgatgccgacgaactgcacgcccttggcggcgttgtcctgggcgaccttgaccaggttgggtgcctcggcgcggcacggcgagcaccaggagccccagacgttgaggacgatgaccttgcccttgtaggaggcgaggtcgagctgcttgccgtcgatggtctcgccggagaggtcgggcgcgggcttgcgctcgcccttcttgacggtcgcgatgccgtcggatccggtgatgaagttggtcttgcccgagcctccggaggtgcctccggagccgcaggcggtcagggcgagtgcgagcgcggcggtcccggcggcgagcagggcggcgcggctgcgggcacgggtggtgcgcgtgcggtgcggacgggacgtacggttcgcccggttcgagcactggggggcgcggctggcggcactcatgtgaaaagtttcgcatgcctgttccggggatctcgcgcgcccccctgccgggcggaaaaccgcatatcaggcgccgttcgaggtgcccgttccgctctgcgtgccggtgctgcccgtggtgcccgtggtcccggtcgtcccggtgtcctcgaggaagcccttccagccgcccgccggctgctgcccgacctccagcgtgcgcagcttggcgagcacctcgggcttctgcacgtccagccagtccacgaactgccggaaggagaccaggcgcacgtcggcgcccttgtcgcgctcggccgcgatgtgcttgaaggcctcttcgacggagtccatgtagatcccgccgttccactgctcgaagtggttgccgatgaagaacggcgcccggttcgtctcgtatgcccgctggaagccctggatgtaggactgcgcggactgcttgcgccagcccgggtagttggcgggcggggccttggtggagttcaccgactggttggcgagcatgttgtagtccatcgagaggacctcgaagcggcggcccgggaacgggatctgctgcagcggcaggtcccagatgcccagcttcttctgcggccacacctggcggccgcccggcgaggaggcgtcgtagcgccagcccaggctcttggcggtgggcagcaggttgttctggccgagcaggcagggcgtgcggccgccgaccagttccttgtcgtagtcgaagggcagggacggcaggtcggtccagccggtgttggtccgccactgcttcacgaacgccttggcctggtcgatctcgctgcgccactgcttgggcgtccagttcgccacggtgccgtgaccggagcagaagtggccgttgaagtgggtgccgatctcgtggccctcgagccaggcgcggcgcacgttggtgagcgtggccttgatgtgcgcgtcggtgaggtagccgatgtcggaggcgccgcgcgcgttgttcggcgggtcgtacatgcgcttcttcgcctcggggagcaggtagagcccggagaggaagaaggtcatgctcgcttcgtgctgcttggccaggtccaggaagcgcgggaagagcccgttgccgacctcaccggccccgtcccaggagaagatgacgaactgcggcggcgtctgcccgggctccagcggggtcggcttggcgggctggtgcggctgcttgccggtgaacgacgtcgagccgtcgccgatggggcgcgcgggctgctcggtgccctggccctttccgtgcgaccccgtacccgaaccggaaccaccggcgccgcccgagccgtccgaagacttggagccgccgcagcccgcgagtcccacggcagcagcggtgcccgcgccaaggccgagtattcccctccgggagaaggtgcgcatgagatccccgatccgtcacgtccgctgaatgctggtcactcattcagaggacgtggcgaacgccggggttccgcacatccatatgaatttcacaacaaatgttatgaaactgtgcgtacgtgaccgaaggcttacggcgcccttacgctccgtgctctaggggagcagccccgccggggccgtgctccgaggggagccgggccggggcgccgtgggggcctacgccccgaacgccttcccctgtcccttcaccggcttggcgccggccaggagatgagccggcaccaggtcccgggccggctcgctgtagccgacggagacgatccggtcgccctggtaggtgaacgtcgtcagcgaggccagcgtgcactgccgcttgcgcggatcgtgccacagccgccgccgctccacgtaggaccgcacgatccagatcggcaactggtggctgacgaccaccgcttcgtgcccgcgcgcctggtccttcgccgcgttcagcgcgcccatcatgcgcaccacctggtcgacgtacggctcgccccaggacggcctgaacgggttgaccacgtgcttccagttcgccggccggcgcagcgcgccgtcgccgacgccgaacgtcttgccctggaagacgttctccgcctcgatcagccgctcgtcggtggcgaggtccagcccgtgcgccttggcgatcggcgtcgccgtctcctgcgcccgctccagcggcgaggcgacgacgtacgtcacgtcgcggggggcgaggtgctcggcgacccgctcggccatctgccgtcccagctcggacaggtggtagccgggcagccgtccgtagagcacgccggtcgggttctccacctcgccgtgccgcatgaggtggacgacggtgacgtcgtccttcttccccgtcccctcgctcatgccgtggcctccgccgccgcccgggccgccgccggaagggcgtcggcgatccgctggagggcctgctcgtcgtgcgtggtggagacgaaccaggactcgaaggaggacggcggcaggtagacgccgttcgccagcatcgcgtggaagaaggcggtgtagcggtacgactcctgcgcgcgggcgtcgtcgtagttgcgcaccggccggccggtgaagaacaccgagaacatgttggaggcgttctgcagggtgtgcgccacgccttccttggtgagcgcctcggagaccatggcctggatctgctgcgagacggcgttcaccttggcgtaggcggcgtcgtcgagtaggcgcagctgggcgaggcccgcggcggtggcgaccgggttcccggagagggtgccggcctggtagacgggcccggccggcgcgaggtgcgccatgacgtcggcccgcccgccgaaggccgcggccgggaagcc

SEQ ID NO: 1170 - DNA, 894 bp, Unknown
  Kingdom: Bacteria, Phylum: Actinobacteria, Class: Actinobacteria, Order: Streptomycetales, Family: Streptomycetaceae, Genus: Streptomyces
  misc_feature (342)..(440): n is a, c, g, or t
gtcctggtccgggggcggggcccagcgccacaggtctgtcggggttgaccacggagtgggagaggactcgtccgaggggtgggcgaacgggccggcgtgttcgtgcatgagcaggagcacgaccccggcgaagagaagagtgatgacgatcagcgccaggccgacggggttgttcgggctgtactcgtagcggtgggtacccgacttgctgcgttcgaagactggttcgtcgtcgtcgaagcgcaccgccggaccttgtcccacgtgccgcgcatcagagcctcacgggagcccccttccacggggcgggggtcagaacaggctcagcaacgcctccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtccgtgtcgcgggcgcggcggcggcggggctggaccaggcccgagtcccagacctcgcagacgagggtgcggtccaggaggagacggagtctgatctcgccctcgccgtacctgagcgcattggtgaccagttcgctgaccaggagttcggtggtgtcgaccagcggttccaggtcccaggcgaggagctgcgtgcgggcgtactcgcgggcgcggccgacgctgcgcggctcgcggggcagggtccagtcgccgacggactcggcgggcaggccctgcacacgggccatcagcagggcgatgtcgtcctcgccgtggtggctgccgagggtgttgaggacgtggtcgcacacgtcctcaagggggatgttcgggtcggtgagcgcgccgacgaacgcctggaggccctcgtccagcgggtggtcgcgggactcgaccaggccgtcggtgta

SEQ ID NO: 1171 - DNA, 3729 bp, Unknown
  Kingdom: Bacteria, Phylum: Actinobacteria, Class: Actinobacteria, Order: Streptomycetales, Family: Streptomycetaceae, Genus: Streptomyces
acactgcataacgtcggcagcgtcagatgcgtatcagatacaggcactacgtaacggcgtcacaccagcactgcgtacggcgtcacaccagcactgcgtacggcgtcacaccagcactgcgtacggcgtcacaccagcactgcgtaacggcgtctcagcggatcgccgcggccgtcgggccctcgcggcagatcagcaggagggcgcggtcgtcgttgacgtccttggccaccgcctcgatcaggtgccaggtggcgccgtggaagccgccggcgacgtagcggtcggcctctccggtgaggcggtcgatgccctcggcgatgtcgcgttcggcggtctcgaccaggccgtcggtgaagagcatcaggacgtcaccggggcgcagggagcccttgacggagtcgaactgggcgccgtcgtacaccccgaggagcggtccctcggcggccttctcctcccagcggccggtgcccgcgcagagctggaggcccggcgggtgaccggcggagtacagctcgtagtcgccggagtcgaggtcgaggacgaggtggatggaggtggcgaagccctcctcccagtcctggcgcagcaggtaaccgttggcggcgggcaggaaggcgtgcgggggcaggctgccgagcaggccgccgaacgcgcccgagagcagcagggcccgcgagccggcgtccatgcccttgccggagacgtcggtgaggacgacctccagggtccggccgccgttcgtgcgggcggcgacgacgaagtcgccggagaaggactggccgccggccgggcgcagcgccatctcgtggtgccagccgtcgggcagctgcggcaactggctctgcacgcggatgcgttcgcgcaggtcgaagagcatggtgccgccgcgccgccacggcactcccacgcggctgcggaactgggcgatcagcagcccgaagaagccgcaggcggcgaccaccagcaccacgcccggggtcacccgtgaggggccctcggtgtacgggccgagccgcaccgactccacgatgagggccgtggccgccgccgcgtacaggccgagcaggctggccgggcgcagcaggaggccgccggcgacgatgggcaggacgagcgcgaccggcgagaaccacaccgagtcgacgagagtgagcgccgcgatcaccgggatggtcagcagcagcccgccgagggcgatccagtccgagccgtcgccgcggaagtagtcgacggcggctcggcgcacgccgacgcgggcccggtgccaccgcatcttcaaccgggccgtgaacgtctcggcctccgcgcgccgccctcgtcctgctgccattagttcgggaccctatccatcggagccgccggttggcacgggaggtccgacttatcccccgtccggggctcgacttcacagtgaacttcacggtgagccaccgcgccgccactccggagaaatttgttcgaccggggcgcgggccgctggtagggatggcatatggcgactgaccttgcgaccgagctgcgcgtgctgcgaccggacgagtgggacacgtggtacggcaacctgatgcgtgccttcggcggtgttccggaaccggccgaggagcaggagctgtaccggtccctgaccgagttcgaccgttcgctgggcgtctgggacaaggacgcgtgcgtgggcacggcgggggcgttcagcttccggctgaccgtgcccggcggtgccgcggtgccggcggcgggcgtgacgatggtcggcgtggccgccacgcaccggcggcgcggtgtgctgacgtcgatgatgcggcggcagctggacgacgtacggtcctggggcgagccgctggcggtgctgaccgcctcggagcccgggatctacggccggttcgggtacggcgcggccaccttccagctcggcgccgagatcgacacgacccgggtcgggctgtccgtgccggccgggacggacgccgtacggctgcggtacgcggcgcccgccgacgtgctcgacgcgtgcgaggcggtgtacgcgcggctggtgcccggccggcccgggatgctggcccggcggccggggtgggagcggctggcgctgctcgatccggagagcctgcgcgagggcgcgtccccgctgcagtgcgtggtcgccgagcgcgacggcgaggtcacggggtacgcccgctaccgcgtcaagcccggctgggagtccgccgggcccgcgggcacggtggtcctcgacgatctggccgcgctcgacccggcgaccgacgcggcgctgtggcggttcctgttcgacatcgacctgacgtcgaaggtgaccgtcgggaaccggccggtcgacgacgcctggcagtacctggtgtccgacatccggcggtgccggccgcggctgcgggactcgctgtacgtacggctcgtggacgtcggggcggcgctggccgcacggacgtaccaggcgccggtggacgtcgtcctggaggtggaggacgcgttctgcggctggaacgccgggcggtggcggctgagcggggacgcgaagggcgcggtctgcgagcggacgaccgacgcggcggacctggcgctgtccgtacgggagttgggggcggcgtacctcggtggcgtgccgttgacggcactggccgcggccgggcgggtacgggagttgcgcggcggggcgctgacggaggcgtccgtggcgttcgggtcggcggtagcgccttggctgccgcacgggttctagccgtacgggttctagccgtacgggttccagccgcacgggttccagccgcacgggttccagccgcacggttccagtggtgtcccggtgtgcgggatcactggttctggcaggtggggcaccagaagaggttgcgggcggccaggtccgcggtgcggatctccgtggtgcagatgtggcagggcagggtcgcccggcggtagacgtagacctcgccgccgtggtcgtcgacgcgcggcgggcggcccatggcctcgggggtgtgttcggggcggaccgtgtcgatgcggttgttgcggacgccctcgcgcatgagggcgacgaggtccgcccagatcgcgtcccactcggccggggtgatgtccctgccggggcggtacgggtcgatgccgtgccggaagaggacctcggcgcggtagacgttgccgacgcccgcgatgaccttctggtccatcagcagggccgcgatcgtcgtacggctgcggctcacgcgggcgtaggcggcggccgggtcggcgccggggcgcagggggtccgggccgaggcggtcgtgtatcgcctgcttctcggcctccgtgatcagggcgcaggtcgtggggccgcggagatcgacgtacgacgtggtgttggcgaggcggaggcggacggtgtccgtgggcgggggcgcgggggcgtcgccgaaggtgaccttgccgaagaggcccaggtggatgtggacccagtcgctgtcgcggaagcggaggaagaggtgtttgccgtgggcctcggtgcgggtgagctccgctccggtgaggagggtggcggcttctgcgaacttgccctgggggctggtgatgtgggtggcggtgtcggagaagcgggtggcgtagtcctgggccaggcggtggatggtgtgcccttctggcacggtggggtgtccttccctgtgatgggtggcccgtcccgggcccgctgtttcgtgaggggggcgtggcgggccttggggtttgcccacc

SEQ ID NO: 1172 - DNA, 1487 bp, Unknown
  Kingdom: Bacteria, Phylum: Actinobacteria, Class: Actinobacteria, Order: Streptomycetales, Family: Streptomycetaceae, Genus: Streptomyces
gccgccctcgacgacccggtgcagccggtgcctgcgccgctccgcgtcggagcccagttcgttctcgaactcggtcagcagatcgggcacgctgagccacggcgtggtgatctgcgcggtggtgcgcagccggtccaggacgcggcgcagcaccgaagggaaacgccgtacgtggacgagctggtcgtggtcgcaggtggcgatcacctccagcgatccgccgtggcgccgcttcggcccgatctcccggcacagccgcacgagttcgtcggcgacgcccctggcgtagcaggtgttgacgatgaccaggacgtgttcggcgtgcgagtcgagggcggcggcgacgatctcgctggtgcgtacggccgtggcgagctggcgccggggttccgtcttcggcagttgcaggaagtgcgtgcccgaggcgcccagtttcccgtgtccggtgacgaagaggaccagggccttcccgcgcgtctcgcgcaccccggcctcgtgcaggaaccgctccacgtcgtggcgttcgcgcagttcgggctgcggcaccttgtggaacggttccggggagttcggcgggcaccaccactcgtcgaggacggcgagctgttcgtcgatgccttcggcgaactcgcccgcgtcgtcgccgtagtcgcggaccgcgaccgtcaccagcagccgctccggcgccggttcactgcccggtccgtgctcccgcgcgccgcccggcagctcgccggacgggccggacgagccggacggggtgtccccgcttccggcaagtgcgcccgccccccgctgcatgctccctattcttcccacatgagccaaccgccgcacccgtatccggcaccccaccggccctaccacctgcccggtctgtccccgaacaccacgcaggacgccgtggtcgtcgtcccgggcatcatgggcagcgagctgtacgacgtggagcgggacgcggtggtgtgggggctcgcgaactccggctggctgctgcgcgcctggaccactcccgggggtctgcggccgctgcacctgacgccggacgagcgtgagggccgcctgggccgcatcgtcgcccgcaggctgctggccacgcccgcctggagtcccgtgctgcgcggtgtggagccgtacaccgacctggtggcgaccgtcacgcgcggcgtggccgacccggcggcggtcctggagttcccctacgactggcggctgccggtggccgtcaacgcgcggctgctcgccgctgcggcgcgggcgcacctggagcggtggcgcgcgcacccggcgcacgccgcggcgcgcaggcaccgtgtcgacgagcgcgagggccgtctggtgttcgtcgcccactccatgggcgggctgctcacgctggccgcgctcaccgacggcccggacggcgacctcgcggcggacacccggggcgtgctcacgctcggcacgcccttccgcgggtcggccgccgccgcgcagaacctcaacac

SEQ ID NO: 1173 - DNA, 1381 bp, Unknown
  Kingdom: Bacteria, Phylum: Actinobacteria, Class: Actinobacteria, Order: Streptomycetales, Family: Streptomycetaceae, Genus: Streptomyces
ggcggcgagaggacggcgacggcgaaaggcttgtagcggcctcgggtccggcccggtcagcgcggcggcggcgccggtaaggtgccgcgggtgaccgaacaggccggggcagtcccggggagacccttcctctacgtcgtcgtctgcgccgccggcgtcgcggcgggcgtcggcgcactggtcgccgccgcccaggagcgcggctgggcggtgggcgtgatcgctacgcccaccgccatgggcggcttcttcgacaccgaggccgtccaggagggcaccggccgccccgtccgttcccgctggcgcaccccggacgacccgcgccccttcccgccgccggacgccgtggccgtcgcgcccgccaccttcaacacgctcaacaagtgggcggccggcatcgccgacaccctcgccgtggccaccctgtgcgaggcgtacggcctcggcgtgccggtcgccgcgctgccctgcgtggccgacgcgctggccgtccaccccgcctaccgcgagagcctggcccgcctgcgcgcgatgggcgtgcgcgtcggcgaccggtacaccggcgcaccccgcgaggacggcacgcgccccgggttcgcctgggaacaggcgctcgacctcctcggcccggcccgccgtcgcgcctgacctgcggcccgtgtcccaggcctcgcgtccggcatccggtacggtcggccgccatgatcgaaaagccgcctaggctctgtccggcaaccacccgaagacaggagcagcaacgatgcagtacgtgaagctcggttcgacgggcctggacgtgtcgcggatctgtctgggctgtatgacctacggcgtacccgagcgcggcgcgcacgagtggaccctcggcgaggaggcgtcccggccgctcgtcaagcaggcgctggaggccgggatcaccttcttcgacacggccaacgtctactccgacggcaccagcgaggagatcgtcggccgcgccctgcgggacttcgcccgccgcgacgacatcgtgctcgccaccaaggtgaacggccggatgcggcccggacccaacggcgccggcctgtcccgcaaggcgatcatgacggagatcgaccacagcctgcgccgcctcggcaccgactacgtcgacctctaccagatccaccgctgggacccgtacacgcccgtcgaggagacgatggaggcgctgcacgacctggtcagggcgggcaaggtgcgctacatcggggcgagttcgatgtacgcctggcagttctccaaggcccagtacaccgcccaggcgaacggctggacccgcttcgtctccatgcagaaccactacaacctcctctaccgcgaggaggagcgcgagatgctgccgctctgcgccgaccagggc

SEQ ID NO: 1174 - DNA, 10667 bp, Unknown
  Kingdom: Bacteria, Phylum: Actinobacteria, Class: Actinobacteria, Order: Streptomycetales, Family: Streptomycetaceae, Genus: Streptomyces
gcacgcgggtggggccgttcggaggtatcgcccgcggcgtgcgacgatgtgcggcatgccgcagcaaccccccattcggagcacaccctcgcggccctcccgtccggacgcctccatgtcgttgatcaccaacgtcatggaccacagcctcgacgacggttacgccgaggccgccgcacggaagaaaaccgccggcgagagcggtctgccgaagacgttgcgggcgcggctcgggctggcggccggcctggtcctcgcggcgctggtggtgaccgtgggggcggcacaggcgcgcgtggcggcccctgtcgtcgccaaggagcgccaggagctgatcgaccgcatcgaccgtgagacgtcggcggcggacaagctcgagagcggtgtggacaagctccgtgacgatgtgggcgcacggcagcgccaggcactcagccgcagcggtggcaacgcgcaggccgagttggccgggatgctggccggtgcgacggaggtgcacggccccggcgtgaaactcgtcgtgaacgacgcgaaggaagccggtacggggggcagcggcaacccgcgcgagacatcgggcttctcggacaccgggcgggtccgcgaccgggacatgcagcgcgtcgtgaacggactgtggcagtcgggggccgaggccgtgtccgtcaacgggcagcggttgaccgccctgtccgcgatcagggcggcgggtgacgccatactggtcgacaacaagccgctggtgccgccgtacacggtgctcgcggtgggggacgggcagcggttgagcgcccggttccaggacagtccggacgggctgtatctgaacgcgctgcaggacaactacggcatccggaccgccatctccgtggagagggacgtccggctgcccgccgcaccgagtgtgatcgtgcggaccgcacagccgaccagtgagaagaccaagaagggcacatcgtgatcgccgtactgggcctcgtcgtgggagtcgtggccggcctgttggtccggcccgaggttccggcggtcgtcgagccgtatctgccgatcgccgtagtggcggccctggacgccgtcttcggcggactgcgggccatgctggacggcatcttcgacgacaaggtcttcgtggtgtcgttcctgtcgaacgtggtcgtcgccgcgctgatcgtgttcctgggcgacaagttgggtgtgggtgcccagctgtccacgggtgtcgtcgtcgtcctcggtatccggatcttctccaacgccgcggcgatccggcggcacgtgttccgggcgtgagggcgatgaccgaccaggacgaactgcctgagaacaggctccgcagggaactgcccgccgaggtgcccgcgcaggaccgcggggccggcccgggccgtgccgatgaggcgacggcgacggcgctgaccggccggcagcggctggtgaaggggctgtggccgccgcgtttcaccagggcccaactcgtcgtcgcactgctgctgttcggcctgggcttcggcctcgcgatccaggtcgcctccaacagtgacagcggcagtgcgctgcgcggcgcccggcaagaagatcttgttcgcatcctcgatgaactggacgaccgtactcagcgtcttgaggacgagaagcagggtctcgaaaagcagcgccaggagctggagaacagctccgaccaggccgaggaggcccgtaagcagacggtcgagaaggaacggcaactcggcatcctggcgggcacggtggccgcgcaggggccgggcatcacgatgacgatcgaggacacgaagggaacggtccgggcggacatgctgctcgacgcgatacaggagctgcgcgcggccggtgcggaggccatcgaggtcaacggcgtgcgcgtggtcgcgagcacctatctgacggactccggcaagagcgtggacgtcgacgggaacaagatcaacgctccgtatcgtttcaaggtcatcggcaagccgcaggatctcgaaccggcgctcaacatccccggaggcgtggtgcagaccctggagaaggagcaggccaccgtgtccgtcgagcgttcggacaagatcgtcgtggacgccttgcgagcggcgaagctgcctgactacgctcggtcgtcctcccagtgaaccgggggtgcatggcggccgtccggcaggggcatgaggttgcggggggtcggcgcaccgattgggtggtgcgtggtggaaactgtctggtggatacggacgttgtgaagatgtccgggtcgaccggtgtacgcagtcagggttcgtcctgccccacgggcgggtctgtttcggtcaaggggaatcgcccgtgaagttgtttgcgaagttgttcggcaagagcgcgcgagagagcggcgacaacgcgaccgctcgtcatcgcgcacagccaggagccgagggccagcgcccgctgttcagggaccaggtagctggtcagggcggtgatttttccggcggccagggcgcgccgtcggttgaccctgcccaggccggcggcataggtttcggccaaccgtcaacctcaggtacgggtggagggttttcctccgatccgtacgcgtcccattccccggcggggcagccgcggcaggaggatccgtccatgtcggccctggtgtgtacgaggtgcggtaaccgcaatgcggacagcagccgcttctgttccaactgcggtgcgccgctgaggcccggcgcggtgccggagcgcgcggcggagacgacgtccacgatctcgatctccggtctggaggcctacgacgcggaggccaccggccagacgccgatgctgtctcccgaggcgcaggcggcggtcgacgcgctgccgctgggctcggccctgctggtggtgcgccgtggcccgaactccggcagtcgtttcctgctggacggcgagctgaccacggccgggcgtcatccgcagagcgacatcttcctggacgacgtgacggtctcgcggcgccatgtggagttccgccgcggccgggacggctcgttcacggtcgccgacgtcggcagcctgaacggtacgtacgtcaaccgggagcggatcgacgaggtcgcgctggccaacggcgacgaggtgcagatcggcaagtaccggctggtcttctactcgagccggcagggctactgacctccccggactcggtccggggaaccccagggaaggtccatgcttcaatcaccgagcggcggtgccggacacggtaccgccgccgcggacagtgggctgatgagtatcggcgcggtgctgaacgcgctgcgcgaggagtttcccgaggtcaccatctccaagatccgtttcctggagtcggaggggctggtcgaaccgcggcggaccccctcgggttaccgcaagttcagcgcggacgacgtcgagcgtctcggccgcgtcctgcggatgcagcgggaccactacctgccgctcaaggtgatccgcgagtacctggacgccgtggagcggggtgaggcggtccagccgcccgtgctcggccggcagcgcggcggcgagacggtgccgaggcaggccgaggcgccggtggtggccaggatcgggcgggccgggctcctcgccgccgcggagatcgaggacaaggatctccaggagtgggagtcctacgggctcgtcactccgctggaggacggcacgtatgccgccgagacggtcaccgtggcctcgctcatccgtgagctgggtcgtttcggcatcgagccacgccatctgcgggtgatgaaggcggccgcggaccgggaagccggactggtcgaccaggtggtggccccgctcaggcggcaccgcaatccgcagaccagggtgcatgcggaggaccgtacgaaggagctggcggcgctcaccgtcagactgcactcggcgctggtacagacggcgctcggggtgcggctgccctgaaatcccggcacggccggcccgcggtccgggtgcggatgccgggaagccggggtgcggccggccgacggggcggggcactgtccggcggccggatcggccccccgtttccggcccgactacccaaacgtcccgggcacggcctagggttgctgtgtgaacgagctcgatgtcgtaggtgtccgggtcgaaatgccctccaaccaaccgatcgtgctcctgcgtgaagtgggaggcgaccgttacctccccatctggatcgggcccggggaggcgacggcgatcgccttcgcccagcagggcatggctcccgcgcgaccgctgacccacgacctgttcaaggacgtgctggaggctgtgggccaggagctgacggaagtgcgcatcacggacctgcgtgagggcgtcttctacgccgagctggtcttcgccagcggagtggaggtgagcgcccgtccgtccgacgccatagcgctggcgctgcgcaccggcacgccgatctacggcagtgacacggtgctcgacgacgcgggcatcgcgatcccggacgagcaggaggacgaggtggagaagttccgcgagttcctcgaccagatctcgcccgaggacttcggcaccagcagccagtgaaacgcccacatatgccaccggcctcggagagcgccctccagccccccgcgggaccattcggctagcctttccccgcggtagggcacgggaaaccactcttagggtgattatcactcggcgtgccgagtgtggcgatcgttgacgcacccctggtgactgcctaccgtcgaggaggcaggtcaaggacggaggtcggcgtgagaagcagcggcgacggtacggctgggggtgcccccggacgcgagatcgggggaagcggtccgtacccgcttcacggcagcgcggccgaccaggctccgcagcggccgacggccgtgcccagcggcagaggggcggcgtccatggcgtccgagcagatcggctaccggggccctacggcctgcgcggcggcgggcatcacctaccggcaactggactactgggcccgcaccggcctggtcgaaccgagcgtgcggcccgctcacgggtccggtacccagcggttgtacagcttccgtgacgtcgtcgtcctgaagatcgtcaagcggttcctggacacgggtgtgtcgttgcagaacatccggaccgccgtgcagcacctgcgccggcagggcttcagcgacctggagcgcatgacgctgatgagcgacggcgcgacggtctacgagtgcacctcgcccgacgaggtgcacgccctgctccagggcggccagggcatcttcggtatcgccgtcggcgtggtgtggcgcgacgtggagagcgcgctgtcgcagctccacggtgagcgggtcgacaccggcgagaccctcgtcggccacaaccccggcgacgaactggcccggcgccgcaaccgcgcggtctgacgggcccggggcgcgaccgggcggtccggccggctcgcggaaggccgatcggaccggagcgtcggtgcgaccacggggagcgggggccccgggagcggcaccgcctccgcggaccgcggcccgtggcgggcattgtcagtggtgtggtgcagcatcggagatgtgagaaccgcgcccacgatcctgcatctcgacatggatgccttcttcgcccaggcggagcaggcgtccaagccgagtctgcgcgggaaggccgtcgtcgtgggcggcctcggaccgcgcggagtggtcgccacggcgtcgtacgaggcccgggtcttcggcgtccactccgcgatgccgatggcccaggcacgccggctggcgccgaacgccgcgtacctggtgccgcgtttcggcttctaccggtccatcagcgagcaggtgatggagctgctgcgggccctgtcgccgctcgtggagccgctcagcctggacgaggcgttcgtggacctggaggccgggggagcggcctgggacgaggagtcggcccggctgacgggagcgaggctgcgggccgacatcagggccgtcacgggcctgaccggctcggtcggcctggccgcctccaagatgctcgccaagatcgcctccgagcaggccaagcccgacggtctcgtgctcatcgagcccggcaccgagcgggccctcctcggcccgctctcggtgcggaccctgccgggtgtggggccggcgacgggtgatcatctgcggcgggcggggatccacaccgtcgacgaactcgccgaggccggtgaggacgaactcgtacggctgctgggcaaggcgcacgggcaggcgctgcacgcgatggcgctggcccacgacgagcggtccgtcgtcgccgagcgggaggccaagtcggtctccgtcgaggacacctacgacgtcgacatccacgaccggctgcgggtcggcctggaggtccagcggctcgccgaccggtgcgtgcggcggctgcgcgggtccgggctctccggccgcaccatcgtgctcaaggtgcggcgctacgacttctccaccctgacccggtccgagacgctgcgcgggcccaccgacgacccggcggtggtccgggaggcggcggcccggctgctggactccgtggacaccaccggcggggtgcggctgctcggcgtgggcgtgtcggggctcgccgactacacgcaggaggacctgttcgcccaggccgccggtgcggcggcggagagcctcgcggacgagcccgcggacgaaccggccccggaggtcaccgcgcccgccgagcggcactggtccgcggggcacgatgtacggcatgccgagcacggacacggctgggtgcagggcagcggcgtcggccgggtcacggtccggttcgagacacccgactcgcagccgggtcgggtgcggaccttcctcgtcgacgacccggcgctgcaaccggcggatccgctgcctctggtgcggcgaagaccgacggatccggtcggcgctccttcgccgctgggcgggacttcagggggcgggactgaggggatgttcgggtttcgggactgaggtgctcccgggcggtggccggtgcggcgcggtgccggtgtgggtgagtcggcgggtgggaccgtgccgcgctccggccggggccgggtcagggatgcgtcaggagtgccgtcaggagtcctccgatccggagcccgccagtttgccgaagtcgtggtcgggagcgacggcgggaggcgtgaggtggagaccgtagtggtggtagagctggagttcctgctcgggggagaggtggcggccgacgccgaagtcgggcgcctccttgatcagggagcggtcgaaggggatgcggagggagccctcgaccagttcgctgggctccaggggcacgaaggcgtcccgggagaacagtccggtgcgtatggcggcccactcgggcacgccggtggcgtcgtcgaggtagacctcgtccaccgtgccgatcttgttgccgttgcggtcgaacgccttgcggccgatcaggttgcgcggatcgatctcggtcagcacggtccctccacttggtcgcacctcatccgtaagcactacaaaagagcacattcggcggggcggccactcgaaggctccggctcacgcgccgctggtaccctggcagcggctgctgaccccgtgcgggagagtcctccagcatcaccggaggcgccgaaggagcaaatcctccccggaatctctcaggcccacgtaccgcacggacgaggtcactctggaaagcagagcgggtgtcgacggcttccgctctcaccgacggtgaaaaccgggcgcccgccggcgacccggtgaagctctcaggttgagatgacagagggggaggccgtcgggacacccgcgccgtggtgtccctcgaaggtcgcgtcagaccaggaggcctccgcatgaccgcccagcgcattccgctctccgagctcgaacagggcattcccttcgagcagcgccacatcgggcccgaccaggaggcgcgggccaagatgctcgcgcaggtcggctacggctcgctcgacgaactcaccgccgccgccgtgcccgacgtcatcaagaacgccgacaccctcgacctgcccggcgcgcgcaccgaggcggaggtgctggccgagctgcgtaccctcgccgaccgcaaccaggtcctcggctcgatgatcggactcggctactacgggacgttcacgccgcccgtcatcctgcgcaacgtcatggagaaccccgcctggtacacggcgtacaccccgtaccagcccgagatctcgcagggccggctcgaagcgctgctgaacttccagaccgtcgtcgccgacctcaccggactgcccacctccggcgcctccctgctcgacgagggcaccgccgccgccgaggcgctggccctgtcccggcgcatgggcaagaacaagaagggtctgttcctcgtcgacgcggacgcgctgccgcagacgatcgccgtcatccagacccgcgccgagccgaccggtgtcgaggtcgtcgtcgccgacctcagcgacggcatcccggcccacctcgccgagcgcgagatcaacggcgtgctcctgcagtaccccggcgcctgtggtgccgtacgcgacatcaagcccgtcatcgaccaggcgcacgagctgggcgccctggtcaccgtggccgccgacctgctcgccctgaccctgctcaagtcccccggcgagctgggcgcggacatcgccgtcggcaccacccagcgcttcggcgtcccgatgggcttcggcggaccgcacgccggctacatggcggtccacgagaagttcgcccgcagcctgcccggccgcctggtcggcgtctccgtcgacgccgacggcaacaaggcctaccgcctcgccctgcagacccgcgagcagcacatccgccgcgagaaggccaccagcaacatctgcaccgcgcaggtgctgctcgcggtcatggccggcatgtacgcggtctaccacggccccgagggcctgaaggacatcgcgcggcgcacccaccgctacgccgccgtcctcgccgccggcctggaggcgggcggcgcgcagctcgtccacggctcctacttcgacacgctcaccgtcaaggccgagggccgggccgccgagatcgtcgccgccgcgcgcgagggcggcgtgaacctgcgtctcgtcgacgccgaccacgtctcgatcgcctgcgacgagaccaccacgcgggcgcagctgcacaccgtgtggtccgcgttcggcaccgcgggcgacatcgacgcgctggacgccgccgccggtcagccgctgtccgaggccctgctgcgcaccgacgcgtacctcacccaccccgtcttccaccagtaccgctccgagacggcgatgctgcgctacctgcgcaggctctccgaccgtgactacgcgctcgaccgcggcatgatcccgctgggctcgtgcaccatgaagctcaacgcgaccacggagatggagccggtcacctggcccgagttcggtcagctgcaccccttcgcgcccgccgagcaggcgcagggctacctcaccctcatccgcgagctggaggaccggctcgccgaggtcaccggctacgacaaggtctccctccagccgaacgccgggtcgcagggcgagctggccggtctgctcgccgtgcgcggctaccaccgggccaacggcgacgaccagcgcaccgtctgcctcatcccgtcctccgcgcacggcaccaacgcggccagcgcggtgatggccgggatgaaggtcgtcgtcgtgaagaccgccgacgacggcgaggtcgacgtcgacgacctgcgcgcgaagatcgagcagcaccgcgacgagctcgccgtgctgatgatcacctacccgtccacgcacggcgtgttcgaggagcacgtcgccgacatctgcgcccaggtccacgaggccggcggccaggtgtacgtcgacggcgccaacctcaacgccctggtcggtctggccaagccgggccacttcggcggcgacgtctcccacctgaacctgcacaagacgttctgcatcccgcacgggggcggcggccccggcgtcggcccggtcggcgtgcgctcgcacctcgcgccgtacctgcccaaccacccgctgcagccgcaggccggtcccgcgaccggtgtcggcccggtctccgccgccccgtggggttcggccggcatcctgccgatctcctgggcgtacgtccggctcatgggcggcgagggcctcaagcgcgccacgcaggtggccgtgctgtccgccaactacatcgccaagcgcctggagccgcacttcccggtgctctacaccggccccggcggcctggtcgcgcacgagtgcatcatcgacctgcgtccgctgaccaaggcgaccggcgtgagcgtggacgacgtcgccaagcggctcatcgactacggcttccacgcgccgacgatgtcgttcccggtggccggcacgctgatgatcgagccgaccgagtccgaggacctggccgagctggaccgtttctgcgacacgatgatcgcgatccgcgccgagatcgacaaggtcggctcgggcgtgtggcccgccgaggacaacccgctgcggggcgctccgcacaccgccgccgcgctcggcgggaagtgggagcacgcgtacagccgtgaggaggccgtcttcccggccggtgtctcggcggccgacaagtactggccgccgagacaccggccgg

SEQ ID NO: 1175 - DNA, 5970 bp, Unknown
  Kingdom: Bacteria, Phylum: Actinobacteria, Class: Actinobacteria, Order: Streptomycetales, Family: Streptomycetaceae, Genus: Streptomyces
ggccggccggccggtcgcatgccgaccgccacccgatcgtctgtccacgtttcacccctgggagcgtccacacattctccccatcgccccccattcatccgtcctgcgcccgacaatgcacttgcacgctcgaccgcgataccgaggctgaggctgaggccccggcccccggcccgcccctgtccgcgccagtccgcgccagtccagaagggactctcgtgcccaccacgcaggacgaatggaacaccggtgacaccgaagcggtgacggaccggagacggcaccggcacctgcgtctgctgccccgctactacgcccaggtggaggcaggacgcaaaacgatcgaggtccgcgtgggcacccccgcgaagcgcgccatcgcggaaggcgacacgatcgtcttccacgaccggggcagcgaccgtgaactcgacgtcgtcgtacggaagatcacggagcacaccgacttcgaggaactgctcgcagcacacgaccctaggcgcatcgaccccgacgcgacacacaccggcctgctcgacgccctccgccgcctctactcaccggccgacgaacaactgggcgtcctggccctggagttcgaccaccgcgccggacgccccggacgcccgctgccgatgacaccggccgagtacgtcaccacggtgccccaccacaccgtgtacgccggcctgtacgtccgcgacgagcacgaacggcccgtccagctgcgttcggtctacggcgaccggctgtggcagttccccggcggcgccaccgacgccggggaagatccgctggagaccgcacgccgggaggcggtcgaggagaccggactcgtcctcggccagggccggccccgcctcctgctgacccactacatgcaccccggcccccgctggccgatgggcaagatcggcttcatcttcgacggcggcaacctcaccaccgagcaactgcgccggatccgcctcgatccgagcgagcacgacctgtgggccgtccacggattcgacggatggcggcgcctcatggaggaggggcccttcgcccgcctgcgggccgtcgagcgtgcccgcaccggccacggcccgcactacctcgtctccgctcccgtctgacgcccgcccgcccctcacacaccaggagttcccgtgtccgccgaggacctcaacgcacaggcctggaccgtctacgggcagcgtcaactggcccgcgcctccatgccgcccgtcccgcggcagatgaactggtcgccctgggacggcgtcggacccggcgacgaggtcctcgggcccctcaccggccggcgggtcctggacatcgggtccggggccggtcaccacgccgtgcacctcgcccgggaccacggcgcacacgtgaccggtatcgacctgtcgcccacccagcacgagcgcgcggccaccgcccacgcggacgtgccgggcgtggaattcgtgcggggcgacgtggtcgaccacctgcgcgccgccgaacccttcgacgccgcctacgccgtcggctccctggccttcatcgacccgtaccgtgccctgcccgccctccgcgacggcctgctgcccggggcaccgctgatcctgtcgctcatccacaccgacctgcacggccgtggcccgtccacgacggtccagccgcgcgagcagacggtcctgttccgggacgacccacccctccccacgctgatgtgggtcctggcaccgcaggtgtgggaggaactgctcaccgagcacggcttccgcgtcgaagccgtcgacctgctgcgccgtcccgacgagagcacgccggtcgtacagcagctcatccgggcacgccgactcccggaccggcccgcacgcctctccagccgcccccgcaccacacgcgcgcccgttccgcacgccgccgtcggtgtcggcgccatcgtcctgagcgaacgcggcgtactcctcggtcgccaccgccacggcaccttcgaactgcccggcggcaccgtcgaacccggcgagtccctcgaacagaccgcggtccgtgaactcgccgaggagaccggactgcacgcccggacagaggacgtcaccctcctcggcacgctcgtcgaccacgtcggcgacgtcgtccgcgtcaccgtcggcgcgctggtcgacgcctggcagggccggccctccacccaaccgggcgagaaggtgggcgactgggcgtggtacccgctcgaccgcctgccggacgggctcttcgtgtgcagcgcccagatcctcaccgcctggcgtcccgacctgcccatcgaccactccccggcacacttcacgccgttccgtccgcgggcagggggcggcggcaccgctctgtgagcatcggctccgtcccgcggcgccgagtgagccgacgacggcggttgtcagaggcggcggctactctcggttcgagtcggtggatcaaagggggaggcgcagtcgtgggcgagcaggaaccggaccgggccgcggccgtcgtccgcgcgctgcgcgaggcggcggcggggcggcccggtgagatcaggctgttcgacggattcacggacgccgagatggacgcgtgggaccggcccgtgccctcagaggtgcgggccgtgctgcggcagatcggcgggatgggcgcccaccgcaccaagtacggcttcggggagcgtgaaggcgcccggttccacgacgggtttctgcgagtgggcgattcgccctccgggaacggttccctgatcgtgggagtctcggccgccggctggggcccggtcatgagtgccgacgtgtggagcgacccgtacgagatcaccgtcgaggcaccggacttcatcagctggctcaccgcccgcgccgagcgcctggcggacaccggcggtacggcggaccggtccgggccacaggttgccaccgacgcggtgagcagcatcgaggtggccgaagggacggacacagagctggccggactcgtggggcgcggtgacccgctgaccgacctggtcgatctgcgcgccctgccgggctatccgtgcggggtgaggtgggaaccgtacttctcgatgtccgacgacacggccgacaccgggggcagcgaggtcgagtacagcctggtgggcgacggccgggcgctgctgctgcgcagcgtggtcagcggcgacttcctgggccggccggtacgacggcacgcagcttcggcggatgcggcgggcgaggcggtggcacaactgcgtgccctggcggccgagttcccggacttcgtgcggctcgaaccgggctgctgcgacgaggagttggatgcctggcctgtcgtagtgcccgaggacatccgagtcctgctgcgtgagatcggcggcgtcgcggccgaagggatgcccgcgctccggttgaggccggaaggcacggcagcgaccgtgagcccgcaggtgcaccggatgctgggcggcgacggcacctactggccgctggccgaggtccgcctgcgcgagggcggggacagcgtcctggtgcagatccgcatcgaccgcgccggcggcacgtgggggtacgtcctctcggtacccggcgacgcctcggcgctgcgggactggccggaggcgactctgctcgcggattctctgccgtcgctgctgctggactacgcccggcgggcccgccgcgcggcagccgcacccgcgggcacggaccgggcagcggacggcagcctgtggctcttcaccaacaccggtcacccctggccacggcccgtgccggtgcacgagtgggcgcggtcggcggatccgctcctggcggcgctcgccgccgaactgcccgagggcgcctgcgccgcggacctgcgcgtcgtccccgtaccgagtgacctggtcttccgcgaggcccccgactggccgtgccccgcctcgctggaccgtcttcacttcgccgcgggcggccaggtggtggccgcgatacccgccggcgtctgaggggacggcgggcgcggtgtccgcgccgcggctccgatgtccgggacgggcacccgtcccggccgcacgcgcgcatcttccgtccggcagtgatcagctcgcggtgaaggcgtccgcagagcccgcgtcctgggtggcagcccacgtcgcgaggagacgcaggccctcttcggagggcgagccgggttcggcggtgtagatggtgagggtgaggccgggttcggcggccatctccagcccttcgtaggcgagcgtgaggtcaccgaccgcctggtggtggaagcgtttggtgccggtgccgtggtggcggacgttgtgggcgccccagcgggtgcggaattcgtcgctgcgggtggacagttcaccgacgagatcgtggaggcccttgtcgtggggattgcggccggcttcggtgcgcaggatcgacacggtgacgtcggcggcctggtcccagttggggtagaagcgacgcgaggcggggtcgaggaagttgaagcgggccaggttcgcctggttgtggggtgcggcgtagacgtcggcgtagaaggcgcgagcgagctggttgacggcaaggatgtccatacggccgttgcggacgaaggccgggccggcggtgacggcgtccaggacccactgcaggctgcggtgcgccttccatggggcagggcggcgtcgcgggcgggtgagggcatcggagccgtcggccgtgtgggcgaggttgagcaggtgggcgcgctcggcatcgtccagttgaagggcgcgggcgagggcttcgaggacggccggggaggcaccggcgaggttgccgcgctccagtcgcgagtagtactccacgctcatgtcggccagcgcggcgacctcactgcggcgcagaccgggcacccggcgccggctgccggaaggcaggcccgcctgctcgggggtgatcttggctcgtcgcgaggtgaggaactcacggacctctgcttggttgtccacgccttcgacggtacgtcccgcacccggccgtagggatgtactggcagtacacccttcgacggtgcctcgctccgcctgccacgagcgggttacctggatgacgtggtcctcttcgtccggccgcgaaccggcgggacgagacgccacgtggctgcccacccgtcgacggcccgtgccccgcccgcatgtatgcagtcacgcacgcacgcatgtatgcactcacgcacgcacgcatggaaagccgaccgcccgtccgcccgtccgcacgcacggaaagaagttcttcatgtcccaccccgccgctgccgcgccgggcaagctgcccttcgtcgtgtgggtgcttgcctcgggcaccttcctgatgggcaccaccgagttcgtcatcgccggaatcctcccggacatcgcacccgacctcggcaccggcgtctcccacgccggactgctgatcaccgccttcgccgtcggcatgatcgtcggcggaccggtcatggccctggccaccctgcgtctcccgcagcgcctcaccctcgtcctcgccctgtcggttttcgccgccggtcacgtcgtcgcggccctcaccagctccttcaccgtcgtcctgaccgcgcggttcgtcaccgcgctggccaccggcgcgttctgggccgtcggtttcgtcatcgccaccgccgccgcaggacccgccaacgccacccgggcggtcggcgtcatgatgggcggcctgacgctggccaacgtcgtcggcgtccccgccggctcgctggccggacacgtcaccggctggcgcgggctcttctgggccctggccgcgctcgccgccctcgccgccgccgtgatcggccgcttcctcccccggacggagcgacgcgaccaggtttccgtgcccggcgagatccgggcgctgcgccagggccggctgtggctggcgctgacggcggccgtcctgatcatgggcggcgttctggccgcctacacgtacatcacgccgctgctgaccgaccgggcgggcatcccggccggtcggtcagcagcggcgt

SEQ ID NO: 1176 - DNA, 3741 bp, Unknown
  Kingdom: Bacteria, Phylum: Actinobacteria, Class: Actinobacteria, Order: Streptomycetales, Family: Streptomycetaceae, Genus: Streptomyces
ccgcgcagaccgggccggcggacggctcgtggtccaggccgtagcgccacaccagccgctcgccctcgcacaccgggcacgccgaaccgggcgcccgctccagcgcggcgatcagccggcgcagcacctcggccagcggttcggacgggtggacccgcgggtcgtcgcaccacgcgaccccgaagccgccccaggtcagccggtgccagtcgtccacgctgcccggcctgcgcagcccgtcgtgcttctccttcctgcgccgccccgcgaactcggactcgtagtcgagccacaccgagcgcgcctcctccagttcctccagcgcggccacgagccgcaccgggtcgggagacctgtcctcggggccgaagccggcccgggagcacaggtggtcccaggtcgcccggtgcccgtagggggcgaaacgctcaaggcacttgcgcagtgagtaccgccgcagcgccagatcgcaccgcggatccctcacctgtctcgccagactccggaaacccgccatcgccctgcacctccgtcacacctgcacttgcacctgtacctgtacgtgggtcacttcggcgtcgtcgtacggaagcgtccaaccgacgtcgtctggtagacgtgccggcccgcgattcggctccatccgatgtccgatgtccgccatgacttcgccctggttgaccgtcatgtccgtcccgcagactccaaaaagtgacgtgtgttcatcttccaactcggggataccgccggtaacgtcccgctccacccccgtcgggaggagcagtaatgccacggcgcaccccacgcagcgcgctcgacagagtgagaactccccacagattccccgggttcctgaagaccgcatccgtatgcgtcctcattgccggtcttttgtcacccttttcccaagcggtcgcggcggacgcggccccgaaggccgccgccgccaacgactactgcggcggccggtgctcggacatcctgccgccgggcgagaacggcaacgccaccctcgcccagatcctcctcaaccagggcttcggcacccagcccgcccatgccgaggaccagctcggtccctacgccaacctggccaagggctacccggcactcaccgacgacacgatcaacaccttcttcaacgacgcctcgttcggcgtccccgccgaccaggtcgcctccaccgagaagcccgcgggccgcggcgacgtcacgatcgtccgggacaagaagaccggcgtgccgcacatcacaggcaccacccgctacggcaccgagttcggcgccgggtacgccgccgccgaggaccggctgtggctcatggacgtcttccggcacgtcggccgcggccagttgacctccttcgcgggcggcgcccccgccaaccagggtcttgagcagcagttctaccgcaacgcgccctacaccgaggccgacctccaggcccagatcgacagcgccgtcgcgaagaacggcgcgcgcgggcagcaggccctcgcggacgtgaacgcctacctcgcgggcatcaacgcctacatcgacgcctccgaccccgggcgttacttccccggcgagtacgtgctgaccggccacaaggacgcgatcaccaacgccggcaccatcgaccacttcaaggtcaccgacctggtcgcgctggcctcggtcgtcggctcgctgttcggcgccggcggcggcggcgaggtgaacaacgccctctccctgatggccgcgcagtccaagtacggcgtggaggagggcacccgggtctgggagtccttccgcgagcgcaacgaccccgaggccgtcctcaccctccacgacggccagagcttcccgtacgccaccaagcccgcctccccgaagggcgaggcactgcccgacgccggctcggtgaccgaggaacccctcctgtacgaccgtaccggcagcgcgaccgccgccgcggcgggcagcgccgccaccaaggccgcgaagaccgccctctcctcggcccggcggggcatgtccaacgccctcgtcgtcagcggcgagcacaccgcgagcggccaccccgtcgccgtcttcggaccgcagaccggctacttcgcgccccagttgctgctgctccaggagatccagggccccggcatcagcgcccgcggcgcctccttcgcggggctgagcatgtacgtcgaactcggccgcggccaggactactcgtggagcgccacgacctccggccaggacatcatcgacacctatgccgtcgagctgtgccaggacgaccaccactacctctaccacggcacctgcaccgccatggaccaggtgtcgcaggccaactcctggaagcccaccgtcgccgacggcaccaaggccggctcgtacacgatgcgggtgtggcgcaccaagtacggaccggtccagtaccgcgccaccgtcggcggcaagaaggtggcctacaccaccctgcgctcctcctacctgcacgaggccgactccatcatcggcttccagatgctcaacgaccccggcttcgtccagggcccgcaggacttccagaaggccgcgcagcacatcaacttcacgttcaactggttctacgccgactcgcggcacaccgcctactacaacagcggtgacaacccggtgcgggccgacggcgtcgacgccgagttccccgtgtgggcgcagccggcctacgagtggcgcggctgggacccggcgaccaacaccgccgactacaccccgcccgccgcgcaccccaactccgtcgaccaggactactacatctcctggaacaacaagcaggcccaggactacgcggcggcgccctggggcgagggctcggtgcaccgcggcaacctgctggaggaccgggtgaagaagctcgtcgcctccggcggggtgaccagggcctcgctcacccgggcgatggcggacgcggccgtcgccgacctgcgcgccgaggacgtgctgcccaagctgctgaaggtgctcgacagctcgccggtcaccgacccggcggcagcggcggcggtggacaagctgcgggcctggctggccgcgggcgcccaccgcaccgagacctcggccggttccgggaagtacgccgacgccgacgcgatccgcatcctggacgcctggtggccgctgctggtcaaggccgagttcgaaccgggcctcggcagcgacctgttcaccgcgttcggcgccaacctgcccgtcgacgaatccccgtccgccggacacggcccgaccggctcgcacgccggaagcgccttccagtacggctggtggagctatgtcgacaaggacatccgggcggtgctcggcgagcaggtgaagggcccgctggcgcagaagtactgcggcgccggcagcctcaccgcctgccacgacaccctggccgccacgctcaagcaggcggcaggactgaccgcggcccaggtgtacccgggcgacgaccagtgctcggcgggcgaccagtggtgcgccgactcgatcgcccagcgccccctgggcggcatcaagcacggcaggatcagctggcagaaccggcccaccttccagcaggtggtggagtacacctcccaccggtgatgccaggggcgcccggatgacatccgggcgccccagcacaggtgccggcggcgggtcacacgatgcggcccgccgccagcaccagccgcgccagctccgggtgcacgatgtcgctgtgcgcgccggccggcggaccaccgcggcggaccacctcggacg

SEQ ID NO: 1177 - DNA, 2560 bp, Unknown
  Kingdom: Bacteria, Phylum: Actinobacteria, Class: Actinobacteria, Order: Streptomycetales, Family: Streptomycetaceae, Genus: Streptomyces
gccggcggcccgcgcacaccccacgcacatccgcgccacaccgacacccacgtcgcggtgacgcccctgtccaggtgacgcccgcgcgcgccacggagacgaagcgaccggaaaacacatgagcacttcctcgtacctcatcagacgcgtcctgcaggccgtcgcggtgatcgtcatcgtcacgatcgtcgtcttcggcctgctgcacgccctgcccggcggccccgcgcgcgggatcctcgggccgcaggccaccgcccagcagatcgcccgcttcaaccacgaacagggcctggacaagtccctgcccgtccagtacttctactacctcggccaactgctgcacggtgacctcggcacctcctacaccctcaacgagccggtctcccagctcatcaccgagcggctgccgaagaccctcgtcctcaccgtgctctccgccctcgtcggcctcgtcctcgcggtcccgctgggcatgtggcaggccgtgcgccgcaacaaggcgacggactacgtcatcaccacgctcagcttcatcgcctactccacgcccgtgtacttcctcggcctgatcctcgtcctggtcttcagccagcaactgggctggttcccgtcacaggcgccgcagggcgagaccctgggccaggtgttctccgacccgcaggccctggtgctgccggtggtcgcgggcgcggcctccatggtcgcggtgttcagccgctacatgcgctcggccaccctggagaacctctccgaggactacgtccgcaccgccagggcgggcggctcccgctcccgcgccatcctgtggcggcacgtgttccgcaactcgctgacgcccgtggtcgccatgctcggctactacgtcccggtgctcttcggcggtgccctggtcgtcgagcagctcttcaactaccccggcatgggcctgctgttctggacggcggcgcagtcctccgactacccggtcctgctgggctgcgtcctggtgatcgccgtcgccaccgtcaccggcaccctgctcgccgacatcgtccagcggatcatcgacccccgagtgaaggcaggccgggcatgagcgccgtcatccagccggacatggtcccggcgaaggcagcggccccgcgtgaggcctccggcgcacggctcgccgtccgccgcttcctgcgcaacaggctggccgtcgtcggactcgccgtcgtggtcctcttcttcctgttctgcttcgccggcccgctggtctactccaccgaccagacccacaccatgctccagcaggtcaacctcgccccgagcggcgcgcactggctcggcaccgacgccgtcggccacgacgaactgggccgcctgatgtacggcggcaaggtctcgctgatcgtcggcctcgccgcgggcgtcctcgccaccgtcatcggcacgctgtggggcgccgcagccggatacgcgggcggctggatcgacgccgtgatgatgcggatcgtcgacgccggcatcgcgatcccggcgctgttcatcctgctcgtggtctccgccatcaccacacccggcctgaccggactcgtcctcatcctgggcctggtctcctggctggtgccctcccggctggtccgcgccgagacactgaccctgaagaaccgcgactacgtcctgaccctgcgcgccatcggcggcacgcacgcccgggcgatcctgcggcacatcctgcccaactccgtctcgaccgtcatcgtcgccgcgaccttccaggtcgccgacgccatcctgctggtcgcctacgtctcctacctcggcatgggcgtccggccgccgcagaccgactggggcggcatgctctccgccggactcaccgccgcctactccggctactggtggctcatcctgccgcccggcctggccatcatcctggtggtgtgggcgttcaacgcgatcggggacggactccgcgacgcattcgatgtgaggggacgcggatgaccgccaccaccaagggccccgccgccgcccgcaccgcggcatccggcccgatcctcgaactcgacggcctcggcgtcgtcttcaccaccgagaccggcgaggtacccgccgtcaagggcgtgtcccttcaggtccggccgggcgagacgctggccctggtcggcgagtccggatccggcaagtcgaccatcgcgctcgccgcgatgggcctgctcgccgggaacgcccgcgccaccggcagtgccgtcatcgccggaacgcagatcgtcggcgcctcggagaacggcctcgcggcgctgcgcggcaagaccgtctccatggtgttccaggagccggccaccgcgctcgacccgctcacccggatcggcaagcagatcaccgaggtgatccgcaaccaccgcgaggtgtccgccaaggacgccgccgccgaggccgtcgaactgctgcgcagggtcggcatccccgaaccggacaagcgtgcccgcgcctacccgttccagctctccggcggacagcgccagcgggtcgtcatcgccatggccatcgccaacgagcccagcctgctcatcgccgacgagccgaccac

SEQ ID NO: 1178 - DNA, 1613 bp, Unknown
  Kingdom: Bacteria, Phylum: Actinobacteria, Class: Actinobacteria, Order: Streptomycetales, Family: Streptomycetaceae, Genus: Streptomyces
tcaccaccccgtccgggcccgacggccgagaacgagcccccgcggttccggcggtggcggggtgccggggcgcaacggcagcgcgatcagcatgcccaccacgaagccgaccacatgggccgtgtacgccaccgtgcccgcgccggagacgccctcgccggccgagtagaacgcctgcagcacgaaccagaagccgagcacgatccaggccggcaggcgcagcggcaggaagatcaggaacggtacgagaacccagacccgggccctcggatacagcaccagataggcgccgaggaccccggcgatcgcccccgacgcgccgatcagcggctgccccgagtccgcgtcgagcagcgcgaagccgtacccggccgcgtagccgcagacgacgtagaacaagatgaagcggaggtgtcccatccggtcctcgacgttgttgccgaagacgaacaggaacagcatgttccccagcaggtgcagccagctgccgtgcaggaacatcgcggtgaacaccgagagcacgggcgacttgtcgtacgtcggcgggcccagcacacagcccggcccgtgcacccccacgcccaccgcgcccgtcggcaccagcgacggcatccgttggtggatcagctcgcgcgggaccagcgcgtagtgctccgtgaacgcctgcacatggcacagctgtgccagcgtgccgctcccggtgagggaaccggagatgccgggcgtcgacaggaacacgacgacgttggcgacgatcagggcgtacgtcacccagggggtgcgccgcaccgggttcacgtcatggacggggatgaccacgtcgaagtactgccccggatgcgccgcgcgaatcggtggacgccgctgtgaacccccacggcggacgccaccgcggacacccctgtgcgccgctacctccgtgcccccgcgaccttggccgccgccttgcgggccgccacgagcaccgggtcccacaccggggagaacgggggcgcgtagccgaggtccagggcggtcatctgctccaccgtcagcccggccgtgagcgccaccgccgcgatgtcgacacgcttcgccgcaccttcccggcccacgatctggacgcccaggaggcggccggtgcggtgttcggcgagcatcttcaccgtcatcggggaggcccccgggtagtagcccgcgcggctcgtcgactcgacggtgaccgtctcgaaccggaatccggcccgccgggcgtcccgctcgcgcagcccggtccgcgcgatctccaggtcgcacaccttgctcaccgccgtgccgaccacgcccgggaaggtcgcgtaaccgccgcccgcgttggtgccgatgacctggccgtgcttgttggcgtgggtgcccagcggcacgtagcgctgctggccggacaccaggtccaggacctcgacgcagtcgccgcccgcccagatgttctcgtgcccgcgcacccgcatcgcgcggtccgtgagcagcccgcccctcgccccgagcggcagcccggccgcacgcgcgagcgaggtctcgggacgcacgccgatgcccagcacgaccacgtccgccgggtactcggccgacgtcgtggccacggcccgcacccgccc

SEQ ID NO: 1179 - DNA, 1232 bp, Unknown
  Kingdom: Bacteria, Phylum: Actinobacteria, Class: Actinobacteria, Order: Streptomycetales, Family: Streptomycetaceae, Genus: Streptomyces
gccctggaccgcgctttccccgcctcaggagccgcccccaccgcctgacgagttcacgccccggcaaccggcccccgtcccgcccggtatcatggtcggcacggcagacgagccgggcgggcggccgcgtgaagtccccgaaagggggcctcccgaggaacgtccgggctccacagggcaaggtggtggctaacggccacccggggtgacccgcgggacagtgccacagaaagcagaccgccgggcgcttcggtgctcggtaagggtgaaacggtggtgtaagagaccaccagtgcccaaggtgacttgggcagctaggtaaaccccacccggagcaaggtcaagaggagcgccgtgaaaagcgctctgcgcggacgttcgagggctgcccgcccgagtccgcgggtagaccgcacgaggccggcggcaacgccggtcctagatggatggccgtcgccggagggcccgcgaggaccttccggaacagaacccggcgtacagcccgactcgtctgccgctctcttgcgcggtgcgtgcgccgctttctcacgcggtacgtgtgccgctctcccacgcggtacgcgcaccgaggacgacctggcgccgagccgttctcacgccgtggcgagcgagacctccgtggacttgaacagggcggtgaccgaggagccctcggtcaggccgaggtcggtggccgcgtccttggtgatcgaggcggtcagttgcgcgccctcgaccgagagccggaccgtggccatggcggcgccggacgccacctcccgcacggtgccgcgcagccggttgcggatggacagcccctcgaccgggccggtggccagcgcgacctccgtggccttgaccagcgcgtacaccgcggaacccgcggcgagaccgaggtccctgacggcgtccgccgtgatggcggcggtgacgtcctgaccgccgacgaggcggaccctgaccgtggccatggcctcgcccggggtgacggagacgacgttgccggggatctggttgcggatgctcaagctcatcgggcgcctcgcagaaacaggtgattcgttacgttttcggggctgcgaggtccaccgtagccatgaatgccgcgagcggcgccccggcggccccgcagcgccggtgggtccggggcaccgctccggtgcgcacgcggccgcagcccggtgggtccacggccgctacgaggagccgtgcctttgcacgcccgcccggcc

SEQ ID NO: 1180 - DNA, 4169 bp, Unknown
  Kingdom: Bacteria, Phylum: Actinobacteria, Class: Actinobacteria, Order: Streptomycetales, Family: Streptomycetaceae, Genus: Streptomyces
gcgccgcggaacagttccgccacggccggttcccggcccgccggggctcccgagagcccgaacttccaccaccgccgccgaaccggccagcgagtggaagccgcccgcgcagtcggtcgccgagggcaggccgccggtgccgggcaggggcaggaagccgatctcgcccgtgccgccggaggcaccatgccgcaggacgccgtccaggaccaccgccgcgcccgtgccgtggccgagccagagcaggacgaaggtgtcccggccccgggcggcaccgtcgcgctgttcggccagcgcggcgaggttcgcctcgttctcgacgatgacgcgggcctgcggcagccgttcctggagcgcggccaccagccggcggtgccacacgggcagcccggtggtctcgcgcagttcgcccgtgaccgggtcgatcagaccgggcgcgccgatgccgacggtgtgcagccgctcggcccccgcctcctgcgccgcccgttccaccagggtgaccgcctgctcgacggcgggaccggtgcccgtgtccgggccgatcggcaccgacgcctttgccagttcccggccgagcaggtcgcagacggtcacggcgacgctgttggtacggacgtcgagggcggcgaggtgggcgcggtcggcgacgatgccgtacaaccgggcgttggggccgcgccgctgctccccggactcccccaccacggtgatcaggccggagaccgtcaggcgttcgaccaggtcggcgacggtagggcgggacagtccggtcagctgcttcaactgccctgccgtcaacggcccttcctgctgcagcaggcgcagggcgagccggtcgttgatggcccgggcggtgctcggggatgcgggcatgccgggaatccttccagatcgtcggggccgggcggcgccgcgggtcccctatctatcaggaagggtccctgatagtttacgtcggcagtacggcgggacgacgcacacgcccgggaggggccggagaatgacagcagtggtctaccagcagcgcgaggtcaggcgcgcccggtacgccgtggcggccgtcttcgccgtgcacggcgccgtgaccggttcgttcgccacccgggtgccgtggatccaggaccacgcctcggtcagcgccgggcagctgggcctcgccctggcgttcccggcgctcggcgcgtccgtcgcgatgccgctggccggcggcatcagccaccgcttcggcgcccgcaccgccctgcgcggtctgctggccctgtggacgctctcgctggtcctgcccgccctggccccgaacctgctcaccctgtgcctggccctgttcgtctacggcgcctcggcgggcatgtcggacgtcgcgatgaacgcactcggcgtggaggtggagaaccggctcggccgctcgatcatgtccggcctgcacggcatgtggagcgcgggcgcgctgatcggctcggccgccggcacgctcgccgcgcacctgggcgcggacgcccgcctgcaccacgcgctgacggcgggcgtgctgacggtcctcggcttcaccgcgtgcgcctgggtcctcgacctgcagcccgccgaggacgaggacccgccgccgcggttcgcgctgccgccgaagtcggcgctgctgatcggcgcgatcgggttctgcgcggtgttcgcggagggcgcgagcctggactggtccgcggtctatctgcggcaccggctggagacctcggccggcctcgccgcggcctgcaccacgggcttcaccttcaccatggccatcgcccggatcgcgggcgacaaggtggtggaccggttcggctcggtgcgcacggtgcgggccggcggtgtcctcgccgtcgccggaggcctgctggtcgtggtggcggggcatccggcggtggcgatgaccgggttcgcgctgatgggtctgggcatcgcggtcgtggtcccgctctgcttcgccgcggcgggccgcagcggcccgaaccccagccaggccatcgcgggcgtggcgaccatcacgtacacctcgggtctggtcgcgccgggcgcgatcggcggtctcgcccaggcgaccagcctggtggtgtcgttcggcctggtcaccgtgctggcctgcgggctcgcggtcttcgcgggggtgctgcgggcgggcgaccgggaccgcccgacgatcagtgggccgagcgcagcagtgcccgacccgcggccctgaactcctcgctccacggcgcgggccgcagcgtggcggcatccagccggaccaggacgcggctgccgtgcgcgtacgtcagcacgccgtcggccgaacagaagcggaagccgtaggtgagaccggtggtgccgagccggtcgagccacaggtggacggcgtacgcgccgggccgggtcaccggcgcctcgtaggtgatgcgcagctccttgaccgcgttgcaggcgtccccggcggccacccagtcaccctcgaagcggaacccgtgctcgtgccacagcgcggaccaggcgcgttcgaccatgagcgggtagcgggcgttgtgcagcagcccgagcgcgtccaggtcgtcgaagtggacggtgacggggatcagccgtccgtacgacagggcgggggcggcgggtgcttcggcggtcacggtggtgctcctgaacgtacgggccggggcggttcaccccccatcctaagcggtcgctcagcgtgcccgacggggaaggtgctggtcagccgcccggcacccgcacaatggtctggaaacacttcacgtacagagaaagcgaaaccccaccatggacctcggcgtgcgctggaaactgcacggtgacgggcgcacgcccgcacccggagcggtggtccggcccgacgaacggctgtcctggccccgcacggtcgggctcggcgcccagcacgtcgtggccatgttcggcgcctccttcgtggcccccgtgctcatgggcctcgacccgaacctcgccatcatgatgtccggcgtggcgaccgtgctcttcctgctcgccacgcgcggccgggtgcccagctacctgggctgctcgctgtccttcgtgggcgtcgccgcggtgatccgggcgcagggcggcacgagcgcgaccgtgaccggcgcggtcttcgtcgtcggcgtcgtgctgttcctggtgggcgtcgcggtgcagcggttcggggcgcggatcatccacgccgcgatgccgccgatcgtcaccggcgcggtcgtgatgctgatcggcttcaacctggccccggtgaccgcctccacctactggccgcaggaccagtggacggccctgctggtgatgctgttcaccggcctggccgtggtctgcctgcggggcttctggtcccggatcgcgatcttcctcgggctggtcttcggctacggcatctcctgggtcttcgaccgggtcttcgggaagatccactccgtggacggggcgggcaagctcaccgaccactggcgcctggacctctccggcgtctccaaggccgactgggtcggcctgccgaccttccacggcccggccttccactggtcggcgatcctggtcgcgctgcccgtcgtcatcgcgctggtcgcggagaacgccggccatgtgaaggccgtcggcgagatgaccggcgacccgctcgacgacaagctgggcacggcgatctcggcggacggcgtggcctccatgatctccacggccgtgggcggcccgccgaacaccacctactccgagaacatcggcgtgatggcggccacccgcgtctactcgaccgccgcctactgggccgccgccggcttcgcgctgctgttcggcatctgcccgaagttcggcgccatcgtcgcggcgatcccgggcggcgtgctcggcggcatcaccgtcatcctctacggcatgatcggcctgctcggcgcgcagatctggatcaacgccaaggtcgacctgcgcaatccgctgaacctggtgccggccgcggcgggcatcatcatcggcgtcggcaacgtcagcatgaagttcaccgacaccttctcgctgagcggcatcgcgctcggcacggtcgtcgtcatcaccggctaccacgcgctgcgcgccttcgcgccggcgcacctgaaggggcaggagccgctgctggacgagggcacgtcgtcgtacgacgcgtcggggcgggacgggag

SEQ ID NO: 1181 - DNA, 2359 bp, Unknown
  Kingdom: Bacteria, Phylum: Actinobacteria, Class: Actinobacteria, Order: Streptomycetales, Family: Streptomycetaceae, Genus: Streptomyces
gtggacggggacgacgaagagctgctcaccatcggcgcgttcgccgcgcggtcccggctgtcggcgaaggcgctgcggctgtacgaccgcctcgggctgctggcgcccgcgcacgtcgacgaggccagcggctaccgctactaccgcgcctcgcaggccgctggtggcgctgctgcgccagctggacatgccgctggcccgggtggcggaggttgtcgcggcggtggaggcggacggcgccggtgcggccggtctgctcgccgcgtactgggcggacgtcgagagccgggtggccgggcagcggaccctcgccgcgtacctccgtggacggctgtccgggaggagttgcgacatgtacgggaagttcgtggtcgagacggtggacgtgcccgagcgggtggtgatcaccgagacccggcacacgctggcgggcgagctgcccgcctggatcggggcgtcactgacccggctggaggacgcggcgcgcgcgtgcggcggcgtcacggcggcgccgtacgtcgtctaccacgccgaggtgtccatggagagcgacggtccggcggagtcctgcgtgccggtcgccgacgagcgggccgcgcgggcctgggcggcggccggggggcggtcctgggagacggcggtgcgggtcgagccggccgtgcggctggcgtacacccggatcgccaaggcgcaggtggcccatccgcagatcatggccgccttcgaggcggtggagcagtggatcgccgagcaggggctcacgcaggccgggccgtgccgcgaggtgtacttcgccgactgggacgccgcggggcccgaggacgccgtgtgcgacgtggccttccccatcaggtgagatcaggtgaggtgaggcgccgggccccggcgtcgctccggggcccgttcctcacttcgccggtttcagctcgtccgggcacggtgtgccgcgcggcagctggtagggcgcggccagacggtacgtgcccgtgcgcggcgcgagcagtgtcgtccacttgtcgcccttggcgtcctgcggtgtctccgccaggcatccgttgacgttgtcgaacgtcttcggcgtgcccttgagccggtgcttggacgcctcggtctcctgcggtgccttcaggctcttgccgtggtcgtcgacgaggctcagccacggcgagtacgggatgcggatgaggacgcggccgggcttgcggacctcgatggtcagctcgccctgctcggcccggtcgacgaccgcgttcggctcggccagcggcgtggggtcggtgaccttgaacagctgccagttggcgttgccccagacctggctcaggtacggcatgccgcgctgcaccagcgcccgctcgcgctgcccgccgtcgccgtccggttcgcccttgggcagcaccacgtagtgcaccgcccagcgctgcagccactcgtggtagttggccgagttgagcgtgtcgtcgtagaagagcgggttgcgctccatgtcggcctggcggttccagccgcgggcgaggttgacgtagggcgcgagcgcggaggcctcgcggtgcgagctggccgggaccacctcgacccggcccttctccgcgccgaccttctgcaactggttgaccagcggagccagctcgcgcgaccaggaggcggcgggcgcggtgtgcacgatgtcgtccaccgtcttgatgccgatccagacgacgaagccgatcagggccagcacggccgcgtaccacttgcgcgagcgcggcaccgtgaagggcagggccgccaccagcaccacgccggcgaacagcatcgccagccgcgtgatgttggaaccgatctgggagctgatcacccagaccccgatcaccgccagcgcgtacacccaggacgtgatccggaccgtcttccagcgcttgggcacgacgacggccgcgaggacggcgtacagcagcggcagggacgccgagccgaagcccatgggctgggtgccggagaacgggaacagcagcgccgagacggccaccaccacgctcggcgccacgccgagcgcccaggcgccggggcggcgcttctgcaggaacagggcgaccgcgaccaggcccacgaacaggcccgccaccggcgagcccatggtggcgagggcggccagcggggccgcgaccagcgccttcgcccagcgtttgtggcgccagcggtgcggccagcagaagacggcggcgaccgcgccgagcgcgaacatcgtgcccaggccgaacgtcacccggcccgatatggcgttgcacagcagcccgaagatcccggccgccgacgcccacagcgggttcctgaccacgcggctgcggatgaggatcagggtgagcagaccggcggagac

SEQ ID NO: 1182 - DNA, 735 bp, Unknown
  Kingdom: Bacteria, Phylum: Actinobacteria, Class: Actinobacteria, Order: Streptomycetales, Family: Streptomycetaceae, Genus: Streptomyces
  misc_feature (385)..(448): n is a, c, g, or t
gcgcactaccgggtccagctgtgcctgccgctgcgcgccgaccgggcggtgttcgccgcgtactgggggcgcgggtacggctgcaacccgggcgcgctggaggcggcgttccgcgagttcgcgccgcacatccgcaccgcgtggatcgcccggccggaccaccacggcaccctcccgtccggcacccgcgcgctgaccccgggcacggcggcctactggacggcgctggcccgctccacgtacctggtcaacaacgtcaacttcgaccgccgcctggtcaaacggcgcggccaggtgttcgtgcagacccagcacggcacgccgctcaagcacatgggcctggacctccaggagcggcccgcggcggccgccggcatggacttcnnnnnnnnnnnnnnnnnnnnnnnnnnnnnnnnnnnnnnnnnnnnnnnnnnnnnnnnnnnnnnnngcgcaacgacgtcctccagcgggcgacctcgcaggacgtggcggagctgcgcgcggcgctcggcgtaccggacgacgtggtcgccgtgctgtacgcgccgacccaccgcgactaccgccgcacccagcgccccgccctcgacctggagcgcttcgcccgccgcctcggcccgcgcttcgtcgtcctggcccgcgcccactacttccaggacaccccgctcaccaccgcgcgcagcggccccgtaccagcgggggagggcggccgggtcgtcgacgtcagcgcgcacc

SEQ ID NO: 1183 - DNA, 836 bp, Unknown
  Kingdom: Bacteria, Phylum: Actinobacteria, Class: Actinobacteria, Order: Streptomycetales, Family: Streptomycetaceae, Genus: Streptomyces
gccgcggccctgctcaccaacccgcggctgctcgtcctggacgagccgtccaacggcctcgacccggccgggaagaagcacgtccacggtgtgctcacccggctcgcgcgggaggggacggccgtcgtgctctccagccaccgcatggacgacctggaggcgctgtgctccgaggtcaccatcctggcgaccgggcggatcgtcttctccggtcccctggacgagctggccgccgcgaacccggaactcgactaccggatcgtcacgtccgacccggcgcgcgcccgccgactggccgccgacgcaccggggatcagcctggccgacggcactccgggacgccacgacggcgagggtctcgtggtgcgcgcgctggtgcccgccctcgacgacctggtggtacggctcgtcgacgagggcatcgcgctgcgcgaactcggcccgctgctctccccgttggaggcggcgttcctggccctgaccgagcagcagagcaccgacgtccagcagcaggagaccggtcgatgaccaccaccacgccccccaccccggactccacgtccacggcagactccgcctctaccgcggactccgcctccaccccagattccgcctccacggcagaccccgcctccacggcagacacttccatgacaggtcccgcccccaccgacgacccggccccctcggaaggccccgcgaccgccggtcccggggagcgagcacgcagtaccgcctcccctggccgcgccaccgtcgcccggagctaccgcttcgaaatcgtcaagctcctctcccagtggcgggtccgcctcctgctcatcgcctgctggatc

SEQ ID NO: 1184 - DNA, 533 bp, Unknown
  Kingdom: Bacteria, Phylum: Actinobacteria, Class: Actinobacteria, Order: Streptomycetales, Family: Streptomycetaceae, Genus: Streptomyces
ggccatccggccggagcccacacgtgcgaagctgccgccatgcccgtgatcctccgctccgccgccctcttcgtcgtcgccgccctcttcgagatcggcggcgcctggctggtctggcagggcgtgcgcgagcaccgcggctggctgtgggccgccggcggtgtcctcgcgctcggcgcgtacgggttcgtcgccaccttccagccggacgcgcacttcggccgcatcctcgccgcgtacggcgggatcttcgtcgccggttcgatcctgtggggcatggtggccgacggctaccgtcccgaccggtgggacgtggcgggcgccctggtctgcctcgccgggatggcgctgatcatgtgggctccgaggaacggcggctgaccgtcccctgcggacggccgtcccctacgctggacagaacccagcgcacgcaccccaggagcagcccatggccaccgccgcaccgtccgccgcctcccgcatcgccgtcgtcaccggtgcgagcagcggaatcggcgccgccacggcccggc

SEQ ID NO: 1185 - DNA, 579 bp, Unknown
  Kingdom: Bacteria, Phylum: Actinobacteria, Class: Actinobacteria, Order: Streptomycetales, Family: Streptomycetaceae, Genus: Streptomyces
aggaactgcgccggccggcgcccgccgtcccggagtccgtccgcgagaccggcaccgtggaacccggtgggaccgcggccggactcgcggccaccgtgggggaggccgtcgagaccagtggcgcaggtgccgccgccgtggtcgctgtcctcgcccccgtcctcgcgggagtcgccgccgctctcttcctcctcgtcggctacgtcctgaagatgctcgacccggccccggctttcgcccagagcctggtcaccgtgggctgggtcttcggtgccgtgaccgcggccgccatcctggcggccgcggtaggactgctggtcactgcgctgcgcaaccgtccgccagcgggctccacgccgtacggagaagccgacgaggaactcgcccgcgcccgggacgcctggcgcgacgccctcgcccgggctgctgaagccggggcggccgtagccgagctgcggcatgcggccgctcggcgccgacggatccgtccgctgcggcgtgacggatccggaggccgcgagggcctcgcggaggaacggcaggatgccgcgttcgagcagggcgtcgcgccaggcgtcc

SEQ ID NO: 1186 - DNA, 3520 bp, Unknown
  Kingdom: Bacteria, Phylum: Actinobacteria, Class: Actinobacteria, Order: Streptomycetales, Family: Streptomycetaceae, Genus: Streptomyces
gaacctgcgctacccgcgccgcctggccgcgctgaacggcgcggtcggcacccggatggcgctggccaatcccaggctgctgcacgagggcgccggtccgggaaccgagacgttcgtgctcggcggccaccaggcggccggacaacaggggacggccacgaccagctcggtgcagttcggggtcaccggcctggagagcgacgcccatgtgcgcgcctcccaggggctgtcggcgtaccggagctggggcgggagccggaccggggccaccgccgtctccggcacggtggagcgcaacgcgcacactccgcgcaaggcgcccctgtacctggtgctgtgcgacctgctggtcaccatggtggcggaggtcaaggtcaccggcggcggcccgtacacggcgtcggcggcccggaccctgcccgcgacggcggcggtgtggctgacggccgggcagttgcgtgcggcgggcgtggagcttccggagtcggcgcgcaaggcgctgaaactggacgggaccggaccgggggcgggagccggtacggtcgccaccggcaccggcaccgccaccggcaccggcaccggcaccggcaccggcacccgcaccggctgctgcccctgcccctgcccctgtcagcaccatcgccgctgccgctgccgccgtcgcggccaccacacgcccgcggccggccctcagcaggccgcgcgggcccaggaggcgccccgcaggaagccgccacggcctcgcaggagcccgccgtcgagccgtgggtcgtcccatccccgcgccacccccgcgttcgccgccgccgcttcggacgtcggccatcctgccccgagcggcgttgcgccatccgcacgttcgccatgggcgtccgaaacgtccggctcagggaacggggaccccctcacggctacctcacgtgaaccggacccgcaacacgaggcacgacaacacggggaacgagcggcgccgcacacacaaaaccccgaccgctacggcggccggggtctgctcagtactggctgtcggtgctcacgaacccgtgggcacggagtcagtcgcctccgtccacagatcctgctcggcgcgatccgcctggatctggcggtacacgaggagcccgccgatggcggccagtgcgaccaggagaagcttcttcaccgcgcgacctcgtctttccttgacgtaggggacctctgccgcccgactatacacaccgaccgatatcgatcggtgacctccatgggccctcaactgtcaggtacgggaacgcagtagacgggcgccggtccgcttcgaccggacggtgatcgcacccgcacggacggtgacgttcgcccgtcctcctcccgcctccgcagcttttcgccgctcatgcgtccatccgagtggtgttcatccgaagatccccgcgccacgggcgtcggtccaccacttcgcggcgctcatacacatgatgagcaaagtacgcaaatcgcccaacccgaaagtgaggggacatggaccagcacaaggtcatgaagctgtggaccgccatcgtcaccgcattcctcgcgctctgcacggcgctcggactcgtcaccacgaccgccaccgcggccacggccgcgccgcagcccgagacggcgcccaagagcaccaccgcgagggtgccggcccagacgacagcctcctggcccaggtccaggtcccatgcccggtccctgccccccacgatgaaacagcggatccgcgcggaggcccacggaaagtccccgagctgccggcaccgcccgctggcagacgctccctcgctcgccaccgacccggagtgcgcccccgccgaaccaccggcccgccccagcatcccgctccagcgctgacagcgccgccccggcaccgccggggcccccatcagcacccatgacgtaacggcgaaccgcgtactgcaccaccgaaaggcaccaccgcaccgccgcatcacgcatcacgcatcagcccgcgagaccacacccacaccggaacacccgagtccccggtcggcctgcccgaccggggcacttcccatgtccgcgcggctggcgcgccaccggccccaggggtacgtcaccccgcctgggacctgcgcgtcttgtcggtcggcgtgcggccggccgtcgcgtagccatgccaacggcaagcgtcgcgaagcccggttcgccagtactgttcggcgagcatcggggtccagaacagcagcgattggcagaggacatgctgacggttgagaagttggaggccgcacttccggcgatgacacggtggcgtgtgcctggggggcgcagagtggactgggccgccctggaggcggccctcgggacggcgttgccttctgacttccgttccctgacggaggcgtacccggtgctggtcatcgatgatttcctcatggtgtcccttccgacgcccggcgccgaggggccatgggcgtcggagtccagggacgacgagatccttcaggacctgtacgagatgggcgacaccgaggactacgttccttggccgcgaccgggaggcctgatctcctgggcgtcgtccaattcgggggacaccttctactggagaacgcaccccgccgatccggacgcatggccggtggtcgtccgcacggacaacgccgagtggttcgagttcccggtcggtgccgtcgagttcctggccggcgtgtacgggcgcaccatcgatgtgccgggcatgcccaggaacttccccagcgactccccgcaggtgctgggcctgagcgaccgcattgactgatcagcggcctgtccaggcacggacagcatgtcaaagacccccagccgatatcgactgggggtcttcgtgctggtggggctaacaggatttgaacctgtggcctcatccttatcagggatgcgctctaaccaactgagctatagccccgccgcgctctgcggtgtgtgtcccgcgcgctgactcctgaagattagcgcacgaggggggcagtcccaaaatcggttgtcgcgaggccgtcggcggaggttcgggaccgcttgacggcctcccgggaccgcgggtgtcaccgcgcccgaggacgtcccgcaggacgcctcactcgtcctcggccagcgtcagctcgataccgccgacgaagcccgccgagaggttgtagatgaacgcgccgagggtcgccagtgccgtcgccaggacgacgtcgatgacggcgatgatcgtcgcgaacatcaggacgtgcgggagggacaggaaggactgcaggtcgaagccgttcgactcggtggatcctgtcgcctccgagatcgtcccgccgaccgtcgagaagacgcccatcgcgttcatgaccatccacagcacggcggacgccacgacggtgcagatgcccagggcgatggagagcaggaagctgaccttcatcaccgaccacggatcggccttggccacgcgcaggcgcgccttgcgggtgcgcgggacggtccgggcgcccgtgcgcggccggcgcaccgcaccggaccggtccgcggc

SEQ ID NO: 1187 - DNA, 727 bp, Unknown
  Kingdom: Bacteria, Phylum: Actinobacteria, Class: Actinobacteria, Order: Streptomycetales, Family: Streptomycetaceae, Genus: Streptomyces
  misc_feature (296)..(297): n is a, c, g, or t
cgccgtcgcggccgacaccggcagcgcggacacgtccgcccaggtgctcgccgacgccctcggagacgaacgcgtgctccacctcgcccggcgcaccggcttcggacaggccgtcgaagaggccgtccgcaccgccccgcacctcaccccggacgaactgccctacctcaagcgccccagcggctgggaccccgtcagccgcacctggcgcgacgacgcctacgacctgcccgacctcccgcacggagaaccggtgcagtggctctggctgctgcacgacgactgcgcccccgaanngcgacgacgtggcggtcgtcggccccaagctccgcggctggtacgaccgccgtcaactcctcgaagtcggcgtcagcatcgccaactccggccgccgctggaccggcctggaccgccgcgaacaggaccagggccagcacgaccacgtccggcccgtcctgtcggtctccaccgccggaatgctgatccgccgtgacatcttcgaacagctcggcggattcgaccgccggctgcccctgatgcgcgacgacgtcgacctgtgctggcgcgcccacacggccggccaccgcgtcctcgtcgcccccgacgccgtcgtacgccacgcagaggcggcctcccgcgagcgccgcaccgtcgactgcgtgggccgcaccgccgcctcgccgcacaaggtcgacaaggccggcgccgtctacaccctcctcgtcaa

SEQ ID NO: 1188 - DNA, 4062 bp, Unknown
  Kingdom: Bacteria, Phylum: Actinobacteria, Class: Actinobacteria, Order: Streptomycetales, Family: Streptomycetaceae, Genus: Streptomyces
gtggctacgcggcccagggggtgttgtcgtcgccggtgccatcgagcagccggtggagcagcgtcatgcggcccgccgtgtgcttggccgccccgtacgcctcgagcgcggcgccgagccggcgcacgactcgtcgaccagtgcgtcggtcaagccgacccgtcgccggtccgctcaccccggccccgtaccgtgcccgccctggcaaccgtgctgcccgcgcggctcgcccggcgaggtggccgtccagcgagccccggccgacgcatcggccgggcgacgacagtggcagcccggagctgaaggcttccgggcgcggcagcgaaccactgggccgctgtgtggcgttccggtgtccggcccgccagcacatgaccgtgtacggggaccacaggagctggggcttcgacctgctctacgagaaccgagttccagcacggcgccgttgacatcgcggcgcaaccgctcatctggccgagcctgctcttgccgctcgccgccccaggcagctgacggttggaccgtcccccacacgggcgccggtccggtgtccgcttcacacagcagactgcttcacgggcgccggtacctgactggcttcggcctacgccacagcgctcgtacacccgatgatggacggatgtccgaagcaaccagagggaccggtgccgccggaccggtcggggtgttatccaccaccagcgtcagccgacgggacaggttcgaatggtggtcgcacatgatcggcgacgcagtcgtacgagtatcaatgaccagcgaccatacggacgacttccgggggagagtcacagcactggagctgaccgccacccaggtgttggccgtcgccttctcgccgatgtctgcccaccgaaaggcgggccacatcagggaatcggactccgaagactacttcctcttcctggtccacggcagccccgtccggctggagcagcgccgcaactccgcactgctgcacgccggtgacgtcgcgctgttcgacagctcgcaccccctcgccgtcgacttccacggccacgggcggctgcccagggtgacattgatgcggctgccccgacggagcatgcccctgccgtacaacaagaccgatcaactgctgggaacccggcttccctcccggaccggggccggcgcgctgctgtgctccttcctgtccgacctgcgcacaaacgccgaccggtacagccgcgaggaactccgccggctaggtgccgtcggcgtcgacctcgccaccgccttcctcgccggacgacttgacaccccgcctccccttccggtcgagacccgccaccaggtactgctggctcgggtcaacgccttcatcgaccacaacctcgccgacccggacctgaccccgtccgcgatcgcggcccggcaccatatctccctgcgatcgctgcaccagctcttccagggcagcggtaggaccgtcgcggcgacaatccggcgcctacgcctggaacgatgccgcgacgaccttgccgaccctcggctgcgagcacagccgatccacctcatcgccgcgcgatggggcttcacccggccagcggacttcacccgcgctttcggcgcggcctacgggacgtgccccagtaactggcgcaaccgctgcttccaaaaaccctgatagtgaagcgccacgtcgcgctcagcggcaaggaaacccgcgcacctcgctaacgactgctcatacttccgtgcgccagcctgtcttccggtgaccccgagtggggccgccggggaatcggtctccctgtacctgcgcaccgtcccctcacgcagcaggcgccatagagccctgctacccaccaacacgggagtggaacatgagtagacgacgcaccatcgcgcgcggcgtcaccgccggcatctcggcagccctgctcggcctcggcttcgccagtcaggcgggggccgcgtcccagtacctgtgggtgtaccagtcctccggcctgtgcgtgtccgacctctcgggcatcaccaccgccaacggtggcaccgccaccagcgctacccgcggctggaacaacggctgttccaacaacttctacgccggcgccggcaccctgtccgtcaattcgatgccgctcgtctacgacttcggcacgcagacctggtacgagtgcttccagaccggctggctctacaaccggtccgctgcctacgacgtgtcggtcaccggcaccaacgtcaagctggcctgcggaggtgaccactggtacgcgaacaacaccggatcgtacgtgtgggacggctcggcgtggcgcggcggctggatcccttcgggtaacgaatggctcgcggccggtggcatcgccgccggcaagcctccggcggagcccaagatcagtgccgcggaggccgtccgcacggggaaggttcgcgtcggcagcccgaccggtccgaaggccaccgaagatcaggtgcagcccacgccggacaccaacgctcccggtgtccccatggccccgaagggcacggtcaccgtgaccacgaagtagggcactacctctccgagcccggtgaagtgggtcgtgatgccggcgttcagctgacgagacgcgagacgctgaacggtgtcggccactgttgggggggcagcgcgcccgggtcggggcgcgccggcccccctccggccctcctccggccgtaggcgtggcacttcgatcgcggtgcccatgccgatgccgaagtagcccgccggccatcgacgccgatctccggaagttcctgaaggcgtccagggtcgcccgtcactcgggcacggtgagctccgccaggcgggcgttgcaagggacgacgatcagcacaccgcccggagcccgtcgttcgccgacgtactgcctcaggtcatcccgaacggcatcaacgtcccagcgggcgccgttcagcagatgctgtagtccagcaggccgcggatgtagtcccgcaaccgccaccgcagggaaccggcccgccaccagcctcgcgctttcatgaagcgggctgtccgacaggtggtcaggtaagcgaaaaatgcctctgaccagcgacaacgaggattgctgaggtcatctgtcgttccagaagaaggtgccgaccatgggcagtccttcgaacggctggctggctgcgtggggcatcctgttcggagccggccggcgcctgccccagacagagcaactgcgcggacgaggcgcacaacgacaccagggcaccgacgatgcacagcgccagctctgacagacacacctcgcggcggccgtacacgtcgccgaacacgccggcggtgagaatcagggcggccaccgcaagtacgaaggcgtccgacacccaggacagttgcgccgtgtctgcccacagctcccgctgaagggcctaccgctgaaccattccccctgcggtcggtccccggcccggtcgccccgttcggcatcgtggctgccgcgcggccgccggggcccttactccaggaatggagtattccgcagatgtgcgatcacccgggacccgggcgggaatcctggcggcatcctggatgatttccccgcagggaaaccgccgtcggggtgttacttttccaggaattccgtatcgccaggagtcccgtgtcttccgaccgcccctacgccgctcacccccacctgcacggcgacctgctggtgttcaccgccgaccgcgaggtgtggggcgtcccggcggccgggggccgggcccggaagctgacctccgacggcgcccgggtgagccacccgcgtatctcgccggacggaagactgctcgcgtggacctcgtcccgcgacggcacgcccgaggcgtacgtcgtcccgctcgccggcggcacgccgcgcaggctgacccacttcggccacccccgtacccgggtcgcgggctggacccccgggggcgaggtgctcgtcctcactccgcagcacacccattcaccgctcgccacatgggcctggagcgtccctccggagggcggtccggcgcggcggctgccgtacgggccggtcggcgacctcgcgcacgggccgcacggcgaggtgctgctgcggagcg

SEQ ID NO: 1189 - DNA, 2541 bp, Unknown
  Kingdom: Bacteria, Phylum: Actinobacteria, Class: Actinobacteria, Order: Streptomycetales, Family: Streptomycetaceae, Genus: Streptomyces
  misc_feature (779)..(780): n is a, c, g, or t
gccgcccgtccatgagggtggaggggtgatcgaggatgacgctcttccgccgtggggactgcgatatccgtgtgacgggagtctcatgccgagggcagccgacgggcactgcgggcgctcgggagcgctcgaccgccgccctgacctgcggctccgtgcccgctgctgcgacgcgcagatgtcgtggcggcacagggtactgcatgatcagaaaaattggcgggcaggttgggaattctgtccggtttcaagtcgttgttcccatcggatgcggggcacccgaggagagtccccccagagagtgccgagcgtcctggaccacccgctgacacaccatcgcaagggagcacgcatggcaacccgtgccgtcgcccgtcgaaagtccgccaccggcgagacggccgacgcggcacgcagtgttcgcgcccacggcggcgagatcgccgaccgcgacctggtcggcatgtacctcgacgagatcgcgcgtacaccgctgctcgacgccgccaaggaggtcgagctgtcccaggtcatcgaagcgggtgtgttcgcgcggcagatcctcgacgggtacgaggagtccccggccgaggccactcgcgaggagctggaggccctggtcgccgacggggagcgggccaaggacgtcttcatccggtccaacctgcgcctggtcgtcgcggtcgcccgtcgctacccgcgcagcggcctgcccctgctggacctgatccaggagggcaacgccggtctggtgcgcgcggtggagaagttcgactacnngtggatccgccaggcgatcacgcgctcgatagcggaccagtcgcgcacgatccggctgcccgtccacctggtggaggagctgggccgcatccgtcgcgtccagcgcgagttcaaccgggagcacggccgcgacccggagcccgcggagatcgccgcggaactgggttcgacgccggagcgcgtcgcggacgtgctcgactgggcccgcgacccggtctcgctgaacatgtcggtggacgacgagggtgagacccagttcggcgacctgctggaggacacctccgcggtctcgcccgagcagtcggtgctgaccctgctgcgcagcgaggagctggacgatctgatcggccgcctcgaccagcgcacggcgtcgatcatcaagatgcggtacggcatcgaggacggccgcgagcgcacgctgaccgaggtcggcaaggagcacggcctgacgcgcgagcgcatccgccagatcgagaagcacgcgctgctggagctgaagaagctggcccgcgacacggggttcgacgccgcggcgtgacgccctggccggggcgccccgtccgggagtgcccccgggcgtggcgtgccggccgacacgcgtacgagctgttggcctacgtgcccactgagccacacccttccgggcccgggagttcgggcccggaacacgacgacacgagacgacgtgacacggcaggccgggcaccgcacggcaggtcggccgacgcacacagagccaggtcccgacgcactccccccggcgccgggaccttcccagagccgggcttcggcgccttcccccgggcgccggagcccggctccattcccgtcggcatgccggagaggcggggcaccccggacctgaaccccggggtgacccgccagatggcagattctgccacaccgacataatctgccggggtgacgagccccgcccccgccgaccgcaagtccctttcccggccccttgccaagcccctctccctgaccgagcgccgcaaggccgccacacgcatggagatcgccctggcggcggcccgtctcttcatgacccggggactgcgcgccacccgcgccgaggacatcgcccaggcggcgggcgtcgccccgcgcaccttctaccggtatttcgccacgaaggaagaggccgtggcgccctgctacgcggcgggcgccgagcggtggacggaggcggtccgcaccgcaccggcagaactcccggtgcccgtggccctggcccacgcggtgcggcacaccttcactcccggcgcgggcgtctcggtgatctcctggcagtgggcgcgcacgctcatccgcctggcgggaaccagccctgcggtgcgcaaggtctgggccgaggtctgccaggagtcggaacgcgacctggcccgcgtactcgaactccgtgcgacaccgcaagtccgcctcccggaagccgccctctcggcgcccgaggcccccgtctcaagcgccgaggcccccgtctctgcgcccgaagtccccctctcggcccccgaactccgcttctcggccgccgtggcgagcgccgccgtacgcgtggccgtggaggactgggccgccggggaggcgccggccaccggcccggacggcccggccgcactggccctgcgcaacctggcggccctgcgcgacttcccctggaccgtgaactcgcaccccagcatcgccagccggaccgcgagccactccacccggtcgccgaccgtggcgcggagccggcagccgccgtccggcaggggc

SEQ ID NO: 1190 - DNA, 1307 bp, Unknown
  Kingdom: Bacteria, Phylum: Actinobacteria, Class: Actinobacteria, Order: Streptomycetales, Family: Streptomycetaceae, Genus: Streptomyces
cgcgtcctcgccgccgccccggtcgcacggcgcccacgccccggcgacagccgctcccaccggactggcgcgataggaactcgaccgatgcttgagggtcgatttgctccccgaggacttgacactctccgtacaggaatccccaccgtgggcgaccattacagtcggcagggctttcgcgggagggcgtcacgacggttgatggaggtgggcatggcatcgcgcgtcgagcgaagggcgcccggacacagggcatgcgggcgccgacggcgcgcgcagggcggtccggccgatgtccccacccacagagctgactcccccaggtcgccgaatcccgtacccgactgcccgccgcggcactcgcgtgcgtgtcctgcgcgtcctcaccggatcccgaggagacccatgacctacgtcggcgtgcatcccgagatctccggaagagccctcttcctttccctggcgccacacccgcgtgaggtggtcttcgaccagctgacgccccgtctgttcgcttccctgatccgcagcgaccagcaccgcaaggctctctattacttacgcgggctgctggaggccgagggacgcaagtcgatccgcgccatcgccgcgctgttcgacgacgacgtctccgaacagaacctgcaccacttcgtgtcgtcctccacctggaactggatgccatgcggcgagcgctcgctgaccatatgacgggcgtgacgcacccccaggcctgggtgtcccggctcctgatcatccccaagtccggccatcattccgtgggcgtgggcaggcacttcttcccgtcactcggccaagtgctcaacgcacagcgcgccatcggtgtgtgggcggcgtccgaagaggtgacggtgccgtcaactggcggctgcagctgcccgggacctggctcaaggaccaccgccgccgcagccaggtcgcgataccccacggcgccggtccggagacgctgacggagtgcctcgccaaggtgtgcaccgagacgctcctcgactggaacctgcccccacgtccgctcgtcgtggacagcgacgaagtgcacgcggccacgctcttccgggagttcgcggacgcgggcatcccgttgctgggccgggcctgtgacggcctgggcctgaccgtcaccgacccactgctgccggccggcgagggtctgacgatgcccgcggaccagatcatggaggtgcccgggacctgcggcgtcccgccaacggggcagacgcgcgtgcggacaccgcccgccacacccacctggccgccaccgtccgcgtcgccctgccggccgc

SEQ ID NO: 1191 - DNA, 2592 bp, Unknown
  Kingdom: Bacteria, Phylum: Actinobacteria, Class: Actinobacteria, Order: Streptomycetales, Family: Streptomycetaceae, Genus: Streptomyces
gtgcgggggtcgccgaggcgggctagggcgtacgcggcggcggcgcagcgcggcgggtcgcggtggttgaggagcaggacgagcgattcgaaggcgcggcggtcacccgcggtccccagccggaaggcggccagttccctggcccacagcggccggcccgcggcggtgaggacaccggccagttcgtccaggtcctccgtcgccacgagctgccggaaatccgccgtcccgcccgactcctgccgtaaacgctccgtgagtgatcgcgactcttcgtccacgaaggccaccttagaggcgtggccggccgtgcgggagccacctcgcgaactcgcggggtctcgcctctggcgcggtcgttaccgacgggttaatctcagacgagcgagttaccgctcgcgctgactcgcagtggcctggtgacgcagccaccgcgagtgctgtcggtccggcacctcgggcacctccggtactccatgtaccgctggcacccctcataccgccggtaccgctgtacggcccggctcggggacagagccggtcggccggatcctccgccgcgcgggcgtgtgcgcgcccacggcgacggcaccgggcgtgtgcgcacgcagcccggcaacacccgcaccctcaccttccgcacccggtgcgccgaaggcgcaccgggccgcgctcccagtcgtcacccctcattcctggagtcccgcgatggccactcccctctccgacacctccgcgtccccgctgaagaccgtggccgtggtcggcctcggcaccatgggcaccggcatcaccgaagtcctggcccgcgccggccgcgaggtcgtcggcatcgacatcagcgaggcggcgaccggccgggccgtcgccgccctggagacctcgaccgcccgcgcggtggcacgcggacgcctgaccgagcaggagcgcgcggacgtcctcgcccgcgtgcgcacctcggccgacctgaccgccgcggccgacgccgacctggtcatcgaggtggctccggagtcgtacgagatcaagcaccagatcttccgcgaactggacggcatcgtgcggccgcggacgatcctggcgaccggcaccaacgcgctgtcggtgacccggctggccgccgactcggcccaccccgagcgcgtcctcggcctgcacttcttcaacccggccccggccatgaagctggtcgagatcgtctcctcggtgctgaccgcgccgcaggccgtcgccgccgtcaccgacctcgcggccgaactgggcaaggagccggtcgcggtcggcgaccggcccgggttcgtcgcggacggactgctgttcggctacctcaaccaggccgccgcgatgtacgaggccaagtacgcctcccgggaggacatcgacgccgcgatgcggctcggctgcgggctcccgatgggcccgctggcgctgctcgacctgatcggcgtcgacaccgcccggacggtcctcgaggccatgtacgccgagtcccgcgaccggctgcacgctcccgcgccgatcctcaagcagctcagcgaggcgggtctgaccggccgcaaggcgggccgcggcttctacacctacggctcggcgggcagcggcacggtggtgcgggacgcgctcaccccgctggacggcgacgcgctcagccccggccggtccgtccgcagtgtcggggtggccggctcgggcaccatggcctccggcatcgcggaggtcttcgccaaggccggctacgaggtcgtgctcgccgcgcgcagcaccgagaaggcgcaggccgccaaggcccgtatcggcaagtcgctttcgcgttctgtcgacaagggccggctgtccgccgaggccgccgcgctgaccctcgaccggatcaccgccaccagcacgtacgacgacttcgccgacgtcgacctggccgtggaggcggtcgccgaggacctggccgtcaagcagcagctgttcggcacgctggacaaggtctgcaagccgggcgcggtgctggccaccaccacctcctcgctgcccgtggtcgcctgcgcccgcgccacctcgcgcccgcaggacgtgatcggcatgcacttcttcaacccggcgccggccatgaagctcgtcgaggtggtgcggacggtgctgacggcggacgacgtccacgccaccgtccgcgaggtgtgcgccaccatcaggaagcacccggtggactgcggggaccgggccggcttcatcgtcaacgcgctgctgttcccctacctcaacaacgcgatcaagatggtccaggagcactacgcctccctcgacgacatcgacgcggcgatgaagctgggcggcggctacccgatgggccccttcgaactgctggacgtcgtcggcctggacgtctcgctggccatcgagaaggtcctgcaccgcgagttccgcgacccgggcctggccccggcgcccctcctggagcacctggtggccgcgggctgcctcggccgcaagacgggccgcggcttccgcgaatatgcccggcgctgaccgggcgggcggccggacgggcggccggaccggcgactcatctgagggccgggcagacgcccgcgcggccgggtcacc

SEQ ID NO: 1192 - DNA, 1309 bp, Unknown
  Kingdom: Bacteria, Phylum: Actinobacteria, Class: Actinobacteria, Order: Streptomycetales, Family: Streptomycetaceae, Genus: Streptomyces
gccgcgttgcggtgcagcgtgccgacctggtcgatgagccggccgagcaggtcggcgggcaggtcgccgtcgccgcgcgccgccgcgagcacggcctgtacgagccggtgcgcgccggcctcgtggcgccacacgatggcgcccaccccgcactcgatcacgtcgagcagttcggcctcgcgcagcgagctgacgacgagcacggcccgcgcgccctcgctgcgcaccacccggcgcagccgggtcagcgcggcctcgtcgagcgtgtcgtccacgagcagtgccaccgtgccgggacccgagccgctctcctcccgcaactcgacctcggggaaccggcgcagctggctcagcaccccctcgcgcaggatcgggtccgtggcgtgcaccgcgaccgggatgcggtcggcggaaccggcggtgccggggtgcgtggtccgcgatgagctgagcaacggtttcccctatgtccacgtgcccgtcacctctgtgggggcggtggcaggcgtgtgcacaccacactcgtgtggtggcgggtgcccgcgcaatcgtggagcaccacgaaccggaccacgagaacaggcctgcgtacaccacgagggtgaccgctcgggcggttccctctgcccggccgtcgggtgcagtgggacttgtcacgtcaccggcggccggtgggggacgtcctcgtgtgcggagggcgtgacgtccgagcaaggaggcagggatggcagggacggcagggacgccgggaccgcaacgggaacacccgtgcgagcagttgcgtacgcgtccgtacgaccatccgtccgggcgcgcggtcggtcaggtgcccgtccagccgtccggtcacccgacggaccgcgtgcctgaccacgtagctgaccacgtacctgaccatccgtccggccgcctgacggaccgcgtgcccgaacagccccccgcccggttgcccgaccgcacacgggcgcgaacctccgagccgccgtccaccgggccctccgccccctccccggcatggccttccgggccggccgcggcttgtccctcggggccggccgcggtcaggtcctccggctcctccccggtccagcttcccggctcctccggggcccggctgcctgaccagatgtccgaccggctggccgacccctccgcggtgcggtcctccagcccctccgaggcccggctgcccgaccggccttccgaccacggcccgtccgaccaccggccctccgaccaccggccctccgaccaccgatcggcccggctgcccgacccgccggccggtcagccgggccgatcggtggtc

SEQ ID NO: 1193 - DNA, 1929 bp, Unknown
  Kingdom: Bacteria, Phylum: Actinobacteria, Class: Actinobacteria, Order: Streptomycetales, Family: Streptomycetaceae, Genus: Streptomyces
  misc_feature (340)..(379): n is a, c, g, or t
ggccgccgcccggctcggcggcctggtccgcgaacagcggctcgcggtcctggaccccggccgcacgcaggactggccggtcgcccctggctacgccccgggagagcaccacttcccgcacgatttcgcgaagacacccgactccctcgcgcgcgcgtggttcaccgacgaggagatggcccgctcgctcgactccctcgccgcccggcagcaggaggacggcggctggccggtcacctggcgccagtggactcccggggccgtcctggaggcgcggtccatggtgacgatcgaggccctgcgcatcttgcgggcctacggtcgtgccatcggctgaggnnnnnnnnnnnnnnnnnnnnnnnnnnnnnnnnnnnnnnnngggacctcctcagccgatggcccgtaccccggcggtcaccaccacggccgccgcgacgatgaccaggaagggcgcccgcaggaccagcgccacggcggcggcagccaggcccgccgccctggcgtccaggacgaggacccgtccgtcggagaacgtctgctgcgcggtgagggcggcgagcagggcgacggggagcagcgcggccagccgccgcaccaggggcctctccagggctcccgccgggacgagcagtccggcgagtttgacggcgtagcagccgagtgcggtcacgacgaccgcggtccaggtgttcaacgctcttccttcggtccgtcgtggcgcgctcgcacgtcatcctgtggtggtacgtcgttatgcgggctcacgtcgttgccatgtgggcttacttcgtcctgtgttcctacggcgtcctgtggacgtacggcgtcctgggcgccgctcctgcggcggccgtcgaggtacagcacggcaggcgcggcgagggcggccaccaggaccggcacgccggccggcaggacgggcagcaggccgagcccgaggaggaccgcaagtgcggcgaccgccctctcggtggccgtcttcagcatgggcgcgagcagtgccaggaacacggcgggtccggccgcgtccagaccccacgcgccggtgtccccgatggcctgggcacccagggcgcccagcagtgtggtgaggttccacaggacgtagagggtgagcccggtgaccgtgaagccgatccgggcactgcgccgcgtgggctgtgcgagagccacggcggtggtctcgtcgatgacccactgggcggcgaggggccgcgtcccgcgcgggagggccagcagctgggagagcctgagcccgtagaacgcgttgcgcacgccgaggaagaaggcgcccgctgccgcggtgagcggattgccgccggccgccagcgcccccacgagggcgaactgggaggcgccggtgaacaccaggaggctgagcgcacaggtctggagcagggtgagtccgctgcccgccgaggtcaccccgaaggcgaacccggacagtcctacggcgaccccgaccccgagggcgtcgcggacgacggcggcgtccggtttccctccgtcggccccgcctgcgccgaccgctcctgggcgaccggcgcgtatgtctgcgcaagctgtcttttctgccacacgcctgacggtaggagcagccgcgaccgcgcgtcttgtacgttcttgcgctcccgctggtaggcgcccggcgggacgccgacgatccgggagaagtgcctgctgaggtgcgactggtcggtgaagccgacggtcgcggcgacggcggccggtgcggtgcccgcgtccagcagccgcagtgcccggcgcacccgggcgtcggtcagccaggtgtgcggcggcatgccgtaggcgtcccggaaggcccgcagcagggcgaacgggctcgcgcccagctccgtcgccaggccctccagggtcggcgggtcggccatccgctcctccagcacggcacgcgcgcgtgccgtgctg

SEQ ID NO: 1194 - DNA, 7019 bp, Unknown
  Kingdom: Bacteria, Phylum: Actinobacteria, Class: Actinobacteria, Order: Streptomycetales, Family: Streptomycetaceae, Genus: Streptomyces
tctaccagggcgaggaactgggcctgcccgaggtcgtcgacctgcccgacgaggtgcgccaggacccggcgttcttccgcagctcgggccaggacggcacccgcgacggctgccgggtgcccctgccgtggtccgggcagctcccgccgttcggtttcggtcccgtcgagggcggcccgagctggctgccgcagcccgccgactggcgcgagctgaccgtcgaggcgcaggagggcgaccccaactccacgctggagttctaccgcagcgcgctcgccgtccgccgcgaacaccccgcgctgggcgccggccgccagatcacctggctggacagccccgagggcgtgctggtcttccgccgcgacaccgacgagggctccttcgtctgcacggtcaacctgaccgcctcaccggtcaccgtggccacacccggcacactgctgctggccagctccgacgtcgagcccggcaccggatcgacgcggcttcccgcggactgcgccgtctggtgggcagtctgacatgcaaccggtacagtccactcctgtgaccacacggcttgccgacatcgctgcgcaggcgggggtgagcgaagcgaccgtcagccgcgtcctgaacgggaagccgggcgtcgccgccaccacccgccagtccgtgctcgccgcgctcgacgtcctcggctacgaacgtccggtgcggctgcgccagcgcagcgagggcctggtgggcctgatcaccccggagctggagaatcccatcttcccggcgctcgcccaggtcatcgggcaggcgctgacccggcagggctacacgccggtgctcgccacccagaccccgggcggctccacggaggacgagctgaccgagatgctggtggaccgcggggtcgcgggcatcatctacgtctccgggctgcacgcggacaccaccgccgacatggagcgctacgagcggctgcgcgcccagggtgtgccgttcgtcctggtcgacggcttctcgccgaaggtgcaggcgccgttcatctcccccgacgaccgggcggcgatgacgctcgccgtcacccacctcgtctcgctgggccacaaccggatcgggctggccctcgggccgaagcggttcgtgccggtgcagcgcaagatagagggcttcgtgcgcgcgatgcaggaccagctcgggctggcgccggacgccgtggagacggagctggtccagcactccctgtacacgctggagggcggtcaggccgcggcgacggcgctgatcgggcgggactgcaccgcgatcgtgtgcgccagcgacatgatggcgctcggtgccatccgcgcggcccggcagcagggcctcgcggtgccgcgggacttctccgtcgtcggcttcgacgactccccgctgatcgccttcaccgacccgccgctgaccacggtccgcaagccggtcccggcgatgggccaggcggcggtgcgcacgctgctggaggagatcggcgggacgcccgcgccgcacagcgagttcgtgttcatgccggagctggtggtgcgcggctcgacggcgtcggccccgaagccccgctcctgacccgggcgcgccgcagggcgcggggaacatccaggcgggacccggccgggggatcttcggcggaagatggcttttctggcagactctgtgcctatgggcgacacgaccgtgactcgaccggaaggtcccgaagagacccttccgtaccccgtcacggacgacggacgcgcctgcccggaccgtcggccgcgcatcccgcgccggccacgcctctggttcgagatcctgctgatcgcggtgagttactggacgtactcactgatccgcaacgcggtcccggagcagagggcggctgccctgcgcaacgccggctgggtctggcacaccgagcaccgcctgggcatcgccgtcgaacaggcggtcaaccaggcggcggactcggtgacttggctgatcgtcggcatgaactactactacgccaccctgcacttcgtgatcaccgtgggcgtcctggtgtggctctaccgcgtgcaccccggccggtacgcggcggcccgcctcgccctgttcgcgaccacgggcgtggcgctgctcggctactacctgtatccgctggcgccgccgcggctgatggcgggcggccacttcgtggacaccgtccaggtccaccacacctggggctccatggcctcgggcgacctcaagcacatgtccaaccagtacgccgcgatgccgtccatgcacatcggctggtccctgtggtgcgggctgacgatcctcgcgctgaccagggtcccgtgggtgcgggtcctggccgccctctacccggcggccaccctggtcgtcatcgtcgccaccgccaaccacttctggctggacgcggtcggcggcgtggcctgcctcgccgtcggcttcacggtcgcacgggcctggtacggggcgctgccgcacgccctgccgagagcggcctggcgggcggcgcgggcacaggcgtaggtcccctgcccccctctcgcagaacggctcacatctcgtagaacagtgtctccatcacgccgcgggcccggcgtgcggtgcgccggtaggcgtcgagcatgtcgccgacgtgaccgggtccgtagccgaggtagcggcccacggcggccagctcccgtgactcggtggggaacgtgtcgccggcccggccgcgcaccagcatcaccgcgttgcgcacccgggtggccagcacccaggcctcgtccaggacgacggcgtcctcctcggtgaccagaccggctgcctgcgccgccgcgagcgcctgccgggtgcgtgtcgtgcgcagttcgggatgttcggcgccgtgccgcatctgcagcagttgcacggtccactcgacgtcggagagaccgccgggcccgagcttggtgtgcagcttcgggtcggcgccgcgcggcagccgctcggactccatacgggccttcagccgccggatctcgcgcaccgcgtcctcgccgaggccgccgcgcgggtagcgcagcggatcgaccagctcggtgaaccgccgtcccagctcctcgtccccggccaccggctcggcgcgcagcagcgcctgcgactcccacaccagtgaccagcgccggtagtacgcctcgtacgccttcagggtgcgcaccagcggaccggacttgccctcggggcgcaggtcggcgtcgatgaggacgacgccccaggaggcgtcctcgaagagggcctcgctcagtgcgatggaccgttcgaggtcgatctgcgcgtggacctcgctgaaggcgcagtacaggcccgcgggcgtgccgtcgggtccgcggacggcggcggactgggtgcgtacgaggacgcggccgccgtccttggtgagcagggcgaactcgtggacctggcgtccgggggcgtgcatggcggccatgaggcgccgttcgacctcctcggcgtccgcgctgcgcaccgcccagccggcgaagccgtgccgtccgacggcttcggcggcgctccagccgaggatgcgttcggcttcacggttccagtgggtgacgacgccgtcggcgtcgaaggcgcacagggcggcgtccatgccgtcgagcagggctgcgagcaggtcggagccgtcgggcccgccggggccgtcctgtcccatgggaccgtcccggggtggctcgggctcgtccggccccagctcgtcggtggttcctctacgccgggaagcactcacctggaccccctgcaggctgcgtccgcacgtacggcgcgtcggttcgctcactgaccatcattcaacttgaacgtgatgcagcacacatcgagttccccaagattggcaccatcgcgaggaatcgttgtgcgcggttcccggctacggcaccggcaccggcgtcagccgcagggtcagccattcgtcgctctcgccgggcagtacgtaccgttcggtctcggtgaagccgtgggcggcggcgaagcgcacgccgtcgtcgttggcggccaggacgacggtctcgatgctccgggcgccgagcacgcgcgcgtgtgccaggccgttctcgtacagcgcggtgccgatgccggtgtgccggtggcccgggagcacgcgcgcgatgacggtggcggtcgcgtcctcgccctcgggcgggcgcacggtggagcagccgacgagggtgtcgccgaggtaggcgttgtccaggcggtagcggccggcccgctcgcgtacctcgtcgagcgtcatcgcggcgggcggcacgatcacgttgtgcacgtggcgccagtcgcggagcatggcttcaccggacacgggtgcgatacggagatcagcttcagacacgggggcagcgaaccgtacgtcccgcgcggggtcaaccgcgttccgcgcgggaggcacgatcagcgccgcccgggggcacgatcagcgccgcccgggggcacgatcagcgcgtggtcagcggcggtagaagatccggtccgcgtagctctcgaagatccggccgttccattcgtggccgccgtcgacgttcccggagcgcagcagcgggggttcgatgccgcggtcggcgaggacgccggcggcggtggcgacgaccgcctggaggagcgcggaggtgacgacggtggaggccggggcgaagggcgccgggacggtgtccagcgtgagttcggcgtccccgacggcgatcttggagtcgaggacgaggtcgcagtggtccttcaggaaggttcccgaggtgtgccgggaggtggtctgagtggcgtaggcgaccgaggtgacgccgatgacgcggaccccgagcgcgcgtgcgtgcagggccatctcgacggggagggcgttgcggccggacagggagacgatcaccagggcgtcgccttcgcgcagcggggaggtgtcgaggacggcggcggcgaggccgtcgacgcgttcgagcgcggagccgagggtggcgggtacgacgtcgacgccgacggcgccggggacggcgaggaggttcaccagggcgaggccgccggcgcggtagacgaggtcctgggcggcgagggacgagtgaccggcgccgaaggcgaacaggcgtccgcctgcggccacggtgtcggcgagcagggtgccggcggccgtgatggcgtcggcctcttcgtcgcggacccgctggaggaggccgatggcggcgtcgaagtactggccggccagcgtgcggtcgctcatgcgaggtccgtcccttcggggtggctgcgtgtcgcggatcacggtgaggtctgaaccacaaccgtgtcaatacggcacccgccgcccggccgcccaggtgcgggcgctcaggggctcagccgttccacccgccatccgccgtccgcctcggcgacgtagcgcaggcggtcgtggaggcggttctcgcgcccctgccagaactcgacggactgcggggcgacgcggaagccgccccagtggggcggtacgggcacctgttcgccctccgggtagcgggcggcgagttcggtgtaggaggcgtcgaggacgctccgggtggcgatcaccgtggactgggcgctggcccaggcgccgagctgggagccgtgcgggcggctgcggaagtaggcggcggtctcgtcgcggccggtgcggcgggcgatgccctggacgatgacctggcgggccatggggtgccaggggaacagcagggagacgtacgggttctccgcgaggtcgcgggccttgcgggagtcgtagttggtgtagaagacgaagccctgttcgtcgaagcccttgagcaggaccgtccgggagctgggacggccgtcggcgtccgcggtggagacgatcatggcgttgggctcgaacaggtggccttcggctgccgcctgccggaaccagcgggcgaactgtgccacgggcgtgtcggccaggccggcctcggacagcccctcggcgcggtagtgcatgcgcatggcggcgaggtcgaacggtgcggtttctccggcttctcggtcggtcacgcggtcatcttgccgtacgggcgaccggcgtccgcgaagtgtccttcgtcactgagtggcactgagtgccgcgcactctccccaaaggtggcactcagggatatcgtgctgttgccgacccggtggggtgaccgcggaccgcacggggcatgacagggatgtccgccccggaccgcgagtcatcgccacgcgaccgcggatccgtacggcgccccacttccgacctccgacacctggtcgtcgtctccgtcgcaccatctgtcgcacagaccacgaggagccgcctgatgtccgacttcgtacccggactcgagggagtcgtcgcgttcgagacggagatcgccgaacccgacaaggagggcggcgccctgcggtaccggggcgtcgacatcgaggacctcgtcggccacgtctccttcggccacgtgtggggcctcctcgtcgacggcgccttcaaccccggtctgccgcccgccgaaccgttccccatcccggtgcactcgggtgacatccgggtggacgtccagtcggcgctggccatgctcgcgccggtgtggggactgaaaccgctgctggacatcgacgccgagcaggcccgcgaggacctggcgcgcgccgccgtcatggcgctgtcctacgtcgcccagtcggcgcgcgggcagggcctgccgatggtgccgcagagcgagatcgacaaggcgacctccatcaccgagcgcttcatgatccgctggcggggcgagcccgacccgcggcacgtggcggccgtggacgcctactggtcctccgccgccgagcacggcatgaacgcctccacgttcaccgcccgcgtcatcgcctccaccggcgccgacgtggccgccgccctgtcgggcgcggtgggcgcgatgtccggcccgctgcacggcggcgccccgtcccgggtcctcggcatgatcgaggagatcgagcggaccggcgacgcggccgggtacgtcaagcgcacgctggaccgcggcgagcgcctgatgggcttcggccac

SEQ ID NO: 1195 - DNA, 4714 bp, Unknown
  Kingdom: Bacteria, Phylum: Actinobacteria, Class: Actinobacteria, Order: Streptomycetales, Family: Streptomycetaceae, Genus: Streptomyces
gcggtcctcagagcccgcgacggacaccgcgggctctgaggaccgcccgggagccgacggccgtaccgacgcccgccgcgccgcctcggcccgccggtcccgcgagcgcggccgcactccgctcttcgaccagtacgaggacggcgaccggccgcgcgcggccaacgagtagcgcgcgaacccgggcgccccgcccgtgcggaccgccccgggagccgtgccgggcccgcgtcgctgaccagcccgggaacggatttccaaccacccggatggggatgctagagtttcactcgttgcaagggcctgtggcgcagtccggtagcgcacctcgttcgcatcgagggggccaggggttcaaatcccctcaggtccacgcagcggtccgttcacgactcagctcgtgaagggtccacgagatcccgtccaactcgacgagttgggcgggatctttcgtttccgggtcggacgtacgggtgctgagccgcagccccgggcacggcacatggttcacgactcggcagcgctccgccgctccccgcggtcaaggcttctccgctgcctcttctcggaccccccatagaatcggcgacctgagctgaccgagcggaccctggaacgcgccggcgccgcccgtgggcagttgctctgcaagcccacgggcgcctatggcggcaaggacatgaccctatggcttcccgctggacggcaccgcctggcgcgcgctcctcacgcagtacttgtgagagctggccgagcgctacgtcctgcagtaccgggtgccgccggccgtcgtggatttgccgggcgtgagcccgccggcccgcgaggtcgtgctggcgcccctcgtgttcggcggccgtttcgccggcacgttcttgcgccaggcgccgcccgggcaggagtcggtgatcaacgcgtcgagcggcgcggggtccgccggtgtggtgagcgtctccgcggagccgctacggccgcagccgcttcgcgtagcacaggctcgactcgtactcgcggtagtagccgaacttggcgcacagctcgtagccgctggaggtgtacagggcgatggcctcgggctgctggtcgccggtctccaggaccatgcggacgcggccggcggcgcgggcgtcgtcctccagggcggcgaggatgcggcgggccaggccccggccgcgcatcgactcgatgacgaacatccgcttcagctcggcgtcgccgtcctcgttgccctcggcgttctcgtcctggctgcgccagccgcccgtggcgaccggcgtgccgtcctcgtcgtaggcgatgaggtacacgccgttcggcgggcggaagtcggccgggtccaggtgggtggcgtcgccgccgtcgccgtagcgcacgtggtactcggcctggacctcgtcgttcagcttgacggcgtccgggtggtcgaaggcgacaggacggataatcatgttggctaccgtatatcgatgcgggacagggggtgggtggactctggcgaggccccgtccagtgtgccggtaaagtgcccgcgtgctgactgtgacctccgccaacgtcaatggactgcgtgccgccgcgaagaagggcttcgtggagtggctcgccgggacctccgccgacgtgctctgcctccaggaggtgcgggccgagccgcagcagctgcccgagcacgtgcgcgcgcccgagggctggcacgtgacgcacgctcccgccgccgccaagggccgcgccggagtctctctctacacccgccgcgagccggacgccgtccgcgtcggcttcggctcgaccgagttcgacggcagcggacgctacgtcgaggccgacctgccgggcgtgaccgtcgcctccctctacctcccgtccggcgaggtcggcaccgagcggcaggacgagaagatccgcttcatgggcgagttcctcgcccatctgaaggagctgcgcgagcgggccgccgccgacggccgcgaggtcctcgtctgcggcgactggaacatcgcccaccagcaggccgacctcaagaactggcgcgccaaccagaagagctccgggttcctgccgcaggagcgggagtggctgagccgggtcctcgacccggtggacggcggctacgtcgacgtcgtgcgcgcactgcacccggacgtgacggggccgtacagctggtggtcgtaccgggggcgggccttcgacaacgacgcgggctggcgcatcgactaccacgtggccacggccgggctcgcggaccgggccgtcaaggggttcgtggagcgggccgccacgcacggcgagcggtggtcggaccatgcgccggtgacggtcgtctacgacctctagggcaggtcctgggccgcgcgtcggcacgcctttacggctccttgcgcaaccgccggtccagtgccatcgacagttccgcgtccaccacgctcttcgccagcgggcgcaggcggtggaggtcttcctcgggggcgtggcgggtgatcaggtcggtgaacagggcggccagcgcctcggcgtgctgccggacgcggtggccggcgtcgaggacctcggcgagcgggatgccctcacggaccagggcggcggagacgtccagcaggcggcggctgatgtggacgatgtcgtcgccgtcggtgccgaggtagccgaggtccatcgcggcggccaggttctcggcggtgacctcgcccgcgaagtggtcggcgagttcctccggggtgaggcggaccggggtctcctcgctgggggcgcctacgccgagcaggtcgccgacgtcgcggccgtggtcgaaggcctcggcgagttcggcgatgccgctgagcgtgtggccgcgctccaggagggccgagatggtgcgcaggcgggagaggtggtggtcgtcgtaccaggcgatgcggccctcgcggcggggcggcggtatcagcttgcgctcgcggtagaagcgcagggtgcgcacggtgatgccggccagccgggccagctccgccatgcggtactcgcgcgggccgccgccctgtccgtcccgtcgtccagcgtcttctgccacaccggaagcctatgttgtaccgccggtaactttcgtcggcgtacccctaccgatcggtacgtctctcctttacgctcccgactgtgccagtgttcactggcggaattgctggcgagtcatggactggcgagtcatggaggggcgctcaatggccgagcacgagcatgagcaggagtacgagcccgagcacgagtacgagcacgtacgggtggcggtgatcgggtccgggttcggcggactgggcgccgcggtgcgactgcgccgggaggggatcaccgacttcgtcgtgctggagcgggcggacagtgtcggcggcacctggcgcgacaacagctaccccgggtgcgcctgtgacgtgccctcccacctctactccttctccttcgcgcccaacccgcagtggccgcgcaccttctccgggcagcggcacatccgcgcctacctggagcacgtcgccgacaccttcggcctccgcccgcacctgcgcttcgactccgaggtcaagaaggcggcctggaacaccgagcggctgtgctgggacatcgagaccagcagcggcagcctccgcgccgacgtcgtggtctccgcgaccggcccgctgtccgaccccaagatccccgacatcccgggcctggacaccttccccggcaaggtcttccactccgcccgctgggaccacgactacgacctcgccggcaagcgggtcgccatgatcggcaccggcgcctccgccatccagatcgtgccgtccatccagcccgaggtgggccgcctcaccctcttccagcgcaccccgccctgggtgatgccccgtgtcgaccgcgccatcagcggcctggagcgctcactgcaccgggcggtgcccgccaccacccagctgcgccgcggcctgctgtggggcatccgcgaactccaggtgcaggccttcaccaaacggcccgacgaactcggcttcgtggagcagatcgccaagcgcaacatggcccgcgccatcaaggacccggcgctgcgcgccacactcacccccgactaccgcatcggctgcaagcggatcctgctgtccagcacgtactacccggcgctcgcgcaggacaacgtggacgtggtggccgccggcctgagcgaggtccgcggctccaccctggtcgccgccgacggcaccgaggccgaggccgacgcgatcatcttcggcaccggtttccacgtcaccgacatgccgatcgccgagcgcgtcgtcggcgcggacggccgcaccctcgccgagacctggaaggacggcatggccgcgctgcgcggcgccaccgccgccgggttcccgaactggatgacgatcatcggccccaacaccggcctcggcaactcctcgatgatcctcatgatcgagtcccagctgaactacatggccgactacctgcgccagctggacgtcctgggggtccccccaggccctcaaggcactgggggaggcagggccgccctggacgcccggcagagcgccgtgaacgcctggaaccgcacggtgcaggaacgcatgaagcgcaccgtgtggaacaccggcggctgcaccagctggtacctggacgccagcggccgcaacaccaccgtatggccgggcacgaccaccgagttccggcgcgccacgcggcgcgtggacctcgcggagtacgaggt

SEQ ID NO: 1196 - DNA, 3278 bp, Unknown
  Kingdom: Bacteria, Phylum: Actinobacteria, Class: Actinobacteria, Order: Streptomycetales, Family: Streptomycetaceae, Genus: Streptomyces
ctcggaggaccgctcggccgggccatcgggccccgcccacaggcacggtgccccgagcacgggcccgcccgacgcctgccgtccggccagtgcctgccgttcacaacaggccctggcctgccttctccccaagcccccgagcggtcggccgctcgcgcccccatgctgccagcggctcgagtgcgtcgttgaggcgcttgccgtcctcggtcagcgagtactcgacgcggggcggcacctcgtcgtaggagacgcggcgcacgacgccatccgcttccagctcccgcaggtgagaggccagcaccttctcggtgatccccggaagcagccgacgcagctcgccgaagcggcggcaggggtgttcgtggagcgcccagagaatcagcaccttccacttgccgccgatcacctccatcgcggtgtcgatcccgcagacgtgtccgtccggtgtccccggccggttcagcgtcgtcatgccccacccttccgacgtgctcgctctccccggggtaaccacccactgccaagtacgtacttgatcacctccggacctgcggccagcctaatcggcatgacacagaacatcgtcgagaagactcccgtgacgttgctgggcctcggcgcgatgggcaccgcgctggcccgcacctggcttgccgccggccacccactcaccgtctggaaccgcaccccggcccgcgccacggcactcgccgccgagggtgcacgggtcgcggacaccgccgccgaggcggtcgcagcgaaccccctgatcgtcgtctgtcttctggacgatgcctcggtcgagcacgtgctggccggcaccgacctggccgacagggacctggtcaacctgaccaccagcacccctgcgcaggcccgcgcccgcgccgaatgggcccgcgagcgcggtgcccgctacctggacggcggaatcatggccgttcctccgatgatcggcgtcccggaagccggtggctacgtcttctacagcggctcccgggagctgttcgagcggcaccagcagaccctggtcgtccccgtcggcaccacctacgtcggcgaggacgcgggcttcgcggccctgcacgacgtggccctgctcagcgccatgtacgggatgttcgccggggccgcgcacgccttcgccctgatccgcaaggaggacatcgaccccgcgtcgctcgccccgctgctggccgactggctcgtcgcgatggccccggcggtccaccagaccgccgcccagctgcggagcggcgactacaccaagggcgtcgtctccaacctcgccatgcaggtggccggcacgccgtccttcctgagcacggccgagcagcagggcgtcagcccggaactgctcagcccctacttcgagctgatgcgccgccgcctggccgagggcagcggcgaggaggatctgacgggcgtcatcgacctgctggtgcgctgaccagccgttcacccccacagaagccacggtgtccggtccgcggaggccgacgccctctgcgacgccgagtacggacagggcagcggcggacaggtcagcggcggacgagtcggccaccgcgacggataccgcccgagcgagcgggagggcgtcggcgaacgtcctgatcaccgcgcgcagcagaccgggacccgccgcggcggggccgtctcggcgagggcgtgccgggacggacccgatgccggagcgatcctccggatcaggtcggagccgtacaccactcctcaggacgcgacgggtccggccaccggactcctcaggacgcgaccggtccgcccaccggccgcaggccgtgtcgccgtcgggcccggttgtacaggcccagggagaagcgggccagggtgtcgtagtcctgctcgatggtctccggggtcgactgggcggcggcgtacgggcgaacctccagtcgtgtcaccgggggctcgatgcgcggcgcgccctgcgcggagttggtgtccagggcgcggtagttggtgcgcacggccaggccgtcgtgctggtcgatcacccgctcgggatcggcgttcagcaggttgtccaggtaatgaccggtcgtcgccccgctctgccggccccgccacaggagcagacccagtggatcggacaccgcctgcgggacatgggcgcggaaggtggcggcgaactcgtccgccaggtgctccgcgtggctctccaggaacgcgcgcggcaccgggccgagcgcggcgcgcaccgcggccagtgactcccgcgaggtcacacccgagtagtccttgggcagcggcccgccgaacagcctcccgcgcccggcggcggcgacctgggtgtagccgagcgcgagcgccccctcgagttcatcggtgtccgcgggacgggcctgcgcggcccatcgggggtgctgttccagccaccgtaggaactgctcccgcccggcggcggcgtactgggccgccgcgccgaggtccagccgggccatctggaccggcgcgacgtcctggcgcatgtgctcggccacgtgcgccaggaacggcaccacaccactgagcggggtggtcgccgtgtggtgcaccagcatgatgccgtgacccgcctcgtgggtccgcaccggcagttcctcggccaggggatcgacccggtagccggcctgcggcgggaagatccgggagagcgtggccccctggggcgccgaccgcagtcgccgcagcacgtcgtggaacgcggcgaccacgtcggcacgttccgcgcgcccgtcgtcccggccgccctccaggccgcgtgcgggtgcggtgaccacctccagcacgggcacgccgcccaccgcgtccagggtgagggtgagcaggcccggcagttccaccagatcgccgtactcctcgtggttgtccccggccggcagcaccacgcggaactggtgcagttcggcctcgaagccgctggccggggcgaagccctccacccggggcgcacgcggcgcggagacaagcggcggccgctgcctcgcggtccgccagccggtcgagcacggcgttctccagccgcgccacggccgcccagcggctgctgctcccgtccttgccctgccgccaggtgcgcacggcgttcaggaccgaccgcagatcccgcggctgcgggtcccgcggcagccgggccaccgcttcgtcgatggcgcgcagcgcgcccgagcgccgctgtccgggtacggaggacatccgctcccagtcgcggacggggtcggtcgtctcgcgcgggtccgggcggtcagggggtacgggcccggcgcccgggc

SEQ ID NO: 1197 - DNA, 767 bp, Unknown
  Kingdom: Bacteria, Phylum: Actinobacteria, Class: Actinobacteria, Order: Streptomycetales, Family: Streptomycetaceae, Genus: Streptomyces
cccggcgacgacactcgttccatcgactggcgcgccacagcccggcagtccacggtcgccgtacgcacctggcgacccgaacgcgaccgtggactgccgggctgtggcgcgccagtcgatggaacgagtgtcgtcgccggggacgtattcgcgcaggctgtcgaattcagtgccctcgccgcgggtgaggacactggtgcggccgtccagctcccggaggcgggccagcttcgagggcaggtgctttcggctggtgaacgggggcaggacgcggacggtccaggggactttgtgcgtgccctggcgggtgaacaggccgagagggccgtaggagcggatggtgacgcggtcggcttggcggtcgccgcggcgggtggggcgcaggcgtgtcgtgacgcggcggcgttcgccggccgggatcgtcaggcggtgacgtgatgcctcggcctccatgccgggctgccagctgctgggcggccaggcgtcacggagccggccccgcagcgggcggccggacgggtttgtgacggtgagggtgacgtcggcggtctcgcccaggcgtacggaggtgtcaccggcacgggtcaggccgaggcgtcgtaccggggcggcgagggcgtagtcgcaggcgcaggcgatggccaggggtgcgttgacggcgaggatgcctgtccagcccgcgtcccagatgccgacgggcagggagccgacggctgcgaggagggcggcgcgtccggtgagggccatcagcgggggaccgggacgtg

SEQ ID NO: 1198 - DNA, 978 bp, Unknown
  Kingdom: Bacteria, Phylum: Actinobacteria, Class: Actinobacteria, Order: Streptomycetales, Family: Streptomycetaceae, Genus: Streptomyces
  misc_feature (502)..(503): n is a, c, g, or t
gtgaggatcgccgtgatcaccgagtcggcggtgacgccttccatctccgcctcggggcgcagttgtacgcggtggcgcagggtgggcagggcgagggctttgacgtcgtcggggatgacgtagtcacggccggtcagccaggcccaggcgcgggcggtcgagaggagggccgtcgcgccgcggggcgagacgccgagggtgagggacggggattcgcgggtggcgcggcagatgtcgacgacgtaggcggcgatctcgggggagacggtcgtcttggcgatggcggcgcgggcggcgtctaggtcggcggggcccgcgacgggtcgtacgccggcggcgcgtaggtcgcgtgggttgaagcccgcggcgtgccgggtgaggacgtcgatctcgtcctgccgggagggcagggggatggtcagtttgaggaggaaacggtccagctgtgcttcgggcagggggtaggtgccctcgtactcgaccgggttctgggtggcgatgnnggtgacctggcgctcctccatcgcttccaggagggacgactgggttttcggcggggtgcggttgatctcgtcggcgaggacgaggttggtgaagaccgggccgggctggaaggagaactgtgtggtgcgggcgtcgtagacgagggagccggtgacgtcgctgggcatgaggtcgggggtgaactggacgcgtttggtgtcgagttccagggcggcggcgagggtgcggacgagcagggtcttggcgactccggggacgccttcgagcaggacgtggccgcggcagagcagggcgacgacgaggccggtcacggccgggtcctggccgaccacggccttggcgatctcggcgcgcagggcttccagggaggaccgggcggcgtccgcgtccccggtgtgcccggcgttgtcagtggtcgggtccatcatggacggcgtacctctctttcgagggcgtcgagtcggtcggcgaggg

SEQ ID NO: 1199 - DNA, 4449 bp, Unknown
  Kingdom: Bacteria, Phylum: Actinobacteria, Class: Actinobacteria, Order: Streptomycetales, Family: Streptomycetaceae, Genus: Streptomyces
cgcgggtgctgcgccgcaccgcccgggagctgggcgcgccgcgctacgaggtcgccgaggcactcgagaaggcggcgctggaggagctgcacaaccgccgtccggaccgggtgctggccaccaacgtcgagttctgggcggcgatcatgctggacttcgccgaggtgcccgcgcacatgttcacgtcgatgttcacgtgcgcccgtacggccggctggtcggcgcacatcctggagcagaagcggaccggccgcctggtgcgcccctccgcccgttacgtcggtcccggcccgcgcagcccgcgcgaggtcacggggtacgacgacatcgcgcactgatcacgtcagggcggccgtcctcaggtctcaggcttcgggccctcggacttccggtctcaggcttcaggtctcaggcttcagccgagcgcctcgtcgaggatgaccgcccactgggcgaccacgcggtcgcggcgggcggcgtcgtcggtgaggaggttggccaggcccaggccgcgggccatgtcgaggaagccctgcacggtctcgcgggtgccgggacggctctcgtcggcgccgagcaggtccacggcgatgcggtgggtctcgcggccgacgcgggcctccagttcggtgacgcgcgcgccgagctggtcctcgttggacgcggcgacccacaggtggagggcggcgcggaagagggggccggtgtagaggtcgacgagggcgcgcacgacggcgcgccggtcgccctgcgcgccctcggggaagagggcgcgcagggccgtggagcgctcctcggcgacgtactcgacggcggcggtgaacaggtcctcgcgggtggggaagtggtgctgggcggcgccgcgggagacgccggcgcgttcggcgacggcggagaccgtggagccggcccagccgtgttcggcgaggcaggcgacggccgcctggaggagccgctgccgggtggcgcggctgcggtcctgtttgggggcgcggtccgccgccgtcacgcccacggcgtgctcaccgcccgtctcacagcacccatgcggcgtcccgtcgttcgaggaaggccgtcatcccctccctggcctgggcggaggcgaacagccgggccgagagcgtggtcaggtcggccgcgtcccggtcgaaggtctccagcaccttagccgtgagcagccgtttcgtctcggccagggcctcgggggcggagcggcgcaggccgtcgagcatgggttcgagtacggcgtcgacgtcgtccccggccgccgtcagcagaccggtgcgcaccgcctcggcggcgtcgaagcgctcgccggtgaggtagtaccgggccagagcccgcgggtcggtgcgcggcagtaccgtcagcgagatcacggcgggtgcgacgccgatccgtacctccgtgaaggcgaaggtcgcccggtgcgaggcggcggcgatgtcgcaggccgcgagcagtccgaggccgcccgcgcggacgtgcccggtgacccgggcgaggaccggcttgggcagttcgacgagctgccgcaacagggcgaccagcgcgtccgggtgaggcgggtcgcgcaggtcggcgccggcgcagaaggtggtgccggtgtgggtgaggacgacggcgcgtacgccggggtccttgccgcagtcggcgagggcgtcggcgagttcggcgacgagggccgcggacagggcgttgcgggtgtccggggagtcgaggccgatggtctcgatgccgcgggtgcgggtgcggccgatgagcggggcggtggtggtcatgggcgttccctgagctgtcgccgcaggatcttgccggaggcggcccgcggcacggtgtcggtgaaggtgacgcgacggacgcgcttgtagggggcgacgcgctcggcgacgtacatcatgacctctccttcggagaggtcagctgccgcggcctggcgcaccacgtgggcgtgcgggatctcgttgccgtcctcgtcgcgggcgccgacgacggcggcgtcggcgatgcccgggtgggtgagcagcagggcctccagttcggcgggggccacctggaagcccttgtacttgatcagttccttgacgcggtcgacgacgaacagccagccgtcgccgtccacgtgtccgacgtccccggtgtgcagccagccgtcggcgtcgatcagggcggtggtggcatcgggccgcccgaggtagcccttcatgacctgggggccgcggatgaggatctcacccgcctcaccggggccgaggtccttgccggggtccgtgccactgtccttgccagtgtccgtgccggcgccgtcgagggagatgatccgcatctcggtgcccgcgatgagcctgccgacggtgccgggaggtgcctcgtgcagtgcggtgggcgggacgacatggctgccgggggacagttccgtcatgccgtaggcctggccgaccggcggcacgcccaggcgccgggagcaggcctgcgccaggcgcgcgtccaggggtgccgccgcgctgatgacgtacttcagcgacgacaggtcgtaccggtcgaccaccgggtgcttggcgagggcgagcacgatcggcggggcgacgtacaggatgccgatgcggtggttctgtacggcggcgaggaaggtgtccagttcgaagcggggcaggacgacgaccgtggcgccgttcctcaggggcgcgttcatcagtgcggtgagcccgtagatgtgaaagaacggcagcaccgcgaggatgcggtcgccggggccgacgctgatcgccggttcgagctgggcgaggttggtggcgatctgccggtgggtgagcatgacgcccttgggggtgccggtggtgcccgaggagtacggcaggacggcgacgtcccgcacggggtcgacggcgacggccggttccggcgcggtcgaggccagcatgtcgatcagcgaacggtgtccagcggcgctgtcgcagacgaggatctcctggactccgcccgcgagttcggcggccctgcgggcggagtcgagcagtggtgagacggtgacgatccagcgggccgccgagtcgcgcagttgtctggcgaactcctcgggcgtggcgagcgggtgcacggtggtgaccgtggcacccgcgcgggtggccgcgtagaaggcgagcgggaaggcgatcgtgttcgggctgtgcagggcgaggacgtcgcccttgcgcacgcctgcttcggcgagcgcggcggcggcgcgccggtggaagcggtccacctgtgcgtaggtgagggtggtgccgtccgtgccgtcgatcagcgcgggcgtgtcgccgaagccggcggcatggcccagcacggcgtcgtggatgggcagttctacggccggaacgtctgcgtacgcgctacggaacacggttcctcctcgccccgcgggcgcggggtcgtagcggctcggtgcggctcagtacgtctcggtgcgggtcagtgcgcccggtacgggtcagtgcggctcagtaggacttgggcaggcccaggctctggtgggagacgtagttgaggatcatttcccggctcaccggggcgatacgcgccacgcgcgcggccgtgatgagcgaggcgagtccgaactcgcgggtgaggccgttgccgccgagggtgtgcacggcctggtcgacggccttcacacaggcctcaccggccgcgtacttggccatgttggcggcctctccggcgccgatgtcgtcgccggcgtcgtacaggtgggccgccttctgcatcatcaggcgggcgagttccaggtcgatgtgggcctgcgcgagcgggtgggcgatggcctggtgtgcgccgatgggcgtcttccagacggagcgttcccgcgcgtactccagggcccgccccagcgcgtagcggcccatgccgatcgcgaacgcggccgtcatgatgcgctcggggttgagtccggcgaagagctggagcaggccggcgtcctcgtcaccgacgagcgcgtcggcgggcagccgtacgtcgtccaggaccagctcgaactgcttctcggccgcgttgagttccatgtcgatggggcggcgctggaagccctcggcgtccggcggcacgatgaacaggcagggcttgaggcgtccggtccgggcgtcctcggtgcggccgacgatcagcaccgcgtcggcgatgtcgacgccggagatgaacaccttgcgcccggtgagcagccagtcgtcgccttctcggcgggcggtggtggtgatgcggtgggagttggagccggcgtcgggttcggtgatgccgaaggccatcgtgcgggtgccgtcggcgatcccgggcagccaggtccgcttctgctcctcggtgccgaagcgggcgatgacggtgccgcagatggcgggcgagaccacgagcatgagcagcggtgcaccggcggcgccgagttcctccagcacgatggagagttccgcgacgccgccg

SEQ ID NO: 1200 - DNA, 1214 bp, Unknown
  Kingdom: Bacteria, Phylum: Actinobacteria, Class: Actinobacteria, Order: Streptomycetales, Family: Streptomycetaceae, Genus: Streptomyces
gcggaccgcgcgggcgagggtgctcatgccctcgtccagttcctcgggggtggtggtcagggccggcagcagcttgacgacctcgctctccggaccggaggtctcgatgagcaggcccagttcgaaggcgcgccgggcgacccgtccggcgcgctccttgtcgtggaactccaggccccacaccaggccgcggccccggtactccttgacgtcggcgaggttctcctcggtgagggagaccagccactgctcgacgcgttcaccgcgggtccgggtctgcttctccatcgccgcgccgtccgtccagtacgcctccagggcggcggtggcggtgacgaacgccgggttgttgccgcggaaggtgccgttgtgctcgccgggctcccagacgtccagctcgggccggaacaggcacagcgacatcggcaggccgtagccgctgatggacttggacacggtgacgatgtccgggacgatgccggcctcctcgaaggagaagaaggcgccggtgcgtccgcagcccatctggatgtcgtcgacgatcagcagcatgtcctgccgctcgcacagctccttgagggcgcgcagccactcgggccgggcgacgttgatgccgccctcgccctgcacggtctccacgatcacggcggccggcttgttgagcccggagccctggtcctcgagcagccgctcgaaccacaggaagtccgggacctgcccgtcgaagtagttgtcgaacggcatgggcgtgccgtgcaccagcgggatgccggcgccggcccgtttgaaggcgttgccggtcaccgccagcgagcccagcgacatcccgtggaaggcgttggtgaacgacacgatggcctcgcgccccttcaccttccgcgccagcttcagcgcggactccacggcgttggtgccggtcgggcccgggaacatcaccttgtacggcaggtcgcgcgggcgcagcaccaggttctggaaggtctccaggaagcggcgcttggcggcggtggacatgtcgagcccgtgggtgatgccgtcgcgttcgaggtagtcgatcaacgcccgtttcagcacggggttgttgtgtccgtagttgagtgagccggcaccggcgaagaagtcgaggtactcgtggccgtcctcgtcatggatgcggctgccgcgcgcgtggcccacagacggtcgaccacgcgcgcggcagccgcatccatgac

SEQ ID NO: 1201 - DNA, 786 bp, Unknown
  Kingdom: Bacteria, Phylum: Actinobacteria, Class: Actinobacteria, Order: Streptomycetales, Family: Streptomycetaceae, Genus: Streptomyces
cctggcggccggcgcggcgagcgtcgccgccggccggctcgccagcgacgccgcgctcaagtcagccccgggccggcccctgcccaccgagccccggctcaccgtgcacagcacggccgccgggcagatcaccctcacccgggacctggcctcgctgcgccccggcacctacggcctggcgggcgacggctcccacgcggtcgtcgggcccgtccttcagggcgccccgcacctgcccgacaccgtcgtacgccgcctggaacgcgtcacccacggcctgctccacccccgcgaccgggtctggctcacgcccaacctctatgtcggcgaccccggctccgccctcggcctcgaccacgccgacatcgacgtacccggcgaactcggcccgctgcccgcctggttcgtgcccggcgtccgcgagacctgggtgatcaccgtgcacgggctggggaccacccgcgagcacccgctgaacatcatggagttcctgcaccgcaggcacttcccggtcctggacgtcgcctaccgcggagacctcggcgcaccccgcccgccggacggcctgagccacctcggcgagaccgagtggcgcgacctcgacgcggcgatccggtacgccgtggagcacggtgccgagcgcgtcgtcctgcacggctggtccaccggcgccacgatggcgctgcgcgccgccgtccactcgcagctgcgcgaccggatctccgggctgatcctcgactcgcccgtactcgactgggaggcgacgctgcgcgccctggccagggc
